United States Patent 9,328,346 (POLYCOMB-ASSOCIATED NON-CODING RNAS) - sequence listing, part 48

SEQ ID NO: 8707 - RNA, 28657 nt, Mus musculus
guucauguagguucaguuguucuuuuaaucggccaugacacauggaugacauuccuaggauguaagccuaggaacucugcuauaacagguaacagaugaguggauucccagugacaacccuucaagguuuacagaggcugccauucucuggguccuccuaugauggggacuucuagcugcacuuuaguguaugcuaaagcccuacacuagugacaaaaaaaucugucccuaccucccuacaggaguccugucucuaaacacuaucccucagguaugaggccuuaccauuuguuuguuuguuuguuuguuuucaagacaggguuucucuguauagccuuggcugcccuggaacucacuuuguagaccaggcuggccucgaacucagaaauucaccugccucugcuucccaagugcugggauuaaaggcgugggccaccacugcuuggagaagccuuaccauuucaaucugaggaagauucaagaauggaauucuuuugagcuguaagcggcacaagaacugugaaaaagaaguccucuucuauggcuccucucaguuugcaagcaguaugcaaccaguguauugccuaaauggcaagggcacugccccugagguugcugaagcucacacaagggacagccacaguugaauauaaaggagcuggacucuuaacugggguucuccuucaugggacagcagaaaaaaaugaaaaacacggagacacuuuugcccaaugacaugucuucagguagauguucugagcacagaguccugaacagccauggacaggaucaaugccucuuaguuuaugaggaaaaguagaaggagaaaaaauugugggacacagaaaggucuauggccaggguccaagucuuugugaugguccuucagaaaagucaaaauucaugucagcucuuucaauauuauguauguccuaguuuuuucucaaaacucucuucugcacagauggugugugugucauacugcagugggucaggcaaugaugcuugaaacggggacaucggugccugagaugggagucaaaggccaagaaaagcuaacugucuccagaaagggcagaggcaggugggucucaccucagaacaggcagaaagcugcugcuagcacagccuccugaagccaggcggaaaguugaaccugagcagggaauaaggugucucgggccagguuccuucaggauguucugcuggcuuuucuaugcaaguugaacacuagaguccacugccucuggaaggcugggguacacuuggcagucugcauaugguuucuaucuucuuaggccaaauacaaaggccaggucaagcaggguaugagacgcuuauaccagacuugggugugacuucucucgaugaaacugcagagagaaaaaggcugugagaagccccauuucaagccagggaggucuggggcacagggacaaaaccuaaccuuccgcacagcagcaaaugcaggcccaaagguagcuuugaccuccacucggucucguauccaggcuggcagcuucgccagaauagaaggacgcgcauaccggugauccaggagcacaaugcuggcaaagucccucuggugccuaauggcccugccuggguagaugcacaagucgagacucuugaguucaacucaccuaccaauacugcaugugcauaggggacuccuccuucacugaccccucaaauggacaauacaguacuaacaucccucccgccucaaaacauccaucugcacccagcagcagccccacacuuaccuauggauugguuuauagccuucauacacagauucucuaucaauaccgucccuggcaggggcugaccuuguguccuaggcugagaaggaaacagaagaggaaagauuagaaucuacuuuugccugccuuguaguccaggcuuuggagcaaggucagguugcaugucuggucaacagcuugugcuauauaguucaugcaguagagaagaucaagugggcuagagguauacuccaaaaccucuagagaggaaagcaaccauuuguacaacaggucauacugcagggccuugucauccaguccuaggggguggcacaccgcuuccucccuuuagcccucugaaacacgacagguacucacaagugucugauucaaguaggccaucuucucuugcagcucuggagacuuaauguugggauauggcauccccaccaucaccacacaccuguagugggucacacacacggccuaaagcaucaagucagcaugcagcuaucacugauauuuagaacaaguuacaugugguuucauggccuuuuaggguguaugugccuauacacaugcguguggaggccagaggaagaugucagguguugucccuccgacacucuucaccuuuuucucugagacaugguuuuucacuaaaucugaaguucacacaauccuaggguccaugagcagaacuacccaggggccugucaucucugacacacagugcuuacugguaaauacaaccaugcaggcuugugugugugugugugugugugugugugugugugugugugugcugcaaaguuguugcugugucuucugagcaugcauccucacucacugauccaugccccaucccuccuaccacuuuuauggcccucggguucuugccauggagguauaauuuuuagcucagagaucuaaccuaggcagaagaccaggauccuaagcaagucacggcuccuacuucucuggucuacacagccagauugacaguaaugucaaauaauccacccacagccuacagaccccaagcaggccauaugggugcugacccuauggcaugcaugccuugagccccagcagacaaagaggacaccacaccuaccggcccaggucaucagagaaauugaucccuucacucaucuucccuccaaccacagagaggagcaaggccccugucagauggccuucugagugacugcagcucugucaggggacaaucacaccaggguuccugagccaaaucuaugagucauacgacuguucccagcugacagacacugguggucucuggagccagccucacuuccaccucucaccauaaugcacuuggaauacgccaucagcaccugcuccaccuggcucgcucuuuugggcucuugaaauaucugaggguagaagacaaggucucccagcaaaaggcuucacaacacugauucgugagcccagucuggguuuggaagcauguggauggaacauguagucaagcuacagggaauccccguggcuugugucccaggccuccucuugguagaugccaaguuaacaagguugagggacccuaggaagagcuacaaguagcaauguccucauaaacaggcuaaggggcacucaccuuuuuccugacagacaaacgugucagcaggccagucuugucccagugagcauguaccuggcgcagguacucauaagaagggagaaagcauaccacaccuccagggaccacauugcacaaguuacagagaaugcggccugucuccuccaccugcagaaagcaaagagcuagccuagagcgggucccacagccacacaggacggaagccgagcagcuccccaugguaucaugcaaugugcucacuacuuuuaacagacaugcccaacuggggcuuguggugccuccuuacauuaugccacaucccaucccuggcaucccacagaagaaaacccagacucugggcgugccacugacaucucccuaugucccuguuucacgagggacaacaaucagaacaaacuggcacugagaugccacaggaguugugccccagaaacaugucuucccagaauagaggcaaggagcaagaacccccaaacuggucagccuucccccacccugcauccucaugggaugauaggagcucuuuagaaagcauuuagcaacacacggugaggaaggcaguuaagaucuuccuugacagauaucuaaaggaagaaaaugacuccacucaugucccagaugugaccauccgucuccaugccaacgcugguaguacucucuaccuggucacaggccagagaggacaggaaguggguuaguacuaaccaucugaggcagcucucuucucugguaggugaauuccagcugcugguuagagggcccacugcauauaauaaggggcaagauguugucuggagggaucacgugaccuggcgauaucaaaggaaggcugaaaacuagggugcagguagggcaguuucucaaaucauuucuccaacuaggagcaacaauuuuaaaugcacuuagcucuucacugcacugacacaacuaguguaaacaauauggugagcagagcucaggaccugagucuagggaagugugcuggagcaagcccacuaagguaccaaugaagugguguccucuaccuuugccccaucuacccaccacacaguuggcuuaccacaggaaaacuccaccacucgccccgcuucuacuccagaacaugccagcagcugcucccgaaagucagacaucugcagcaauaacaucagggccuugugaccucagagccugggguugugugcucuuguagugaauguaagagaagucugggauaagaggcaaacccagucaacaaaaaggaacagccggcuaaugacccaagcuaaaagaaaacaaccgguauccaguguggacagaaaacuuagagaagagcagugacggaagugucaggucuuucuacauguucaaaucaagaagagggaggaacacuaccuacaauacacaaagaacuggacaaaucaaacaaaucaaacaaugcagucaggaaacagaguaacaaaacgaacagcccucaacacaggaaaaaaaauggccaauaaacauaugaagaaaugcucccucuuaccagccaccggagaaaugaaaaccaaagcuacguucagacuccugccuuaucccaacagaaugacagucaaggcuuagaaaucuucaggaagaggggaacauggauuaugagagccacagguggaagauaacaucaagggaaauguuucaggacacaucagggcaggugacugugacagaugaaauccagagcaaacucaaggcagucagaacuccagcauggaggugggaugguggggacaaagucccaucacuaacugaggaacuacuagacccugacaacugcugcaagggggaaagccagucuucuuuaaugaugugagccucuaguaaguugaucacauaaacacagaaagaacucacuagagacugacugggcaacacagaaugggcugauggagagaggagcugagggagaggugaguuuguucaaaacacaucagaucaaugucucaaacaauaggaauagaguuuaaauggcaagaaaagagaacaaagaauucuggcaaggauguggacaacaggccugagacauggcugaugggaaugugagcuggucuagccaccguggaagucaguaugcagccuucccaaaacaaaacacacugaaaaugcaucuuccauaugugcagcugaauaagaaaaugaaauaaaaggaggagggcauggcaaggauucuugcuguagauauaagggagaaagcaggcugagggaagaguccaggcugaacauggccagcugacuaaagcggacugugagaggggagacuggacggagagcaggagaggagcgggggcuaagacgagugaguuauacaggauucaagcuggggagaagggaaaaggaagccuagcugcuagaaggaagaguuugaggguaguggcaggguggaguacugggaggaaucacagguacuaaaggauucaagagcuagcacuuugauguguuaacagccauuuaaccauuugucucgggauucugagaccuaacaccagcucuacuacuccagaauacugagccaaaggccuccaacauaaucacagaaguauuccacaucagggcucaccgcuguauugaacaccaacccaauuaguaaaauaaacaagauauccaucaacagaggcuuggacaaaaaaaaaauaaauaaaaugugguauacaagacauguuuuguuuuacugggcagugauggcacaugccuuuaaucccaccacuugggaggcagagacaaacggaugucuugaguacaaggccagccuguucuacagagcaaguuccaggacaggcagggcuacacagagaagccugucucaggagagagagggaaggaggcaaaugaggaagaucacauuaugugaauuaagcuagcugcaguccuagauucuauacauggcaucgucacacacagauggcacagucgacgugcuguugucuaagggaacaacgggaggaaaaggaaggaaauagggaggagggugaaauacuaggauacacucaacauuuauacauagacaaaaucuuuaauaaaaaaacuugaggccuggacagauggcuccaugguuaagaaccuucauggcuucugcagaggaccuggguuuggcuccuagcagccacacggugacuaaaaagagucuguaaagccaggcaaggccacucauuacaacuacauaguaagagcugggcaugcugguguuuauaccuuuaaucucagcacuugagaggcagaggcagacgauucucuugugaguuugagggcaaauucuaggacagcaaggaccuuguaaagagacugucucaaaacaaacacacacacauacacaaagacuacauaguagugagacucccauuucaaaaacaaacaaagcaacaaacagaacaauaauggucaugcaccauguuaacaccaaaugaauacacacaaauccaaaucaaaaacuaaacaaauaucuacaugggcuuggaaugugccuugacagucaaauguuugccuggcacauacaugguucucagguccauccacuguaauacagagaacacaacagaaaagucaaaaaaaaaaaaaaauucuaguauccguucuagcagguggccaaggcuggaauccaugcuuaggagcccaacagucuagaccauaaaaugcucucaagaugaaacaaggaaacaaccuuugaucacagaauugagaaaacuagagacaaugggaaaagaguguaaguauccaacaaagcaggacuggggugagcagcacacugguggaauaugacauguguguggugaaaugucacacaggucacauuuaaacgcaucacagagugugcuagaauaaacauuugcucacaagaauaaacaaacaucuguacagagaaaaaaaggaaauuauaccaauaauguagaaguguaguuuuaaaaacgauguacauaaauaugcaauaguacaccaucauugacccuugguucauagaauucugauguuaaagcuugucuuugacuuuuauauacuaaaacuaacuuuucuuuuuuuaaaaaaaagauuuauuuauuauauguaauuacaccauagcugucuucagaagagggugucagaucucauuacagaugguugugagccaccaugugguugcugggauuugaacucaggaccuucagaauagcagucagugcucuuaacugcugagccaucucuccagcccuaaaacuuaacuuuucaaaaaccauacagguaaugacuuuccaggagaugcugguacagggauggaaugagagaacagcaucuccaugacugccugggacuacagaagagcauuuucucagagaagccagcuccagcagcugcagaaacacaauagccacaggacuaccaccccaccagucuaaaaggcaagggcagugaaauggcaguggccccugguaggcacugcugagccugcaugcgcuggccuauuuguguuuagggacccagaagacagagaagagagacugauguguguccuucccugguaccuuaccggcugcauggugccaccugcaaugaccacugcucggcauuccuucaccaccugggcaaagugcacagcuggguucaagaguaagaauuuaaggcugcucugacccacacugccugaaagacagacaaauggcaaaggaauagagcugauuaggccugagaaacccagaugaccuguggaggccagugagcuaccauccucccucuaaaagaaaagcauuucccuugccauugguaccacagacuauguggaaacucaggugcaaagauagucuggccaguggcacauaacccucagacaacagaacaaagauacaguccaaccccauucuaaccacaaccaugagauucuagcuucuguagggcccuugccugagagaacucagcaccucugaaacccagucucccgguccauugguggcuccagccuaggaggcaugugguuccuucacauacagaaucaggcaguaugauagagcccuuucaagcuaggccccuuggcuacaagcaguggauuaccuuggcgguucacaauaacccugccauccugauuggcuguggugagagcugccaggaaggccucgaugugcaucaguggagaggcaggccgcagggcuacagccuggcccuccuccggggagucugcagaagacgguaggaugggaaagagggccuuccuuagaucgaguccaugcucgcucaaagggccugugucuggcucucaucgcucacccucccagcucacccucaguaggcccugacugcaggcucuucaggaacugcuggaagccagccagaccucgguuuuccugagagucugagagggauggaagaaccacuccgaaacauucugugaagccaaagagcugugucggggacaagagaacagacaaaaaugagaagaaacucuggaucagacacccaagccagcccacagcccauuuccucccaagccaggaaucacuccacacuauggacagugcaaucagaagccaagaauccucgggcagcggaguaaggcagcagggguucccuggcuccuugcuuaagcaacgggaaagguaccuuccugcugagcaugcucuucuccaaguaccgcugcaccugcagaaccaugacagacugugagaaggaagcaaacugggggcuaaauucagacggccaccccacaccacugaaggaauauggcucacugcccccucagaggaacccaaagccacguaacaaaggaugaggcaguggaccacgagagguagccuggucuugguugagcuaaaggcuuugaauuaccacagacccugaagggacgcuaggagcuuugccuggcaccaggccccugucacuagcugaagcucucgauagaucuaucaaaucuagauaaucuagauuuaauaacguucucagcucuuccuugguucccaucuagauuuaauuuagauuguggagaccucaaaccacagccucaccacagauguucccacucuucgggucaccugaagggaguucaagacaagaucucaaggaugaaaagguuggcucagcugugagagcacuggcuguucuccuagaaaaccugggaccuacaugauggcucacaaccaucuguaauuccacuucagcacaucucccuucuuaugaccucuuugggcaccaggcaugcauacaugugguguucagacaugcauucaggcaaaaaaauaauaauaauaauuuuuuuaaaaaggcacuagcugcaugcugcuuccuuccacgugcccauaugcagacugggccuugaagaagagguaaguuaaaaacaauuccaagggcgauaaagacggcucacaagcuugccacacaagcacaaaaaccagaguuggaauacucagagaacaccaaaaagccagacucagcacuaagucuauagccacaaugcucuuacugagaaaugagaugcagagacaagaaacaccccagaagccugagaaccaggcacacacaguggcaaaacaaucaagagacccuaucucaaacaggguaaaaagcaaggacuaacauggguacuuguccucuagccugacaaacacuguggcauaggcacaccugaauucaaaacaagaaugugugcuggcauacacauuaaaaagacaaaucuuuaaaaacuaaagacaaacaaccaaaaaaccaaaaaucaaaaccauucuaggccagccuggucuacagauugaauuccaggauggccagggcuagauagugacauccuaucuugaaacaucaaaaacccaaaauaacagaaaacaaaaaagcccaauccuuuccaucaaggcagaaaggaaaugcgccgguccagggaagguccagaugcagucucccucggugcucagucagcuuggugccucaccucagcucagcucacaauguagcaugagagucuguggaauuagacagacugcuaccaagccuggcaucggaugaagaaagcuucagucagccuuuacagagugaaagggggagguuugaggcaagcuggagaaagaagccuaccacaagggucauagcugaaguaaccaagaacuacggggaaugacaacuguucagagcuuaacaaaagcagagaaagguaccaaagaugaccaauaggaucacaguaaugacgauggccgaagguuaguuuaagggacgcugauuugaaaacuggaaggcacucagggagagagcaggaucuaggaugggucuagcuggguuucaacacuggccccauccagccacccuugguucaccugaguguagcuugagccagucacucuccagagcagguagucugagccuguuuuccuguucuuuuguuuguuuuuuguuucaggguuucucuguguagcccuggcuguagaccaggcugaccagaaacacagagauccccccgcuucagccuccugagugcugggauuaaagguaugcaccacuauacugcccagcagguuuccuguucuuuuuuuuuuuuuuuagauuuauuuauuuuauguauaugaguacacuguagcuguacagaugguugugagccuucaugugguuguugagaauugaauuucuuuuuuuuuuuuaaagauuuauuuauuauauguaaauacacuguagcugucuucagacacaccagaagagggcaucaggucucauuacaggugguugugagccaccaugugguugcugggauuugaacucaggaccuuuggaagagaaguuagugcucuuaaccacugagccaucucuccaggcccagguuuccuguucuuaaguggccauaguauguccuggcagugugcucagaacaaagggacaguauccauggaggcuuaauuuagacacacugggcugugguauaauggccuaacaccugugggagcaccagauuucaaaggcuaacagaagcaaaggucugugugugccaucccacccaaggcuccagcaggaagacuggcugggugguccuagccacgcuguccugcucgccucauacggcacaccaugguuuauacgcugaaaacaauucccuggagaaagacuggcagaacauagauggauagggaagaggcggcuguguuuaucccaagggacgcaaagcgcaggcucccuuuaccaaccccaacgcccuggcacaaccauuuggcugcugcuauccggguuaaagaccugguaacugccucauccugacuuagauccuuggguguuagacuacucaaggacagugauuuacaccuuauugcuucuaggucuacuugauuaggugcuagaggcagaacccagcaggcaagugcacaacagcuggccuccuccccuaccucuccuuucagugccuuaagucagucaaaagguguuuaaaucagaauaggccuuuaccuugaagagguugauguuguccaccuggcucugaaagagaaagucguugaugcucuucagcucagacccugugagcagacaaaggacgcugguuuuguaccuuaccaaguccucucagcccaguucuaucugguaagcucuggguggcucacaccaccucccacccuugacagcaaccuccucaccuguuugagacaggcucuguguaguaggauuuugcuuaacauuaccuaaaaaagggaauuccauugggucacaguggcagcucucugcccacagcugaguuauaauuguccuagcuucaugaacuacaaggaacauucauguuucagagacaucuguuugggggcauuuauagcaaacaaaggacacacuaaaaagacaggaggugacaggaacccaaggccaggcaggagacaugaucagagcagucuccccacugucacuaagcuggacaagggagaaaaacaggaucugccagaagauggcgggcuguggcacaggcagagacggaaguggaaaguacuaacgugggacaacagcuugcuagaaaagccuccaccaacuuucuggaauauagaacucuggagucaacagccuccaggcucaugagcaacaggcaggucccaccuugagcuuugguuuucccucugagaauguaguuuaaagcuccuggacuucucuucugccagagugucuuagccaguacaccacagggcuguaacuaugccacacaacaucaugucuugcuuuacacuguaugauugcauaaccgugccaucuuaaagugaaaaggcuaaggucucaaccaagauagaaacuaggauucccuaaggaaugaccaggauagugcuuaaaagcauaaaacacccaaguguccucacuagcauucaaggaauaagaccaacacaaguggcagcgccaggggauggugccccuaccucccaaaacagccacaaacuucuccagcaaguacaggaucugcuugauguacaucaaguucuuggccuuuaaacgcuuccugaggaagaagcaacaagagcagaugguagcauucuccaggaacucccuccaccggaugccacuggaccuuucuaccuagggccugacacacugggcugugagcuauaaacccuccagcagagaccaagguuuucagcacccacugcucuaucccaaaaagucuaggauguagagggcauauaccaggccagaccaauucaacccauuccuccaagacuuugacacuagcaguaaccucuuccauuugugcucuggcaggcuaacguggaagccauagaggcugagccuggccuagaccuugggccucagguaguuucuuaccuguaucuuuccauguacuggagcaacugggaaugggccuggcagagcuggagagaaaacagaacagccugaaggcagcccaggauaggauucagaggaucucuguagagaucuaggaaaugccagcccaggacacacgggugccaucaaggugaugggcaucuggauaguaacagacaaaggcaaaaaaacaaaacaaaacaaagcacguacaggcuggccauggggcugaugagagcugagaaggcaagggaagagccggaggccuaagguccuaaauugcacaggaggacugaccugggagguggcugauaucacacaggucucccggucagaagccaguggucauuauccuggcucaccucgauuugcaguguggguuuaagacucacagcuuugcccuccaugaaucccaaagcucccaaaauaaagcagggaacuccuaccccaagagaaaagcaugagacacacagaaccccuuucaaugcucgccacauaccagaggaaaguaaacaggagccugcggaaggaagcccugagcauuccuccaugaaaggcccccaaagcaauccugggagacuacuggucccugaugcuacuaccccuacuaacagaacuagugagcagcacccuggaugaagcagagcucaagacaaaagcagucacccucuucaagcuggcucccaagaaccucacucuaccaaugaagaagaaaagacaaggguuucaguucaguucacccucuaccaaggcccacauccagaagacuuccugauccaggcauuuaaaggaaugaccuaugucacucugcccaauacaggagaggcugacccaccugggaaccauugaccucugugcuguggauguuggugauggugucgaucagguugugagccucgucaauaaugaccaccugaccuuguagccggauucccgcagccugucggguagcugcaugcagcaacauuggguaggguagcaccacuagcugcaggaaaaggugacaguuggauagagaagcaaccugacuucacagagcagaaggcuuauccugcaguaaacucuccaggccacuuaaguccuaguggcauuguuuauuuucuuacucagaccuugcggauggggggaggacucaagccagaaugccgcaguucaguauucugccuguuccaacagcccuuucagagguuuucugugggauaucaaccaugaggaauaaaauuggagcugaucacccgggaaggggaggacuggagucccuggaggugaccugaauccucaagcuccaaaguucuucaacugacaaucaccaagcagcagaaggcaaccuagccucuggcccuagggcugcucucucagcucugugauucuggcauagucucauuuaaauggcccuuggucuuucaucagcuaagggaaucugacagaacaugucaaugagggcugaguauaaaauuaacuuuguagguuuacgcugcuaugaagauuuucccaacaaacaagugagggagaucacucaggcaguaaaguguuuuccuugaaagcaauggcuaaguuugagucacaaaccaauggggaaaaggcgaggaauauuguuacccacucaagaucgcagcaucagggaugcacagacaggcucacuugccagcuagcuuugccacacccaaagcuguucucuggccugcacacaggcaggcacacauuugcgcaugcgcacacacauacaauaugaaaaccaggugccaauauggguaccaucauuuaagacagugagagaagggaagagaauccuguguucucauguagaaaugcagcuauuucagugggcuguuauaaaggaaaaugagguggaaacagccuccacaugucaagaacacaccaaucucagauuuucuauauggugacagcacuagcucacgcagacaucuggagacaagggggagucccucaguuugucugugacccacacacagcagggacaaccaugaguaagcacugcacugagcaauaugauuaccaagagugcucucuugaaauccauuuaagucucuggaugacacagaucucccaaugagugacaguuucaaggaggggagcaagauagcaugaaaugacccacagugaacagcaaggggcuguggaaggaaaucggcuuuccucucuguauaaagguaaggcaggucuaaccaggacaguauugccaugagcuggcuggcaggcggguaaaugagcaguccaccugaaaagccauuuggcuacuuucaaguucugcacucggcuccuacgcaacacccugucagugugguuccuuaggcugaacgacacucuucuuggaugccuaugggcugaacacucaauaaugcuagccggccucuugcccaaagccacuggggcucccuggccucuucaaacucuaugcucuggauaagauagcuuugugccauggggaugagaugcagagcaguugucaugcuacucuagguaggggcacccuccucccaugaagagggaugaggaaagccgccuuccauuagccccaauuaacacuuggaccacuucccccuuccccagcacacucaccugggcugcagggauggcaaagcggcuuccguaauaggggcaggcccgggccuccuucccaagggccacaaguuguuccauguccuucacuuccagcagaaucucaucccggagaagcuccaucugcucgugguuguagaaggggcaagaggucuggaucuucugucucuuucucuuuggcuugucuuccccagucccguucuuuucuguggugguacagaugggggaaagcaaagggcaggaaggggcucagcuacauccggggucaggaggagguacaaugauguagaaacacauccauucacuugggcagggaaccgcugcuuacuguggacucaucacaacacgcugggauccagaaggagauggcacaaacauguccaagccaggucccugaccccagacccugacccagaaagcacucucgcccauggagaggcuugaggcagaagccaaggccugcuuagccguucuuucugguuaacucagucaucaugccauggccccgcugcagaccccaccacauugccgccacuuccacgcugcccggcagcacaccucacuacacagggucccuguacacaccgcguuugcuucuuugcauguccacacagcggucauucauaaguugcacagaacccagguuuuucacaucuucauucacacaaagggucuguaaggcaggagaagaggaaagcagcggcuuucguuuacccugggaaaaccucuaccaccaagcuuacccucagucaauucuaaauagugccucaucuugaccuuugcuuacagaauggaccauuaauauaaaaucugacacuaaacugcucuaaugccuuccagaaggaaguuuuuguuugugccugagcuauaccacacaaaaccccucaccucugccgagacugaaccuguucucgucagcaugaugaccuacugugugucagucaguggugauuacuuguuuacguuuguggguauucugucugcaugucugacugcgcaccaugugcaugucugguccaugcaccgggaggccagaagaaagcauaagaugcccuggaacuagaguuauagguggcugugagcugccauguagaugcuagaaauugaaccuagguccucugaagagcagagcagccaguguucuuagccacugcgccaucuuuccagcccaaguuuauauuuuuuuugaagcaaguuucuucaaaguccauuuguguaugaguuuuuuuggguuuguuguuguuuuguguuuguuuguuuugagaaagggucucacuauguagaccaggcuagccucaaacugaaaagauucgccugccucuguaucccaugugcuggaauuaaaggcgugugccaccacacugacuaaaaugaaacuguuuuaaugugcugauauucuguuucuuucccaaccaaaggaugaguguucuguguuuuuuuuguuuuuuguuuuuuucuucaggaaaccucugcaauuuauugaauaaaauauacuguccuuuguuguggucucugggccuggaugagagaaaaagaaaccacaggaauacaguuucuuuuuugagauugaaauacauuucuuuuucuccuucccuuucuuccuuccaaacacuccuugcugucuuucaaguucacaaucucuuuuuuuuucauugauauguguauccacacauauauaugugcauacauauuaucuuccuaauuacagccugcucagucuauagaacguuacuuguaguauguugucaggacugaucaucuggucuuggauaagcaauggugugcucuuccuuggggaagacuauuucucccacucucagcauuucuuaguucagcugaacaucuuugauauugaacaccgacaggugucuuuaaagauaaagaacauaaaugaugcugucugaaggcuauaagaaggauccacgggggacuggugagauggcucaguggguaagagcacccgacugcucuuccgaagguccggaguucaaaucccagcaaccacaugguggcucacaaccaucuguaacaagaucugaugcccucuucuggagugucugaagacagcuacaauguacuuacauauaauaaauaaauaaaucuuuaaaaaaaaaaaaaaaaaaaaaaagaaggauccacggcccagucugcaucuccugcacccuuuaaagaauaaucagccaacaaaggagcgcuguucccauggccacuuugccuucaccaaccucuguuuaugccuaggccaagagacaagacacuggaggaggaaucugucuggacaagaacgccuccuuuugcuuaccugccuagagccaagugagacuagccgggucuccuugccaaaagggcucuucaguacuucccgcacaaacugggccagcugugaguguguccgacugcaguaauaaaucugaucagaggaaaguaaagggauucaaagagggagucuuacuaguccacauuggccugagcgccugcaggaggaaggagggugguuacaaaugcauacuccugagaugacagaaagucagcucugguuacaccugaugagggccuagcagugccuaggauccaagucucccacaacuuaaacagccucaagucuccuaggagaccuaggagaccuuggaaaagugaguuuccccacagugcuaaaucuggauguggcaauuauccucaacucucuggagagcaugcguggaagguuacucucuacacauacccuaaaaggaaagguuggggcccagggugcacauucugacugcucuaggauucagcagacuuaagacaggagaacaaagcacagggacuuugcacagaaaagauacagcucagauaaaaccacagacuuaaccuggagaggugccacggcacacauagcucacugcacuccauguaugucaaacacaagcaagaagagaaccaugccacgagaguccaagagugaggacucaacacuugcuugcuccuaccuugcccuuaccacugcccacuggagagggagacccugugaguccuuggcccaguauggcuguucuuccaaggccucccuuagaagccuagacagucaagggagcaacaagaagccaugcucuucauuugggaagcacacaccucagaggcuagggacucuucaacuccaagaggcugagaaaguguuaaaacaaagaguccuagcccuagagucuucccugucuucccucuagaagccucugagaagugggcaacuuaccuugguuauauguucuuccuccaagucauccucagccucguccacccuaggagacagacaaacauggaggugagucuucacuaaauaccucaaagugccgacaugugcucugggcucucacugacaagcagacgggcggcccuuuccucagaagucaacagggcugaggggcaagcuccgaauacaacacagacaugacccaguaaacugccaagcccugcuccucaggacaccucacauaagcucuauagcugccuucacugcugcucaagucugugaaaccuagaaaacacggagggaaaaaauggaaagaccuggaguucuuuuuuucuuuuuaaagaccuauuuauguauuuugcacauauggguacuaucuggauguugcugggaacugaauuuaggaccuuugggaaaguagugagugcucguaagcacugagccaucucuccagccccagaccugcaguucuuaaagccaccucacauacuggaagccaagaugugaucucugacacaacagccucacagaccacucugcuauaaaauggacuccucuggguucuccagagaacuacugaguccugcauggucauggaagggacugcaugauaugauugauucucaccccuggaauagagccagcaaggugugggccuccacaagcauugacaguugcuaggcaugagguuuguuuguauaaaaaaauauauacauuuuacuucauguuccuccuuugggaauauucuuccugccaaaguaaugaagaaguggauguucucccccgggaguugaguacuccacuauaauuagaagcagcucaaguccagaaugugagggugugucuaaugucagcaaaaugguaaaugcugaaacccuuaaggcugugggaaagaacucugaaaacaugaauucaaaaauauauaauuucucaacuauuuaaaauauaagaaugcaaaauacuuguauaaagaguuucaugggccuaaaagaacagagacagcuugucagauauuaaggaaggagauagagacuuagguaguggugaacacagggcaagaucccacccaacuagcuuauuauuuucuaccgccuaacccccaacucccaaauuauguaagccuugagucacccccaaguaaaguugaucugccucccuccaguugucccagggugucuuuuucacccuauguacugaaagggcuucuaaacccgcacccccccacucccuaccccaccugucaucucugcucccacugcccucauaggccauugcccauacgggccgauauugguugacaauccccaaagccagggagaaucgcaaauggcuacacaccuuaaugcuugaaggacuuuccuaguacuggaaauguaacucucuggcuuaauuaauccuccccccugcauccuguugugacauccauccaguauucacuccgccuauagagaccuggaccugcuucaacccuaggucuucugucucuuccucucuuuguucugauacuucccucaugcacacacucuccccacuuuuggcccagugaguuuaugggugccuaacccucaggccucagcaggccucaccuccgaaugacuucagacacuacugcuguacuacuccacuuuccucaaagcaaacacgcccguuucaaacuagcacugugcuuauuuaccgccguucucccagucuagaaauguaugcucuucauggacagugcuacacccagcccaccucaacuggcuaaucagaguucccacacagguccccagcagggaagaaagaagucugcucuauuccccuaaaggccaagucaaguccugcaccucacccugacaccaguaucuauggccacugugccuauccagcaugaaacucuagauggcagcacuugggccaccagacuuccuugccccacuagaauuaaggugggaaugagaauaagagggccuucugaggagcuguguggugcagcaaugaucaagucccucccuucugucugggugucuugggccacucacaagugcggcucguaaaauaagagccuucugcucaccuggaccagaaaccuuaaaacaaugucaaacugugaguccgggacucucugacaguuaggaucaugcauucuacacaugcuuacguuacugguggagaauacagaauccagaaccagguggacuacauccaggcccagcucucuccuccacucaugagcccacagcaaugacccagacauagcaccugaccaauccauagccuccaggauuccaucacugaacuauaguggggaaaacuaacucaacacauacaugggacugucacagaauaaagggucaaccgugguugucaccagcauuuaugaccgcaggcucucacgagugcuccggccucucgggcugaaggcugcagauagacagguagccacucucaccugcugccucuucucuccucaucacucucauauucugccagaaccaggugcuccuccccacacuccagcugcuccagcugcucugguccugucccugcauccagcaucucccugcugaggcgcaggagagccucagucuccucuuccucauguuucuggguaggaacaaagauacaaagagaagccucacacuggagcccccagccgacuccaugacagaccuggcccagcacaguggggguccugccgcuccggucugucacuucaaucggccuuccagaugcucaccgugcgcuuggcugcaaaccugagccucccauccuggcagaccuccuucagucgcuccucucgcuuccuccuccucaccugcuccuccugaaggacagggacagcagaaagagacaaaccuacugagggagcccccucacagggugcaacacccuccauucucucugccccacugcucagugcaacggggcuacauccucucuuucucuaaggcauacaauaaaaaccauucuucaacucuguccuuucccaggugaaugaaaaauggaaaagguuugcaucaaaaagagacagcaaucucauugcaaguucacccaagggcugagaggcaccaccaaaaaauauauauauuauuauuauuacugcuaagucuuguaauaaguugaaaauaaucaaugaaauguguuuccugaucauucccuuucucagccccucagaucucacccuuagccucuccaccaggucccuuucuucuuucuucugcacaaauucggugacccagucaggcucuccagcaggccucgggguguccguagguucuuggcaagaugaggaagucaggagcgaguucuucucacuacuuggagggccggauccaggugcaaggagaagagccucugcuugcaauuucuucuuuucaaagucacgcagccaggaaagggccccacaaaucagacuuaaggacuuucccugcaggaauaaaaaaaugaccucaaaccaggccagaagcaaagcuucccagaugacuuucccauuuaauaaagauaucaaagaaacccuaguucuaaaauugaggaugcucuaagacaaucuagaauggaaaggaauuaguagucaccagaaacaagaaaaggaagguauauagcuugguaccaagcaguaaugagcuguucuuaagccauacagcuccauguuccaaaagaauuugugggguuuuuuuuuuuuuucaauuuacaaauacugcaaguuaaaauaucuaaacaauggugagaaaaaaacuacauuaacaaucaagaaauacaaagcaugaaaucccaaauucuugccaaggccauaucugacucuaagcuuuacagcaacaaaguccaaacauacauaauguuauuguugaaaaugucuacucuccaaaacacuauuccugccucaggucacaccuucccauggcaccuuucacaggcugacaugcugugcuccuaaccccggugggugucucaguuaacaggaggcacuuuaguggguccucauucuuacaaggacuggaaaccacacuuaugaaaaagggugauucagaugcagacaugcagggaacaaaggcaccauauaaaaaaacacagagccgggugugguggcgcacaccuuugaucccagcacucgggaggcagaggcagguggaucucugaguucgaggccagccuggucuacaaagugaguuccaggacagccagggcuauauagagaaacccugucucgaaaaaccaaaauaaaauaaaauaaauaaaaaaccacaggaagaagauggcaucuaucagacaaggaguucucacauagcccucaggaagagccaaaccuguuaguaugcugauuccagaccugaaccuccagaauugcuagauuugcuagaagugcuagauuucugcuguccacgcaaucugcaguacucuaugaugacuaagagagcuacuauagaggaagucguggauuccccaccccccgccccccaggcuguugccccuuagauccauuuggguucaagugaaucuuuagagcuaaccuucugucuuaggauuuuacugcuaugaacagacaccaugaccaaggcaaguccuauaaggacaauauuuaauuggggcuggcuuacaaguuuagaaguucaguccauuaucaucaagugggaacauggcagcauccaggcaggcguggugcaggaggagcugagaguucuacaucuucaucugaaggcugcuagugaaagccugaguuccaggcagcuaggaugagggucuuaaagcccacucccacagugacacaccuacuccaacauggccacaccuaauagugccacucccugggccaagcauauacaaaccaagacaccuucugucuaccuagcccuccgagccugcuuacuucagggguggcugagagucuccagagccugguuugaacccacccgcccagggagguaccauaaguaauaccacuccucaccugcaaguccaggauuagacaguggcucaucuuaugagcucuggggcuacaagccgacucccaaagcuuguuuucauauauaugcaaaagugggacagaugacgguaacccucacucacggaccccauucaacauucaacauucauuaccuuaguuaauacauagggagcaggauucaacgaccuggcaguaaagucagaaacuggguacuugcuacuguugagcaaugguggaauuuuuauuauccuaagacagggagccuaucagcuuucguugauauuuugaacaguuuuugcuagcauaacccuucugaaaacacacagaugacacaucuuaaagaacauucaguuacaauguuucaguucuagcaaacauuacaugggauggcaaagaaacccaagcagcacuccaccccaaaaccuagagaugguuggugauccugugcugugcugacuguggauaugggguguguguguguguguguguguguguguguguguguagauguauauccguacauguauguauguauguauauacacacguauacguauacauauacauguauauacauacuaacauuagcuguuguuagacaagacaggcaaaacaucaagcaugaaacaguggcccagagacagaagucuguuuauaaagucccuacauugucuccacuaaaaaaggagcagacguuccaaagaauaugcccaaaguuaucuuccaaaauuaacugugugcgcgcuaacacagacaccagacagaggguaaccgaagccccagcuuuagauacuguaacaagacacaagaguacagccugagaaggcugcagggugagugggcagcaaagagcucggcugauguggugcuuaugcccugguuugaugucaaggaacguaaaacaggaguaacaaaaguaacaaugcuaacgguucuuaggucgguuggaacuuauuaaaaagcugcaucuccaaauggucccugaagccauggaacaaucuucguaaggcagucacaaaacauuccuacucgcuguacagaccacugguucucagccuucaacacugggaccuuuuaacacagucccucauguuguggugacccacccagccauaagcuuauugucacagcugugauccgccacuguuaugaaucauaaugugccuaucuggaaggcgauccacuaccacaggagucgagccccgcaggcugagagccacugguauaaaggggugaaaaggacguaagagcacaucucaggggaacaacacuuucuguccaggagcgucagcucugaagaagaacgucuacacucgaggguaaggggcaugcgcugccuucugcuuguucagaaaauacauaugaaaagccuccugugggccaacccugcuaagcuccaguagaugccgagcacagaguaguaaacagacauuacaggguccccauuaucuaggaaguuaaagccuagaguuugggacucuucacaucaacauacauaguucacacaguacucacuaugcacaguaacacagcaaaguucugaaaagaagcugggaaccuguagccacagcccuauucaguuccaacagcucaccucaaauauaucccucacucaaucugggccaggaaggaaaacagggcccuacaguuggcuccuuaacagcacucaguguccuagacccuacauccuaaaacaguaugcugaaccugggggaaagccaacguuuucugauguuccucaacaucaaagcagcagugugccagagaaaucucaaaaguauugguguuguaguuuauauugcaauuuucaagucuccguugccuuuagccuguucucaggccacggugcugcguuuagcaguugaagagaguaagagaccauuaugcagaaagagagacugaugacuacggugcccccagcuucuucucaaggaaggcaaggucuacgcaggugaacugucauggugagaaaggcugccuucaaguugucugagggacacucccucaucccucacacucaccgugccaguuggacuuucaaauaucccaaucuugccaccuuccaaaaccuuguagagcucugccaugaagucuuucuggauaggauagggcgggaagggaaaaggaaaauggaugccaccaaucuccugguuuucgucagccauugcccuagaggaauaaagaaugaacaaaugaacgaaugagggaggaagggaggaaggaagagggagggggggaggggggaaggggaggggggagggggaggggagagagagggggagagagggggagggagggggaggggagaggggaggagggggagggagggggaggacagagggggaggagagagggggagggaggggggaggagagagggggagggagagggggagggagagggagggggagggagggagagagagggggagagaggaagagggagaaaucuauuacuuuucucaugagcuaugcaguggcuuuaagucuacuuaauccacagcaguuuucucacuagucacacaauuucccuuuggauucuacauuuucuggccagcagagaccaugacuauaccaaaaccauacaauccauaaaaugaugcugaucggauacuguuuuuguaggauccagccccgaaaggccuugagaugagccuccugugcugcugcuagaugcccuuccaauaguaaggcuuucccugcccaggugagugcuguuuggaacccagcugccccuugggaguccuucuccagcgaucuucucuaaggucucugcaaugggucauucgcaugcccaagcugccucaccugcuccuacgaggaaggccuagaaaccuaugggaaaugacccggaaugaccaagacuaacuccacaaggugcuaauucacauccauagcagcucacaucugcuuuucuucaucucuuucaacacaggcagcgccaucuauugacuacuguuucuggccuugaaacacaagagcuuucuggggcucaaggguagaaagcuuacuaggaaauggagacucccuggcaccuuaacaccccuaaaaaacagccauuuaguuccagacuggaagaaugcuuuucagagccaccaaucugacuagacuggcuucccaauacuaagucuaugcugugcacagcagucccuuccccuggcaggccaagggcucucagcuccaugcguuuucauuccugucuccucuucugaaacgcuuuuucucugccaucucuuggccaucuggaggaaauacucauccaugccucuuuucuugagauguaacuggacaggccuaucuguucuaaguccaaacaguaagaacccuaagacccacuuuauuauuaauaaacagaaaccuuuuuuuuuuaacuacacugugcuaaaagacagugauagugucaauccauuuaugagagaugguaguugccaauguguuccuccagguauuagggaaagaaaaacgacuacccagguggagaaagcaccgagcaaaacaaaacaacaaaaacuaaaggccacacaacaaauuuaagaaaaugcaguaauaaaaagagcuaugcaacuggaaaaccacuaaaacacgaagagaggguaaagaaauguagccaacaagagauggagagauggcggaguaguuaagaacacuggcugcucuuccagaggacccagguucaauuccuagcacccacacagcaacucacaauuguuucuaacuccaguucuagaggauccagacauacaaacuaugcauaaaauaguaaaaguaaguuuuuaaagguaaccacagauucugagcaucuaacauguguuaagcacucuucagagcccccaccccacccccuucuuaauuucacuuaaccuaucacggauaucaugacagaacugcuggcuggagacacugcucacuaguggagcccucgccuagcagcugcccagagcuuaaucuacaaccgaaagcggcuggguguuaaggaguaaguagcauuaaagaagaaaaaguacgcauuuaacccaggugcgaagcgcucugcuauggucaagcucaccuaaguacaacagagaacuuagcaaggcuaaacaggagauuuccugaaaugaugcacucggaggugaagaaugucgccgucugggaaaaccaggaacccgggcugcgggcaggcagggaaacccuguacaugagaacugcaagcuagccgggauuucaggacaggguccugcaugcagggaccauguauuuauuauuuaauccuacuuuuaugccacuuccaucaaaauguggucgacuucccgaacuuccucaaccuuaaaaaaaagggggggggggcagugcagccgagaaugcaacaguauggucccugaggcacacugccaaauuggaucucaaguucauuaucagucaaccugugucuucaccugacuucacuauauacaauaaccccugaaaaucguuuaaaacagacucucuacauuuuagaauccaaccuguuacguacacucaccgaaggcgccacuauacuugggcugccacucgcuccaauccaucccacgccgccuccgcccccacguccggccguagggcgcgcucggcuaacccugcccccuggcagccuccucggcuuccgccuccgcucgagugugcccuucucaccucucugccuucggucgcagcgcuucucccacacagcaccgaacucgaucgccaccgcaggaccgccucacugaggccggcaagcgagccuggccgccgcggcugaauuuaaacugcaguuucacugaaggagcaugcgcgcacgcagaaaacccuccacguggccacgccccc

SEQ ID NO: 8708 - RNA, 2748 nt, Mus musculus
uaaucgaaacacgcucuuuauuugugcacacgggcugccucccucuaaggcagaauuugagaggucuguaugggaagugaggaaggcaagguuuuuauaguucaaggguaggagguuuccaaaugagggauuugguggguaaaauaagggagguuacaggagaagaacauuaacauaauaaguuaguccuaaagaccuccugaagcaaagaccugacugcaagcugcuccuaagguagucauaacaacagguagcuauaacaaccuuuugaaacaaaaguucgguugcaagaugguuacaauaacuuuuuugggggggaaagaaagggcaugauugccagaacaucuguaguuaagguuacagguggggcauagaccaauccuugagaaacagacuuagucauaaauaggaacgagccucguuugucuucacuguaagauggcuuucaagccuaagauggagggaggcugauucgucacuuucagaugagaggccaaauaaaagucuuacacugcccagcaaaggaaccaaacagaugcaagcccaccuugucuugucguucuacagaguaagggauuuaaguuugauucuaacuauaaaccauaaucuuuaacuaguuuuuauuuaacagaaggaaaaaaaaaaccucucuucaagucauaguugaauuuuaaacgucuugcccacaggugugugugugugugugugugugugugugugugugugcuauagugccuguaugauguguuguauguaaagugcacaaugcgggaugcauaccuacugaggccagucugcuaacucuccacuuuacucucuugggacccuggagccuauuucuuuucuacuagccuagccggccagugaacccacacgcgggcacugcaagcacgcuugcuuuuccagugagccauccaugaacccaacaagcccgugucucuuuaaagucaggaaaacaaaggaguaccgacuccucaggcuagaugcuauuguauguauuguauuccauguauuguauguauugagugaugcuaauaaggaggaacguuguccuuuuuaagggaaaggaaguugggucccagucggcaaguuuuuggaagacuuacugaaacacuuuuggguggacucuucaugacuguguauggucugaaaaggugacauguuaagaguccuggucauacuucuucaggaaugugaggguuggcaggggauuuugacuccucacguugguacuggaggggaacgcuggagcgcccucucguggacacagucucguggacacaguuagucaagcgugccugccggccuccaagcacuucaaggggcaggucucaaaagguacuuauuacggauuauauagggugugccucacuuucagaagauuuucacaaaagugacucgcaaaguccaggccuguaagugcaaauugugucggaagguuucaauaggaucugagcucaagccccaacaagacauucuaucuucugguuuauaaucaaaaaaaaaaaaaaaaaaaaaaaagccauuuccugcagcuucugacgguucgggcuacggaaggccauucugucguuaagaccacggacuuugaguacaauuuuccuuuaacauuucaagucuguacucuccucgugcuucgggaugcagucacccacaccaugcccucugccccacccugcggcucugggaucuuucucagcaaauaagaucaaccagaauccuucacuuuccacuccacagcuuuaggucuaagcccugucccacuuaacugugcugugaacuucaagaccagcaucuuucaggaaacacacaggauuuccccgcuggcgucuucuucuuguucaucccugcuccccaaaucccgaaucuagauagaggacaacuuagacuuguccucggggcgcuuauugcccaacauccaaagccugggauauaaaccacacggaacaucugucaaaagcacuuuacaguggacgggugaguccuucucuuugcucaguuaaucagaauacaucuacauucgguuuucucugauucuacaggugaggcgggaaucggagacccaaaaggucaaguaccuugcccacggagcggaacccucaggcuccuuggugcucuaaggcaaacguguacugcugagacuccgguagaccuagguuugaauccccgcucagccccggaguucaaacaagccacuucacuuccucgugcccaugucuccuucugaaaacaggauuucgaauucgggacugucaucaugcgaguagaagcagugccuggagcaaggucgccggaacuauaaaugugagcucccuuucagaccccggcuugacgagcugcuucuccgauuucuacagcggcuccucccuuucagagcugcccaggccacugggggugccaacuguggagcgcugugucgguccugacgcugcauccgguaccaggaauccuuaaagaagcucuggggagagcggugggcagcgaagcgaagaggggaggcaggagucagauagagggggcuggguggaacagagagaaggcuggcacccaccgcagaggggcccucuaccccgccugcaccugaaguguccccaaguggccgaugcccgcccucuucccucccuucaccccagcuucuucccuuccuagccggcucagggugguagccccaguacauccaaaggcaaagagugguccucugcugcguggacgcgugggcacucgggcucugcgucucccgcguccccc

SEQ ID NO: 8709 - RNA, 9099 nt, Mus musculus
ggagaagaaaggguuuauucagcuuacacuuccacauugcuguucaucaccaaaggaagucaggacaggaacuggagcagggcaagauccuggaggcaggagcugaugcagaggcuguuaaggaaugcuguuucccguggcuuacucagccugcucuuauagaacccaggaccacuuggccagggauggcgccacccaccguggucaggguccucccccauuaaucacuaacugagaaaauguccuacaacugaaucucauagaggcauuuccucccucucuggugacucuagcuugugcugacaguauaaagaguaaguuugguucuugaaucacucugccccaauuuaauacucggucuguucuucccacauauacucugucacagugccauuagacccugaacucagcugcaccagugcuggcaaaccuccagaaccaggagcuacauagaccucuuuauaaagccaccuacugcaggucuuacaguauacucagaacaacgggcuacuagagccagggaggaaggcauucuggcuaaaccaacauaacaggauucuugauaagaacaggucagagucagacaagaucugggggauggugggcagugagaaccugauccuucacuggggauaggacucguuaacuaacggagcaggauucuuugcgaacacuagauguuacaagaaaguccauagaaggucugagaaaucauucgggaaccuaacuaaaguuagagucuuugacauuguuccgccacauucuccuuuccaaaaauugcaccaguguugggauaaccuuuccuguacauuguguggaggcguaucucuguaauuucaauuauuaauucuguacuggcagagcgcuaaaugccggcaggcuuucaguauugucauuucuaugggcccaucacaagacuugcuauuuuguaaauauucauccuucuuggcugggcauggugacacacgccuuuaaucccagcacugcagaggcagaggcaggcagauuucugaguucgaggccagccuggucuacaaagugaguuccaggacagccagggcuauucagagaaacccugucuugaaaaacaaaacaaaacaaaagaacaaaaaaauccuuccucaucucccuagaauuguaucagagauugucuugcuacugacugguguaauaaagauagccaauaccugggcaggaaggaggaggguggaacuugcuggaagauagaaugaugggguugggagaagaaauaaggagacccaagagagaacagagguggaagagacauggaccacagcacaacagagaaggguagagagcuagcccaccuaguaggucauaagcuaggacagacagguuaaguuagaugaggcaccuggagauggucccagcaaaaggccuaagcuguagacucuauuagaagccucugugucguaauuuacacuguuggugggucugagagaguccuacuaaauacugguucaaggacuucagugugagccucuggcugacacuuucaggaggacaugcuuagcagcacggccguuugagcaaucccagguugcuuagcaagcacagcucacagacucagcucucagccucacagagcagguagcaucacagaucugaagcucaggagaccagggagccacacauguccuucacacucucuguacaaggguggccauuucauuagaaauucucuuuuuaugaaaaaggugacagaaaaaucauggacuuggaagauuguaccaugauuccaaggacauaaaccacauuguuagcugggaucugaaugcuggaugcauguguuuuguguaaaacugugaccaaagggaggguuaccauccugcagagaugaugacuuuuaaaaaaagauuuauugauuuauuauauguaaguacucuguagcugucuucagacacaccagaagaggacauucgaucucauuacagaugguugugagccaccaugugguugcugggauuugaacucaggaccuucagaagagcagucagugcucuuacccauugagccaucucaccagcccgaugaugaucuguagguugcuugaagugucuauaacggaguuacauucaauuuggccuuuguauacucucuugauuucucuuuucucuugccucaaaaaugccuuuucuauuuguucgaguuugaaucuggucaauauuuuuaggauuuucacacaauagaggucacuuuugaaaaaaauuguauuguguguuuugccuacauauauguccgcuuaccacauguuaccuggugccuucggaggccagacaagugcuaggauccguagguugagaauuacagaugggugugauccacugugugggcacugaaccugguuccucuggaaaacccagcuagugcucuuaaccacugagccaucuuuccagcccagaggucccuuuuguuuguuugcuugagacagggugucaggcauaucagacuggcuuugaacaugguguauagcaggggcauggccuuguacuucuaauucuucugcuuuauucuggcguggcacuguuccccauuuccagcuuguagcuguuuuggguuaauuuccuacugcugugacaaaacaccaugaccagaagaaagaauaaaaaaagcuguguggugguagcacaugccuuuaaugccaacaggaggugugugugugugugugugugugugugugugugugucugucugucugucugucugucugucugucugucugaguuugagaccagccuggucucauacauguccugaaucaagucccaagacaggcagugcuacacagagaaacucuacccugaaaaaaaacccagaguuagccgggcgugguggcgcacaccuuuaaucccagcacucgggaggcagaggcaggcggauuucugaguuugaggccagccuggucuacacagugaguuccaggauagccagggcuauacagagaaacccugucucuaagaaaacaaaaacaaaaacaaaaacacagaguugccuuucuugcagaagcaaugcuccagaguccuguucacaccaugggaugcuugguggccauuucaaggugaaauggcuuaccuccugaauuuggaauuuuuuuucaaauuuccuuucccauuuuauaaagagaaaauagcuacuuacaggaggaaaaugaaggguuaaaauauuuuauaaugaaguauuuucucaaucaaauaaaauggggucaacuaccaacuugaauguuucacaucuuaucuuacguugcuugagagacuuguaccacucccauuucucauuuauaagugcaaaaaccucacucuuuucuccacauuauucaagcugagaagucuaucacuacuagcacuugccacauuuacaaacguaaaccacccaaagaugaagaucaauuuagcugaugaaaacuuagagcaggauacuuuggcucacacagaaccagugugugcacgguaaucuuuuuccuacgguggauuacagaggccacaugucaucaucuaucugcagacuagaaauagacuguuucauugcauucuacccagagagcgggugucgcuggcaggcccucaaaguagcuaagagugagucuagcucuugcagaagaccuaagggaggacccuagcccaucacaugaggugacucccaaucacuuaugacuccagugucaggacaucugccacccuccggucugcacaggcaccuucaugaaaugguacacauaaaauucacacagaugcaugcacauacacguuaguaaaaauacauaaaucuuuuaaaacaugacuguguuuaaaaaaaaaaaucgugugauacauacaugcccaugcacaauuauuguuugucaauuaaaagaagagacggguauggugguaugcguguaugccugucuguuugaguaugucuguguaugugaguacaggugccaaucagaggccagaagggucagauccuuuggagauggaguuauaucggugguugugagcugccugacaugggugcuggggacugagucaggcucucuguagggcaaucgcuucccuuaaccgccgugcccuuuccagccucuagugauuaucaaugaaagcccuuuggagaccagcaggcucuggaaaaagcuuucccugauaucccuuaaccugccucaauauuggaccaucaaaaaaggaaaaccauugcauucgucuccuuucugaggcuuggcggaacugacgcccagccggcucuguuccaagcuguccucuggacucauucucuccuccuccguaucgcuuguaccccccuguccccucuaaaacaguguauagagaccucaggccucagcgcuccugguaccaccgaccuccuucccucacaaagacaagagggcagggaagcguggaucagcucuccaaaccacacuccuagaggacaggugacagagggagagcaugacagacaguggagaaaggaggaaagcaagacuagcgugccucagcccacgcaugcuccgaggagcugugcucgcccgcuuaggcagccucagcgcacgcaugcuccgaggagcuguacgaacccaccaggcugcauguagguugugggccaagacuguaugagagucucugaagggaguuuccauucugcugguuagaagccauggauccuagauaagucacuuucccucuaucuuggagucccugguucagacaucaggugaccaaaauccgcuuguuucgcaagcuccuuugagaauaaauucauccaaaacggggaguugugacagaagccuguaaauucagcacuuggaagcgggggugggggguuaggagggugggggaagauaggccguucaaggucauccuuaaccaagaagugggggaagaaacagaaaggaagacagaauaggcagcuauugauauggaaauccaguacggcacacagcacccuuugccacagccuccaccuccgacccugcgcuuugcauacagcuggagccuucccucugaagucacugagccuacgggugucuagagggacaaagaaaggcgcggcuguugcgggagcuguagaauaaagguuuagcccggaccccuauuguccugccuucuuacucuuguuuucacauuucaauuagcaaagcugaacugggaggccaacucuuuguuuucgucguagccuaacucaaauucaacgcuaaccugaagaaucugugguacggcgauaaaaauaaaguggucaaaucggagguugucagucacaaaccaaaagggccuacgcaaagucauaauccuaaggagggcauuuuaggaugacuuucaaaacaaaguuagccucuuuuuugggaggggguugugugugugucugggcggguucuucucggcuuaaacaggcuccuccugggcagaaguuacuguggcuuggagagcccaguauugccuaucugaugggucccagggccuccccgcccugguucaacgugauccgauuagcuggcagucuccggaggucaggagcccagcugcaagugcaaauuggucuugggaaaggguguggcuuccagucucugcuagucucccccacaucagcagggcugcuuuccuugguaaaauucaggaggacuggaggaggagagaauuuuuaucgaguccuuagcauugaggcgacccugugcacugguacaggcugaccuccccucaucagcgcagauggccugcagccagugugaccagcccccagccucccguucccucauagauugcucagugccacugauccacccgcgacugucgcuguuuaugauuuaauuuauacuaauagguuaaagcguagcugugacauuugucauuuuguaugggagcaacaugcuucuguaaggcaauuaacgcuaaaugcucacuacaguacgguagugacgcuugucugugugaauuguuauugaaguacgccaaggcagauuucccaaacaguaagcguacacugccgauuuaaauugauccuuguacccacaaagucacauuacugcacacggaauuuccuuucuugcuugcuucccuccuuggcagacacaauugaucaccagucaccauccauucagacacucauuuacaccuucaggacacaccugccaucaggcccauccccaagugucuuaggaguaauuacaucacacaccaaccgccaggcugagaggcaggggaaucucaugaaugugaacagaauguguuuauaaaaagauaaagggggggggggcaguauguuuuauggagguguagucagguauggggaaaggaggugccuuggcggcccaugcugaggcaucccuucccccugagggaccagcacaugacgggauaguauagaauagaguuuauuaaggacauggggaagggaguuaagaggguaguagaggcagcaaaaggaagaggagaggagagggaaagguggggggagaaguagaggccggccauaagcaaugaguacauggagacauggggauggagggggggcagggaauggggagaaagaaggcaagaaagcaacagagugaggaggggccaaguggccccuuuuauagugagucaggcauacuuagcgauugcuagguaacuguggggcggagcuuagacugaaugcuaacagucuacacuucuguuuuuuguuuguuuguuuguuuucgagacaggguuucucuguauagcccuggcuguccuggaacucacuuuguagaccaggcuggccucgaacucagaaaucugccugccucugccucccaagugcugggauuaaaggcgugcgccaccaccgcccggcuacaaaaugaguucuaggacacccaggucuacccagagaagccacgucuugaaacaccaaaccaaagaaauaaguaaacagaugaauggacguauaaauaugguccugucgagccuugauaugaauauggcuaugucucugagauuggcucaagucaaucacaacacacauuauaaaauacagaaguuuacuguuguucuuuucuuuucuuuaaagauuuuuuuuuuuuuuuuuuuuuuuuuuuugguuuuuugagacaggguuucucuguguagcccuggcuguccuggaacucacuuuguagaccaggcuggccucgaacucagaaauccgccugccucugccucccgagugcugggauuaaaggcaugcgccaccaugcccggcuuaaagauuuauuuauuuuauguacaucaucacuaucuucagacacagucaucagaacccaaugguugugagccacccugugguugcuaggaauugaacucagaaccucuggaggagcagccaguguucugaacugcugagccaucgcuccagcccauacuauuguuauaacucgauaaugacuuauuucaaaaagcaaggauauuacauuuuauaauaaucaggauuagccaacuuuauuuggugugacuuuccaaaguucaggacucucugaggccaugcagagccagaagccgagaccagaguuacccagugaaugugcgguagcccccacucaggaacugaacucuccugggaagaacucagauccuaaugcagugccugcugcagagcugucccccaagguuuuuugucuguuuguuuuauaugacuuucuuuucuagauguuaguauugauuaguguuuauaggaagguuaggaucugggcggauccaacaaucuucguucugaagaaguccaguaggguacccagugaggccauuugcaugcuauuaaagcaaaacaaacaaacaaacaaaaaaaaaacuugcuaaacuagucuguggucgcgaagcugguggccucucaguaggcaguuaggaacuguuuaagcagaacuugaccguccugaagguguuccuuacuauagugugcuugccuagcgugugugaggcccuggacuguaucccuagcacagaaaaauagccgagcaagacgaaaugcugaaguaaaacaugaugaacuuuguacagaguguuaaguguuaaaccaaauggaaaggcggaaaauacuaaaugagacuugccguuauuuauuucuuugugugugugugugaccccacuccuaacacaguuuucacacagaggccagagggcaaacugugggacuuaauucucuuccuccaccaaguggguuccaagacugaacuccgguggucaggguggguagcaagugccuuuucccauugagcuaacccaagauuuaaaauaaggaaaaccccagaugugucaaacucuaggcucagcccccagcacugcaaacaggucaaugaggaaagugaaugaaugaaugaacgaaugaaugaaugaaugaaugaagauaugaauagccgaggaaaggauuguagaucgccugaauuagcacuaaugagccaacuguuagcaacugaagcagagagcucaccaaguggccuugguccagaaagggaagccagggauauguuugguauaggugcaguauggugagguggaagggggugccucugggggcccaugcugaggcaucccuuucccuugagguaccagccauagggcgggauaguauagaauagaguuuauuuagggcauggggaggggaguugggaagggaguacacacacacacacacacacacacacacagagguagucuaucaacaacacgugaagagaggagagaggggggaggggaaugggagagaaggggcagagagggaaaaguguaagagggaaagagagcaagagaguaagagagcggaggggccaaacagccccuuuuacagagucaggcauaccuggcuauugccggauaacuguggggcagagucuacggauaacucaaguuguuuucucuguggaaacagggccagaaacaccuccagucagggcucucagggggccacuuacuggcccugucaggaucucagagcuguaagacuggugaagugcccucagggcugugaggucauucucuagagaacucccagcauucaguguagcuguccaggagucacagagaacuggguagguacaccugaaagggaggcugagaaugagaucggauaggcgggcgagagaagaaugaagccaagccaaagaguuccaaucauggcuca

SEQ ID NO: 8710 - RNA, 9099 nt, Mus musculus
ugagccaugauuggaacucuuuggcuuggcuucauucuucucucgcccgccuauccgaucucauucucagccucccuuucagguguaccuacccaguucucugugacuccuggacagcuacacugaaugcugggaguucucuagagaaugaccucacagcccugagggcacuucaccagucuuacagcucugagauccugacagggccaguaaguggcccccugagagcccugacuggagguguuucuggcccuguuuccacagagaaaacaacuugaguuauccguagacucugccccacaguuauccggcaauagccagguaugccugacucuguaaaaggggcuguuuggccccuccgcucucuuacucucuugcucucuuucccucuuacacuuuucccucucugccccuucucucccauuccccuccccccucucuccucucuucacguguuguugauagacuaccucuguguguguguguguguguguguguguguacucccuucccaacuccccuccccaugcccuaaauaaacucuauucuauacuaucccgcccuauggcugguaccucaagggaaagggaugccucagcaugggcccccagaggcacccccuuccaccucaccauacugcaccuauaccaaacauaucccuggcuucccuuucuggaccaaggccacuuggugagcucucugcuucaguugcuaacaguuggcucauuagugcuaauucaggcgaucuacaauccuuuccucggcuauucauaucuucauucauucauucauucauucguucauucauucauucacuuuccucauugaccuguuugcagugcugggggcugagccuagaguuugacacaucugggguuuuccuuauuuuaaaucuuggguuagcucaaugggaaaaggcacuugcuacccacccugaccaccggaguucagucuuggaacccacuugguggaggaagagaauuaagucccacaguuugcccucuggccucugugugaaaacuguguuaggaguggggucacacacacacacaaagaaauaaauaacggcaagucucauuuaguauuuuccgccuuuccauuugguuuaacacuuaacacucuguacaaaguucaucauguuuuacuucagcauuucgucuugcucggcuauuuuucugugcuagggauacaguccagggccucacacacgcuaggcaagcacacuauaguaaggaacaccuucaggacggucaaguucugcuuaaacaguuccuaacugccuacugagaggccaccagcuucgcgaccacagacuaguuuagcaaguuuuuuuuuuguuuguuuguuuguuuugcuuuaauagcaugcaaauggccucacuggguacccuacuggacuucuucagaacgaagauuguuggauccgcccagauccuaaccuuccuauaaacacuaaucaauacuaacaucuagaaaagaaagucauauaaaacaaacagacaaaaaaccuugggggacagcucugcagcaggcacugcauuaggaucugaguucuucccaggagaguucaguuccugagugggggcuaccgcacauucacuggguaacucuggucucggcuucuggcucugcauggccucagagaguccugaacuuuggaaagucacaccaaauaaaguuggcuaauccugauuauuauaaaauguaauauccuugcuuuuugaaauaagucauuaucgaguuauaacaauaguaugggcuggagcgauggcucagcaguucagaacacuggcugcuccuccagagguucugaguucaauuccuagcaaccacaggguggcucacaaccauuggguucugaugacugugucugaagauagugaugauguacauaaaauaaauaaaucuuuaagccgggcaugguggcgcaugccuuuaaucccagcacucgggaggcagaggcaggcggauuucugaguucgaggccagccuggucuacaaagugaguuccaggacagccagggcuacacagagaaacccugucucaaaaaaccaaaaaaaaaaaaaaaaaaaaaaaaaaaaucuuuaaagaaaagaaaagaacaacaguaaacuucuguauuuuauaauguguguugugauugacuugagccaaucucagagacauagccauauucauaucaaggcucgacaggaccauauuuauacguccauucaucuguuuacuuauuucuuugguuugguguuucaagacguggcuucucuggguagaccuggguguccuagaacucauuuuguagccgggcggugguggcgcacgccuuuaaucccagcacuugggaggcagaggcaggcagauuucugaguucgaggccagccuggucuacaaagugaguuccaggacagccagggcuauacagagaaacccugucucgaaaacaaacaaacaaacaaaaaacagaaguguagacuguuagcauucagucuaagcuccgccccacaguuaccuagcaaucgcuaaguaugccugacucacuauaaaaggggccacuuggccccuccucacucuguugcuuucuugccuucuuucuccccauucccugcccccccuccauccccaugucuccauguacucauugcuuauggccggccucuacuucuccccccaccuuucccucuccucuccucuuccuuuugcugccucuacuacccucuuaacucccuuccccauguccuuaauaaacucuauucuauacuaucccgucaugugcuggucccucagggggaagggaugccucagcaugggccgccaaggcaccuccuuuccccauaccugacuacaccuccauaaaacauacugcccccccccccuuuaucuuuuuauaaacacauucuguucacauucaugagauuccccugccucucagccuggcgguuggugugugauguaauuacuccuaagacacuuggggaugggccugauggcagguguguccugaagguguaaaugagugucugaauggauggugacuggugaucaauugugucugccaaggagggaagcaagcaagaaaggaaauuccgugugcaguaaugugacuuuguggguacaaggaucaauuuaaaucggcaguguacgcuuacuguuugggaaaucugccuuggcguacuucaauaacaauucacacagacaagcgucacuaccguacuguagugagcauuuagcguuaauugccuuacagaagcauguugcucccauacaaaaugacaaaugucacagcuacgcuuuaaccuauuaguauaaauuaaaucauaaacagcgacagucgcggguggaucaguggcacugagcaaucuaugagggaacgggaggcugggggcuggucacacuggcugcaggccaucugcgcugaugaggggaggucagccuguaccagugcacagggucgccucaaugcuaaggacucgauaaaaauucucuccuccuccaguccuccugaauuuuaccaaggaaagcagcccugcugaugugggggagacuagcagagacuggaagccacacccuuucccaagaccaauuugcacuugcagcugggcuccugaccuccggagacugccagcuaaucggaucacguugaaccagggcggggaggcccugggacccaucagauaggcaauacugggcucuccaagccacaguaacuucugcccaggaggagccuguuuaagccgagaagaacccgcccagacacacacacaacccccucccaaaaaagaggcuaacuuuguuuugaaagucauccuaaaaugcccuccuuaggauuaugacuuugcguaggcccuuuugguuugugacugacaaccuccgauuugaccacuuuauuuuuaucgccguaccacagauucuucagguuagcguugaauuugaguuaggcuacgacgaaaacaaagaguuggccucccaguucagcuuugcuaauugaaaugugaaaacaagaguaagaaggcaggacaauagggguccgggcuaaaccuuuauucuacagcucccgcaacagccgcgccuuucuuugucccucuagacacccguaggcucagugacuucagagggaaggcuccagcuguaugcaaagcgcagggucggagguggaggcuguggcaaagggugcugugugccguacuggauuuccauaucaauagcugccuauucugucuuccuuucuguuucuucccccacuucuugguuaaggaugaccuugaacggccuaucuucccccacccuccuaaccccccacccccgcuuccaagugcugaauuuacaggcuucugucacaacuccccguuuuggaugaauuuauucucaaaggagcuugcgaaacaagcggauuuuggucaccugaugucugaaccagggacuccaagauagagggaaagugacuuaucuaggauccauggcuucuaaccagcagaauggaaacucccuucagagacucucauacagucuuggcccacaaccuacaugcagccugguggguucguacagcuccucggagcaugcgugcgcugaggcugccuaagcgggcgagcacagcuccucggagcaugcgugggcugaggcacgcuagucuugcuuuccuccuuucuccacugucugucaugcucucccucugucaccuguccucuaggagugugguuuggagagcugauccacgcuucccugcccucuugucuuugugagggaaggaggucggugguaccaggagcgcugaggccugaggucucuauacacuguuuuagaggggacagggggguacaagcgauacggaggaggagagaaugaguccagaggacagcuuggaacagagccggcugggcgucaguuccgccaagccucagaaaggagacgaaugcaaugguuuuccuuuuuugaugguccaauauugaggcagguuaagggauaucagggaaagcuuuuuccagagccugcuggucuccaaagggcuuucauugauaaucacuagaggcuggaaagggcacggcgguuaagggaagcgauugcccuacagagagccugacucaguccccagcacccaugucaggcagcucacaaccaccgauauaacuccaucuccaaaggaucugacccuucuggccucugauuggcaccuguacucacauacacagacauacucaaacagacaggcauacacgcauaccaccauacccgucucuucuuuuaauugacaaacaauaauugugcaugggcauguauguaucacacgauuuuuuuuuuuaaacacagucauguuuuaaaagauuuauguauuuuuacuaacguguaugugcaugcaucugugugaauuuuauguguaccauuucaugaaggugccugugcagaccggaggguggcagauguccugacacuggagucauaagugauugggagucaccucaugugaugggcuaggguccucccuuaggucuucugcaagagcuagacucacucuuagcuacuuugagggccugccagcgacacccgcucucuggguagaaugcaaugaaacagucuauuucuagucugcagauagaugaugacauguggccucuguaauccaccguaggaaaaagauuaccgugcacacacugguucugugugagccaaaguauccugcucuaaguuuucaucagcuaaauugaucuucaucuuugggugguuuacguuuguaaauguggcaagugcuaguagugauagacuucucagcuugaauaauguggagaaaagagugagguuuuugcacuuauaaaugagaaaugggagugguacaagucucucaagcaacguaagauaagaugugaaacauucaaguugguaguugaccccauuuuauuugauugagaaaauacuucauuauaaaauauuuuaacccuucauuuuccuccuguaaguagcuauuuucucuuuauaaaaugggaaaggaaauuugaaaaaaaauuccaaauucaggagguaagccauuucaccuugaaauggccaccaagcaucccauggugugaacaggacucuggagcauugcuucugcaagaaaggcaacucuguguuuuuguuuuuguuuuuguuuucuuagagacaggguuucucuguauagcccuggcuauccuggaacucacuguguagaccaggcuggccucaaacucagaaauccgccugccucugccucccgagugcugggauuaaaggugugcgccaccacgcccggcuaacucuggguuuuuuuucaggguagaguuucucuguguagcacugccugucuugggacuugauucaggacauguaugagaccaggcuggucucaaacucagacagacagacagacagacagacagacagacagacacacacacacacacacacacacacacacacacaccuccuguuggcauuaaaggcaugugcuaccaccacacagcuuuuuuuauucuuucuucuggucaugguguuuugucacagcaguaggaaauuaacccaaaacagcuacaagcuggaaauggggaacagugccacgccagaauaaagcagaagaauuagaaguacaaggccaugccccugcuauacaccauguucaaagccagucugauaugccugacacccugucucaagcaaacaaacaaaagggaccucugggcuggaaagauggcucagugguuaagagcacuagcuggguuuuccagaggaaccagguucagugcccacacaguggaucacacccaucuguaauucucaaccuacggauccuagcacuugucuggccuccgaaggcaccagguaacaugugguaagcggacauauauguaggcaaaacacacaauacaauuuuuuucaaaagugaccucuauugugugaaaauccuaaaaauauugaccagauucaaacucgaacaaauagaaaaggcauuuuugaggcaagagaaaagagaaaucaagagaguauacaaaggccaaauugaauguaacuccguuauagacacuucaagcaaccuacagaucaucaucgggcuggugagauggcucaauggguaagagcacugacugcucuucugaagguccugaguucaaaucccagcaaccacaugguggcucacaaccaucuguaaugagaucgaauguccucuucuggugugucugaagacagcuacagaguacuuacauauaauaaaucaauaaaucuuuuuuuaaaagucaucaucucugcaggaugguaacccucccuuuggucacaguuuuacacaaaacacaugcauccagcauucagaucccagcuaacaaugugguuuauguccuuggaaucaugguacaaucuuccaaguccaugauuuuucugucaccuuuuucauaaaaagagaauuucuaaugaaauggccacccuuguacagagagugugaaggacauguguggcucccuggucuccugagcuucagaucugugaugcuaccugcucugugaggcugagagcugagucugugagcugugcuugcuaagcaaccugggauugcucaaacggccgugcugcuaagcauguccuccugaaagugucagccagaggcucacacugaaguccuugaaccaguauuuaguaggacucucucagacccaccaacaguguaaauuacgacacagaggcuucuaauagagucuacagcuuaggccuuuugcugggaccaucuccaggugccucaucuaacuuaaccugucuguccuagcuuaugaccuacuaggugggcuagcucucuacccuucucuguugugcugugguccaugucucuuccaccucuguucucucuugggucuccuuauuucuucucccaaccccaucauucuaucuuccagcaaguuccacccuccuccuuccugcccagguauuggcuaucuuuauuacaccagucaguagcaagacaaucucugauacaauucuagggagaugaggaaggauuuuuuuguucuuuuguuuuguuuuguuuuucaagacaggguuucucugaauagcccuggcuguccuggaacucacuuuguagaccaggcuggccucgaacucagaaaucugccugccucugccucugcagugcugggauuaaaggcgugugucaccaugcccagccaagaaggaugaauauuuacaaaauagcaagucuugugaugggcccauagaaaugacaauacugaaagccugccggcauuuagcgcucugccaguacagaauuaauaauugaaauuacagagauacgccuccacacaauguacaggaaagguuaucccaacacuggugcaauuuuuggaaaggagaauguggcggaacaaugucaaagacucuaacuuuaguuagguucccgaaugauuucucagaccuucuauggacuuucuuguaacaucuaguguucgcaaagaauccugcuccguuaguuaacgaguccuauccccagugaaggaucagguucucacugcccaccaucccccagaucuugucugacucugaccuguucuuaucaagaauccuguuauguugguuuagccagaaugccuuccucccuggcucuaguagcccguuguucugaguauacuguaagaccugcaguagguggcuuuauaaagaggucuauguagcuccugguucuggagguuugccagcacuggugcagcugaguucagggucuaauggcacugugacagaguauaugugggaagaacagaccgaguauuaaauuggggcagagugauucaagaaccaaacuuacucuuuauacugucagcacaagcuagagucaccagagagggaggaaaugccucuaugagauucaguuguaggacauuuucucaguuagugauuaaugggggaggacccugaccacgguggguggcgccaucccuggccaagugguccuggguucuauaagagcaggcugaguaagccacgggaaacagcauuccuuaacagccucugcaucagcuccugccuccaggaucuugcccugcuccaguuccuguccugacuuccuuuggugaugaacagcaauguggaaguguaagcugaauaaacccuuucuucucc

SEQ ID NO: 8711 - RNA, 25213 nt, Mus musculus
gguccgggaugcugcuaccgcugcugcggagaagcugcuucccuuccucuacucccggcggcggcggcggcggcgguagcgcggagcggguggagggugcgcgggggcccggggcgcgcggacggcggcccgagcgcgagccguaugcgugcauggaucccagcgccgcgcugcaccggcggcccgcgggcggcagccugggcgcggucuccccggcgcugucgggcggccaggcccgccggaggaagcagccccccaggccggccgacuucaagcugcaggucaucaucaucggcucccgcggcgugggcaagaccagccugauggagcgcuucaccgacgacacguucugcgaggccugcaaguccaccguggguacgccgggccuguggcgggugggccugggggaggucggggcccggucccuguccccauggaagcucugacccucucccagggccucaacgaaucauccuacggaugcccgggcauacccgccgugggcacaucuggcauccgagccgcgcacagcccaggucuccguggaagcccgacccucucuuguggccagaccgagcuuuuccguggccuuuccgcgggugucggacccccgaagcccaaacauucccucccggagccuucaccagucaugagguccgggugaugcauccgcggaaacucccgguccguuacuccugcucacccaggaaaacggcuuugugaaccgaaaguagagcugaaggccacccaccagugcagugccccgggguuacucaccaucuuaaauggguccggaccucgcagcuuugcaggcuggagggauggaccaagguuugcuuucucauuuucugucuauuuucgugguuuacagaaaagaaguuuguugcagagacaguucgcgcuaaagcuacacucggguuucuuucuuguucugugcacaaauguagggcaaagggauuucagcuguguuuauccuugaccucaaauaaccggguggauaggcgggcaaaguaagggcgauuucccggcacccacccgaggucggugaauuaccgggaaauccauagguaacgcuccuguuaccuuccucgggaucuggguuugaaacugcaagggaauguuuuuagugacacuggauugacagggcuugacauagagguuuguugggguuaugggaaacaguugugaccauggaaaagcuaccuggaaaacucucauuugggguggcuuauagaaaaagggggugagcaggagggacuggacagagugacaaaaaaucuagcguucucccugaauccuagccccaaggagaggaagguggaucucugauuucgaggccagccuggucugucuacacagugaguuccaggacagccagggcuaugcagagagacccugucucaaaacaaacaaaaucucagcuuggagguuugaaaagcuaaacacuggugcacauauuuuccguuguaaccauugaugguucccguuuugagaugagaauucuguagagaauuucagggacucucuuuaggucguaauugguaaguugccggguaacaaaacuaccacgguucuaaguacuuagaccggaaaauuaaaccuccaguuuucacacugacuuaaauuuccuuuuugauuaugccccuucaugccuuuuuuuuuuuuuuuuuaacagaccauuuuggaaauauuuaugcuccuucuacccuguuuguuuuuuaaauguuugucuuggggauguguuauuagaacucaguaacguaauuauacccacugcaaauauccaaucuuggauccuaagaguauacagggaguuauuaaccaggaaaugaggcuuauauuguuuuguuuguuucugacauaagugcaguaggcuugaaugcaguugagaauuaccagucguuuauggccccacacuuacauaugcagaaaugaaagcuaaugguuauauuuaauauagaagggaaauaggacugcagcacucggaaggcucgaggugacggacugggguggggagagcuggccuuuaugacagcacacccacauucuaggaaguuuuccuagggcucauagaaguggauccguggagagcuggccuguccuccugagaaagaugggccuacucaguaagcuuuccccuuguugacaaaaugaaacuagcuugagacaucauggaauuacauagacuaucuggaaaugagcggaaacaggccuccuuacauacauaauuauauguacaaauauacgggugucuccccacacugagggugguugaauuuuucccuuggauguuuuuguuuacuucauauccagccuaaaguaauuaauuucaguaaguguuucuugugggaaguucggaaaaagaugguaaccauaacuuaaggaaagccugaagacacuacaugcuaacaggugccucugccucuucaacuccugccucuggguugaguuauuuucuagccagccugcgguuuguugagcaccugcuguguguuggguguugugccgccugugggguaauguggaagcccagcgugggcucagugugcaaguggugccagcaggcgccagauuacagugcucaaggggagcauggacagagaaggguacuuaacacacaagccuccuggcuggggccaagggcuuguuagaagauuccuucccacugagcccugaggagccaaguucauuccuuaaguuccuuuagaaaaugcuguuuaaauaugacccugggugugguauagccuuguagcuacugcuugagcagagcuucuaggucuuccuguggccuguuuucuaguuccuucccagccuuauacaaagagccccacaaagaagaggagugucuucccugaugcuuuuuuuacugagucaaggcugcuucuggaagagaccacaguccccagcaugaguccaccaagauaggucacauggcaccugucauucagaggcuagaacgggcaggggugggagggccugaaagacaccuuugacaaggaaucagacaccuguggaccuuguguaacaggaucuguggagguaaaugaauguaaagguugaaucagugagacauugauaucuuuauuguuaugauuaauaaucggugcauagugggcauaaaacaccuagaauucgcaaggaugugaaacgauacaguguuuagaugauuuaauggaaauuauugugauuuuuuuuucgaauagauuuguauuugcagaauugaauuaguggaauaaucagccagcgcugguuauuaauaauuaauaaaggggcagcuuuaugaagguagaaagguaggagaagaaagcuuguuugcuacagacguuggcacccagcugagcugugccagauuuuucuaguuuccucuuugccuagacugguaguucaaccucccugaugcugugacccuuuaagacaguuccucauguuguggugacccccagccauaaaauuauuuuuguugcuacuucauaacuguaauuuuacuacuguuaugaaucaaucauagugcaaauauaugagaugcaggaucucugauauucaggaugaccccugugaaagggucguuuaucccucaaggguucuugacccacagguugagaaccucuggccuagacaaugacugacauacugacccacuuuccuucccugaauaucuguguuauuguaaacauacuuuacgugcugugacucccuagguaggugaguucgcauugucacuuucugggugaaagauauagaagcugugcugaauccgucuuccuuguacuguauucccuucauuuaguauaaauaacuucuuaaaaaguguagcucagggggggcuggagagauggcucaacgguuaaaagcacugacugcuguucuagagguccugaguucaaaucccagcaaccacaugaugucuuacaaccauuuguaaugggaucuaaugcccucuucugguguaucugaagacagcuacaguguacuuauauauaauaaauaaauaaaucuuugaaaaaaaguauagcucagggcuagagacuuggcucagugauuaagagcauuuguccuugcaaaggacucggguucgauuuucgauacccacacggacgcgcaccaccuccucaggcaccaggcauucauguggugcacagacguacaugcaagcaaaaugcacauuaaaaauaauaaauaagcaagaaagaaauuuucuguuuaaauaaaaguauagguuuuaaaaagcaguuaaaaugugauuauuugggggcuggagagaugguuccaugguuaagaguauugcugcucuuguagaagaccagaggucauuuccuggcacccacaugaggccguucagaacugccuguaauuccagcucuaagcaaucagacacucucuccgaaacuccugcacuaaacgaccuuccugcaauguuuauaaggcaugugaaacauaaguguuguguuuagacuucaguccagucucuuaucaucucauuauguauaugaaaauauucuaaaacuuuuggaacacaaguaaauugauguaaaguuauguaagccagaauucuguuaugccuggacaguacaguuucccccuuaaaaaugcuagagacugccgugggaucaucagcucuuuuauuuugccaaguaaguacauuuuaaaaucccacuaucaccagcugagagagagacugagacagagacaggaugaugaugaagaaguagggacgaucagauagcaaauuuaaagcucuuugaauuucccucugaggaccucagaccucugcggaaauacuuaaagcuucccagccgcaccuuugaaaagaaagcgccucagaagaccucgucagagaagcaccucugagcugagaucugaggccuggucucagaauacagcuaaguacuuagagaagggaugcuaacuggugggccacaguccuugugugaccuuccuggauguccucuauaguucaugcagggggugggugugccucagcuacuggggcuaggccaccccugcuggaguacuugaacugacaacugaauugagggcccauaaaauaaaacuggugaaugacuaagucccugcaggcaaaccacccaugcacuuaaaauuaaauggagagggagaacuagggggaaagucccuaauucccuucuuaaacaucgaagaacaggccucccgagucaccccauucccugccagagugaugugcccugacaacucagggagacuagagagaaagaggaacugagguuugggucgcccggcacagggaguaguacauacgcugugacugaguuuauuuaaggggguuaguguaagcccacaggcuuguacaauguccgaguugugacaccugguuaucuuucuaucuaccugaaagcuaucuuucagaggaaggcuguagauuuuggagucaguuguauagggaaaaaaaaaaaaaaaaaaacccgguuagauuuggccccagagcuuucccuuuauuucugcuucucacacugaagaggaaaaguuuuaguaugacuauuuauuauggggucagaguagagauggccucuguuccagccuguagagucagccagaagcagucuguuggaagcccuggaacuggcuggagaagagagaagaggcuccuuugagaauaauaggugagagauguuuuacugcccaggcaucaaauaaguuguucccaaaaaagcauuggcuugaaccaggaaagaaaacauggcuuuguacgguagucacuaagcaggaauuuuugaggguucuaugcaucugcaucagaccauucugggagccauuuaaauagggcacagaguuaacaccuggcuuaucccuucagaggggaugugugucacagagaaagugacaauccaguguaagaaagaggugagagcuguuggguuucaucagggggaagaaacugguuauaucuaccuguuuucuuccuguuguauauagcuuggauguuggggggaaaaagcacguggaaaacaaaacuacauucagaaacgcuacccgaauugagugugguuauguuguuacuuaguccuggaaagccaggaagcaacaauacagaccuaacaggagcagccuaugugcggcugaaaggucucccugucuauucuccucagucugacucugacaggcugcugauuccagcccuucugcuguuuauuagcaggaaaacaagcaacagcggaccucuggcgggugggcguggagagucuuccuguuccuagcccuucuuaguggagaaacccccccgaacucugccgggaacccugugauaucaccaucccgggucaugcuuuuguagaauaaaaaguuaguuuucuccuguuguuaacuaaaauaaaauuggaagccgaaaucuuauuauuuauuuauuuuuuuuuaauuuugacucaaaaagagacgcucuugucauuccugcagccgccacagccuuuccgugugcuggagaauucgggagguagcgagcuaguccucaguucuggcucuucuguauguuaccaaugcuucuuaaagcagaccacgccccucgggucccucauaccugaagagaggguugaggaggcccagcaugguggugugcaccuuuaaucccucacucaggagggcggcagagacagauggauaucugugaguuagaagccagcuugguccacaaagcaaguacccugacagccagagcuacacagagaaacgcugucuugaaaaacaaaacaaaacaaaacaaaacaaaacaaaacaaaacaaaaaggaaggaugaaaggguggguugggggaaccuucuacccucccuggcucacacugugggaauaagcgugguaccaugucuuaggugccuggcccagaaagguaauucaucaugcuguuucccagagaagugcuauaaaugcagaaaccgccaggaaaucguaugcgguacaguacgaaauaccaagugucaggcacaggcauggugaaguagagccaccucacagugccugcacugggcagcaguaaagcugguugagcgccuggcuuuccccagcuguuuccuaccguaaacguuuuucuuccucucgggaguaaggugguccguggcgcaaaaaguagcagacauccacugaugucauguuuccuugacuugugcauaauaaaguucacuaaagggauacauggcaaugaaauaacacacauuagccucuuagaguagaaccuagaacacagcgaacaccagaacaauuaguucuuaguuguuuuacuuaaacgaagggagaagcaccauuuucugagauucuuccuguauacuuuggugaaaacagagcaugcuccaggaggcguggccacucagcaauccccuccccugcccuaugcugugucucuggcuauugguucuuguggcaguguguucuccuuaugugugggacugggggguggggggagucccaggguggucugcauuugucaaggccagaaugaaagggaaagcagagcugcagauggaccugugcuguccauagcccagagagcgucugugaugaagcaugguucguuuacaacuccccuccccccuuuuuaaagauuuauguguguggguguuugccuguaaguaugucucugcagcacaugugugcaauauccucagaggccagaaaaagcugacacaggucuccuugaagugaaguugccaaugguugcaaauucccacguagaugcugggaaccaaaccuagauccucuuugagagcagccugugcccuuaaaccacugagccaucugucuagcccucccucauccccguugugcucuuuaauggugucuuucucagaaaugaucacaagauuucauaauuagaauauuauuuuuaguuuuccugaauccucacaguaacacagcguagggaagaaaagucagccaaagccaugagacuucacacagaagauaguuucugggguugauacaauguuaacgugcagcucuggaggcagcuagccucauugcucuccuucauggugagcaggccuagcucacccuuacucuucauaggccacgcagcuugggcaggagacacauuuccuucaacaauaguagagcugucugucacacacucggcgccucucacccagucuugacacaucucuuacucucucacugccagugcagggaucuaauguucaaaguggcugacaucguugauauaaguacuuugccggagcuauagugucacagccauuuuacguggagaccugugucagagccugggacuccauagcuguguuaaugucggguaaaguccacugcggucugggacaagcugaggucuuggguuggcagagaagcaaggugaucuacuggaaggggaagcugggaggcugcuuguuaucaaagacuugcaccccaguguuguuucuucuucaggcaggaaaggaaugugaagaaagaggagucuguguguuucugcuguuuucauuuuguaacuucuuagggcucagaaaaagcaacaguguuuuggaaauguuuuucccuccuggccuuccuaggcaccaauuccuuaggcuaugaaagaccauccagaaggaagcaauuccagguucaggucucaugacaagauaugaugauaaugggccauuuacagaacacaacacacaccuucucagccaucugaucgcauaacaaccuugcauugugcauacaagcgcgaacuugaaucgggauucugcaguuguguaggcaugugguccgucaguuacuccuccugucucugguccaguguguccccugcgggaugacaugacagugcccaccugacuaggcugccaugagcuuugggggugaggcacuaaauaugacugucauugcuauuaaaacaaaugaagguugagccugagccacagucccucagagaccacacacuggcauuggugauggggagccuuacccuguaagcugaguccuuucuggaaacauuguuaaacuaguuucagaagauuucuaaacaaccagaagcuuaaaugugggucccuguuaccagaguaaucugcuugggggcugaccacuccaugcgaagugaugggguaaguaauuuguuaccauagugaucacugggcugagugugugcagucuaagucgagcugccugugcuuuacacaguuacacaggaaguaaaauguaucugcucacacacacacacacacacacacacacacacgagcacaggcauuccuaucugcugcugccauuucacaucugucuccuuugccucuuuaaaaacaaacaaacuggucaguccuggcuaucgcucauuuguccuguuagucagcguuucuccuugaacuccuugaauacaccgcauuuaguggaguagagaggcugacugugagccucggcaggaagccaaggaugcugggucgcugggaaaugcacagccuaugggugaggccagcaaagaaaggccagaagaguggcgggccaggaaugggguaggagcggguagguguggucagggaaacuucccugggaaaucuaggauuuaaaagguuucugggcagacaagaagguucucuaagaguacauggcaggggaaggcacuuuguugccaagugcgugguguguuaaugugggucagugugacccagcuuugggggcagggacuguccccauuaacccaaaggguagugaggaauguugcuugccugcuaaucaagacgccucugagagggcuggagagguggcucagugguuaagagcacugacugcucuuccgaaggucccaaguucaaaucccagcaaccacaugguggcucacaaccauccauaaugagaucugacgcccucuucuggugugucugaagacagcuacaguaaacuuacauauaauaaguaaaucuuugggccggagugaguguuggcccaagcgacgacgacgacaacgacgaugaugcugccucugagaaacuguuuucaacagggugacaggcucuucaccccuugaguaugcaguucuccacuccuaucucugcugacugucccuaaagcuccuguugagacuguugauggcuugcuaugauucuuuaaggaccguuagcauuucuguggcucacagcugcugcagaugugcgacaugaagucauuuuauacuugggaggugagguuucuagacagguccgaugauagacuuguauuaauacaaagauguguguccgagccguagguuggauuaagaucauuacaagcuacuuggagcuguuguuagauacagugcaggcuauuuuauuuaaaggggacagguuuauuuauuuauuuagguuccucaaggcaggauuucuuuguguuucuuuggcuauccuggaacucacucuguacaccaggcuggccucaaacucauagagaucuacacaugggguaaagaggugcuucacccagcucuuacauucauccaucuacccauccauucacuuauuuauuuauucauuuuggagaggaauaguuuuaaugagcuguucccauuuauagacuuggguuuuuuuuguuuuguuuuguuuuuguuuuuuuuuuuuuuuuagauuuacuuauucuaggccaugagugguuuugccugcagcacaugugugcaucaugcacacaguuuuugccgggaucagaagaaggcauuagaucuccuggaacuggaguuacaggaaguugugagcugccguguguguguugggaacugaaccuggguccuccucuuugagaacaagagccgcccuuagccacauuucggcccugguucauacacuuagagauuuagccacuuaccugcaccgggacucuucugcugagguuacaguguggcuguguugugauuccucugugcacacacucgguucuucucaguggcugagcagauuccuuguccuguugggguagcugaugauacccaggcccauuucuucauucugaguacuaaugccugauccuuuucuuuguucauuaagcuucgugguuagagacaugacccuuguggaggccugcuaaaacaggcagguuuuucaagcuaguugagaaggaguggagagcacauucaggcccagcaugauauagcagagaaaacucuguccuccggacacagacggcccacacuggccauguaaaggguucugucagucaacuggaagcagagcucgggagagaugaugucacuggcccauucucuucaguaaaagaacaaauuuacgaauguuaccucucccuuaacucagauucugaaaacaaauucauuugaaguuggggguaaagugaagucaaagaggcuggcagggugacugucuaagggcccgccuuggaggcugauggccugccugcccccugguauccacgcuguacagaacgugaacuccugcaaauguccucugacccccaccccuugcccacucucacaugccacaaauacaauaaauaguaaguaauuuuuuuuaaagauuuauuuacuuauguacucugucuucauggacaccagcagagggcaucaggccccauuacagaugguugugagccaccaggugguugcugggaauugaagucaggaccuuuggaagagcagucaguguucuuaaccacugagccaucacuccagcccccaacaaacugcuguccuuacaauaguaaccugaaaguaugugaugugaauuacagaucaaaugcaaggugccaugacuuuuauuucauuuuuuaaaaauuaaauuacaggcuggagagauggcucagcgguuaagaacacugcucuuccagagguccugaguucaaaucccagcaaccacaugguggcucacaaccaucuguuaugggagauaaugcccucuucuagauuugucugaaaacggcuacaguguauucauagaaaacaaauaaguaaagugguuugucaccaagaugugccuuggauuagucagagcagcagugcggucaugccuccaaaguguugcucuaaggagcugccaccucgagugagucauuuaggagucucaaggccacgaacugcucagaccugcucagaccugcuccugggaaccuguagacuuugggaagcagucagcuggagaauuaaaagugagguuaugucaaucagccuugccagucugguguaaagaauuacuaauugaaaugugccugguguggaggugcacaccuuuuaucccagcagggagggucuguaaguucaaggccagccuggugugcagagugaguuccagggaagcugugcuguaaagagagguccugauucaaacaaaacacaaagaacaagcauuuaaaaagaagaagaacugaaauucaggagaccugucuccuuuguucuacugugauguuuuauauuauuggaacuccugugucauauaucuaaggacucuuccccagcucaggcuuauaaacaugucuuguguugcuaauuuuaaagccagucacaugucugucuguucaucucagaugucaucugaccaaugcugccucagguccaaaauggaugagcagagaggacaggcagagccacugcuggcugcgccccaccugcgcauucugcugccugggaugguccgucugggcccuggcaggcagcugggaaguagacccagaaaggaaauguuuacagugcuuguagucagcgagcaucucgucucucuacuuauaaauauuauguuuuuuaaaaaguauggcuucaaauauuuuuuuucuauagcuauaaaagauaaucagauauuacacaaaugaaaauuuggauuuuuuuuuuuuggaauuuauuugaagcuuacaggucugucuuuaaaaggaaaaauauauaugugauaguuugguugcaauauuaaaaaugaauaaaaauuaaaaucgaauaugcuuaucagaugaguagguuucuuuuuugugcugaggucuuacuuuguuacccagcuugucucaaguacaccacaccucagccuccugagaggcuaggaguccaggcugcccacauaaccuggcuuacuauacacaauuuuauaacaguuuguuccucugugauguacugagucauccacauacuuaccaucacccgugagggcuaacgauguuaauauuauuaguaacuucuagauccaaacaaaggcuguugaaaacaggagucauaaauuagcuauaacaggcugcguguggagccgaaaaagccgucgagcagcaggccucugcacacugaggccagggcacccucgacccucucacuuuggaauuuuggggauaccgauucuuuccguuuucuuaggggcacacauaaggaggacuccuugauacaccgagucucacugugucucucuugguuugcuuauauucauugguuuccucuacccccaagaagggcucuuugauacaccgagucucacugugucucucuugguuugcuuauauucauugguuuccucuacccccaagaagggcucuuugauacaccgagucucacugugucucucuugguuugcuuauauucauugguuuccucuacacccaagaaggacuccuugauacaccgagucucacugugucucucuugguuugcuuauauucauugguucccucuacacccaagaagggcucuuugauacacuguaucuuuauugcuuugcuucauagccauuuguuuucucugcagguguugacuuuaaaaucaagacuguagaacuaagagggaagaaaauuagauuacagaucugguaaguagcagugugucccagucaugcccuguauguuuagcagucuacacgcuuggccacuaagaggaacccugagcccucucaccugcccacuucccuucacucccuuuaaaaucggaagaagagcacuucccaggagccacuccucccuucacacuuccuuugcaccuggggugagcugagggaggcucucucccuguuuuccaaccauaaacaugucuccaaacuccaucauugaacagggugcuucaucguuggccucacacucagcaugcagcucagugguagaccucuuugcuuggcauguacaaggcccuggcuuccacccccagcgcugcugcgggggaaagcuugucuuuguguuuguaaauuacugcaugcucuucaaaagaucccaguauguucguaaccauauugucagguggaggacacacaucaccuacacaagcagcucggggcccuuaugcugcuacaguauggacaggguguggcaggcgugcccuuucuugcucacuugugggugcuauguaacuggggccucuucuguguaccagagggggacccagaaaccccauccaaugagagaagacucucgauucagccuaggaacaaaaggccaggccagcgguguuuuaacuguaguugaugcuuaaaucuuucucuucccuauuaacaacccacagugacagcuagaaguacccaaccgauguuccuggccagcucuguggaagaaagggcagggucuggccuguaugcuuuaguaguggcccugcucagcucagugguuugaagaaugcuuugugguucucaagacacugggccagcacacucagcuuacuaacuccucuuggcaggucgcccucagcucugacugucuguccaccgucugugugugugcuuucaucugcguuaaucgcugccacaucugugcuaucaccggucaucuaacgcuugaauguuaguggcaugucuccauccuucauccauguccuugucuggggcacagcugcagccaagccagccuugcuccacuggcguccugagguaaucacuuucauuuggucaucugcaacuguguaacccacguaagggcuucucggguuuuaugguuuuguuucuaacaguuuugccuaaauacuuagauaacaaaaaauaaguauuuguuacacuaguccacaaacaagguaacaaucuuuguauaguucguugcugucugccagauuaucuuccauggccugaagagagagaaugcuuagcaguuaaguccacuggcugcucuuccaaagggucaggguuugauucccagagcccacaggauagcucacaacuaucuguaacuccagucccagggauccaacacccucuucugaccuccuuggacccuaagcauauacuuacuacacacauauacaugcaggaaaaacacccauauacauaaaauuuuaaucucugacacaaguaagcuccuucaagacagcuuuugaaggguucaggacauguccaccuuugugacuagcgucuguggcuguuguucuuuguccugagaaggguaauggagcuaauauuagaauguguggcagcugguuugagugggugaugggcagacuauguccuggggcuggagagaugucucuacaguuaagagcagcuaugcacuguugaaggaccugaguuuggguccccacaccuacacugcagggcucacucaacacugccuguaguuccagcucuagagcaugcaacacccucugaccuccgagggcacacucacagguauauauaguuagaaaaggguugccuuuuuuuuuuuuuuuuuuuaaaagcuauaucugaauguucuagucccuuuuguugguuauagccucucuuacagugucuuugggucugaucaguuccuggcuucccuuauggaagcuugguccaugaaguugguuguguguauucagccacgugggguucucagaccacuuuucucuuagaugcgaaagcaguccccagaaacugcccucugccugccuguaaaugucuaggccauggacaggacacugguggcagucaauggggaagagugguaguguggucuggguuugcugaaaagcugauggcacacuuggguuggauuaucccagggcuggguuaggaagcucuuccuucccaucgaaaguaccuaaggggagcaguguacagacggcugcucugucccggcucgugguuuaaggagguacagccuucacaguggaaaggacucaaggcagaagccaggggcugccugcuuccaucucagcagcccaggaacagaaugggaauguuggcuggcacucagcucccgccuucuccuugcuccuggcuuuauucaggcagagugcccagcccaccgucacuuguucaguaccgcgcuuacuguuagcucauccccucugcagaccaccccuuccaggaggccguguaacucaccagugcccugggugcuguucagccugacugagcaaguuaacaguccaucguaaccucuuuuuccugaagagauuuccagagugaaucuuauuucuauaauagaccagcuaucugauuaaucaugccauacucaaacgacuuucuccugaaauguuuuauuuaaaagauaaaaggugagccagaggaauagcccagugauugaaaucauuuuuuccccucauuuugcagagagcacaggugucaggcuccucuuuuauuauuucuuugauaaaaguagagaucggauacucucaucugaaauccuugaaaccacuaaugucugggauuuguaaaauauuugcuuagguacaaugaaaaugacuuggaugugggucccaagucuaaacaggaaacuuggagacagauagucuuacgcacuaucucuaguaugccuacgucuuuugaagucacguguggaauuucucaugugugacagugccaaguuggcacucagaaaggucuuagaacauuuggacuuuuagacugaggggacucagcaucugcuguuuguagugcagaguccagggcagaccccgggcuguuguugugaaucguuuguauguugucuucucugccauucugucaccagcuggagcaggacagggggugcauaggacagagcuuucccuccccgguugccacagaggaacuguaaacaauuaagauucuuuuugggcuggugagauggcucaguggguaagagcacccgacugcucuuccgaaggucggaaguucaaaucccagcaaccacaugguggcucacaaccacccguaaugagauccgaugcccucuucuggugcgucugaagacagcuacaguguacuuuacauauaauaaauaaauaaauaaaucuuuaaaaaaaaaaaaaaaaagauucuucuugauaauucauccuaaugaaaauacugaacugaagaguucuacacguuuauaauccccaagcuugagcugucugucucaguguaagaucacacauugucucugccaccuuuuuaauuccuugauuguguuuaaagcaccauuuuuuucucaguacuuaaguauuucuacucugugugucacuaaaacaaaaugugcccaggaguauguaguuucuugaauuuugugcauauauacauauaaaaacauguauguauauauguauguauauauauguguguguauauguauauguauguauguguguguguguguguguguguguguguguguguguguguguauauauaugcaugcuuguguggauauguauacaugagggcauaugccugugcaguucagcagaaggugucugguuauaggcacuugagagccaccugauaugaguauugggaacaaaccugggcccucuguaagaacaguaugcgucuucacugcugagcuaucucucucaaguuacugugaugaaauagaccugaagccuuugaaauaugucuccugcuuuugagacaacauaggauugacagguugguuggcagaccgcaucauuuuauccauuggcccagucaucacuggaggggaauuuugucucaacuggcauuaaggaugcccucacguuucccuuaguccucugcuuggaagagguggaaaaauucauaguaaaguugguucccuguccugccaauuagugccacuuacgugacuguauuagacagcaaaaagaaucuuugaaccagggcuggaaagauggcucagaaguuacacaagcacacacugcucuguuguuguuguuguuguuguuguuguuguuguuguuuugagaaaggaucucauaugcccuggaauuccccuguagaccaggcuagccuaaaacugagagauucagccuuccgaguucugggagugaagguguuugucacugugccccgcugucacugcucucccagaggacccacaaucugguuccuuucuccaaggucgaggcacacagaccuguaacucuacccccauggggucugaagccucaggcaccacauucagguucacagacagacaugcacauaauuagcuauacauuuuuuuaaauauuguauuaccaaauuggaaaaauagaauuucaggaauuuuucaccuuguaccagaagcaaagacaaaaaugagaauaagaccccaugacagcaaaacccaaauuucuagcaaugagcucuuuaucauuacaaugaaaacuccucuucccggaggcaaagagagacagagacagagagagcaggaauggauuuucucauggguccuuuguagaagauagagagacagcucugcgguuaagaucacuuguugcucuugcaaaggaaccagguuggguucccagaacccaaauggugguugucaaccaucccugacuccaguuccaagggacccaaugccuuccuuugaccuccacagguaccaggcacauacaggguccauauacacacaugcagcaaaacacucauacaaauaaaauaaacaaauacuuaacauuuuaaauaaagugucucuguacugauguacaguagguaguuaguugauaacccguugaauggaaucaacauuucucuugcccugcugcucggucaugugugguugacacggucuaguguauaguagcuuugaggaguagaaaauaacugaguauuugggaagugcagacuagucacucuaaggacuguuuuuccugccccaggcauucagagucaggcaccaaaagcaggucagaggguaagcuucgguggggagugggaacugagggcguuuguuagugcugcgucuccccguuguuuuaaagacaggcacgaccccaaauuuugauguccugacaucccuguuguggcuuucagauggagcgugguaggcuggaaagguuguucaucucgguggguaaucugucuccguuugugcaauuuagcuguuaauccauacacagauucaucgugugucuccuaaugguguagaucagcccggccuucuccugguccaccuguaaggcucagaggagaauaucccccaaucuugugcccccaccgaggugcagaagugcauaaggguuugcacuagaagauggaguuggcuaccugggugguuugagaacugauuuuuacugcuguuuccuagggacacagcagggcaggagcgauuuaacagcauuaccucagccuauuacagaagugccaaggggaucauacucguauaugacaucaccaagaaggagacguucgaugacuugccaaaguggaugaagaugauugacaagguaagcaucgccuucccuguuguggccuucagccugugcgcaucucacuguuaaagggaauagagcacucagcauccauaguggaccgaacgccaucuaagccguacuguagccucgcuacggauggggcacuggggaaauacauuauccagcaugcaacgagagcaggcuuucauuccggucccaaggacugccugacuucaaaacccauccucacuccuuuugcucugucugccgcuuccucagaguuacacuaaaacaggaaagguugcguggacacccgugggugguccaggguucuagucguccucagcaugguggaacgucuuucagguccuccuuuugagcaagacauuuccuucagcugaauguugaguucuuacucaauuuugagugaagaaaaucuaguaucuucaugguaaugugaauuguguuuugcucuaggaaaugcgugcagcaaaugcaccuuuagaagucagcagcuggaacugagaugugacucuguguauacaguugaccacaguuucagagguuuuugucuccaauuccuuuacguuacaagcacauaacaaaacaggggguguaauugacuugagaccugacugugucuguaugucuuauagcuucuggaaaaagguucucgucugguuuuacaaguuuucagugugcguaugucuucacuguauguuagggugugagaaauaggagcgccaggcauggcggcaagcgccuuuaauuucagcacucuggaagcagaggugggcagaucuccaagaauuugggacaagccuggucuaccugacaaguuccaggccagccagggcgacacagagaaucucaguaacugaaaacacuggagcagagacaggccucuccuuccaccugcucugccggcagggugggugugaacaggaagaccucagucccagcgcaccucccguggauagguuuagggauauuuaugggauaaagaugcagauggucgaggguguggggaaaugauuggagggacucaguggucugcucugcgacgcuucagcugcaguggcaaugguuaacucuugaggcacucauccgauggggacgaugacgucaaaagcccauccaucagauuuguacauaggcccaagucaagagucaggguuuuuaaaaaagaagaaaaaaaaacccuucacaucucugggaaaaaaaaaaaaaaaaguggccagguaaccaucauccuggggcuggugagagggcgugguugguaaagauguuuacugcuaagcugcugguuguccucugaccuccacaucauauaugccguacagcacacaugcacacacaacacaaauguaacaaaaagaaaauccucccugguuaccccucaacugagaguucugccugccuccgccucugccuccgccuccgccuccgccuccgccuccgccuccgccuccgccucccccccugccuccgccucugccuccgccucugccucccccuccuaagugcugggaucaaagguguacacaaccaaggccauuaagaccuaucauuucuggacuguucgcccugggccaggcugucccaucugccagccagucaggccggcgcuccugcucccucccacccccucaccuagccuccagaguacuucggcuguggucccuagauuccucccauguagucacuucaaaugauguuuuagaaguacacagaagggaauuauucaagagauacuaacauuguuuaaagagagaaaucuguuguaccuacuuuuuuuacguucuugcagauaucgcuuaaucuuucugaguguagcgauuacccuaacuucauuauagcccggauacaucaccaguuuuucuccaggagggccuuccugugucgcuugguguuccagggcagaagggaggggccuugcuuguuuguaugugcugugcuucacucuacccaauuuuugauuuuuugauuuuuuuuuucaguucuugacaucguugugccugucauuuuuaaucauuuccuuaacagucuuaagaguggccaacaccaaggccauggucauucuugaugccccucagaagguacuuucuaaaccacugugagcccuguccacccccaggagacagugggagagaaggaacaagaaguaacgggugacaagcccugaguuugcguuuugucugucagugcauaacgucuuuaaaaacaucccacaguaugcuucagaagacgccgagcuccuccugguuggaaauaagcuggacugugagacagacagagaaaucucaaggcagcaaggagaaaaggugcgugagugggggcucucccaagcagcacccgcaaucugcagcguguccacucacugucccucgcgugcugccagaggaccgugggugccacacagcagugcccagucacacccuucccauuauucauucuuuguguucauuuugaagcagaaggcaaaagcacauuaauauauauacuguaucauuauguaaguugguguuuuauacggaacaaguguuugggguuguaaaauuugcuuucaugauauuuuucucuccugccuuagcuuuugcuaagaauacaaucauggcgacacaugguauauuuuaagugucagauacauuguacguuuagacucuuacacacauaaugggauuuaaaggucucaagagaucuguuauauacauugcuguuuacuuaaggaauuugcugucccugugaacgugauauuugagcauaaauggggcuuuucagauccuaagcaccuuccccccacggggucuguggucuugucagagguccagccugacacacccacaccggcgugggcggcaccuuacaguuaaagcaagcacaugucuucuuaguuugcacagcagauaaccgggaugcgcuucugcgaagccagugccaaggacaauuucaauguggacgagaucuuucugaaacuuguugaugauauucugaaaaagguaaaaaagaaaaaaaugggugggugggucgguggguggguggauggauggauggauggaugcaccugcucagcuagcuccgugcuagcuguugcuaguacaugggcuuguggaguccucaggguugauaggcauucuguuggcuuugccuugugauagaacguucuauggugacuuagacaaggacuagugacuguaagaagaugaguguggcucagugguagagcuuuugccuagcauccuugaggcccuggauucugggcaguacuguguacauagauagacuggggcugagaguguagugccgugaagagucacaaggcccuggguuccgucuccggcacuagagguggauaaaguuccauguuuauucaacacuuccuuuucuuuucuuugucucuuccuucccauaagaguuaaguuuaacauggaagccuagaacagcacgcagccuugcuggcuuagagaaaagccgccaccacuugcuucccucaugcccucucuucagaggaugcugggcagccugacugaacagcaaccgucucuauagagacgguuccagccacuaguuaauguucaccagaaaggugacucuaggcacccugaaaccgauggcuuacaguguaaaacagccacagugcacuuaaugacagcuguggauguucguuacagacaguuauuuuuuuccaggcauuuuuccucagcguuucauuaaaucgggcaguguagaaucuucaguacagagugcggcuaagcacuaacugaacaugucacuaaggccccgggaggaccagcccauagagccucacgggugugacgugauucagaaguuucuaaugaaccuggggguuuuuuuuuuguuuuguuuuuugauuuuuuguuuuguuuuguuuuuuuuccgagauaggguuucucuguguagcccuggcugcccuggaacucgaacucacucuguagaccaggcuggccucgaacucagaaauccgccugccucugccuccccaguguugggauuaaaggcaugugccaccacgcccggccaugaaccugguuuuuauguaccugguggagguugcuucuuccuuuagacaauggaccaguuuuccacuaguaacauguuaaauuuucauuauaguagacucugugcaagaaaauggugguuuuuaucgaauugcuaggaaccaagccuuggggcuuuucgcacauacugggcaaacacuccucaccaggcugcuucccagccucuuccaaagagccuuauaaacaauacuuccaagacugaagagauggcucagugguuaauaacacuggcuguucuuccagaggacccagguucgauucccagcacccacccagcauuucacaaccgucuguaacuucagcucccagagauccaacacccuauccuggcuuccuuggguaacgggccuguggcacaaaggcaacacacccgugcacacggaaugaaagguuuacaguuuaauacaauccugccguuugcaggacugaagugugucugugcucucuucuuguccuccagaugccucuugauguuuugagaaacgaguuauccaauagcauccuuucucuacaaccagagccugagaucccaccagagcugccuccucccagaccacacguccgaugcuguugauuugauacuuuggagauggugcaagcgauuccuagaagggggaaacguucuguucugcacuacaaucacgugacaauuuccuuucgcacuuuguaacccaagucagcuauacacuaacuuguaaauaugcaaauaugcaauccuggguaaggucggguuauauaaguuacacacuucccuucaaauuauauuuccucauuaccccagugucuaguguacgcacacugggaggcguaguacuucuaauacgaagacugggagagaagaaagauguaauauuuccugaguacuauaaauguccuuguuaauuacacuacaaggcagacgcuccgaugagaagagaggaccuggugcuucgcuugcuguuucaacgaaaaucuacaaaacugaaguuuuuugaaaaggaagacaugacagccaccuuuucuuuauuuaugggcuuuccccacacggcaccucaagguuuggagugucucugcaccaaagcagagcucccucacggccacagugagagcacacaugggccauguagugagaggguuccuggauaggggacuggacuuagucccgaggcugcagaacccuggguguuucccguuggcugugaccugcuuuuaagaaugaaaagguucaauagagaaagaacggaagggcugggauugcagcucagcauuugagcaucuguccagcguacgugaggcucuggcuucaauccccgucaucgcaaggaaagaaagaaaaagaagcguuuuugaaacuauagaaaagauuuuaaaaucacacugcuguccuacacaaauccuguuuaaagggauuuuaagaguuaccuuuuaguauaucaaagaauacacaugcauuugccuaaacauccuguaucuuuguaaugacaaacuucuccccuugauggugaggcuuauuccuauuaagccuagacuguguucuuuaaguuuucuugguccccacccccccuugaggguuuuuuuuuuuccuggucugauaaggaauuugugaacucuaucuuugguauaucuuuuauuaagcugcacuguuuuguuuagucaagguaaauaaguauguauuugaauaacuuggcguguccugaguguugugcuaugagaagcaucauggucuuucuacacuaaugaagugcaaauaaaauuuuguauuuaugaaugacagu

SEQ ID NO: 8712 - RNA, 1294 nt, Mus musculus
cugaggagggaagcagcagcugcaggagauucgacacaugcucguaaccuacugacgauaugaacuugggacucuggcauguuuacacugaccucaggagucuugauguuguuggugcuauuacauaaaauucacccuauaaccaauuuaaaagcacaguucagcgguacaaggauggccacauugcuguguggcacugcuaccaaaauccauuuccuaggacugugucaucauuggugccccagguuuuccuuugaaugugauuccuucaguugccuccuguagaggaaugacgugcguguguccuucuguaacagccuucaguuagugacugccuucaagucuaauccacacugugguaagucucaguauucagccuuuuaaaaccgacuaaccuugcuucauauguauaugcaauguguuguuuauccauccauucagucacaggaaccugacagucuccauggauagagaugaccaaugaugcugccauuggccucaaacauuuuagcuuugacuuagauugcaauccuuaugcucuuuuccuucucaacuacuccuccucucgccuguguguacauguguguuguuuuccuggaauuuaccugaaagaaaggaaugcacauaccucagcagaaggccugccuggaacauggaacguggauugguaugcagcaguuguuggagaaaguuuggauaaaacuguuguucagggucggacucuggccaaagcuaccagugaucaaaaaugaaggcacuggagaaugacccuugauugagaaaggagcauccccaguccucagguuucuuuccccuucaugucccuaaucucugugcccaaaaggagcaucauacucccuacuccuuuggagaaucugugaaauggaggcauccagcugcauagugguguugaucaaaccagacgagaucacagacucacagaucaaacccaagagaucacagccucacauauuuuagccaaggcucuaauaggaaaacuguuggucuucaaauuuuuguagaagugaaugaucuagaacacaguugagcacacugucuaaagaugaccuucagagauucucauagaggcuaaaaauaggcuuguguggaugcuuacacaucuuuguaaacgggagagggucaaaccuggauucucaagugggguggugucuuagucaggguuucuauuccugcaagaccaagaagcaaguuggggaggaagggguuuauucggcuuacauuuccauacugcuguugaucaccaaaggaugcaggacuggaaccaagcagguca

SEQ ID NO: 8713 - RNA, 6772 nt, Mus musculus
gcagaucauccaagaaaucaaaaugacaugauucuuaagggcagccacuacccacuuaccaugagcacugacgcggguuguccuucaugaauuacccaugagccgcccggauguguguguguuuacacagacuugcugccgauucauuaaguuggugcagggcaccugcuuccacccuuuccuacccucaagcacucagcguuagggggcuuuaauugccuccgcuggagccacagggaggccuucccugucgcugcaccuggcauagaacacugagaugcgucccucuucuccaguggggacccaggcacaccugccaggaccugucauuaucugaaaucccugggucacuaucaugcauccucuuucagcuccucuuucagcccgugcaucugagaagggacccucugucaguuucccuggcaccugccaauagcugcgcaccuggcgguuaaauggugcuggaauguguugugauugucgucccugcuuaaugaacccaccugagggacaguuagugucuuacccagcuuccuguuucccaggcauccccguuuacacuguuuguguggagauuuaaaaaaaaaaaaaaaaaaaaaaaaaaacgcugccaugguguugaacuaauccaucugccagaagucucauaaccaaaucugcagggcucccagaggagauuuuugcaccgguaauuuaagcuaaugauuucuaaacauauuuagucaguuuuuaugaagaccucauuagaaugugacuguuuauuaaaaauccaaaugagaucucacagugauuuagggaaauucuuguugagucacuaaauaguugugguaacagaugacaaaaugucugagaacuaaggaaaguagggaacacagauguuaacuucuguuguaaaugaagaggggaggagacuacaccgggaagaauuucaucugcccaaagaagccgaccucaaauuccuuccauaguauuucucccugaaagaauaggaaguaaaaaaaaaaaaaaaaguuuaauacaaacacuggaugucagaauuaguuuacuaauaaagaggguagauuagaauucaggugcccauguuccauaggaaaaaaaaaaaagaacaucccguuuucaucaguagccuccaagcccagaagcaaugggaagcucaagagagaagguuauauacuucccaaugcaugggcguaacucgcuuacaagaacggcccugguaacccuuacaaguacaaaauggcgagaccucaucacuacacaaacuugacguguuugaaaauacugauccgucucaucugugaggaaggagaagauguuuuccugcgcacuccuggcauccuugucugaagcuuucucacaguuuccacagauuuuuuuuuaaugaaccacauuauuucuuauugaaaaaaaaaagucuuuuucauacaauacauucugauaaugcuuucccuuuuccaacccagauccuucuacccgccccguccauucagccccuucuuuuuuaaacaggcagacaaaacacacaaacaaaaaccaaaggggaaaauaugagaaacacacaaacacaccaacacaccaacaacaacaacagcacaaaacugggaaucauaaucuacaagcaaaagaccaauaaaaaaaaaguauacaaacaaagcaacaugggacaaagcgucuacaaggauaucauugaguucccuugguguuagccaucuaaugcugguauggggccugcccauaacuauguucaauauacccagugagacuucauuggagaaaacuaaauuucccuuugcaugugaccgccaauugcagacagauuuuuuuuucccuuagggaggggacuaugugucucucuccccuucucagcccugacaccaucuggcuugaaccugugcaggucuagugugcucugccacaguucccgugaguucauaugugcaucagcccugcugugucugaaagacguuguuuucucagaaccuaccaucaccucugguccuuacagucuaucuacccgccucuucugccuagaucccugagcucuuggggagugggggugguauuuagaaauaucccacuuaggacugagugcuccaaagucucucacucccuacacauugcccaguugugaggacucugcguccauucccagcuacugcaagaagcuucucuaaugauggcugggcgagacacugaccuaugagauuaggagaaugucauuaggagucauuuuauugcuauguuccugaacagugguacuugguuuuccucuaggcccauggccuauccacucucagguucuuggcuguccaacaagggucaggcaugguuccaucucauggaauccaagcugagugugauugguuacccccucauugagccacuauugcaccagaaugucgugcauucgggucacuguuguagaucacggcauuuauaacuagguugauagcucccuuucuucucagauagcaugcagaguaccuuccaguaagucuuggucaauaaaugcuagucuguuggggugaaggcuauagguaggcagcagaucaacgucucuguguucagugagauguuuaagugugaagaauagggcuucaccacaguuuauagacagcaacuauuguugaagugcuuaaucucaauccaggguuucugcccugccuuggcuauuuaguucugggguaaaagacacacacacaaccuuuaugguuacaauaaaccuuaaucaacacaagaccugggcagauagcuauccucuaugcuauuaugucuauuuuccagccaaugaccucauuauacaauuugccauguuuugucugggcugcucuaaacuccaauuagccaauucacaugaccauuauuuuaagauucuuaacccauggcacuuucuccucucuucaccuucuuuuuuccccuccuugugguucucuccaacccuaagcccccaagccccagaacccuaaaccccaccuacgucucuucuguccagcuauuggcugucagcauuuuuauucaccaaucagggauaacuuggggcgggcaggaucacauagcaucauccgagucuauguacagucucuaggagcaaccaguguuuagcauagcaaaagacaaccucaacacaucauuuuuaaagauuauuuguggccugagugauuucagucuuagccuuugguuaaucucuguacuuucaagggauacccaucuccauuuauaucuaccgcaaacauuucacuuaucacaugacugagccagauucaagucuuaccucucacccgugcuugacagcugaguuucucacagcucacugaccaucucccucaaacaaaacaccgcaaucuaagcaugucguucagucuaaggcugcuucucacuaugacauccucucgugucauucaauucugagaacaaacuuuguuuuguacuugcuccaguucgaugucaagccaugugaauaccaauaugaauggcucauuuaccuucugucgucauggcaccgccacaguagcuuccaaccacagucuuucacaguagccacagcagcaacacacuugcggcccaccccggcauuggcauguuuguuuucauuuuuuggguuuuguuuuuuuuuuuuuuuuaauaaaaauggcucuuaaccuucugcucaaaaucccuuagggauuucuuuuuacacugaauagagccuaaaugagcuuaucuuguucucuaugccuguuucaauauggucuccaauuuacacauccaacuuuaucccuaccagccguaccuaaagugucccccuaauugcccauggguugaaagcuuacucuccaggauggcgcaauuggaaaucaguggaagcauaaagaaguagggaccuccuaagaaaucugcuaguuauugaggacguguccuugagggacuauuaggacuguggcccuuucuucucccuuuggccuccauaccacggggugacugggauuucuuuaccacauaugguggccaugauggccugccucaauauaguucuaagacaaucaagacaacuugaagccuccaaacuauaagccaaaauaaacccauucauuguaagucagauguauuuuguuauaguauuuaaacauauauacucacacacccauacacacacacccaaaaauuucugcuugccaaauaugccucacauaagaaaaaccuuugacuguaauggaaauggaauuuucugauuguacuaucccacccagaugccccaguggaauggaauaugaguucuuagaaugucacuaguauaaacaaauuuaauuuuaauuaauuuauauuaauucagauuucaauaaccauaugugacuaguagcuuuuuuuggacuaugaugagacauuucuuucaucuuccugcuuaaauaugacccuucuuuuauuaauaauuuauuauaguacccuuucuaggagagaaacaaugaaaggggugauuggagucugccuauguagcccaugcuagccugaagcauauggcucuccugccucgcccucccauguacugugaugaugagcagcgagccuuucaugacucuuccgugccuauucuauuucucccacugucauccucuuucaugucacuugccauucugucccagagugugacuuuuagcucagcccuuucuaguuuauagagagucucucccagugcccaucacaauaccuguagaauucaaaaacccucauccauaaagaaaacacaggauagcacacagacauguauauuuugcuggauuaucaugagaaucaauauaugaggugaauaucuauugguccuuuccccguggucacaagcugacuuucucagucuuuucuguacaaaccacccacuggguccuuccauugcggcccauggaaacaaacaagucagagaucccuucccccagacuccggcagcagagagagcaucuccaugcucaggauaguagaguugauuccuuucuccugauuacagagauuacaaguuauuuacuucuaccgcuaugaauauuuguucuucaugccccaaacuauuauaacuaaaaaugagagaagguaucagcaguguccucucacaguaacuuucuaagcacugcuguccuccaagucaacucccacaaaacaaucaccagggaaggagacacccaguguuacugagccauucuguggacagcaauuaagggacuugguggccucuaugaaaauauagaauauaugaaaaauaaaucccucgucgcaccacugaacuaugaggagggcucuaccuaaagaacucaguucccuuaugagaaucuaaaacaucacagaauaucagccaagaggacgaauuugucuaauuuacaaauuaaucuagggccaggccugcuaacccuucuuaguguguacuuaauuggucauuuaaugauaguuacugaauucauagcaccaagaaguagaaagauauguauaauucccucaucuucauagcacaccagauguauuagaaacccaaguauaacaaacaauuaacugugauagacuuaagucagaaugugauugugccaauaagauaggcucugcauauggaauacaggacuuggagguggccucaagaggcugaacccucccaggaguaacaacuuccauuggcaagaauaggacacaaaucguuuuugcaaauaggauggaaagccacagaaaggagaauugguggcaggaggagaaagccacggccuggugcaucugucuuagcauggaauggagacucugauccuugaaucuaguucagagcuuguugaaaugggucugcaauggagagcgguaaaaggagaaugucugucuuacuggaagucgucgaaguagugaaucaguuguucugguuagcguugcagaaacacaguuccgacuagacacaguagaguacacuuguugucccggcuacucaggcaggaggauccaugaccagccagaauaacauagccaggaagaaggugauaagggagggaggaagacaaggaaaacgguggcugugguaaucucggaaaagcagcuggagaggggccaugggcucuucacuagagagcaggcucagcaagaagcugguguggcuagugauagcguguuuaugggagaucacagucugaauauuauugggaaugggcaucauuaaggaaaggugagaaguuggauaugagccuggaucuuuggcuuugugucuuggacuguuaaugugaaggcuaauaaccaaguaccuagcaaaucccuuccuaccucaccccauccuccaagaaagggcuggagauuuaaggaaauggcugaauggcuguuuaacauguggaguuugagaagacgagugaaagacagacacgaggaagucucaggaaagaggugaacugaagguauugcaaaaucuggggucuccuuuucauuugccaccaucugcugugccuucucuacccucagcuuuaagccagacaugaauaucaagaugagcagacaaggcacgaucuaagaagugucaaaacaacgauuauacuaaugaguacacgagugaacacgcacacauauguggguggcuguguucagugaucggaugcuauauuagucuguuuuuuucauuacuauaauaaagucccuggggaaucuaccuuacaaagcaaagaggcugauuaaaccucauagcucuggagucuaaucaucucaacaacacuguucagggucuugcaaagacccccuuggcuucaccacaucaugguggugugggaagccguugcagaguggcaguugcaaaguggca

SEQ ID NO: 8714 - RNA, 2623 nt, Mus musculus
agcacauucagagcuguaguugcuaaagaacuuaacaaaacuucaaauuuuaauccuugaaucuagcagccuccaaaaauauaaaucuccuucuauacaaaacaaagccagugacuauuauuaggcuuacauuuuauuuguuaugaaugaggaaauuauccaccguaugcuccacuuguucauacaagaccucacuuguaaauuagagggagguaacuuuuuuaaugucuuggcaaaauaccauguaauuagaacacaaguuuauauacugauuucauauugauauuguaagaggguuuuugcuuuaaguccuucagcuuggaaaauuuaaaaauucauuguuuugaguagcccacaaugacuaaaaaucaguagcggacaugucuguguggaccaagcacuugaucuugaccccagcucuucugauggacaggcugugaccucaaaagcuuacugggcucuuggaugugcccagcuucaguaagugcacagggaacaaauggcagccaaguguagugauggguuuugggcacucggccaccguuauguaacaucacgguccugugccacaaggaguucacauccuugcucaaggcuucgcuucugaagauauauucucuccaauacaccuaaguuauuaagacuucucuauacaauaaaucugucucugucccuaacaacuggguaauaaauuuagacuacuaauuacuuuucugaauuuugcuuauauaacaguucuuaacauuuacugaaauuuuugugugccaagaauuguucuaaguccuuuaaguauauuaguuuauuuagcccucccuugaauaauuaauccuaugagucaaaugcuauuauuauugcuauuuaacagacugagaaacccaggcaguguuauguaagaccuggaagucacacuuugggccacuguacucuacugauuacacauuggauuuuuuuuaaaaccuaaaauuauucugggagagaaaaaaaaaagaagcccauaugaaauaaguguacauagcauugauaucguuggaaaugaaacuaaugaaguguucauagcacugcccaugugccaaaccugauacgagcacuuccuagguagauuaagccauuuugucaguaccuggucucugugagguaggucccgcuuuaauuccuacuguauagcaagagagacugagaggagagucugagcaguucaauggagacccccucacucaguacagggcagaaguucaaaggaagagggaacaaaccugcugucacugcaaacagcucagcaccuuucucccaccauugcugcucugcccugaacagguugauguggucuuucuaaaucuccaaagcuguguuuauuauacauaaaagguggggaauucuauggucuggaaaguccaaguauccuuacugauuggguccagagaucucugaaaacuuacauaaaugcauaccuaugccauuugcugcauucaaacacaagcauugguuuucuaucugacuggauccuagcauuucucugcacaucuguaugaguggcccugcaaggacaucuaauaggaaguaaagaaagaaaaaaaaagauugaaauagucuccagaauuucuaaucacaucccaucauucaccagcaggucuaaaucuuuguaaaucuuuguaaaaccuuuacaacugaccauaucuaaagcccugggcaagcccuccauccuuugacuucaggcuguuucucuguggucaggaaguagagcugccacgcagguucauugaucuuauauaugaagcugggagauaaauacauggaccucaguaaauaguaagaaaaaauuagcauggcuauugcagauuuguucucuauaguuguuaaggcugugaaucaccacaggacauacagaguagcacuugauauugagcuagguuagguugcuuaaggauuuaacuucaggaggccucuauaugaaauuaacaugggcaauuaguguuuauguaaaaugauccaaauaauuaacccaucaguaugaguaacugcagucagucagucauuuaggcugaauuuucugguuugcaggggaauuuuuuauucugcccaucccuccuuaguuaagcuaagagagaauaacuuuauaauuuguuauauguucuggggacuggaaacagcacugaaaaauauccaggccuuuuuuuuuuuuuuuuuuuuuuuuuuuuuuugguuaacuuuuaaauaacauacucucuaacaguagaaugaaugaagauacaaugaugggggagggguguuguacuuguuugucucucucaucuguuagaaacucacuuuugcuuuauagaaaagcucaauaaauuaauccagagacucaaguuauuagcuuaguguguauaguuugaggaaacauuagguccauuuaaauuucauuacagaaaguuauauggaaguuuauggagcauaucuuuugcuaaguuguguguacaaauauaagauuguauccagcauaaacccaauacccugaauuuaaguuaagcucuuagagcugaaggggaucacaaagauuacaucguucaccagaggcccaaaaggauuaagagauuugucuguguuucugcagauaaugaauaaccaccccagauugcagaag

SEQ ID NO: 8715 - RNA, 1122 nt, Mus musculus
aggggcagauugagaagcagcguacagaggagcagacgaccagagacguuaagggacuaagcuccaugugacaugcaugagucucuguguaaagugauucacuagcaguguuaugggcuacacaaagggcuugcagaauggguaucagggaaaaguguucaaugaucauauaagaguucggaggcauuaggagcuccugccgggugcaugagggugaggggugaccucucgggggcaacugacgacggcuccucuuuccuaaggcuuugaggugugucagaagcagccauaaaggaacgugcacccuuuauccucguauuugaguuaauuaccaaugguacacaagcucugcagacaccaaccaguguagggagccucucuguucccaccaaugagcagcuagaacuggagagaagaguaggguugggucgucuaaaggcuggaugggggagcugaguuagaaagaagaugacuaccagauccagcugugcuuggauaagggggggaagagcuccaggguucuguagcucagucagugcguagcguugacacggaaucucacauuucaaaacaccgagcaggaacgauuuagaauauccccagcauugagucacgagccugacucaggagacaaguaucccaaacgaucccuaaucggauggacacaucuacagcaugcuccagaaauauguacaauuauuaugugaccauaaacacuuugaauauuuuuuaaaaagagaagaaaaauuccuccugaucuuccauggagagugagcugacucucuccauccccuggccugguuguucugcucuuagagacguuagaugcagugcuaaaggacggaguuuagucaacagccacaguacuuacuaggaccuccagacaacagccguuuuuccaacacccccccccccccgcccccgaggaacaacagaaucaaacacaaagcuggggaaggcaauuuucagugcauuucccaauuaccccaguuaccugcgcagacaagaaaaagaucagcaguaauccuagcucccaugcccgguguauuugauucccucaccuuggugccucgccacauaaauaacuuuugcuguuaauaucaacacgcugguuguucugcg

SEQ ID NO: 8716 - RNA, 2055 nt, Mus musculus
caguuucauaccuaggagaagcugaugaucgcuuagugaacugaugcuuucgguaaacacacuuacuucuccuacaccgagaagcgcccauaaacacucaugccuucuucucauuaaugcgaaagugagaccugaggagacugcuguuuaaaugggaggucggaaguugagagagcaagucaggacauacguuccucuggcauauaauccugggcuuuuauuuaauuuaauguuuuuuauuuuaaccguaacugguuauuucaauuaauucuaaaucguuggcuccuuuuuuuucuuaagugagagaagcccccuucucaguaaaacuuucccauauaagaaaacugacuuuaaaugacacaguggggacagcuaugucaccccagggcccuuacuuugccuguguagugaccauuuggccacccccuagagagcauccugcuaucucucuuucaaaauaaauuguuucuggaaagugcccuccuuaucaagauccuuuuacugugagauacuugcccaagaagcugugaucgaguggaaaauuaaaacucccaacuguugugugagagaaagccuuuacacaaucguguauaugcauuccuaaguccuugcagagaaaauaagaaucaaauuacauccauuguaugacauuuucuuccccuccuuugaacacugcuugcuuaucaccagggccaguaucccgucaucacuguauucacgacaaagccaguccaucugaaaagagaagagcuggacacccauuccaguuacuuugaagaagauuucuuuuuagguagaauaaauaaaaguagugucaccagagucucccugugccauugaacacugguucuauugcuuaaguaccaggagacagaguuucacauuuguugacuuagucauuaucgucuuuguguuaucuggaacagcacugaccaaccaaggaaagggcuccauuaauaaaguacuuacugugcgauccugaggaagggaauuugauucuccaaaaugcucucuaaagccagauguggcggccgugucccugccacgaaaagagccagaaaccacugaguacacagaaacuccagagccaccuggguuggaauacgcagcaguaaacaacaagagacccugccucaaacgugauagaagacaagaacuaaaacccauacaugccgugacacuugugugccucuaucacguacaaauacacaugugcaugugcguacacgcacaacaagcaugagcaaacacacuuuaaaaaaaaaaagucacucuccaguuaugccauuauaaauuuaaugguaauuuucaaaucuggaauguucuauuucuguuaucucuuuuggauacgauuuucuggcucuaaaaauguuagacacuggcucgaguuauaaauacauaaagcaaaacaaacaggcaccaaaccaaaacaaagaaaaacaaaagccaagcuucuuuuuccaugcugauacuggaggaagugguagauaguugguagccuuucugaaugauaauuugggcaauaggagauguuaauaaacacagacuuuaaaagucaaagccauaagacugauuaaaaccuguuauuccugaaucuucgggaaggguguugaguuaguaaucgaaggagauggugcucagaccgcucugaauguucccuagauagccaugccuucugugugcaagcagacaguggagacagcccagaaaggccuuuucaacauaacccaauagaaacaucccuuuguagcuaaaaggcggucagagcuggcgcuugugacuacucucacucucugcuaaagugugcaggaguuccauauuguugcguuaaaucucuccaacccagauaugccccgcaaugaaaacacaacucaauuaauaugaauacaugcugugagccuacauugggcagaucucccacuacucgaccaucucuuccaucuaugagaccccuuagaacuugcaguuucuccagaccaugugcuucugcucugcuuuucuucuuccuccuccucugaguccucucccucuuccauuuucuccuucucucccucu

SEQ ID NO: 8717 - RNA, 8370 nt, Mus musculus
caggccagggcucuccgcgggcggccccguagacccagggaaagcaaccacccgucaggucccagauuaacccuuuccucgcucgcucacgagggaggccccagccaguuccgugccugcgcaagcggcggcgcgccuucucucccccccacuaccccggagcccgcaccgcgcaugcacggggaggggggugguggggguguucgcggcggguuggcuagugugugcucgugcaggaggagggcugccaccaccagggacgugcacgauucccccccuaccccacccccuccccaaacucagaaaaaaaaaaauuaaaaaaaaauccaaaacacugccacccaccgugcccccgcguccaucccgucccuggcuugcgcgcugccgagcgagggagcccacagcgacagcgagcgucuguagcggugccaagcugcagguaagcgcgggccgggugcuggaagggccggggacgggcgcggggacgcgggggcagccggcggcgggcgcggccggggcggcugcgaggaggcgcguucccgccgagcuccggggcagcagccagcugcaggauguggcggcgcagcgcggugcgagcgggaucggggcgugggccgcgguugggcguggggggccgggcguccccgguggcugcgcaggccagcgagcggguggggaagaggccaggcggcggccccgcgcgcgcgcucucucuccgcggccgaguucauggccgccuggcucuccgcgccgcagugcaccgcgguggggguggggacggccgagccgggcccgagcgcggcccgcggggcgccgccccucgcagcugugguuucccccggagccgacgggaccccccgcgcacgcucccccgccugcguccgccgagcuccggggagccggccgcgcgccgcccccgcccuuggccgcgggagggcgcgggaggaccagacgcgcaggccgcggagugcgcggggcgcgagcucggggcucgcgggcggagcagggcgcggcgcggcgcggggcugcggaaccggccgcaugcccgcucccgagcucgucgcgccgccggggcugcugcgggccaaggaagagagccucgcgcccgcgccgcgaccuggagaaguggaggaugguggaagggaagguggcccgucgcuggcgggcacagcucaggggagcuuuuguuuaggagagaaugcugagggcucgcugcauccggcggcucauuggcugcgaaaugcgaaugugggcuccccacgcgcggacugcgccccaugucuuucgcggggccccggauuccccacucccaaguugugcggucgcaacagggaagugguguggccgccauugucgcagcugcuccggaauaaggaggcggcugcggcugcuuauguaaguuugcuuugggaaagccuggcucugugcucggugaggacgccuuaacgcucccgcgauuuggggagcugcuagcaaggagcugcuuuauaguauuauagguguugggcuaugucuuguccuacaccuacuuacacacauacuggcaaugguuaucuucagguuugacucauuugaacuuagcaaugggaacaucucuauagggggaaaaaaaaaccgagccgauugcccugugaccuccuuugaaaaagaauuacacacucaccagaaucgagaaggcguacgcacgcugauauguugccauagcuaccauagggccacucuucucccaaguccaugaccucagaagugccacggagggaauuucugcagggaaugccuucccuuaggcugacugccggcccagggugcaucuagaacccaggaaggcugaggugaagacuggagggagcauccuuagaaacuaucuuaccagcccucacuccgugcacaugggaaagccugcuaacucagagcccugugauuccuauaguaugaacuuguuauggguucucaggaugucgacccuuugguggaaucucggacaaagucauuguguaggacuguauuguaacacggccaccugcuucuacugcacuugugggauugguggucaguagaggaaauuuuuguucuucaaagccuguugggcugcaggauguggaguucuuugggugagaguuaagaacgaaagaaaauucuuugaaccugcauccggggauggagggagaaaaauguaagauuucuccauggcagucuuggagacaaguuuguaauuguguaguagacaaaguggcaugcuuauuucuccacucuuuagcuguuggguauguguguuccugcagccguccgauauucaaacaugcaucuagaugucuauaguucuuaaaggaaaaugugcacccaacaggaagugguguggauaaagaacauauaugugcugauguuuucaagaauauauaccacggacuacuccgggucuaguccuuacauagaaccagaccugacuacuguuagccucacagugucuccccaaaaaacgguucauaggcaagaggugggacagaguguuuugugacucuuguaaauacuugguuuaggauuuaauguagaaaaaaaaaaucuuacuuaaucugugccuuucuuccuguagaucuggcuugccccugaucagccugagucugaucugaagauuuugguguuuaaggcauuaagaacauagccugaauuguucauggugaguguaccuuagaguaguaagccucagacuaucaucuggcauuugauuuuaacauaaguaucucgggucuagggguaucaguaagggcuaaaucuacguccucgguuuaagcaagucccugauccccaguguguacacauacacacauucuacacauacguuuguaauucuacuuccaugaggaaaaaccuguuuucuucagacuuaaacuggguugaauaaaaguaagaccauguuguuuuuacauaaaacacaguauuuuucgauaagcucuugaacucgcaguggaaggccuucuguggugguucugaaauuacuuuguuuuaaaaauaugucuauacuuaaccaaguacagguugaaccuaaguccaaaauguucaaacucugaagcuuuuugaagggcaauaagaagccauagaugaaaauucugugcuaugaaguuuuguugagaauauuauuugagaaaacaaaauaaacaaaagaauauuauuugaggcaggcaagaggaaagaucucugaguucaaggccagccuggucuacagauccaguuccaagacagccaggguuacccagagaaacccugucucgaaaaagaaguauuuuuugaaauaguauauaaauuaccuucaugcuguauguguaagguauauauaaaauaacaacuaguuuuggaguugggcuuggccuaccaucuucaauuuaucucauuauguguaugcacguauugcaaaaccuggaggaaaaaaaaucuaaaacuugaaacacuucuggucccgagcauuucagagaaaggacacucaaccuguacaucuguugacuuuuaacuggauggcuggaagucuggcauccuaugagcauaaagccacucaucacugucuucccagaggucuugggggucagauuacaccuagaaacucauccaggaguggcucaaaacuacuauggagaaacuagaggccaacacagaaccauuguggcaguggugcccucucuaguucuucagugguggcuugucucuucucucaaggaaguacagugcccagcccgguguuauugucaaguccuccacaccugaagucaggucuugaggaaucuuuuuuuuuuucccugcauuugugguguauguauacacaucugcaugugugugcaugcaugcuggugcauguauguggccauucccucggagaccccaaagcuggcgagacaggcaucuucuuugauugaugucugcuuuguccacugggacaggaucucucaauucagccuggaguucacuguuuagcuagcagagccagccaccuugacaccgucucagaauuacagguggccgccaugggcuggacugagucuccauuguugggcuguuuaucugucuuaacagagugaacguuuccuggauuuaauuacuggaucuuacaagcuguaggauguugggcugcuuccuaacuucuuuuagaaauugaggacaccaccuacccaauaggacauuaacauuaagugauauuaagugaauugagccaccuaaaacuuggagaguaguacauggucuauauuuugugaaaagcugccauugucauuauaaccagggaacuauuaauaaacagaaaguaauuuaaaauugcauuauggaaaucccuugucugggguuguuuuguuuguuuguuuuguuuuguuuuuuuaccaguuugggaccaucuuuaacagacuuucuaaauuaucagguuccaaauauucacgauaugucuaaauuuugcauaggguguacuagguucauauuaaacaccuuuaaaauuuccuuugcaggaguuuuucaucaguaugucugaaaccauaaaauauaaugaugaugaucauaaaacgcuguuucugaaaacacugaacgaacagcgccuggagggagaauucugcgacaucgccaucgugguugaagauguaaaguuccgagcccaccgguguguccucgccgccugcagcacguacuuuaagaagcuuuucaagaagcuagaaguagacagcucguccgucauagagauagauuuccuccgcucugacauauuugaagaggugcugaacuacauguacaccgccaagauuuccgugaaaaaggaggacgucaacuugaugaugucguccgggcagauucucgguauccgguuuuuggauaaacuguguucucagaagcgcgaugugucuaguccggaugaaaguaacggccagucgaagaguaaguauugccucaaacuaaaccgccccaucggagacgcugcugaugcucaggacgaugauguggaagaaaucggggaccaagaugacagcccuucugaugacacgguagagggcacucccccgagucaagaggacggcaagucucccacaaccacucucaggguucaggaagcaauuuugaaagagcuggggagugaggaaguucggaaagugaacuguuacggccaggaaguggaguccauggagacucccgaauccaaagaucugggcucucagaccccucaggccuuaaccuuuaaugaugggaugagcgaaguaaaagaugaacagacuccgggcuggaccacggcggccagcgacaugaaguucgaguacuugcucuacggucaccaucgagagcagaucgccugccaggcgugugggaagacguucuccgaugaaggccggcugaggaaacaugagaagcuccacaccgcugacaggccguuugucugugagaugugcacaaaagguuucaccacccaggcccaccugaaagaacaccuaaaaauccauacaggguacaaacccuacagcugcgaggugugcggaaagucauucauccgcgccccagaccugaagaagcacgagaggguucacagcaacgaaagaccauuugcgugucacaugugugacaaagccuucaaacacaagucucaccucaaggaccacgagagaagacacagaggggaaaagccuuuuguguguggcuccugcaccaaggccuucgccaaggccucagaccugaagaggcaugagaacaauaugcacagugagaggaaacaggucacccccagugccauccagagugagacagaacaguugcaggccgcagccauggccgcugaggcugagcagcagcuggagacaauugccuguagcuagaggugauggguuaggaacacugggccugggagguggaugcuaagauugcauuggcuguagucagugaacaccuuugaccgcuuuguggcaauuuacagcguugugcuggcuggaccuaagacagugcgcacuccgguuaggugauucucaaauuucucaaggcaguuauguuccuacguucugaccaaacaguuugcuuuuuuuaucuuuugguuugugugugcgugugcgugugcguguguguguugucuaguauucauauucccaguaagcuccccuacccuucuuuaugguuuuaauuugaaaucuccuuugucugguuuaaaaugaguggcuucuguuucauucuuaauuccucaacucuugccaagcuggugagugcacugcacagagucauggaauaaauugauuuccuagucccaguauaugugacuuaugucaaaacagcaguuuuaauaacuggauacaagaccuuuauauggaugcagaaaauguuggcacgcgcugacccagaacacugcagaaguacaaaaccaaauuuggaaaaauggaaugguuuuaguuuuauauuugguuugugauuuuuaaaucucucucucuauauauauauaucauuguuucucacuguuccuuggacaaauaaugguugcuuugcugaaguguuccuucauccauuacaauggccccuguacccaccccaaaugcugcaggucauguauaccucaggaugagugagaccaccaggaugcuggugguguugggacucaguuucccuuucauucaguguggccaugcugucuguguguguccgugcaauggaccagcaucgacaggagaagagucugacacaagguuuucacagauacaaaaaaccccuaggucuugaaaucgugacugauuucagaaaugguuuuguauuuaagaucaaaauuaggacaagcagcagcaauguuucuucaaaugcguuuuuguaguuuacagauggucaggccucggggucucugcaucucugcagcacucaauuucccuuggagcagaugcuuccuuaaauacgucugaaacccuucacguguguaaauaguauuguuggucuuauguauuucgagaaaagggacagcugcauuuuuuuucuuuccuuuuuauuuuuuuuauacaguggauuaaaguaccuuucauuggcaacacauaucagaccccuuuaaccaauauuaaagacuaucagaccaaauguuuauguuuuccaaauaugucuuaucacugguugcaguuuucaauagaagcugauugcccugucauagccauaaaucggaauuaugaacuuuguuucagauuggguguacuaaaacgcuccuuugacuauuuccuuaaggauauauugaaaugcccacagaguuugaauuauguucuguaggaaaguguagacaguuguuuuaggauguguacaguuguagaaggugccaacuuuaaaagcucauguuugguucuuaagguuuucuuuuuaaaaaaaaaaugcauuaaaguaauuucguuacauggccugcuguacuaacaucuguuauuacugucgugagaaaaauuuuauuuuuaaaaccgguguccauguugugccagagauuguaggauggaggggaggcuaccuuuaaauuuuuuucuuuauuuaucguuaaaauguuucagcuuaaauuaaucuuuccugaguguuuuuuuuucuguuuugaaggcaaucccaucaguucgucugugcaguuaguaggaggggccggacuggugauccuaggcuguguuaaccaaagcaaaugugaaaucagcuggcauccuguugauaacuacuucaacaaaccauauuuugggccuuuguuuuuguauauaaagauaaugauacacuccucuuguucuugaucauucuuuauaccacuguuguuaauguccagaucuauacgcuaccauagucaugguuucauagagggucacacuccugaucuaaaaucagucccuauaaaaagccuuguggacagguaaucaugucauugugucccaaucugagaaaacaaaguagaauucugaauacuucguauuacauguuuaguguuugaaccuuuuuguauuuguguuauaacuucuaccauggguucuggguucuuaugggaguaccuguuuuuauuuuuaguggugguggacucuuaaaauuacuuuccuuggcccugaacaggaacagugccucucuacauccagcuaacucuagucaucccuaagguaggagggacccacccgcagaggcauggcgaguuccugcugagaugcgcuggcccccaaucugcagugugagcagaaaggaauucuaagccgggcagugguggcgcacagcuuuaaucccagcauuugggaggcagaggcaggcagauuucugauuucgaggccagccugcucuacaaagugaguuccaggacagccagggcuauacagagaaacccugucucaaaaauaaauaaauaaauaaauaaauaaauaaauaaauaaauaaaaaagaaagaaaggaauucua

SEQ ID NO: 8718 - RNA, 9606 nt, Mus musculus
gaugcucaucgauauuucuggcaccuacggacaguauuuggcuccgaggcuugaagcucuaucacucaguuuccccucuuauuagaaggcuuuccucuccuaugauucucuguucuuuccuuuucuaguaagggauuuaaucagaaucagauucggggcucacuuuaucugguacgagcacauguuaacucauugaaucugcagauauugccauguccugucuugagggaugaauucuagggacacuaugaacuaaccaugggcuccuaucuaauaaguacccccuucuguuuucucugcuuauugucauucucuguacaaccaucaguuaucaaauaaucaaugagcuagcuggguuuuacacaccauggaugaccuuacacaagucacuccuuguuacauuuuucucagaacucagaaauaauaaggccagcaaguaacucauacagacacaguuuaucuugagcaugccuguuagucaggcuucauauauuuuccugaaguuucugcuugucuucuuuuaauugucuugcucuuuuggggcuugccaaacuuuaaaggucagugaaugcauuuuucauaacuuuaaaugaauauuuucauuuucaauaagaucuuaaagauggaaaauaucauuaacuuuucuaauuuuuaaacaguugaaaaugcuccuuucuuuauauuuauguauggauauuuuuaucucugaacaaagaguuggcauugagcaaguguccagugagacagugauaagcaacagaugauaugauaucaugaagaugaugauaugacaucaugaagaugauacuucugcaguaucaaaguguagaaucaauuugagucuuaauaauauccccaucaucagaguccaaauguagauuuccaaauauguuugggaaaaucuaauuuacuauuuugggguuuaaaaaaaaaaguagcuguaaucaaugugaccaguugacuggaauugagaaaggacguauguaguuagaccgcggguguggugccacuccacaguguagccacagacacagaggaaccaacacaggaagugugacccuguguucacccaacuuuuaucaguggaacaagauaucugauagaacaaguuacuacaagaaagauuaauuuuguaucucugcagagauuucaguccauagucuuggccucaugcagcuggguuguuauaugguagcaaauguuauauuuguacuucguggcaccaggggagagaacaggagagcaugggagagagaucaaucuaggacaauacacaaccccugaugacacacuuucuauaaguaugcauuuggggggguacucuguaucuuagccauaauauucuaugccugacccccaaaagguucauacaucucauaauucaagauauauuuuuauguguagcccaucuugaaggguuuccauaaucauaacagucacagcauuauucaaaauccaacucugaaguacccucugaggcucaaggccguguaaaacccaggcugaguuacaaacucucagaauaaaccggggcagaauaaguacgucuuuccaaauggacagaaagaaggcugacgggagggggggcgggggaggggaguggggccaaggccaagccagcaggauagacacugagucuuguaacccauaguccacauuuugggccacauuacgucaugcuguuggcuucagugggcuugaacaguuccaucccuacagucuuaauggcugcaguccaugugggcuuucuaccagggugguuaugcuuaaugcucgcagcuucccuacggucuccauucuugguaucucagacuucuugaagucuccauuguagcucagguuucaccuucacagcuucauauacuacuucucaaggacacugugcaaggaaucuugaaacuccaauauguuguagaaacuuuuaaucccaaucugggauuucuacccugccuugaucauucaguucccagacaaaauaugcacaauguuuauuauuuacaauaaaccuucaacagcacaagagcugggcagauacuacccucuaugguauuagaaucuacuuuucuaucaauaaccccaagcuauuauguuucaucuggagugcucuuaacuccaauugaccagcccucuuggucauguuuucauggcucaccgaacccauggcagcuucuccuuccucuuucaccuucuucuucuccuugugguucuccugcaacccagagcccgggaacccuaaaccccaccuaugucucuucugccaagcuauuggcuuuuggcaucuuuauucaccaguugauggcuuuagcuuguuucaaguugguauaaacuauacagcacaacaggcuuuacagaacuuucuaaggacaccuuucaguaagaaaaggauggacaggaugcugggagguagauuuccuugacuguuguuagcuuuccuugcucuucaaaauggaaaacauagagaagggcccugaguuucauuauuaaagagggaugaagcaaguucaucuggaaaucauucaucuuguuuguugcaugacuuuuggagagaugaacagaauuaauaccuaaccacccaagagaggacaucagcaaaucaacgauaugaucccaacugaguuggcuugguggaaccaaugaaucuauugaggucaauuacaggaacugguuguacuugacagaucagagaaggagucucaguuaaggaaaugccuccaugagaucuagcuguaaggcauuuucucaauuagugaucaaggggagagagucuagcccgugguaagugcuaccaccccugggcuuguuauccuggguucuauaagaaaacaggaagaagcaagcaagcaucacuccuccauggccaaaggucaaaauaagauguaaaagauccuuuuaacuccuagaccagaacacugauagauacgccuucaagaauguauugggacaguaauuuguauuuugcuugaggaagccauaguuaucaggagaaaacguacaugcaagucaguauagacauucuuguuaagcuuacuucaucucagucauuaugugcacaggagggugcaaggaugccuagcacaccucaguaguuuuacauacuuugaccaaagaguguggacgucgugagagagacccagguagcacugcaguuaggcagaucugggacuggcugcucaugugugcuuggcaguggcaccuaucaccccagcucccauucugauaccuauuugcaguucccugaacacgaacauuuuaauuccucuggaccuuuucaacugcuauccuuuugccuauagaccaauaauuccccccccucacuuuauuccugcugauccguuggauaaacuguccuaggacgcuacccugacuccaacagcuggaauaggcacaccuuuacacuuccaacacucucccaacugaagcaaaauugcacugaagaguuucucccucuucuagucaugaacuccaggcagcauugccuuucccauagcuccucccccuggugccucucagucugugccauacacuuguccaacuacaguuggacaucaaauaacaaugugggcuuugccaugcucuggagacuuuuguauuuucuuuccaagacucacuacugauuuggaaagcauaaagggaguguucaacuuuauagacuaugaggaggggcaggugauagaauccaaguucaguaaggcaaacauuuaaagagucuuugagaaaccaugagggcaggcucaaagaacuagagagaaaucuaaugcucugauuuaaucuuauauuguacaauagaucucuaaguguggccucaacuauugcuggaaaaauacaaauacaaguaucuuuccaaucagccugcugagagagguuucaguucucuuucuauugaauaagcauuaugcuuggaugcuauauguguaacuggacaucugcugaggugacucgcccaaaggcuaaguugauggaauccauuauauacauacucucaauggaacuaguuuuucaguaaaagaacuugacaccacuagcuacacggaggccauccuaaaugcaccaggcaauuucaguacccacaaauuugcucccuauucaaaguaaaaagcaaacauccaaucucucuacuggggguagauuuagccuggagccaaguauucacugagguagacaauguuccagaaagcugggagacagaagugauaguuucaugauaaaauuuuauugagauggcuuccaggccaagggggaauccauucuugguuuguaaaaguguugagaaacugacuuagcccucagaagaaugcacaugaauugcagagaaacacaggaaguggugcaaagauaaaggccuucaacaagagcugcaauuuucuuggaguauacaaagaaugaguuuaaacaaacuuuuuuuuuuuaacuuuuuuuccucuuuucuuuuuuucuuaaagaucuuuauaagcagagaaaaacugccagaaaacagugaaaggagcacaaaaucagaauaggguuggggggacugcaaaagccaaugguggugcuagcaagaagcaauuaguuuuaguuuaagggaacaaggcaaguggacacagcucagauggggugcuccacucauuagcucuuuuuuuuuuuuccuuuucucaugaaacguuauauucacaauuuucagcaggaaacacccaacucgcccaagcuguguuuccuguguuuucuaaacgguauaauacguuauuacaaaagaaacaauccaaacagcccuguggaggggugagaaguaaagaauaguuuuauacuuaaccagacaccagauuaugaggucaagucauacagcaucgugagagauacaaggaaaaacugaaagugaacgcuuucugccugaacuucucgauccaaaaaacaaccuuugagaagaggaugaaccagaauguguaaaacuaaguaauuccgggaggaaacccuaagaugaccugagauauucaguccaagagggugggugacaccauuucaaagccagucuaagaaagggugguugagaugccucuggcaaacccuuucaacuucugaaggucccagcgccaagcgacaagggcccugggcagagccaagggagagcuugacacagacggccgcggucacagggcuggagaguuaggccccgggucguguggucuggcggauucuauccauuuccgcccaggacgguaagaaaccccagagaccgagccguggcggagcaguugguccccggugcaggaauucgcuguccucccagcacagugcacggcugggaacccgaucagcccgcgugucagcuuggggcggagccaagccuggucaccaccggaagugcgucacuagagcgggccgggagcgcaggccgaacccggaagcaggccuggcguaggcuggagcuugggggaggcgccgggucucugagauuuagugaccgaacugcccgcgcggagaggacuggcggcggagaacugcagcaagagcaggaaacccacgggaccgcggacgugcgcgaggcucgaggccgugcugcaccgaggggcucgacucguggcgccgagcggucacuuccggccugcgggggguacuuuuuaaagggauagcggguauuuccgaagccacgggggcaucgccacgccgcggugucgccgcuggggccggggcuucuguggguucuaaugauucugccguacgugcuuugcccuaauugucaacuguuuugucaaguccgcguuggcuccaagagagaccuucccugacguuuucagugcccgcggaguggacagccccggcggagcaucugaccgcccgcuccccggcucccgcugcagcugucauucacgucgaugaugcuguuuuccuuagagauccgaguguacaaauggacugaugcugcaaaguccgugggugggguugggguggggagaguacuucugccugccaggucuucagagauggguuuacacuucgaugaguagcgcugacaagccacgucuugcaagggcgguugcauucgaccgaauagcacagguucccuucaccgauaugagcucggguagcauucaucaucuggagggggaucuuuccuuaucuacuucuccuuucuacuguuugaaguguaaauucgucuuagguuauugaguuuucaguacuuugauuguauccaaauggaagcauucaagugugauauugucuggcaguaaauuuacuuuaaaaaaaaaaaagcuuacccuguggacuaucacaugaguuaaauauccaagauaaaagagugaacagagaguugcaggaggacuaagaaacacgaguaaacaugaguaacugugauaacgguuauaauuugcuuuaaagaucauuuacauuuucuuuuuaaauuuccuguguaugaguucuuugccuggaugugugucuauucacgaugugcuagagcaaccagagcucuuaaccacugagccauuucuccaacccccaaagaguauauauuugccuuuugagagagaacaguuuuuagucguuuuugucauuuccauggacgugggaaauuaaaauuccaaauuuauuucuuggcuauuuuacuaggaaaucuaacuuaauaaaacgguuguucuguugaaccuauaggucauacauugggauaagauaguuccaaaagugcaguuaccaccucgauguaccuuaauguuagucauuaaaauucucugagugguguggaaaaguaaaucguacacaucaaagaaggggcucuugggaucuaggaggggugggacaaggcuuaaacagacaccuuucagucucaggcuuagucuggaggacaugaaguucuugucuguaguuuuauagguuaagauuauuuucauuguugugggaaagaauaguguuauuguuuuuaguuuuguuuuucaaaaaagaaaaaugagucaccauauaguuugugggacuuacuuggagagagagaucaaaaugucgcuugcacuugacagucgguauggaguaaaaggcuuugaaacccauggaagucugggcacaugcgcuccucucauugagggcaguaguguccaugugcagucuuuugcaauaucauauguuauaagaaauuguuuuaaaauagaugcucaauaaaugcauauguucuaaaguaauaaagcauaauaaaaaaaagcaaacacgaaucuaugacugauauuaagaucuagaauguagaauguggaugugugagugcaggugccuguggaggcagaggacgugggauccucuagagcuggaguuaaaacugguugugcgccauuaacugugggacucagcccugcaucuacuucuacaauauaguuuaucauuacaucauaugugcaguguuuuaagguuuucaacuagcuucacuaauuugugauuuuguuucuagcauuccaagccauggccuguuuugucagcucuuuucaccaauauauaauacuucacuacaaauagacuguauuucugugucugguuccuugauaauggccauuugaauuaucccccaacauuuucuuauacaauauuaaacaggcauaccuuucaguuauaccacagccauuaugaagaguacuuucauauuuugacagauaaguaucccauucaaauugacuaauagaugacgcuauaauuaacaauugaaaaccuuagaauagugccucgcaagugauacauacuugguaaauagcggucauuauuuuaacauacaguauuuaaaucagcuucagcuuuuaaugcuacucacccuugucucaaguagugcugguaaauuauaggcuugacuauagcauuauguucaauaucugauacagcuuuuauaggcuucuuuuguguuuuuaauuuuuaguuacguguguguguguguguguguguguguguguguguguguaucuguguuggggaaugugacugucaguacaggcaccguggaggccagaagaggagagcagaucccccggagcucugucucaguccuuuggauacugugaauacuacugccaugaacaauguguacaauauacuuguuuuaguaccuguuucaacuguugggggggggcgggaaggggugcaauugcuuagcuuaaugaaaaguuuauauuugauuucuugaaucaccaaacuauuucccauauucucgaaaucaauaucaaaacuuuuauuuguauucucucugacacuuguuauuguccauuaagaaaagaaaacauauuauuuacuagauucugcauaggagggagaccauccugccuuucauguauuugauugagcaguuugccagugugucuguguguacaucacuugugugccuguuccuacagagaucauaagaggguauuguaucccuagcaacuagacuucagggugccgcugugggugcugggaacugagccuggugcuaugcaggaggaggaaguguaagugagcacucgccaugucuccauucaugucgcugguucucaugauaaugccccuuacacagagauguaaaaaucuggugcugcuuuuuuuuuuauuauuauuuuguugcuuaugcauuaggugucauaaacuuagaauccuuuaccaaucuucuaucaggcagaucuacucuugcuuuggucuccaagaguuacauuauuuugguucuuguuguucgauuguugguccuuuuaaguuaguuuuugugugaugugagggaggaguccacacuaacuccuauguacacaucugcuuccaucaugguuugaaaagaauauuuuuccccucugcaugauccugacacacuugucaagucagcuggccacagaugaacagauuugcuucugggcucuuaauccuacucgguugaucuguguauccgcaugucggaaaugagcuguguguagugugauaccuucugaaauugggaaguguuacucuagcucuaaaaaaaccacuguuuuggcucuguggggccacuuaaauuucuguaucacauuauggaugggcuucuugguuuguucguaaaaagccuuuggaucuuucauguugcugcaccgaacugguagauaaucuugaagagcuacacuaacauuguuaggucucuuaaucuggagcagucuauuaaaaucucuaaauuccuucagugcaguuccauaguuuuagaugucuuugguuuauuuuuaaaaauuuuguuauuuuggauauuacugcacaugaauuuuccacuuaauuuuuuucagaauguuuauugcugguguauaaaaauacaacugaugcuacacagagaaaaccugucucaaacaacagcaacaacaaccacaaaauacugauguuuuccuggcugacuguauggccuauaacuuugccaguuaacauaguagggguguguguguaugugugugaauuuucaauauaccaucuguaaauacagguagcuuuacuuuuauuguuaguuuauaugacuuuuuaaaaauuuuauagccuaauuucucugucuagaacuccaauacauuguucacaacaaauggaaaaauaauguuuuauuucugauuuuggggugaauuuuugcuccauuaaauuauauuguuagcuuuucauguaaaucccuuuccauacuaaagaaauuuccuucca

SEQ ID NO: 8719 - RNA, 1540 nt, Mus musculus
ugaagucgccgggagccagcucgggaagccugcaggcugugagcacguugaucaaaggucccuuugcgggcucaaauuaacagggagcuggcgagcccgcgcagcaccugccugggaagagcagcgccacagcaaaccggcucaucuugccgggaggugagccucucaaaaagcuugcccaggcaaaguacuuagguucugucugggucggaggggaaaggcguggucuguuuucuuugcguagagauauuuauuuuuaacguugaucuuuacgccacuagagcccuccccccuccgcucuaauccacaagcaaccccuuuucaaaaauggauggaugaguugagauugggagaggaaugaaugguuuuaucauaaaauugcgccggccccuuuacgcagcguugucccuuucaucccuauuaaaagccauaguauugauaggguuuuuuguuuuguuuuguuuuuuaaagaguagcccuaaagggucagaauaaaaacaaacacacuggaaaacaaagcccgugggcucagagagcugaugccuagaaaagaaagugaaaaguuauguauaguuggguguuaauacaccgagaagcugcggagagcgcacaggaguucauugugucagacucuuuguaguuaaugagacuuaggaaauccccgaggacucggcagugccucgagucuuccuaaggagcagauguggucaaaaggaaaauggagaagggguaacuugguagacaacagaggauagagguauuuagaaaauaaaauuauaaacgaucauuugccaaggcaacuccaaaauccuuuagaguauagggugguuuuguucauuuguuuuuugggguuaucucuuugcaagucauuugauuucaaaugcagugcucgcacagcaugcagaaucugcuggggauugagggcugcauuacagcccauagccucagacaggcugaacucaccagccagccagcuuccucccccuguacagcaguaacaacaccucucacuaggguugugaagucuaaacgacuguacauaaggugcccaauaaauaagauaaugugauaaguggcaauauaaggugugcaauagauagacuauuacuuuuaagucaaucugacuuuguguuucuauguuuacacauguaguauuuggaaaugaaccuuggacuuuaagaacgcuuggagucauugaaccacacccaacuccuauucugacauuucacugcuauccaggauuuacagaaaauguuagaaaaacucugcagcaauguuauuuugaaauuuauaaagccuuuacaaaaaugugaagaaagauguauauauuuguggcaucuugaucucuacuauaaauugcgaaaugauuggauugagcuuaagguauuaaagcuuuuaauuagaaaauuuuaaauaaaugauguucuggauaugucaugcauguaacuuuggagaaaaaugucaacuacguguaacacccccugacuugccauuauaccuauuauggauucaaaggaauuuaauacaccugucuaguuua

SEQ ID NO: 8720 - RNA, 9344 nt, Mus musculus
auugcaauaacuuuuaaagaaaauacuuuauuacaucaugaaaaaagguauccaacaacuagauucauacuugcuugaaucuaaaaaaaaacaaacaaacaaaaaacugaaaguuuacucauuagacuguaggugggcgucccauuccacaugggaagagagaggugcgagggcgucuaaaguauugcacagucuuggaacauaaagaagaggagucuggaggagaagaucacaugauacugggaaccgucucacauuaugagaaacuaccaagaaacauucgaaaagaaaacccuuuguuucuacaguagcuuuaguuuguaguucuuggaaugacucuauuccacuuaagacaucuuaguaacaggaagcuucgucugagcaaucccaugugcaaauauuaauagaaaaauauauaaaauaaugcaucucuugccaucacccccggcaaucaggaccguauuuuggagaacuguuuuguuugaaaaaacgguuaagcugugaguuuggccugaagcuccaucucugccgcucguuugagugcaacauccacuagaagcuggaauccacuaaaauccugguugaggucugguggaguagggggaggaguguugaaaagaccacucugaggguuuggacuggguccagauuugcaaguguccucuggguacacgagagaggugucuguaaaguugcugggugcuauuugcgguacaucuguacucugucccacaccaaucggcugacagagagagaaaggcccauccuucaaugcagucacagugguauggcagaucacugacgggcgagccaaaauggauccuggggagggagguuugggagacacuggucucccuaggguuggguuggguccaacuacgcaggaaugaaaugggcucucuucuagaguuggcaugaaguuuuugauacccauugcagcuucaauagagcuagcuucugaaaucuuggccccacggcgggaaaucgugaacugauuuggaucuuugccauccuuucucagcaugucaggaaggagccugcggcgggcguugaugaaccaguuacagaccugaaaucacacagggucuccuucaauacucucaguucacuugacaaacagguucugaaaacauccgauguaggaagccugacuuaaagagguaauaaaaggggcucaucuggcaccaaggaaguagcucaaugguagaguacuugccuaguacaccaguggcccaacagcaaugauuuuuaaaaaauaaacuaaaauaaagcuuuuuuggccuucccagcaagucagaggcaccuaagcugggucggccugccauaagggcaaguuuacuuugucuaugccaucauccuuaacccuuucagagacaaggaaaaggcgcaaaaucucagauaccugaaaauaaauagcuuuaacgaaaguucaccuuuaagucucuuucaaccuacuaccuacugccccagcauuugaguuaaucaacuacaggaaaacauuuccuguuuaaaagaggccacaccucccaguaacugauuucucucaguucaaaugacugugucaacagacacaacacaauuaccucaccaaggucuguccuuguuuaaauagcaaaccaguuuccugggcaauagaauaagguuuaaccuccuucucuuucaggcacugaaggaaaugcuuccugacagaugaaugucaaguguuucuguccucuauuaaauagccaauuauuaccuuuucacccuauaaaguuuacaaugaaaagauccuguuucucucucucuucccucccucccucuacuaggcaccagagaagagcuuauagccuggcacacaggaaugcuauaaauugucuguaaauaaagaagaaaguguauguauagguuaggggcauaguucaaaucugggcuggaaccccaacaccuuacggggcaaauucuggcacaaacuuuuaucuuucuccuuaccuguaguguggacaggugugucugcugggacagcagugcuuucucuugcucugagggauaggcguuguaucuguguucauacagccagucucgcagaaucuggacugacuccuugggcagauugccucuccuccuucucuugccagaggcugcugaugaggaaagguccaggggacuguccaugcugucuucauccucagagucacugccagaugcugcaacaagaccugagaaaggacaaggcccgcggucacuugcuuucaccagcagggaaacuuagucacuuccuuagacuguuccacauccuugugauuuuucaacuacugagugugaaguuuucagucggggccaagguguccaaggaaaggccuggaacacgaagggugccgggcaguguggggaauggcccucacaaccuugucuuuaaggucauccaucacucaugagagacagcaauccagugaacaaggacaucuuauaugcuuuuuucucuccuuucgugaaaggcuugcuguuaaagcaagcaccguccauuuuuauauacuugaagguuuuuuuaagacugucaauuagauaugaaccuaaaugcuacccaucaguccuuaauucuuacgugacaaagaaaauugaauaugugcaacccaccaaaaaagcuauuuuggugguacuuuaaucccaccagaaauguuaagaauccaaacccuacagaauauuucaaucagagcucagugacaauuccggccaguuggacuuugauagacauuuugaaguuuagaacacuucuaagaaaugcuauuaacuccuuucaaaccuacaagccaggcaucugugagacugucucuguucaucucaaaggucuuuucuuuaacuuuguauagcuuuuuuucccuccaauccuaauuaagucccuuuacugaucuaggaaauaaaaccagaauauucuucacauugauacaucaacuccgugaauuuuuaaaggaauuuauuuuacaacugggagcaggcugacuuuguugacacauuuuuagcuuuggacugcagggggcagaaggugcuagaaggaguuccuacaggaaacacucaaagcccgcaaagacaaaguaaaagcagguucuaacaaaagacgcggaugauuuugcaaauucacuguagcuuaaggcucaacaaacugccacaaauaaaccacaaacaccuccauuuuuaacugccaugcaauugaaggauuccuuccugaagaugaaaucaaucuguuucaagaaaagaaagucuaaagaaagggcaauuuuaaaccugaaagagcuuucauuguucagaaucugagaaacuuuaaauaaaaaacaaaacaaaacacccauauugaaaugagugaaaaacuauuaauuacaaaaaaaaaaaaaaaccaaaaaacccaaaaacccuccuuugauuacaaaugaguuucacauuugcuuugguaaccaaggaaaacuaacuuuuaaacaugccagguuaauuggguaacuaaguacauuugaauaaagcaauuugcuucaacucccccaacuucagaaaagccagacauucuucaacacuacuuauuuccuucccccucuucuuaaaucuaggaggggaaaagugugaaaauuugcucauugaacaguuaauucccaacuguaaauuggcaauaacaaagugcuugaaacaaaaacccccuaaagccugcccuuugauccgccugcuuggaguuugacaagaagcgcggucuuucagaauagguuagggacacaaagcagguuucuguuaagcaacaccaaacugccgacucuguucauuugagaaagaaaaaaaaaagaaagccagaccccuagaccucuuuacaaguauuuccaaagcaugcacaaaggaugaaggaagcggggaaguuuuaagacuuggugccuugggcacaccagcugauccguuuagugcugcgagaucacguuugcuacugucaaggcuauuuucauuaaaacucccucccgauuauggcucgacuuggaaaaacaaagacuuuuuuccucguuacucauuuccuacuguaacagagcuuuugaaaaguuucccaguuaggacuuguuuccaaucaucucgcuuugcuuacacuuugaaaaaaaaaaaugcgguuggggagggagaggugggugugggacagauucggaauccucuuacuccauccacauacaaggaaauguuguuccgaaagccacaagauggcccguggaacccacggcucuaggaagcaaaucuugcuucuucacuuucuuuuucugaagucaugaaacauggaaguugggagggugggggguggggaagcacuuggauaucuuggagacuagaaaaagaauaugggggaaaaagaucaagggaaaaccaaaccuaauuagucucuucccuauggacaaguaacucggauggaacuuuacauccaaggcacuaaauccacagcuggcuggaagugacccagccaguucagcccuaaacagauucaacaggcuuggagaccccgagaggacacuuggugauuuuccuaguugagcgagcccucuuccagccugcuuugaagccauuuuuggagcucuuucuuuucgggcggucucggcuuucuacagagggcacucuauuaccauauaccagucuuuguugaaagaugcucacuuuccuaaaacagacaauaggcgggacagguuuaagcaguccaggcccaaggacaggcagggaagcucacccuccccucccagguaauuucagacagugggaggcagggcuguggaggcuugcagccgagggaggggcaagaggagagagcaagcagcuuuuguucuucagccccaacugaagcccgccugcuaacuguacaaguuagcaacggagcuggccccuggucccuaaggaaguaaagaaauggggcggugcgguucauauccucaagggucugcccccuucccagacccagugccgaggaagccuaaaaaagggaaaaggagccaggacaaccuuagcagucucagcucucccaaugagaaacucgaaaucggucucagcaaaguuuccucuccaacacgucaccguucaucguuuccaugagucggggggauugacuuggggaacccacgcucuuugggcuggggaccucgcaucuggggaaggggacacccaagaggguggagccugaaugggaagcuagucgucagccuuccuccccacccacggaaacccaguuuugcauucccgcaccccggagccacacaaaaccaaacuacccucauugaggugcuauuggagcggaaugccucccacgggggucuagaucugucagccacgucaaggggugacagaggucuugagaagaucccuaaguuuuccccagagcucaguuaaacugucccccaacucagagcgcccacacucugacugucccaggguggaaaggagcaaggaggccuacuuaaccaaguacccggggucuucaugaguuccguauguuucggggucucucacagaauaacauccacccaacucucuaagguaggaagcgcggagaaaccccgugaggaagcguguuuggcggcagcugcuauaaccguguuccguuggaacugcagucgcggucuaggucugaaagaauguggaguaacaaacucgaggaagcucccgggcaugcgcaccagcgcccccuuccccccgcccgcuucuccaagcgauuaacuucuguuuugaaccacuccacauaaaucacaacaaaaaaagccaacuccaguccacgacuggaacacucgagggaccucccagucagggacuccaaaguuagcuucaaaagggacuucacagucuuugaccuuuuggguuuuuuuuuuccccccuuccuccccaguguguuuuguuuuuaaaccagacugacggcaaguuuuaguuguaaagcuuugguggaaacaaugacagccucgcuuuuugcacuuacaaccaagccugcuugucacacuuggacaguuuucgacugcaugguacuuguguucuaacagcacacgcgguccuaaauucaucgugggaaaacuuucagaaacuaguaaaaauuuuaaaguccaucuuuccaaagcuaugcucgcccuagggcgauaugugugggggucccggaucacauuccuuugauagugaaaaacacaucucuuuaaaaaaaaaaaaaaaaaaaacauugccaggauccggcgaggagugagagaacacccggaacuacaaacuuuuagacaaaagguaaggcgacuggaauucgccaaggaccccccacagggaaaagcgaggugccagggucuccuagaacaucaaccgcaaagcccugccccagaaacggcacuagaaaccacgcggcgccugggccgagcauggggugucaggaagacaaugaaacuuggaggcguacaaacaaggcgcugagcgugguucuugacaacgugccaacagcguggcgcggcucagccuccccacaacagccccucggguugugucuagaaggaaaagaacaccaacugccaucagagacacagccucaacaaagagaacagccaccaauccagccggggagccacugguccgaaaagucccaucaagucaguguucucccgauccggcgcggcccgcacaugucccgcacuggugccccgggcgcucacagcccgccgccaccuuacccuucuugcuuuucauucuggaacucgagucccagugagaggugaagcugggguuucuaggagccagcagccguggaguggcgggaggguagucgaugauccuccuccuauacuagugcuccgguaacuuacaagagaguguuccaaccacuauugcuaaacaaggugcuccggucucaggcgcuggcuucuggguuggaauucaagugacacuugggcuuccuccagucgggaucuucuggcagccagccggggguucucccuggcccaauucccucccucccuacucagcuccuuuguuucccgcuccacucggcgcaccucggcgcugucagagugagagagcagagggaagguacaggagguccugccuccgcccccaaccgcccgccccgucccccgcccgccccgccgcgcuccucugccccucccccgcaccuuccagcuccacaacccugggccugggggccgagaucacccgucccucuacgcgcuggcggaacccagaagcagggucaugccugccugcccguggcgagagcaccaucuccaucccucagcucucagcggccacacugguuucucuuuuggggccuuuccuccccgggcuagcgaagagugcauuuaguuuguaaaggauggagagagguuuaaggacaucuccucuguccaccccagagaagaaaagacacccccauccuuguuuuugacagcugccccaaacuucacugucucugcuccagccgccggaggcagcagcuucugauucaagggguggggcaccgaaggaaaaguauuccagacaagaaucaacuucuuccagaaggcgcagcugccauugacacgcgggcgcggcacagcgcacccuccuccucguggacucuucugccaacagcgacaguggggguggggggaggcagacauagucaccgugggcaaaugucuauucccccgggcuaaagcucugaguuccggauuggauugcaaggcaguuucgaaaucuaacacguugcgaauagacacuugucaugcucacaugcucuuuaaacgucugggcuagggggacggccagagcgcgcgugugccccacugcgacucccccacccccacgcgccuuuuuaaaaagaugggggacuacgccgggacugcucaucuguuucaguaaacagugucuacuuugugugcuaauaucccaccagaggacacccuucaguauuucaaacagaaacuagccauuaaauaaacacucauuccuauugguuuauuuugcuugagaggggagcuccaaagaguugaacgaagaaucgagaaucguccccuccccaaauacaagccagaugcuguuauggcugacuucgagacgcgcacgcccgcacuucugggucuaguuuucaccuaugcccgguuguuuaaaaaaaaaaaaaaaaaaaaaaaaaaaaaaagcaaagaaaagcaacugucacaugucacagaagacuuuccccauagagggggggaaaaaccccaaacguaaauaagcugagcagcgacgucaccgccggugucugucuccaguuucggcuuuguggcuguucugguuuugugaccucgguggagauccggcaggaggagacagacccguaaaaacaagguuaaagccgagccacaguaaggcggccacaggaugacccgcuagacuuuggaaccuguuuaugauuauguuggaaauuaaagcaagccuccgccgcgcccccuccgaggagcgcguuaaaaccccgagucaaaaaagaagcuugggugguuuuuccaaaaugaaccaacuggaggaagagucacaguaagcaggcaggaaccuuaaaaugacccucccccuucccuaaauccugugguuugcagagugcucccuaagugagcacacgcgggcaucagcgcaggaggcgguugcacgacaguguccagggagaacccaacggcuggcaagcccccucugcaaaccgcccuggcgcagcgcuuuccgggacccggcaggggaugacucagcugcugcgccccggugcgggacucauguggugcgggagggggccacggagggcccagccgccgguugagggccgccucgcucuggguuuuugguguuuguggcugggauugguggcucacauccgccggggacucgggagaggagggagaacagacucggggaggaggagcuggaccgagugaguggcaggagccggguccggacccggcggugacugccuugucauuuuguuugcuaacuuggacagcggcuucaggguccaccccacggaacccgccucggguccgcuaagcccaacccacggcggcucgaggccagagcguucuuucccggcgguuacccgcggccacgcgguggcucucauuauguacacaaagguagcuuuucuuuucucccaagucagccuggcuaaugaaugcgauucuccggccgcacugauggaaaccggguuuacaagguuugaaaacaaacuuuacggggcgagcgggagcagagagagagaguagaagccucuuucaaacuaggacgggaggaaaacgcagaauuaaaaacucaccgugacgcgaaggccagcugaacuccgccagugcacaccuucugcucgcauaaaucuuuucgaggcaguuaagaagucggagcgcgcuggcggaauucug

SEQ ID NO: 8721 - RNA, 563 nt, Mus musculus
auauuuuguuuguuuaucagauagucuuuuauugaaauauuuucuuguugcuucuuaacuagcugggcacuccacugcaccacuguugaugucaucuaugacgucaugaggguggcggccguccacauugcagcccacagacugugugguacccaggaucuccuugauaguucccgaaaguucucuagccaaagaccggugucucaucugccggguaauguugacaaucucaucaaaaguaaaguucccacuguguuuaauguucugcuucuuccugucucuugguggcucuuugagggcuuugaugaucagggcagagggcaccaccucaaucugggucugucuguucuggaugcucaguuucacuguaauucugagaccuuuccagucaccgguagccuuggcaaugucaucgccaacuuucuucggagacaaauccagaggacggaucuugggggccaaggcggauguggcgccgaccucaccuccggugcaccucagguacaugacuuugaucucguugggguggaacuuggguggcaugguggaggcggcuggugucc

SEQ ID NO: 8722 - RNA, 799 nt, Mus musculus
gaugcccaaaggaaagaaggccaaggggaagaagguggcccuggccccugccaucaucaagaaacaggaggccaaaaaaguggucaauccuuugagaaaaggcccaaguacuucggcauugggcaggacauccaccccaaaagagaucuaacaugcuucgucaaauggccccacuacaucaggcugcagcagcuaagggccauccucaauaaguggcucaaaguaccgccagcuauuaaccaguucacccaggcccuggacaggcaaacagcuacucagcugcuuaagcuugcccacaaguacaggccagagacaaagcaagauaagaagcaaaggcuacuggcccaugcugagaagaaagcugcuggcaaaggcgacaucccaacuaagaguccgccuguccgccgagcaggcaucaauacagucaccaccuugguggagaacaagaaggcucagcugguggugauuguccauaauguagacccuauugagcuggugguuuuccugccugcccuguguagaaagaugggggugcccuacugcaucaucaagggaaaggccaggcuggggcaccugguccacaggaagacaugcacuucuguugcuuucacacagguuaccucagaagacaagggugcucuggcugaguugguggaagcuauuaggaccaauuauaaugacagauauggcgagaucugccgccacuugggaagcaacguccuggguccuaagucuguggcucgcauugccaagcuggaaaaagcaaagacuaaagaauucgccacuaauugggguuaaa

SEQ ID NO: 8723 - RNA, 67261 nt, Mus musculus
uaaugaaacuaucccgagagaaacaggaaaagucaagaaugagaagcuagagaacaaacaguaacagcguguucuacagucugggcugcaagcuacauugggcucccaaugggaaugaagguguagcuguucccagugcauugacuuggggauugaggacuggguucucuggguuuaauugcacuuccccacagcggaggaguaguauuucucgagcauuuacgggaaacuuucaaccuugaaaacauuucuuucacugguagaucagaugaagagccacgcugaagugaaaaaucccaguagguuugggugucucuguggaccuugguaacuacugaggcaaucugguugaauuccacacggcgguacuuaggcagggaaacgaaagguuucccgggucccagcacagacuaugcucaccgcgcuucauuguugcaaagaaacugcugugcccaggcccauaccggagagaguuuguauaaaugcauggcucagcggccggaagacugugucacacuguucaugcucgcggugagcacgaagaaauuaacaagcauuuagaagugaugccauggccuuccaucgaaagaaccagcugcagauauacaagacgaaaaacagccgccgucacuaacacucgcagcugcagccguuaaagugcacuuuuuaaguaggcgguguuaucaccgagcuccaaggguaaauaaggaaagauacggguucugcagugaucccaugauggugcacucgcguuacgcggggacaccauuaugcagcagaccguuugcacucuuuuuugguagcuggacucugaagcccgacgcagcgccgcaagguugccauggggaccggaggaaacuuuuuuuuaaagcgcccuucugaggccggcgccggcgucgagcugcucucuccccggaggggcccagggcuccaggcgcgcggccggcgggggcggagcucgcgucacguggccgggccggggcggggcgugcgcgcagucuaccgccagcucggccgccgccgccgcugcugccgccgccgcgucccauucaugaggcccggcgggcuccgcuguagcccgcggcuucggaggcggcggccccgcccccugcucccccgcuucuuggggcaucccugcggggcugcacaacaguccgccgagugagagccgcgcgcggugccgcagguaagcgggccggagacagcgccggggcuucccggggggccgcguccccgcucgcggccucgccucgcgugggccacguagccgcggccgcgccgccugaggacgcgcgggcgucugcggagacccucacgucggcagcgguccuccgagccgcgggcggcgcgcccggggaccgcagccccgggccugggggaggggagcggacgccggcgcgcggucgcggucaucccccggccgggacuggcgaggugcaguuauucccucaggccguuggcuugcccgccgccgccgucgccgucgccgccgccuccugcaggccgcggaccugguuuagaugugaguagccuguugccggcgacccccggggcccuggaagguucugucggcugugggaaccggagcucugaggcccaguuuugagcgccgcggauccaccccagccuaagaaaauuauuuucauucaaauuuaggauggcguuucggagccauaauuaugcagaacaagacuaggaagaucgcccucgcuuucagaaaguacuggaacgcaggauacuuggagaggcacugagggauuacugaacaagcggccacacacuuauuuuaaugcaucuuugagacuuaaaaaaaaauuaaaaauggaaacugaggcucuugcauggcgcugaagcucauuugcccagcaguagggaugcugguuaaguugguaccgaaccucgccucacuaauuuaaaacguuaugauaacacaaguugaauuuugaaaucuauuuugggaucauuugccgguuagugucuguguugauccgacauugauugcuuucacuggcuuaaaacuacgaaucguggcagguauugcuagacuggguuagcaacccagccagccaccaagugugggaggaaacagguguuuuagcccucguugggcugcccugcccggugugcccucucacauugcccguggguagccuccuacgggcuuccuccuaguuaaauguguucuugauugugguuuaucggccccagcgaucuucaaguucgagguaguagcagaauagcuguagcaugcuagaaaugaaauggcugggucuacuuucgcguuuguggcaaaauugagauucggcagagcagcuguaugcuuaagaggcucuggaaaugggagcauuugaaaacccuugaacgccaagugcaguuaagcagauaaagggauaaaggucggagcuuuguuucuugaauggcuguaugcuuguucuccuugcuuagccuugugcguuuugguuuacugacuggacuauccccugcacugggcacaggauccccgcaggcaagacuccaauagcuguuuauuacuaagcacagaggcuggcuuuuagaagagcuuugguuggggcuucuugagugaagagaagaagcugcaagcaguuuguccuuguaggucacugggagccaguggaaugaaaugaaaucaucaaauuuucuuguaugguaugccuuggaugggauaaucuuggugcuaucacgggucagagguggucaaagguuaggccagugaacauuacgguggacauuuuguuguguuuaaauauuaauauuggacuuaaauauaguauaggucacugcagcuauccucucugauggugugcauaauauacuucagaagugggacaaugaguuggaacccuucuugcugggaggugcacuggugccucccuuagguguucagcagccugugggcaagaucuuaagucuaaguuaagccuaugugucuugucuuugaaauccucugucuguccccagggccuguugucacuuuguuuagggguggggcuguaggaaguguacccucucaaucagcuggucagcaggguugcaggaguugauuugcaacuuugcuuuagcugugucugacucccuucauugcuaaguaaauuaauacuuuuggcuuagguucaggguccuaggaccugucaccuucauggcaaaauagcuuauagcuuuguagucgggccuucaguugucagaauccaguguaaacaaugucucauuaaaacauuggaaugggggcuggagagauggcucuguaguuaagagcauugacugcucuuccagagguccugaguucaauucccagcaaccacauagugguucacaaccaucuguaacgggaucugacgcccucuuuuggugugucugaagacagcuacaguguacucauauauauaagauaaauaauucuuuaaaaaaauuggaauagcuggaagauauacccugcagugauaacacucugaugaugucuugauaauaaaguuuuuauguuuuugagacagucucauucagauaguucaggucuugaacuuacucuguauugugugccaccauaauugguugaggaaguucugagacuugaacucagggcuuugugcaugcuaggcaaguacucuaccaaccgaacuauauccuaagcccccuguaauaaaauauuugaauacauuuucuuacucacuuugcuaacaguuaggggaucuaccuccccuacaaugucauagguaaaugugugcacuuguguucauguaaacaaagaagggagucaggugccuuccucuauuaccuuauaccauauuguuuucggacagggucucucccugaaccuacaggucauauauuuaguuacucugcuaagccagcaauucucacuccaguuguccagaccuaauggugcugggaucugaacuaggucuucaugauuguacagcaaacauuuuuagccagugauugaucuuuccagccacagcaguggguuuaauagcgaaacacuucacauguuucaguccuguauuuuucaagaugaacauguaagagaaaaaucacucacucuuggggaccacaugaaaucaguagagaucccuaacuauugguagcaacccguaugugguggcgggauggccggaguacuacuacccugugcguucugucugucugccucaccuccagcccuguuguuuauggcaggaagcuugaguugaucaucuccuccuacuguuguuagaaucuggaaagagauaagaggaagaacaagaagagagguugcccaagucguuaucccagugcuuugggaucaggagucagaaggaacucaccaguuccacgauuagcuagccugggguacagagugagaucuuaucucaaaaccaagcaaaaccaaacaaaacaaaacccgaggauguguuaggagacuuuauuacauuguaagaucuauuccgugcgguaugacgacacaagcacuucuuuucuaguuugauucacagacugcaguugagucuuuuuaaaacagcuuuuuacauuuacugacuugugaacccguacauguguacuucuggagccaguguccuuccagcacguggguuccaggaaucagccucagguugacaagcuugcugacaagugucugcugagccaucucacaggcauuagaguccuuugccucagaagccuuuggauauuaauauuaagugauuuuuuuaaacugguggauuuagauagcuguuagugauguuacuaagaaaucaggacagaagguagaacccuaacuugcauaucauguuaaaaacagucaccucuaccucaccucugugcaaagccaaggauuugcaauugggugcugguccuuauauguaaugacacacauuuugaauaggaacugcuguccaguguaagcuuuguaucuuugguguguagacgcuggcuuccagaaggacagaccuaguggggguuggguuguuuuccuuacccagccuuuauccaguuucucagagggcucgcacuucuacuaacuucauuagcuguaacggaauuaacauuauuagcugacacugaacacuaaauuaaaugccacuugacuauaucuucaucugcuucuugcauucccuccauguauugcugaauagugugugcacugucucaacucuucauuuuuaucagcuagaaacauaaaauguuaagugacgguuuauaaauucuaaguugucuucaacucuugucucuccugcucuagacuacgcagugauccauucuuaguuuucaucuuuguucucugaguuuuuggcuuuuuucuccccagacgcuaauacccccaccuccccgcaucuugacuaacuucugcuuuaggcgucaacccccucacauguggcggcaugcuacuuuguguugugugcugcuuggguauuucuuguaguuguuagucauuaucagggugaguaacuuggccuucuuaaacuuucuuacguucgguauaggcagagccccuuugaucuuucuuuaguguaggugcugaacuagagggaaauguaaccuugaguccaaauccugggaagugaauccuuggggguacagcaaagucuagugagaaaguaggacuugaggauugguggcaaguugggcugacaccuguggaguaggaguagcaagguaggaucuaucaacuacacgugcuuauguagggagaagagaccucagagcaggugugcaugagagugcuagcgggcagaggcacugcugagaccugugagcucauggcacugggguguguuuuaagguuuggaguguucuuucaguauuuuuggaguaauaguggaaauuuaaguagcguuuaguggggcuuagagaccagaguuguaaaguuuaggaaacaugauuagagacaaguauuucaacgagaagauucuagauuugaucuccaugguuccaucagauaaagaggaggaacugcaggcaggaaaagcauccuuuagaagugccaagguugguccaggaagagaagauagguauguggcauccaguaccuucuuuaguugcugguuguacuuuugcucuuauauucugaaauguaauggaagggauaguugacacaagaauauucauuuaaacaccuauuuuuaaaucuauaugguacaaugguuucauuuucggaaacagucuuaugcagcccagacuggccuuggaccccuagucucccuaauucaccccccaaggccucuaccuggccugacuaaaagaauuuuuuaaaauaaaaaguuacucaauuuuaaacaaaaagcucaucgauggggacugaaauggagcaguguuaucuggugauuugguuucgugagguuuuggacuguuaucccuuacgucaguaguuaaucuggauuugaagcuuggauugguguugcuuggcucaugcuguaauuucuuccccagugguugagucuguaaaguauggucuuuaggaaaggaagggcuucucuuaggagaggcuguaagucaggaauguccaggcuucaugaagcaucugugggaaaaaacccuuuaaagggaugcacucgucauuauuuucccuuuuaaacacuccaaaacaucuauccacaugcuaaguuuccuuaaauugccuucccuuguuuuugguguguaagaggcaccaaucugacaguuguaccaucuaauuaaauaugaaggaugacuuagaaaagagaaacugauuuacaguguauuggacaaaugccuaauagaaaggguugguuuucaguuguaagguuuucuaaugggucguggcuuaaacuaguucauaguagccuacuuaaucagugugaugcaaaagggugaacuugagaaucugagccuucaacauggucuaugcacuaagcucacucuaucacguggugugaugccuacuagacucaucuaaggguguaucuuagcuuuauaaaacuuauugcuacuaucaucacuugauuaacaccuucuuugggcaggcaugugcugagagcuuuacacugucuuaagagucacuauaauacuaccagguagagagaauggcccugcuuucuaugugagaauucugaagccaagagauguagggaagggcucacagcaaauagcuacucuccuuuggcccuugggccuugcugcccaaggauuuacaauucauaugcauuuacuugauaucccuaagucaacuuuaggaauuuguuuuugcuugcauuugcuagaauaagaaacuguucuuaaugccagcauuuauaaacugguaguagagugcaccugcuguggagcccuggguuucucggaagcauuuauguguacaaggccaauugaaccagggagaggaaaaacaucugggaaaauaauggcauugagaggccccaccauugccugucaggugccuguacugggacgaacugggcaucauccagcuguuguuccccuggggaccucucauuaggcugagacugggucagaggaaauguuuaaaaauuguuuuucaaauauggcagguggcucugugucacuguugggaaggaggagaaaugguuguuggacuguuugauacacgcucguuuguccgcugugcugcugccuuaacggauuuucuucagucacuauaauacuaccaguuccugacuugagaguauacaccagauccccgcagaacaguacugagcagagggacuaagcauuaaguacugagcauuaaccugucagcauuagaugcagaagugccugucucuuucuguguuccaagucuggauuccaucacacugguacccagcugagaccucaguaccgcacauggauggauccuguuuguccuccagggcuuuccuuacagugucacuugacucacucaguacuuacaugugcagauaaggucccugugauggcaccuuuuauuuuauguaauagaaucaaugaguggcuaagaaucuuucauuagacgaaguauauuuagaaccacuuaaaauguauuagcuuauacuaauugugcaaaauaacugacuuuaucgaggcauuuucucaugauacuuuuggcacaugguucacucgguugucucuuggagaccugcaugccugcccgcuuggcuaugucugauacuagaugaggguguguguuaaagcauaccuguuuggaagacugcgagcuaagggcgagucacggggcaaagggagaccugaaaguaacuuguagugcuguugggggaagugaacuagucaucucacguauaaaauaaagcaggguguucuaaacggaggcccugaggguuaggaaugggagucagcuuagagaauugaaagugaaaggcaaagaaguaucuuggggagagcuccuguguuuauauuuuuagugugucaauguuuacuugaaggauuuuuuuuuuuaauauuucaaggaaaccauuuugugugcuugcauagauuuucuuccuugacucuugccuuccuagcgacaauacgagcaguuuuguugcugauaguugauaaaguuaggagugacuauuuuugugugaauucuaguucauguuaauaaaaauugugaagcauuugaaauaaucuuauucuguguauuggaaaauccugugugagaguuuuaauugucaaauugguacagccuaggaguuagccuggggaggagggguugugcgccuugguuuggccugugggccuggcuguggggaucaucuggguuccuuuaccugaugugggaaggcacaaccugaaaguggacuuugagguuuccugguguggagcuguggacugugcaaaagugauaaauuugccuaggguaacuucacaguguaacuaguauuuaucuaauauuuaauacucagcuaguauaagcaguuuucacugcuuaugucuucauagguagauagugugcagaauuacacaugugcggugauuuuacuuuuccuauacauuuuguuuucuuuguagugaacaguggugugcugacuuugcgugacuccaggcucacauugccugacugucaguggggucugcguccuguucugaguaucugagucucucucccguugggucccuuguccucauucuuuacucaauuuccugcuuaucuggaauuguuaccuuugcggcauuuacugggguuuuuuuucuuuauuugugguucuuucucuccuccuccaucucuuaaaucuucaucuucuaacuuugccuucucuuacugaagugccuuucucaccugggaaauaccggccucacuccuggccuuguuuugucccucacaccugagaaggaagguguguuaccagagucugcaggccagagggcgcgagagcaccagagacucaucggggccucuguucuugugaaguugaggagguggcuggcuggcgcugggcucuguuccucugagugggaauguuucugucuugcuugcugugguccugucuguaggggauuccagaggcucuuggcauuuugucuguuaggauugucauugguggacccuucggucguucugguauggccuuucaaggacuuccaugguuucaguuuauuguuauagcucuugagaugaggacugggggaugccacuauguccaagaccucaccagcuuuuagagaacuagucaguauucugugggaugccucacuguaaguuuuccuuauugcuuucucaugauaagacuggguuaugacuaaggaagaccacagaggguaaaguaccuugugacucaugguggucauggccuugaucaacagcaguuugagguuguguguuucagauuuuucucuacugacaaccuaauuuguauuuuuuucuauguauaagaaguuuguaggggggucguaagggggggaugguagugugugugugggggagggggguuggcagccagaggggggcuucccuuucuaaggggaauuggggaaggacuuacaugagggggcacugggaggaaaggaagggcugauaaugggcuguaaagugaauaaauaaauuuaauaaaaaauauugauguguaugcaugcuuucucuguguguaugugaaugcaucauaugugugccugguaccuguggaagucagaagagaguguuggauucccuggaacuggaguuaugggugauugugagauaccauguggugcugggaacugaaccuagguccuuugcaagagcaacaaaugcucuuaacugcugagccagcucucugggcccuauauauuauuuauuuauuuacuuauuuacuuauuuacugaggaggauguaucgcagugaguguguggaggucagaagacaacucuccaggaauugguucuuuauuuacacauuguuaaggcagggucugucucccguguuuuugcugcugugcuggguaugaaagccucaccccaucccaauucucuggucccuaccuuccaucccccaccauccugcuggcccuaguuuaugucuucuagaaauuacucuccuagcuaauaucuaaagggugggaauuacccaugucauuuuugagaguacaguaucaugcauuuggaauuuuauaugaaaaauaaguaucucauuccaguugauaaguucagguuauuugcuugcauuggaauagauucauagauagccucugcuacuguugguuaugauguaauccuguguauguguauaguuugugagggcauuaugacacacugugggcuuagguagcgugaacaauaggaauucauugccucagaauugacucaagcuaagaucaaggcugucugcaagggcuguuuuguuuucuuugucuucaccuucuuuuguguaugaauccauuccaaauccccuguuuaauguaaggacccuuuuaucuuggaauagggcccacuuguuuuuggaggugggguauggucucucuguguagcccuugcuauccuaaaacucagagcucugccugccucugcuuucuaaacgcugggguuacaggccaugugccaccauaccuggcaauagcauuuuauuuugaauauuuuauuaaaaauuuuuuuaaaaacugagcuaaggacccauucugaagaaccagaaccagagcuuagauuuccugucuccauccccagugaaggguguggaaacauugugucauuguguggcuuagcaggguguauaguuacaguaauauuuuaaaaagugccuugaggcacugucugcaauuuucacugaagaucagaaaguccuuaggaaguaauucucagauuauaacuggaaguuuuuguucagucuuguguaaccacuaaaauuucucagauguuuaauaguuuagcgugcuucauucuuauuuguuuucuaaaguaauucagagguuggcaagaacaaagaauccaaugguggggccuagugcaacagaauuagucugguuucuuacaggguagcccauucugaugcuuccuagggucuuuaaacuccauuuuucaguuggcaaguuuccuggaguucuccuuaguuuucuuauucuggucuuucucuguuccuacauguuaaaguaaccucugccccgucccaccccacccccucuuacuuuccucucuccacaccucccucccucauuucccuaacauuuagauuuuaucauagcacacugagggaugacuggcucaguggguaggcauuaugauacugucucaaaggggaaugcuguaguuuugaccucaauuguguuccuuugcauuuaaguuagguuuagagaaauacaagccuccaaaagugaaaugugcauaggcaugaaguauugccgcugacaccugcuaugcaaaaguuggcaaugagccuuggaguuaauagcagguacagagauuuugguggcugagagaaggccuuugggagaaccaagaaauaguugguguaggggcguuguucuguuuguggauaugugugugaagcuguaugugggaaaaugcuguucuaggguguaaaaguaucaguucuuucugcaucuucucugccuguugaaaauggaguaucgauagccauuacagauggcauguaacacuguuaaugucagccucaccuguuaccuaauuauaauuuuaguaguuuuuaguauuacccuuuauuauaugaguaguggaaggaaacuguuggcucuacuaaugaaaauguagcuaugaaggagaaugauugagaacacaaccaaagguacaaagacuguugugggguguguguguguguguguguguguguguguaaccugacacauuuagcuccuuuuuugcccauguaauauauacauuuauauacauuucaauuauucugucauacuggaaaacaccucucccaguaaaucuuuuagcguuagagguauuuuucacccuucacggugguagauuaagguuuuacaaauaguuuaaaaaguuacucacugcacuaucugaugaugagucauguauauaagagaaaugaacuaaguuuuuggcuuaugaguguugugacuauugaaagagcacucuuagaagcuagauggcucccuuuucagagccacauuggguucccaguauucaugacagauauggcuuacaaagaccuguaacuccaucuguagaggaacccaaaugccucuggccuccacaaguaccuguuaaaaauaauaaaaauaaauaagaaagaauucauggguaggaaagaggaacugauaaugugcuagguggugauauguugauuaucagggccuuaagaggugacucacacauagccuucaugugugauuuugcagagaugugaguguaauuagaaaguguugcacaccguggggaagugcuccuaccugccugagcacaggccugggagagcucaggcuguuagcuucaccuuuacagcuguuucauauggcuguaggcucuucugacccauuucugucuuguccugccugauuguagcuagacugugaauuagaccuaacuuguugagcaauggacugaagaguggcauucaguugguugagcuccucagaaagggaaaaggauucgcaaggcuaaaaagacuuaaagcacuguugauggcagugagaauuuagauggagucauuuguauuuuccugugucccucucuaaauagugaccaccuucguggcagugacccaacugacaguuacugauuaagcauggacugugcguggcauaguuuuugucuuuaaguaguuuuugggcaccaccucauggaguccuaaccacaguccuaccugauagguguuccugccccaggucaagcugaaacuaagaaugguuaugugcugcagguucuuaucauagcaagugagagcgcuauguaugauguuagacgcagcuuacggaccugcuggcccacugccaacauuucuaagaaccuagcaaacccgucagucacaaauaagggaaaugccauucguguaacuuggugguucuuguguugcucaugagggcuuauagcuguaaacccagcacuggguagaccggaaggaacaucauuaguuugaggccagccuagguaggcuaccuagugaauuuugccaaggcugaaaaaugaaaaccugucucagaccuaaccaaccaucaaaacaaagaggacuaacuaaauacacaaaugaagaaugauggugauuaccaccugggggcagguuugcugccagcagacuuucaaaaguaaacagaauuuuuguuuuguuuuguuuuguuuuguuuuguuuuuaauuguuacaguuuaagagagggugcugcugacaucuagugguugaaggccagggacgcugagugucuuuuuauucccaaagauuuaucugaccccaaaugaaguaugcuaagacuggaaaauccagacuuaaaaauauaucaaaaguuagaaagccaggccgggcgugguggcacacaccuuuaaucccagcacuugggaggcagaggcaggugaauuucugaguucgaggccagccuggucuaucgagugaguuccaggacagccagggccacagagaaacccucucuugaaaaaccaaaaaaaaaaaaaaaaaaaaaaaaagcuagaaagccaaucagcauuccuguggucuggccgcugacacccccccccccacacacacaccucacugcucugcuguucuccagcuguuucuuugugcaucacagggcaugguaugaggcaaucugacugaugcuaaccaccaauucucuugggcaaauugaaucuauguuuaaaaacuuagauagaagucugcaaagagagaaagccagcuuauguuccaaauguucuaauguugcagucuuucuagagugcagggagcagaguuagaggauggcaugguuccuggccuguaagaggaaguauuugguuaguggacauuguauuuccauauucagaucuuggagggauagaugugcauguguguacauccugugcuacuuuaaggacuguugucauguauguaguaaagccagacugagcuuuuggcuuuacuacaugcaugugguggcuuuucuugguugucaaccuugacuacaucuagaauuaacuaaaacccaagcagcuggguauagcaaugagggaugguuuuucuuaaugaaguuaucugaaguagccagacccacuuuuaauccggaucuucuuaugagggaagacccacccauaauccagacuuuuggaggugagaacauccacuuuuaaugugggccacaccuucugcuggcagucuauaauguaaggacuuggaagaagaaagcuuauucuuucuaccugccucucccuccuuugauggcuuuagagucuacuucucuggaauucuggcauauacugaagaccaucugagccauccagccuuguggacugaacagcuacuggacucuuagccuuuuguugguaaauagccuuuguuguauuaccuggagcauaaccuguaagccauuauaauaaauccucuucauauauauauauagauauauagauauagauauagauauagauauauauauagauauauauauagauauauauagauauauagauucauucuauaaauuuuguuccuuuagaaaacccugacugauaaagcauauuuuaacuacuuugucugaggaauaauugaaaauuuuucuacaccugaauguucuuguuucacaaauaguaguuaacuuagaaucagagguucuugggcugggggcagugacucagugagaaaaauguucauccugaaagcacagcacccgaguuugaaucucuagaaccacguacagcuagacacauuaucaguugucugaauccagugcuucuauggcaauaugggaggcugagacaggagaauugcuccuguccccauuagcugguccaugcagcagcugacaacagagacucugugacaaacaagguggaaggcaaggaccacagaguguccucugaccuccaucuuuacacacgugacuaugcaagugcacacguagcacacauaccacauucauucuuagaaucuauaaguuaaagaggggcucuaggaaagcuuuggccacaagacauuguaguugugugaguauacauacacauuaugcugucugucaacgaggacacuggauagaagacacaucccagcacuugguuaggcuuugaaaaaugugauuaucauaaacuaccauuuaacuguuuucucccaggcuacauaauagauccuuagaagccugauaagggcuggagagaugguugcguuaagagcacuuuauugcucuugcagaggacaggcgcuugauuuccauaguggggugagggugaggguucacagcucccuguaacucuagcuccacauggaucuaaugaccucuucuggccuucacaggcaccugcgucugugacgugcgcucaguaaagcaguagcucaguauuaagcaguagcucccuagcccucguccuaacgcagucugugcgugaucuuucacauuccuuuguaggccaaggcuagucuucaguccuggcucuccuccuaccuuaccuucuugaguggcugggacugcagacauguguauccacacccagcucuagucugacuuauuaaugugccuuuucuagguuuuuaguuuuguuuuuguuuuuacugaaaucauaugaugcccuuuuauguaugcuuuguuuuuuuuuuuuuuuuuuuuuuuuuuuaagcaugcuucagggacuggcuagcauaugucagaaccucauuuguuuuuauagcuagagaauauacaucuuuuuauauguucuacauuuuucuccaucuacuaauggaacauugugaguuuuccaacuaacucauucaguauucugagcaaugcuuccaugaacaauuuuacuuacaagcaucaguuugagucucuucaaguuuucauguacauaccugaauauggaaugacaggauuuuauagucacucacuguuuagauuucugaauaacugccagacaauuuccacaguggcuucacaauuuugcauucccauuaagagugcacaaaguuuuucuacccugcugguacuugucuucaaaaaguuaugguaguuguagugggcaguggcgugacagggucacugugguuugacuuguauuucacgggugaaucuucucaucuccucacuggcuguugguauaccuucuuuaaagguuuguucagacccuuugcccacacuuuaauuuccuuucuuuauuuucucaggggaggacauugaugcaugcaggccagagucagcuuugaggaguuaguucuuuuuccaugaguucugggaaucaaacucuaguugccagguuugaccacgugcuccuuaacuugcuaagcuaucuccucagccauaaauaacauguccuuuugaugacuuguaauucuuuauauagucuggauauuaaacucucaucaaagaugauuuaaaaauauuuucuuauauucuuagguugucuuuucauaaugucccuugauauaaaaucugcuuucaauuuuaagaagaguacuaucugcauauuuuauucauguucauccaugucauugcaaagaugauuugucaggagaggccagaagagggcaucggaucuucccagaacugaaguuacugaacuugugagcugucauguugguguuagaaaccaagucuggcucucugaaagaguagccagugcucuuaaccacugaaccguuauuccagcuccucugacauuucguugaaucucuuauuuuguaaucugugagggaaaggaguaagcaauucuaaggaucaaagaugaauacauacgaaggacuaagaacugugacuuuuccaccugagcguccccaguuagccagcaacucugacaguguggcaucagucugccccagaggggcaucaucacacuggggaucacaggaccccauguuuuguugcuuuaaguggaagauagacuccugugguuuagcuuacccaaggacuucagccaaucauccaaauaauugaaaauccagggguggucuggaagucuggaauacugagugauugaugcguucucagugcacuuauuugccaaguucguauauagaacacacaauuauacaguauuaguuauuaaaauccauccuagagaaauuugccuagcucccuggagagcuggcaugcugaagacacgcauaggccaccuacaacaggugucacucuaauguacaaguaugugguagagagaugggagagacagagacacagaaaccggagacuugggggugauagggaauagccugaugugaguagccuauacugccaccuaaggccaugaugaaggccagccugugcugccucagagggucucacagugucuauggccaugcagcaacaggagucugugucaaugucugugacccauguuaccaccaaaggccaugugagagcacugggcugccacuggggccguguagauguucaagggcugcccagagcuggccaugccccucaucagcuacagcacucuagagagaggucccccacauguggaacugggcagcacaaguagagcuggcccugguggcagauccagccgcacggcucuggagcuccggagagcugguaccaaccucgucugcugugagguggucugggugccggagagaugcucucuuccucucacccucaucccuuacggcagcagaagagcagccccugcaccuccccugugcaucacaguaaagcugacuugggguagugaaguugcaggugagugggacccaaggaauggaaugggagagaaaccaaggacaugugaaugggguggagguggggguaagcuggccccagcugcagcaggugggugaacuagcugaggcagugcuagagagcuagcacuauuaguguggguuugagagagcuggugugcucacuagcucagauaccacccaggcccagauccagggcuuugaguuggcccacccguauaucuagcccaucuaugaacugcugaaguggguaaaggggccaguccuacagauccaaagcugcugcagaaucuccaugaaacaggacaacaacauauauccaagaggagucaggagucauauauccugggugaggauucaguauuguuaauguagcagaagccagaggucccaagccugaccaugauucauuacaguggacauuuguaaguaaagauguuugagcaaaacacugugacacacugcaucuccagggcaagauggaguguugguuuguuugcuuuuuguuuguuucuguuuugugggcagguugcagagguagagggcaaauacaaagagacagggagaugagugggauugggguacaugaugugaaauaaacaaaucaauaaaaaguuuuaaaaagagaaaaggaaaaagaaaggaaaagaaaaaaaggagaaggagaaacccaccacaccuugcugucccauguacuuaauaaugaaaaaacagaaucugauucucugggcaucauuuuaacuuugcuuuugaagcuaggugcaaacuuaaaucuuagaaacuucugucccuccguuccuuuccaucaccagacagucuuauuuuacagcacagacugucuugaacuuucuacguagcccagguucuccucacuccugagucagccucuugaaugcuggcguuggaggcauagaccacauucugauccccacuuuucaaagucucaaaagagccgacacaguggccuuucccuagagucucaagacuuaggaggcugagaugguaguauggcuugaguccagccugggcaaaguggggaggucugcuuucgagggucaaggugggcagauaauuaaaaaaaaaaugcuaugcaaaaguaaaaauauuuuucucaggauucaaccauuuguauaaaaaauaaaacaaaucaaaacaaacaaacaaacaaacaaccccacguaucccaggcuggccuggccuggcccacacgcuugagccgaugcugggcuuccuuccugacccuuuccuucuccuccugagugcugcaccauccgaccugcuuuauugaugcuuuagggaugggacgggacucagggcuuccugaaggcgagaugcuugcuccuucuacacugugcuccuuccaaagcccucggagucacuguuauccuuaaccuggacagaagagcugaugcuuuucuuugaaaguuauggggcugauuggaaaugguugcccgugauuuuacuguguguuggacaugaugaaaagugccgccugagcagccuucaggauuccagagguggcgaucuagguguagagaggagcucaucucugguggguccaagguacacgcuguuugcaggcaggacaguuugugaguuauucaucaaaacagugacauaauacugaggugggcaggaacccauguaagaggccuuuggagugacccuuguccacugacuuuguuacagcugucacugcccugcugaguuccacacucuucacuuguugagccauggccucugagucugccagcugcuucucucugggucucagcaaugaaacaaauaaaccacagaaaggacuggagaagcuggggggagucucauucuguacccugcccucuucagcaagugaccucuaguuaguagcuugaccucuuucugggccuuaguuagcuuccucacauuuaaaacaugauuuuucucuuuucugucuccaucuacccuccugcuuaauucugccuuuuccgauuucucucuauauauuuucuuacccacauuuuauuuccucugcaucuaacuuuucaucuuaggucauuucuccuuaaucaauucccuguucguuuuucucccauucuucucuccugaccucucaugucucccucaccucagagugacauuuuauugcucuugucugaugccggggccuggagcuacugcaggucaugggggaagagucuggaauuuuuguccauggcauaacauuucagcugucagaacucuucaguuccccugugaagggggagaguaguauaugugauguguaauuaaauugcaagugaguauggaugcuuuguuaaucucugacagcagcugggaaaaugacuugaauauaaugaauggguuuccuauuuuuaauguuggggagauugauuucucaauuguucuccuuauuuucuacaauucguuuuguggguggagugccacagcaugugugugaaggucagaggacaguguaugggagucauuucuuccaccauaggaguuuuagggacagaacucagguugucgggcuugggaaaugcuuuacccacugagacaccuccaucacaccucaguuuguuugaguccugauggaguguugcugcaguuagcauuuccauccccucuuggccaaaauguuugagugaaucagaggguugaugaauuaaauacuugaaaagaaugauuaaaaucccguuaucuuuaguuccucauuaggaaaacauuucgccucuccagguucuuuugguguuaaaaacaguggcauaagcagaaguugcaugugugcuguaguguaacuucagauucccucccugucauguuauuaaaagaagcggcagaggcuggagguagcucugugggagagaggugccugcuaugcagcauaggggucugaguuggaguccagcacacaugggaaagcuuaugugcacaccuuuagcacugccgaggauugcaaagaaggaucacuggggcuuguuggcugucacacaagcucuagguucagugagagacccugucucaaagaaauaaggaagagcagaguaauauagcagacuugacuuagucuguccucugaacauugcacaucacucuaagcauguguaccugugccauacuuuaacauacaagauguaaaaagaaucccaaaaauucaauuaguauauuuaauucagaauauagaauauuauuuuacuacacauauacaucacaauuucuucacuuucuuuuuucauauuaagccuuccaaaucaaguggccaucuucacucauuaauaacauuuaguacuagcuugcaaauucaauaggcuuauauggcuggaggcuauuuguaauaaauuccagagucuuagaaaaugacuucaauaaaauguuuuaacuuaaaaaugaaguauauaugugugccuuaccuauguguaucgugugcgcuaggguucuagaaaaguuugagguaaccauguaggcauucugagagcuggcaaguaaacacugugaacuaaguauugcccugucacacucgugaaaucaucuaguuuugucauuuauagagugcugagccaggguaucucccagguuugugagaagugcuagguuaugccaguauaaugaagaaaaaauaucuaguaguuagacuauagaagcgcagugaugcagucuaagcauaugaaaaguuuuucccucgcaugacuacaggaguuuuuuuacccccuguguauagcuguuuuuauuucugcauaugaagaugugauuggcuuaaggaaucauuaacucaaucccuguucugugugauggaagcuguaguugaccgucuugugauugggcaggacuugguaccuaucaguguaaacacauggugcggccugccccaugccccugcuuaucauccguggagagauggggcugaggcauuuugagcaaaucucauugguaaaguggugugugcauugcuuuuuuuuuuuuuuaaagaccuguuugcuuucaguuuuaacuaugucccuuucugcggcaguuagcacuugguuguccacagaauaaguuuuuguuuguggugccuucaccucuguagguagagucaugcuugaguagucucuuuaguuuaaagaugcuuuaccuagaagauaacagugaagaugagaagacgguucaggaaagcucguugaguaaaccugcaaguguuuaccauggcaaggccccuccugggauucuggugaguuuccuucacccacuucucuuucccuuugcuugaggcucagacuggguagcacugagaaggggcagcaccugcuaaaugaaaguggugagcgccccuguaaguggugagcgccccucguuuggaaaauguauuguugugguaaguuucuaauuuuuaaaauguuacaaagaacacaaaucuuuggcugcccgcucuccccacuugccuuuaugccuuccuuacucuguucguuauuauuuaauaacuuuaugccuagaaaaaaugcguuugcucuaaacugagaacuugucuaccgcuagauuucaaagcaacgugcugagcucuguucuugcaucucagguggugguugaggggguagaagucacuuaaguuuuauggguuuuauuguccuggcaaacucuccuguaaggcuaagcaaguauuuugaaaguggcauuuuguuuggcuaugugauacaaaagaaugauguuaggcugucccuuuuaugacuaugaacaaacaaaaaguaugccuguuggaguuggaacuuuuaaucuaguuuucucuugcuacaagguacaaagucaaauaugacuucuaaguuuugaguucuagaaaucuguuaaggaaacaaagucagaugauguaaagauaagaucauuuaacucugcuggugggaccuuaaaaaaccaauguguucgaaucugucugacuuuaauuacauugguuuuuguuuugcaugagggucuugguguguugcucaugcugacugcuucuguggguuggccuugaacuuacuauccuccugccucagcacuccugaguguugggaaucacaguccugugccacuaggguugucuuaaaugcucauuuuaaaggcagaggcuaaaaaacuacauucagauaaucaggaacuccaaaugagaguacugacguuguaucuucucauuaaauugccuugguuacuuuuuuaaaaaaucgaauuagguugaauauuuuuaugaaaacuaggaugaagucaacaaaauaaaaaaugaauaaauucugaaaucuguuaaccuaguugauuuggguuuuaaaggcaugagagugcuuaugcugccuuagaaguuuugccauauucugucugauauugaugagguuaccgguguccacauacagacuucacucacuaguggcagcauuaaucgaguaugaauaugagucauaagauucugugcgaggcaauuuuauuuuuaagucugucauaauacaaaggguauguuuaugcauucgugcacgucugucuuaauggucagaggaaaggauaugggcauacuuguuucucuguggaauaguucuaaaguccacuuagugguaccgcauauagacugcccauuucaagggaauuucuuugauguuuugcuacugauguuuucaagggaagucagagacguuugcuuagacugcaauuuguuaacaguucccucuuaugucauugaugugcccugagucaccaccccaccccaagagaauuuucugaauggcuaguggcuggcauacuagauuugauaucugcuuuaauaagcuaugauaauuauuuaggaguuugacuuuugaacgaacaugggugugugcaguaaagagcccuggcuuuuaaauuaaccagagcucuaaguguugaaccaggcagacagacagaaggauaauaaggcaagaaguccucugucuuccugacuaccagauuuguugaggaaagugguuuggagucuaaacaggacuuccacagauuaaacggacauuaaacagaugucuucacugcacuccccaacccuggcccugccagugcccaugaugagcugagccccauggcuucccuccuccaccucacuccccgaacugaggagucgcacuggcugugugcuagcgcugcggaaauccuuguaucugagagaguguucuaaaacaccuggacgaagggugcucugauagaaccucaggcugcugacucggucuuaaaggaacugggacacaauucccuaaaaggucuaaaaucuuacccuucuugggaaaguauuuaauaccauuuauguauucuaauccaauucuacaggguuacaaaguccacacaguaggaaaagaaaacuauaggcucacauucuagaguaaaugaauucugugugugauguuuuuuaccuaauugaaaauagggcaacuugugugaguuuucacggcuuucaugucuuauuguagaacuuguuuucccucuuccucaaauccuauaugcuccggaggacuuauccaaaugucuuuuguaagucaucaguacugcugauggucuuuuuuaacugugaugaaauccuacuugcuccugggugccuuugguagaucaucuuagcugcuguccaucugcaagggagcuucccuagcaguguguauguaggcacgcuguaagggucuguaagugugguggcuccuaggcucaagaggcagaagcagaagacuggugaguuugaggccagccugggcuuuuuguuaaacugucucaaagugaaaaacaaaauagagguaaagaaaaaaagaacuccaccuacagugaacccuggggcagcccugaagggaguuguguaaucucagaaguguuaucacgcgcacagauugaccagcaaacaaguggaucuccauccaggucaaggggcacaagagcugagauugugguggucaucuaucaccuuauauuccuuacuugguaacagugcauaguaccauagcccauauaggcugacauccacucaugagcuauauugaaacuauauuggaaaaaacccaauuccuucgaggacaaugaagcaaaaaaggaagaaaaaaaaaaaagcaguaaguaucaccuucaacuuugagaacugaaagcuugccucuggucgucaauuugaaguaaagugacauuuaggagucagucacuugaggacuugggaacuacuguaccuguagugagguuguaugcugguccuaggaaggccucgagggccucugcugugagccagagaguacuauucccucacauguaugugccaaacagacugaagcaguagggagcccaagacacaccacacacacacacacacacacacacacacacgcacacacacgcacgcacauuuucuauuucagaacccgccucucugguugcuguguguccucagucagucccuuccaaccuucuuacucuucccuguuuucagggucuucacauuucagugaauacugaucagacuugcuguauccuuaauuuugguuugucugauaucaucucacaauuagguugggauuuuguguucuugacaaaauaccacagaaacaaugacuccguuuuaaugagucgccucuugauuauuugauuaugguggugccugaaggucccacacuguaaagcuacugucuucccuuuuguguaagagugugacguggcuaccuauagucaccaggggaugcuuaggagguucugcuuccccucagccacgcuuucaaguacaacugggccagaauuuuacuaaaaccaauucuauuucaacucuuaaguauagcuuucuuucuauagaaaauauuauucuaucagacuuauugauaaacaaaggucuuagcuuuggguuguugaggcugucacugaccuuuggccugcgaguguuaauagcugccuuguuaauagaagugcugugauacucuuuaagccacagugaguccugugccucacugcucccugggcuuuaccagggcaccaucagacucaggggagaccuucagccuagagaacucacacaguuguaugauuccucaguaucagugucccuuggcucuaggcuuuaaaacuauuuuaaacuguuuuaaaggggguggaagggggcaagaaaagagaagagggaaagauaaaugagguuuaaccuaacuuuuccuggggcuacgacuacaugaauauuagacucugguggucaaaggacagcuucagccugguuacagucuaaucuuaauguagguuguaagcccagggaguguauugauucuaaaagagucauauuaauuuuuuuuaagauuuauuucauuuaugugaguacauuauagcugucuucagacacaccagaagagggcaguagaucuuauuacagagccaccaugugguugcugggaauugaacucaggaccucuggaagagcagucagugcucuuaaccuuugagccaugucuccagcccagaaaugacaguucagauggcugggagccaucaaacaguagcuggaguucaaacugaggucuuuuggguccacagucuuaccugcuaacccacagcuccagcacauauuaauucuuggcuuagaagucagugcauaaguaaaaagaaccuccaguaaggagggaugcuucaaaggaaauuguauauuguacauuguacuacccguauauuuaauagucaucccugagguagaaagcaugguuucuauagcaacuuacuaaaacuggaugacuuuauguggaagccaaaggaccagacuucuguguuuauuuuagagaccuugaaguuauuaucacuaccaaaauagacuaguaguauaguuaucacauuguaaguagaagguuuaaagcugggagugugagggagagaaaguuuagaacuugacccuuuaaacauagguuucugaucauaacauaucuaagucuacuuguguuuuuuguuuuauuuggagguggggagugggguucaaaacaggguuucucuguguagcccuggcuauccuggaauucacuuuguagaccaggcuagccucaaaugcaaagagauccucuugccucugccucccaaaugcuggggcuaaagguguaugccaccaugccccuucuaaagcuuauugaaacuucuucuuuuucuuccuccuucucuuccuccucuucuuccuccacagggcagggcaguguuguuguggggguugggaagagaaguugauacccccucuccuaugugcugcuugccauguuagaaucugcucguuauuuugaaaucugaagauguguacaugaguaagcauguagcuuuuccuacucuagucuaaauauggcuacugaagaaauacacucguacauuguugaauguuuaaacuguagcucuaacauuccugaagccauguuguauagauuguaauguuguguuuugaaauaaccuggcccaccuuucauugugugugucuguagucugggaugaucacuugucaccuaguuacccacacugacucccacaggaacuuccuuuucagaccagcagacucucuugucugcaguuuucugcuggaccacuuaaggguccuucagaaugaucuguauggcugucguuugcucucacagguauauuuugagacuuuacauuaugaggugagugucucgucacugucuaaguuagacuaugcagguuuuccccugggaggcuguuggcuagugucuggagaaaaguguuugguuucuguugugugagcaucacuuuuaggacuuugaguugacuguacugguaucuaaaaaaaaaugugugucuguguguguguggacacaaguugggagcacuuucacaggcuugcagcugucuuacuguguccucacauggcaagguaaaaggaugcuggcucuuaacuuuuucuauaggcaccugugaggaugggcacuaauguucacucucgugaccucaucuaaacggauuacguuuaaaggcccuucuccaaauaccuucacuuagcaugagggcuucagugcaugcaguggggguaggaggcacguagaagcauccacccuguaacaucgcccaauguaucugaagcuucuguuucuauaguucuuaaaauacuuggaggccaggcaugguggugcacaccuuugauggguaucugugaguuugaggcuaguuuaguguacaaauuaaauuccaucucagacagccaagaucauaccgugaaaucccaucucaaaauaaggucuaucugggguaagugggcucucugagaguuacugcugcuagguuuccuguguggucagcagguugcucuggcugucucugggguaaguaucuguuucaguccaggccuccguguaacuuuugguuuuguauccuacaaaauuuaaacccaaagggcuucaugccuuccaagaaaaaacaaguuuauuuuuaauuuuuuaaauuuuuuaaacaauuuuauuagauauuuucuucauuuacaauucaaaugcuaucccaaaaguccccuauacccuccccccacccugcuccccuacccacccucucucuucuuggcccuggcguuccccuguacugaggcauauaaaguuugcuagaccagggggccucucuucccaaugauggccgacuaggccauccucuacuacauaugcagcuagagacccgagcucugggagggguacugguuaguucauauuguuguuccaccuauagggcugcagaucccuucagcuccagaaaacaaguuucuuaacagccuguauuuugcuacauuuagcaacuaaauuuccacacuagauuuucauguauaacagcauaucucuuaaccacaguaauuaaaaucauccugaauagauguuguuauauuuaauuauggauuguaugcucuaguugauauaagcuuguuacacauuuagaacaugguuguuuauggcugaauauagauguuuaaaaguagccauuuucaguuucuuuuuuaaggucuguacuauuauuuuuuuuuuuuuuuuacaaauuguaacaguauucauuuuaucauuaccaccauuggucagucauauaauacugacugcuuagucuggugcagcagauaaaacagcauauuuuaaguguguguaacuuaagaggacaggaauagucaggugugguaggugacaaagaagcauuucugguaaaagaggcgaugagcugaacuaccuccagaugaauuucaccucagggcugguuuuggagauagucugucuuuaacauaaaauggcaguauaccaugaccacagaagugggaacaaagaccugcauuuucuucccuucuuagugagaugaggacucucugaguccugucaugccauagucagacacucguggggcagagcagugcaugaaaagauggauguucagcuuuguuagguauuaaagaaaugcaaaucuuuguaaucauggccaaacaguacugccucauugugugccaaugccagauaacuucaccucguagacauugcuggugggaagauaaaaugguagagcagcucuggaaaguagucugacugcuccgaaacagccacgccuguagugguuuacaacggacaagcugcacucaguuguacacacacaguguguggauacuuaaaauugugccuuuaucuguaauagccagaaacugcaguuacuuguucuucaacaagagguuuauuuuggggggaggguuguuuuguuuucuuuuuaaugguaagucuauaccaugaaauacugugcagcaauaaaauagaaugaguucauuaauacagccaucuggaucagucuccagagaauuaugagggaaagaaggcaguccuaaaaggcuacauucuucauggugcuguguguaugacuuccuuucuaaauggcagacauuucagaaauagaaaacauauuaauguugccagggacuggggaggagaaggcaagagaaaaaugugugugacuguauggggcaacaggauuguugugcugaugguggaauuucggguuuucacaaucccacccccauccuagacuggguuucucuguguagcccuggcuguccuagaacucacuuuguaggccaugcuggcuacaaacuuagagauccaccugccucugcuucccaagcgcugggauuaaaggcgugcguuaacgcugccuggcguguuccgucauuaccugcgauuguugguguccuuguuaugauauuuugcuugugcaucccaauuaacaccaaguaaaagacacucaguugaguggacgcucaguagaggauuuggggcagccauauucuuucuuggagcucugaaggucuacacugaucucacagcaguuuacuguuguuuauuugcuguauuagagguaggaucucaugcagcccaggccgcuucugaacucuggauccagaaauguuaaucuuuaaaaacauaaugagccaggaauaguggugcucaggaggcagaggcaagugggucucugugaguccaggccgguagcguccucauagugaauuccaggccugcuggggcuacauaguaagaccauuucaaaaagaaaaaauacaaugagauuauccaugagugaucugauggaauaguauuucugcugcacauaguacaguaaugacucuuagcuguuuauugguuuuagcuuguuuauugguaguucauuugauaguucuuuccuuauucaagaaauaauuauugucaaauauaguagcacacaccuguaaucccaacacuuuagagacuaaaguugucuuaaguucuaggccaucuugacuacaaagagacccuggagagaaagguuggucaggagugguggcaccuuuaaucucagcauccaggaggcaggggugggcagaucccucugugcucagaagcaaccuagucuaugucuugaguuucaggccagccaggacuguacagugagacucuaucucaaaaaaauuuuuuuuucaaaaauuaaguauuugaugugugcuuaaucuggccuugcuaucaaaauaaaagcaaccauccucauccuaaaaccaaagccaccuguuuauaauuguuucauggcuauaacauauuuucuuuauaauuaugacauccuccaccuuaggagaucguaguaaauguagcugcuuguguacauugcacaaagcaagcucuuuggaaugugcaguuggaaaccuuggaauacccaggggaauaaucaggauuauaugcuucaggcuacucaacagcuagacugugguuacagucaucucuguauagacuguugaguggagucugucuugccuuaggcacugacugucucuggccaguaggcugaguuaugugcugaugggaccuggcagguccacuucauuuuuuuuaggggaucagcacuuugucccuguuccaccuaggacuuaccugacaacacagaaugucucucuagaacuuugcaaauauggaaucuugagcuuagggcaaccagagcugguuuagagaggccacucugcgcaguuaauaguuuggacucauuacuccuagaguccaauaaaaauugacuucugcauuagccuaaagcuggagguuuuucugauccuacauccaggggauggacucucuguggauuuggcuuuaacguaacauaaaggugucugcugagugaugguguguucacccgcuggagggagagcugacagccugaggacuaauggguuuguuuugguguggguuggguuuuucaguggaugagucaggguaaggggugaagccagauuuagauguacccucucucuuuugaauugcagagcucuggugaucuugauuugaguagugaguugaaguugagaaaccaaaaccccuuuugugcucugaacauugugggacacaaacguuaugucccauuaugccauguugagguucugaagucaugguacguguguuagucuuggcgcagcuuaccacagcucgcuugacgcagcauguaccugauguaucugaaccagaagaucucgguucucaguuguaucccuugucucucugcaaagauaaaucccaagcuuccccuggaggugacaguccuccuguccuugccuccuguggucagaguggacauaguacugcagguccugagcgguugguggagggagaugaagacaguuggccccacccugggguguggaaggaaacagaacuuccacagccuccaaccccacuuagaggcacugccagucugagacauaugugugauguagcuggggcagcaggagagcaaugggcucuggacagcagagcagaguguauguuuaaucaaacucuuuaugucguugcuguuaguugucaaaguuagugcugacaucguuuucuuuucucagucucaaaccaugaauuaugugggccagcuggcugggcaggugcucgucacugugaaggaacucuacaagggcauuaaccaagccacguugucuggaugcaucgauguggucguggugaggcagcaggauggcuccuaccagugcucgccuuuucacguacgcuucgggaagcuggguguccugagguccaaggagaaaguggugagugcacaggucaccauggugaccggccccuuccucuuacucuuuuuuuuuuuuuuaaacuugcaugcuauugaagaccaugguaagaaaccaacuuuauagguacugcuuuugaauuggcuucuaaauucaaaagacucucuuauagaaaguuucuccaaaugaaaaagaaacugaaaucaugaagagacucagaacaaaacuggagauaauuacaaaugaggaaguugggcuuauuuugaaaaagaaauuuugcuuuauuuaauauagcacuuuaaaauaguguagggccagcaagaugauucagugguaaaggcucucuccaucaguccugagacccacagggugcaacaagagaacacacucagaagucauccagugacuugacccguguacccuguggcucauguacaugcuuuaaauccucaguuuaaaaaaaaaaaaaggcucucuaaaaauaaaauaaugcagucuggagauacagcuuagucagcaaaacauuugcauaccaugcaccaagccugugcaggcacugaggagguagagacagaaggacaggagcauucucagcucagccacauagcagaggugcacgaggccagccugagacacaggagagccuguugauugauugauugauacauacacacaaacauauaugauaauauuguuguacugauuaugaguagguagacuaagcucauguaaucaaguguagauuauauuuauuuaaaagaaauaaacaccccaauugaauguuuguauuuuuccucuuuugcauuuaauggggggcaguguuuggauguuuuuaaauuaucauuucccucaaguauugggcaauaagaagguuuuugaauuguguguaugguagguuuuaaaacagaguuaaugauaaaacuuuguagagcauguauuuggcaacuuuucacuuccacauugucuuccacauggugauaauaaugucagcaacucuuacuaagauuucggagcacuuugccacuggguagcacaguggaagggugggugccgaaggaccaacaugcacaaguuaaagagguuuuugcugguguuuuuuuggauauacaucucccucuacuuaggcuuuggguuuuugaaacugaaagaaaguggguuuccaaaacuagacuuuauuuuucaaagagaaaccaucucuuuggguguuauaaaaucauuucccacuggauuuuucagacuagccuuugcuugaucccauuagaaagcagaagcagcuacaguguuacuucuuggccuggcagcuucuacucuagggcaggguugucuagccauaguuagugcuuucuguguuuguuuccuuugugguuuuuguagugacacuauuaguacuuucauauuagagcuguuucuccauagauguucaaggaucuguuuguaaaauuucuuuugggggucuucucagaaguuucucccaccauaccauacccgccccccaccguucucuggaaccagguuucuaauugauagguugacucaggcuuuuggccuuugaguggagcugcagcagaugugugcaggcauuuguccucuguguaagugagaagcugagcagauguguguauucucugugcacuuuguaauuagagauguaauuucuuuaccagguuacacgggugguuuuauuaaccauuaacuguuaaauaccuugucagacaucccaccccuaccccaaguacuuuuaggaucauaauacacagggcccaagaaaagaaaaaauuucuucuuuccuguucccuuccuucauaucccagaaucuaggagaucuauuugagaagaaaucuguccauuugauuuaccaaaacacagcuuucuuaugaaaguaaaacuugagcuuuaucugucauaggcgcacuggugacuuacauugaccucuugucgcaggccuuucugcauuaggguaagcuguucacugauuuuuaaauuaacuacauuuucacguguggcagcaccugaaaucauaacuacuuuaaaacagcuguuuagaggcagucauuuccuaugacguguccauguuugacagaagaccaguccucuugugacaucuaguaacucagaguacacguuuuguuaauguuucacaaaaucaguaucaugauuauuuauugaaguaaaugcccaauguauuggaacuguccccagcaugggugacaaaagccuacccuccuacuguuauaagcagaaaaguuaggccaaaguccaggggcaucuacuuuagucagugcugguguagggagggguuaaaggcacuggcaggauucugauuccccaccuuagaguucugccucugucugaguucuuccucaugccagacagcagccagugcugccaggcucacugccauuaauucagccagcacaggcgagagagacauugccuuuagaagugcuggcuucaugcuuggaucacauccauccaaggcuagucacugucgcuggaauggaacaaguccauugggcuggauuaaauaaaagccucaccuucaccugaauccacuugaaauguagagucugaaauaaggaugggcagaucccagaagguaucagagauacucacaacuaaaggaugcacaucaaagcagacauucauuaccuccaguaucuguaucuucucauuuuagcaucaguugaauacauugaacaaggcuaaagcacaaucuaggaauacaacuagggaauaaugagucaccaccauuagacaguaucacuagaauuugacaaauugagaguccuccuuggggagcacuugaucuaccuuggugcuugucuuaguugcuggucuguugcugugaagagauaucauuaccaaagcaacuuauauaagagaacauuuaacuaagggcuugugaggguaaguccaugaccaucaaggcaggaaucauggauauagacuggccuggugcugcaggaggagcugagagcuuacauucuugucuacaaauuggagacaguugguaugggcucuuaaaaaucaaagcccacccccaaugacauaaaagaccacaccuccuaauccuuccuaaauaguuccaccaagggaaccauguucucacgugcacaaguuggguugguuuugguugguuuuuuuuuuuuuggggggggguguuguuugccuaaggaauucuuguacauucuuuuuguuuugcuuuguuuuguuuuguuuuguuuuuccgagacaggcuuucucuguauagcccuggcuguccuggaacucacucuguagaccaggcuggccuugaacucagaaaucuaccaagcacauucuuuuaagugcacucaguacuggcacaauuugacauauguuuuaauuuuuggaaagacaaaacuuuauucauagacaaaugaagagaguaaauaagugaacauguugaguaauguauuugaaucucaagauaauggcugugagugguaguuuuucuaagaugaugccuacgcaauuuagacuuugaauuugcauuuuaaaagaaguguuauuuaacguuaucuccauuggguugaauggauagcauccaaauaggaagaauucaaauacauggaauguauuuuuauuaaaugucagauacauaauuuuauuuaaacacuuguauuuaccuuuaaguuuuuuaauuuuuuauuuuuaauguguauguguguguagcugcaugugugaguguagcugccugaggagaucagaaaaggaugucagcuuggagcuggaguuacaggugguugcgagcuguccuacgugggagcugagaauucagcucagguccucugcaaaggcaguuggugccuuaacugcugagcugucucuuaaaaaguacuaaguuagcaaacauccuuccaugauuguagaaguuuccaggcuaaaagccucucagaaaccauaguucuauucauugguuucuuggcaguaaauauucaguaaaauaaagaaagcugacuagaaaaugaggcagcauaaaugcucuuuggaauggcauuggauggggugauagugcuugcagcagggugguggaugacccauuucuaaucccagcauacaagagggacagacgcaaccccuggagcaaacuguguagguacacuaaccaaagugcacccuagguuccaauguuaugugcugcuucaggauauagagugaggagcaaugaagaaagaaagcacaccccccccacacacacacacacauacacacacgugcacucacucucucacacacacauacaugauucgcacagaaaauggcauauugccauuuccucuaaaaaguaaggggaauauguucauuuuuuacuuguaggcaagucacagauguaauucgguaaagcuucuuuuaggugagacuagucagugacagugcuugucauucagaugugacaaccuaaguucaguccccagaaccuuguggcagaaagcaaaucaacuccagaaaguucaucuaaaucuccgcuuggccacaguggccuccgcccugggaacucccagcauucauaaauagaacaguuuuaagagacucugcuacccaguguuuucuccuuaauguuaacacuuuauauugccaucggagaguugccaaaacccagaaauucauaguggcauacacugccaacuagagacauuauucagaugccucaaguguuucuaggacugucugcuuucugugccaggguccuuucuaauguugacuuugcauuuuucccuguacuuguaaggaauacagaaguuacaguguagauugucugucggguugggauugcccuugguccugugaguaaaaaugcagaaagauggucacuauagcuauaaggcacccaucuggugcugucaucugcacacauacauacauacacauacauacauacacacauacauaauacauacauaugcacacguguacauaugcuuacacguaauaaauguguuuuauauauuuauauaaauauguauuuaaauauauuaaauaaagaauacauacauauagauguauaaaagacauuucaaggacaccuaaagacuuuuuucuauauauaguucuucugguuauauaucuaggucuguccaaaagcuccaaccucaugguuccuauagugagcuguuuuuuguauaacucucaaauuugauuuuaauuuuucuuuuguuaaacuauuuuauuuuuugagauuauaauguaaauaacaucauuuuucccuucccuuuccuuccuccaaagccucccugauaccuuuccuggcucuccuucaaaucaugacuguuuucauuguuauuauauguguguguguguguguguguguguguguguguguguguguguguguacgugcgugcugaaacacauaaguagaacccacuuggccuguaucaugucaccuguacguauguuuucaggacagaucaugguaaguagcgggugugcuuucccuacugaguacacgccccacucagcaugccauagucgccuguaguuggcuuucuagagcugagaccucauccacguuauugcgcuuuugugguauccuugugaugagcguguuuggguggccaugugguuuuacgggugacaccucuaacauuccuaaggaacacagucuaacagcaaauuccugagccugucuggcucuuacaguauuucugccccucuucagcaguguuccagcagcgugcaggauuuugugcauccauugggacugggcuccacagcucugcauuuggacugguggugguuuucuguagugcucuccaucugguacaaggagaacauccuugaugagaguguacacugacuuacugacaccacauuggaaaagcuagauuuuccguacaacacuaucaguucuuuccuuuuuuuuccccccuguauuuucauaucuuguucaauaguuaccucuuugaguuguuuaauuuuacaaaauguuacuugaggucuggagagagaguucagucaguaaagugcuugcuguacaaguaugugaaccuagcuuugauuuucugaacccauguaaaugcugggcaugguagcaugugcuguuaucugcucuggggagacagaugagcagaucccuaggucuuucugcccagccagcacccccugagcaggcaaguccccaucccagugaaaaucuugucuuauacaaggugaaugacaccuaaggacuuagaacccgagcuugaucucggaccccaugcacacacauacaugugcacccaugcauacacaacgauguauauacauauacacacauacacauaugccuaccacacuucacucuguggcugaacugaguaacaaaacucuguagccagucaccagcacagucugcagaaggccaguggcugcucacugguccugacagugucugcuguugcauagugaccuggguuaaaaauacucacaggaacuaugcucacaacucaacacuagagucagugaaacauuugaaugucugaguucugcaauacgagcccugcuuaugcuauaacuugcaagugcagaauguuucucccauuucacaauauuaugaaguuuaagcuggguguagugacucaacuuguaaccucugcacuugaaaacugaggcaggauucugugaguucaagaucagcguagccaggccuuguucuccagaaagaaaagaaaacugagagauuaagaaauaaacuuuugaaaugcugugaaaacauuuucuuucaacccaugguuaccgguguuccccaaguuuguuggggggggggaaucuguggguuauuaacaguguuucucugggacuguagcucuagaaacccagugcuaaguuuggcuggagaguccagaauuuggguuuggcuaagccugaaggaaaagacucuucaugcuaaaccacacuuguuuccuccucagauugacauagaaaucaauggcagugcuguggaucuucacaugaaauugggugauaauggggaagccuucuuuguagaggagacugaagaagaauaugugaguucucaaagcccuuugcauguugagccaggcuucuauagcaugucacaaaacagcucuuccacuauuuccaugauugugugaauaauuauuuuuaacuaaacaagcuuuuguuauauguugaaaucaacuucucagaaaagagcucacaccagcuuucagaguccagagagcaugcagaaagcugcuuguugugauaucaaagggauuuccugcuucauagccaucauagcuuacgguuugacuugaaguuauucagcccugccuugaggcauaucucuuuagacuaagugugcaaguguauauaugugaccuuuaaauuuagaagagauguuucuggggccagaaagagagcucaguguuaaagacacauuucacauaggccugacaagccugcguuuuuuaucuccacaugaagauguagagaacucaaugcugugccacacacgaguccacuacacacaugcacgcauguacacacaugcacgaucacacacauacacauaugaggcuuucaagaaugacucuuuuguuugguuagcaacguuauacccaugacuuuaagaaccacugaccuauaaugucaagagauagaaacugauuggccuauggcuuucuauauuuuaguauacauuuggccucuucuacaagucuauacaagucccuguccuugugcacuccagacacacauaacccacuugggacaagaacaaacuauucuugacgcagucauugugacucuuuucuaaaacuauaggagcgucauuauaucuuuuuccauaagaaauuauaucuuauaacaaaauuaagaaguuucaaguuauuagggcacaggcuuuugcgggugagcuucuagccugaugacagcaagagugaccagcagcaagcagcguuaguuuacuuuggucaguguuugccuaugagcaugaggugcugcucugugcguccugcagccuacaaaggagccuccucuggcugcugugucccuggcccucuugcugguguguuacuaccucaucugcauugacgugacauaaacaacauuucaccuccucagaagaggcaaagagcaagugaagcauaauaaauauuagcuggcugucaccacauaacccaggagauggggguucuuuagagcucuugccugcagguacugccagccuuucucuggaaacccugcuuuagcgguuucuuucugugagcagauuccacugcacgauaguaaguucuaggacagccagagcuacauaggcucuguugcaaaacaaaacaacacaguaaaaauaaaaauauccaaauucauuaaacaaacauuagaauuacuguacuaggacauauacuaugaauaaaauaauaauaaaauaaagacgugcuuuuaaagugaauuagaagguaacaaaacucaucagguacuguuuauuuagucuguuucucugacuucuucucacauaauuguccacaucaacauugcuuuucagucagcgauucugaaacagccucuuucauagcugcacaguuuccauggugagguuucacuggcuuaucuagcccuugucuuauugguuaguagaugccuuagcuagguuuuuaaugcugugaucaauaccaugaauuuauuucaccuuacagcuuacuauaugaagggaaguuggggcaggaaccuggaggcagaaacuaaagagaaucguggcugacuagcuuguuccucauggcuugcucuccuacacagccaaccaccgugggcugggcccucccacgucagacauuaaugaagaaaaaaccccacagacuugcccaaccaaagagcagucuaaggcaggcaguuccucagcugacauucccucuucccagauauaucaggugugugcugagcugacaaaaaccaacuagcguagacauccggguacuuucucccucaccccagacacuucugugauaaaacuggaagacacuccugaaaaccauaacagcuuugaaaugcaaggcaccuugauaaguaacaaaacccauuaaaugaaaccucuagaaauuagggcacaugagccucaucugggugccuugggggcguucaggcuauggcaguuguauauugguggugagcugguaaacuaaacuuucagcugcaggguguuuaccaaauccaaguuaaaaguuuuaguuaugaaaacacacuuuuuuugaacuauuguauaaaauuuugaccauuuaaguuauggaguuaauuuaugccugucuaaugugccucuccuuucuuuugaaaggccaagaaauucacuagauuaguuuauucaguauuaaguugaaaguuuaacuauucuaaacauugggccaccuuuuguuuugaauuccugagaggauauuuggaaugacauugacugaccucacucacuguaggugucccuaagucacagucacagucaccuucuucaccuucccauucauuuguucacauggcucuaaaccugcuggcuuccuguuucucucgccugcccugcugcccuuguuagauguggccuuggccuuggccucugccucaucacauugugucaguccuuguaaugcucagcugcugcccugggacagcucuuugcacagaauaauuggcuuugcuucaaccacagcuuuugcauguuguacucagucacauccugaaaugagcuagcacuugagucuugcuagcacuugacguucugcccuuaggaacuauucccuccuaccccuauaaaaagguguguacucaaagagcauccaguuugucauagauaacuuuccuuuuguucuuuaaggaaaaauuaccugcuuaucuugccaccucaccaauucccacugaagaccaguucuuuaaacauauugaaaccccuuuggugaaaucaaguggaaaugaaaggccagcucagaguucagacguuucucacaccuuggaaucagaggcaguuuucacucagaguucugugaaaaagaagaaacgaaggagaaagaagugcaaacaggacaauaggaaggaggagcaggcagcuuccccuguugcagaagauguaggugaugugggugugagcucagaugaugagaagagagcccaggcagcaagguaaggacuucugcgggugcuugccaugccgugugcauccaguagagggccccagcucuauuguggggccaagugugagccgcaucccacuacccucacugucagaccuucggcuaugcuacuaaaugcuccuuggaacagucuggugguuucucugccagcuuggauuggcuugggaugagccuuccaaccugcaggucuuuccccucccaguuccuccccuucccuuucuucucucccaacugacugacugacugacuuccuucucucucucucucucucucucucucauuuuguuuugaauuuaugagcaaaauacccuuuuauguuaaagaagacuuuugguuuuuugaaugggauuuugcucaacacuuucauaccaguuaauaggaaucucaaaaccuauaccacuuuuugagccagcacuguccaaaauuucaagccuagcauuuuaaggcgggguguacaguuuuucucacuaccuguuugacccagugcucacccaaacacuggaaggacauccacaaguguugucgugguucucucccuggcagcucuuugaggcugcagccauaggugguguauuggcuaguuuugugucaacuugacacagcuggaguuaucacagagaaaggaccuucaguugaggaaaugccuccaugagauccaacuguaaggcauuuucucaauuagugaucaagggggcaaggccccuugugggugggaccaucucugggcugguugucuuggguucuauaagagagcaggcugagcaagccaguaaagaacaucccuccauggccucuggaucagcuccugcuuucugaccugcuugaguuccacuccugcaucgaucaacagcaguauggaaauguaagccgaauaaacccuuuccuccccaacuugcuucuuggucaugauguuugugcaggaauagaaacccugacuaagacagguggccugcauguaguguccuuuauggaacuggggaaggacucaggagagggaugcugacccauuugaauauuucagcugagcugcuggaaggaaaugguacacugucuggaaacgcugggcuuucacagaaaaguguugcuauagaaacugugcagacuaacuuuugccuugauguguuuugcuuauuaagguuuuuuuuuuaauugucaaaucgugagaaaccuguuauugauaaaugauuaguguauuauaauuauacuauuuucugaauaguaauucucccuuggagauggaacgguuucugucuaaucaggaacuuuucacaauuuccuuucauagaggacuucauaagagauuuuuuucuacuucuaucauguuuaauguuccaaauagauuuuaaaaacugguugaaugcauauuacuuuuagcuucagaagauaucauguauauuuaagaggcauuuaacuauuauaaauuauuugaugacuuuuaaaaaaaagagagagaaaauacaucagauacagagcaagguaaauuauaaugaugacaacucuaaguccugaaaagaaugucuuucaguuaguaaaaacacugaccaggcugaguuaugaauucuacuucuuuauaucuuugauucccaaagaauuuaaccugcuuagagauguggcauugcuuauucaagacuugucucucuuuccugcuucuagucucugaaggaccauuuaccuccagcauaaaaacuuggagacuuccagaucucucagugcugagagcagcucuguuaaaguucuauacauagucaaguguuucaguggacaagaaguguguuuuuauaaaacugugaaauacuuacauguggcaguuaccuacauguguguuauaaugcccauucuaugccuuauccugaaaauguuuuugcagcuaaauuuuuuuaauuaauuaauuuauuuuauguauaugaguacacuguagcuauacagaugguugugagccaucauaugguugcugggaauugaacucaagaccucugcucacuuuggcccaaagauuuuuuuauuuauuauuauauguaaguacacuguagcugucuucagacacaccagaagagggcgucagaucucauuacagauggaagugagccaccgugugguugcugagauuugaacuaaggaccuucagaaaaguagucagugcuuuuuacugcugagccaucucuucagcccacagcuaaaauuuuugauccacuaaagccaaccugaagugaugcuuuuuagguccccagagccgaaaauuagcaaaguuuuagaauucuuuaaaaaugagcaacuuuaucucaggaagugacaauauuucuaagacacacacaaagccucuacuaaacacacgagaacugcaacgcuaaaggaauucuguaaacagauagugucagucaguacaugucgauauacgaccagaacugcuggggucccaacugcgugauaguuguugcuaugguugccagcaccuauuugcuugguaagaaggcaucaugguacaugugagcuugagccucuggcagcauucagggcuaaguggucugcucuucauucauuuggaugcuaguaagcuguuaacaucacccuuuggaggagcccucccccgaaauuuccuuagaacaaaagucuguuuaauuaugcaucuaacagaaacuagacaguaagaauuagcuagcugugggagugaguucaggauguauuaugaacucaguggugucuggccugugacaauuuuucuucucacccuccaggaggacugagcugcggccauaagcugcucagcugugggguguauucugagaaaugcauuaauagagaggcugacacagucuaaaugauacagagcugcccuucaucaugaaugugcuuagugaggaccacaguggacacacagggauguauucaguccacagccacuggccaugcccuccacuacaucccacacagccacuggccaugcccuccacuacaucccacacagccacuggccaugcccuccacuacaucccacacagccacuggccaugcccuccacuacaucccacacagccacuggccaugcccuccacuacaucccacacagccacuggccaugcccuccacuacaucccacacagccacuggccaugcccuccacuacaucccacacagccacuggccaugcccuccacuacaucccacacagccacuggccaugcccuccacuacaucccacacagccacuggccaugcccuccacuacaucccacauucaaccuacauacugagcugucuugucuccccagccucaauuuuucguuucuuuagggaaaguuuaaccuuugauuuauuuuuauuagauaaugguugguuccuagugucugcuugaguauguucuuuuuuccuuuugaguaagauuguaugugagaguccauugagggaagaauuuuaacagaaagaucuuggaagaugcaugcauuccuaugucuuaagugauuuuuaucugugugggaaggcagguaauagaaaaagagguaauagaaagugugcuagaagggaaguaguacugaagaaguaacagcgcuuucuuuccgugcucucagcccuagagugagugggauggcucuggguuauguuuaguacgcugucggcgcacuacugcucuguaaggcuuacacucaguacacuauugagcugaguguucuagaggagcccugaaccugcaguacagugcuuugugcuucucagagguuuccgccauuuccacaugcuuccauagaaaccuccucgugacugagaaguagacagaacacaugacaaauuaacucccugaagacaagaacugaggccguagcuuuuuacuuuggacaaauuguuauacuaaacugccggaucuuugacuacaugcuauuuacaauggaauuuuaaccuuaagaugaauaaaugacacccacugaguagcacugugcugaaguggugacaacauauuguuugcaucaguuuacuggggaggguuuaaagcucacauaccauuccugccuuacuuuuuuuuuacauauuauuccuguuuuuuacuuuguuuuucccuuuggaagaggaucuucaaaugcuuccuuaaaggaagaggacuacaaggagccuucacucuuccauucuggggauaacuaccccuuaucugauggagauugguccccauuagaaacgugaguauccuugaaauuuauuucuguuuuccuaaggggaaggggacgcuuaucaguggcuuucguuauuugauagugauaccacuuucccauuuguguaauaguagaguaaccauuagguaaaauuuagcaugaguaugaaaugauuuucaacaaccauguuguuccuaaguuucaucuuauucuaauggugcuugccuguuguaagucugaauaaucagccuagaauuugccugagcuaccacuaaauucuaggucuuuggugucacauaccacagugagagaacaugugaccauacuguuacaucugugaucaaaccuuuagauuuuuaaaugauuuuuuaaauuuauauauguuauguguaagguuguuuugucugcauguaugucuguguacucacagaagccacggaagaggacgucagaucuccucccuaggacguuaggauugcaggugauuacaggcuuagcagacaacugugagcaaccaugggcuugcugggaccccagguccucgaguucuuuauuacgagccaucuaucuggucccacgguaacugauuguugagcccaccuuccuguguguuuuuugccuuacaaaauuaccuguaucacugguuucugcugagaaacuaguaaauaauacauaccauggugggucuacagaggaccuaggaagcccuuaauaauccuagcuggcauuuuuauuucauuaaagaacuccaggaaaauguguaauugaugcuccccucaggaggaaugugcagcucacagcuggccuugcuccucucugcucugugaggcugcggcucaccugugagacugaagccugcuucccuuuguucuuguguuugcagcaccuacccucaggcugugugccccaagagugacucugagcuggaggugaagccaucugagagccuccucagaucugagccgcacauggaguggacguggggcggguucccagaguccaccaagguacgggcucacagggaagacgggaugucugacuaaauuuuaguaaagaucauuuuccuccauuaaaugaaagaagcgauuucucaccaaacucagagaauuaucauggcagugcccucuuguggucagaaaaaguguuuuaaaaaguaaauaaaaauuaacauuucauaauauuuccacuauacguuuacuuguaacugaaggaauccaguaucuuuuguaauuuaagauaccuaaauuagaguuuccacacugaaauuuaauaacuaaagguaggauggggcauagcucaauugauaaagguuugucuugcgugcucaagacauugggucaugcauguccccaacaucaggaagaaggaaguucauaaaauuuuucagcugcucacacugagagaguaaucaacggaaauuuccauuuugugagaucauuuagaucuucuguugaauucaguuuuauuaaaacagaaauguacuugcuuuuuugacugcuguaaggaacacuggaaucauguuuuaugaugagguucucauguauacuauaagcucuuucccucaagaugacauuuucuguccuagacucugaaaacugucuauacaguuuucuccaguguuugacucugaugauaauaguuacaaaugugacucuuauaaaugucaugacauugaaccaaauaguuauuuugccaauaguguucuguuucacagcuaaugaauguauuaccauauauaaaauuaaccauaacaaaugcauuugaaguuaguuuuuaaacaauucaccuuugcaggucaccaaaagagaacgguaugacuaucauccaaggacagcuacgauuacaccaucagagaacacacauuucaggguaauucccagugaagacagccucauaagagaaguugaaaaggaugcuacuguugaagauacuaccuguaccauagugaaacccaaaccuagagcccuguguaagcaacugagugaugcagcgucuacugagcuucccgaaucaccucuugaagcaccucagauuucaucguuauuagaugcagacccuguucccagcccaucagcagaggcucccucagaacccaaaccagcugcuaaagacucaccaacaaaaaagaaagguaauugcuggaccucacauaccgucaggguagaggguaugcugucucugugugauaguccuuugugguuuugcucuccagucagacagaaccugucccagacuugacuauggugacuuacccauuguggcuucucuugcucucuaauuuccucccugcccccccccccaaaaaaaagagacuuucaacuuccaugcuuuuguuuuggucuuccaagucaacacucaggaagauuuuaagaagugcuuaguaagggcuagagagauggcacagagguuaggaaguguuuaguaagaaggaaaugaaagaguuccaacccauugaugagcauagugacagucccauugucaacaugaggaaaccauacaugucuuccccaagcauaucacgaugugugcugugcuuuuacacaagauucguguguugucuugaauuauuaacuaagaauguuagugaaugaaaucgucaaugaccuuuugcuuagaaauaaaaauagaacagagaaaaaguguuuucucagaccucugcuuagcugaagcaaaaugaaaucuuuuguagguuuggugugguugaagaacaacugucuacuaggggauagaugcaucagugguuaugaccauggcugugucuccagaggacccacauggcagcucaugacugauucuagugcccggggacccaacgcccucuucuggccucugugggcaccaggcacacagccauauaucaggcaaaacaugcauauaccuaaaaugaauagaaauaaaaauacuuuuuaaauguccacuaauuauuagugcuuucuuucaguaauuucccuccuuaaacuggugugcagacugagaaggccagcccuugucacaagcacucacucuauaucaauuguuuuagaucgggcuuguugcuaaaagacacacaguuacccagugagagccagaaacuacacacucugaaugcuagcuuggagcccauguauguauguauguauguauguauguauguauguguguauauguguguauauguguguguguauguauguaugcauguguguauauauguguauguguauauauguauguauguguauauguguguguguauauguauguauguaucuccaccugucauauuuagcugaauuacugcuucacuuugauggaagaaaaaaaucaaacauucuauuaucaaaaauugauacaggcucagaucauucagaaauaagguguucaaacuaagaguguuggcuauccgggguguuuguggccgaaucugacacauagcugaugguggcucucaccaaaaucugcauaguguuuguucuguuguaagaaauguuaaggggcauaaccaauucucauuugguagaugcuugguugcuugguuuuaacauagcacauuguguaggaauuuauagacgugggaacucagaaagguucuuaccauuucuggcuuuauucucucuccccaccaccaccaccgccaccacaugguuaugaacguuucauacauucuguggcacaucacucaauggcagggauguugucugagaaguauguccuugggcaguuuaguauugugugaacaucauaguguuuuauacaguauaaaucaauugaccuggcuucuuguuauaaucaggagacgcagggaacaugaaaugaugcuguugcugguauagaauggcauaccauuacaucaguagacagaugggaguaugcccuaaaauaguuauaaguaauaacuauauaaauaagucacagguaucacuaccaagauaaucuguacauaauuugauguacuuacuaacauaggaauaacggggccauagguguguucacaccaccaccaucccaaacaugucacccuaagaugcuauaguagccaagugucacgaggcggcagacauuuccaggugcauuuuaguauuuugggaccacaauugucuguguauccacugcagugucauuaugugguacaguacacagcuguaucucugccauaucuugacuuagaaacagaaagcaaguucuagacauguuaacauuucacucuugagaaccguaggacaugccauguaagucuguucuauggaucacuacaacacuguuacauucagagagagaaagagagagacagagacagacagacagacagacagacagagagcccaggccaggacaagguagaaggcaggacaggcacugguccugaggccuugccuuagacacacagugguccuucuugcuuagaaaacuuuauuuuaccacaaucaauucuuaucuauguguuuuuuuuaaauuaacagguguucacaaaagaagccagcaccagggaccugaugacauuuaccuugaugacuuaaaggcucuugagccugaaguggcggcucucuauuucccuaaaagguagugugugcuguugcguugaggagugagcaaucuugagauacucugagcgagaggaacagagugacugucuuuuagccaaaucugcuuguugcuucugguuuagggaagcuuauaauucauguguguugucuuaacuguagugacuugaaagugucacuuguuuaugaaaacauauaaaaguauuugacuuuagaauuucaucucucaccugguguguguguguguguguguguguguguguguuuguguguuugugugugugugugugugcacgcacgcgcauacgugcacgcggcuccccgugcagaggacaaaggacucagcuguuuguuucucccaugcagguccccgggaucaagcucagcugucaggcugucacagugagcacauuugcuugcugagcaucuuggagaccuaguuuagugugcucuguacagucguuaauaacaaacugaauaugcuuauguaacugcauauuuuuaaauaguacauuucaguuugcaaguauuuuacaaagaauuccuucacuccuuugaagaguaugaagccacuugugaacuuagucaucuaaggccucauuccagggacccuguccucguguugcucacaguuccugcugcgucacaacacuguugucccccgucccucacuguuuuaaaacuguuuuaaaagguucuuuuaaccuuagaggaauuacuacuucauacauugguuauaaaacuauuuucuucucagaaguauggcuugaaucuacugagccuuauacacaaugauauuuuuuaaauaaguuauugggaagacauacuucauuuuuacuuggaauggaaaaaugagauugacauaaauauauuuaaaauuuuuuaacauguauuuuugggagguucuuaaaguuccuuccuaacucuauaccguaacuuaucuuaaaauacuacauacuucauuuguaauaauggguuuuuaaagaugaaagaauugaaauugcuccaguuuuuaaggguggaaaaaauuuaaauguaaucucuuagaauuaugacuuucucaaguuuggcagugguggcacacaccuuuaauucuggcacuugggaggcggaggcagguggaucucugaguucaagaccaaccuggucuacagagcaaauuuuaggacagccagggcuacauagagaaacccugucucaaaaaacuaaacagaaaaagaaagaaagaaaaaaaagagagaaggaaacauagauagauagauagauagauagauagauagauagauagauagauagauagacagacagacggacagacggacagacagacagaugacuuggucucauauuucccuauccuuuuacuuuauuuucacacuaagaaauagagagcaggaccagacacgcaugguggcacacacuguuaauccagugcuugggaagcaaaaacugguugcucuccgugacucugaguuagaggccagccgggucugcacauccagugucaggacggccacacgaggcuauagaauagagacaccuggucucaaaaagaaaggggugggcugggaguagucacugcugcgcugggauguuacuguacgugguaauauuuucacuaguuaagguuacugcuguucacuagccacacuuagcuugaagacugacuacugggacaugucauaauugugcuuuguugugcuugucacccucuguguuacuaaauugucauaguuuauacagccaaacucucacacaugucccgucauccuauggguuuggcagcuugcugagucagauggcaucccuguggugacauguuguuaccguuggaggacuccagcugcugcaacugauaaagcuuggggagaguguccagcacugguguuggugggguccccacacuggcaucuucuaucucaggagcccaggacagacagugcaagagcugagagagagugcacagccaucuucugcuguggccccucugccccuccguccccgcacgggcuugcugcucugcccucucacuguccauuugaaggugugcauuacaguuaagagacaguuucuccaaaccuaacacuccuuccuagucugagcacaucugcagaucugcacggcugccaccugcaaccccacuuuuagguuuauuuuugguuuuuguuuuauuuuucagaaguucauauugaucucaccaacugugucaugcuuugucuugcuuuguuacaauuuuaagaauccugccuucuuauguaagggaugugacuuaguggccaaaugccuguguaggauccuaaguucaauucccaguauuaaaauuuuccuccacuucuaggaaaauucugaacauaucaaguacuaugcuaaguauuuaccgaaguuucaaauaguuaauggcuguaagagauacaguguuccauuuccuuauuucacauuuauguuccauuacaacagguuuccaaugcacuugcccucuagcaccaaccuuucugugcccugucuagaaaauaagaauaguaaggucagugcugcaaagacagcugcauuuccugaugcacaccuucugugcguucuuucuugaguaauuucugcuuuuuaaauucguuuacuuuuagagaguauuaaguuguugaggggagcaguuuaacuuaagaauacagccugggacccaguaauuuucuccagacugcauauuaccaugccuguuuccuggaaugcaggaucaaagcacuuccaaaugucagacuuuucuuaacuguccuguuaguucauaauggcaauuuaaguuaguacuuauaacuuuuucuucuauaauuacagucaaaaagaccccaguugaaagucuggccccauugugaaguguuuucuacauucacaauuaauuuucucauauucagauucuuaauuaugucauuuauaaaugugauuuuuagacauuacuuuaaaaauuuauagagcagggucacugggaagauggcuugguggauaagagcacuuaucugugauaacauaagacccugaguucaaaucaucaguccaugcacaaagaaaggugugacugcuacacaugucuguaaguccagcauaaggugauggagacagguagacagauccagguacucucuuauugaccagccuggcccggauaacaggucugcagcucaggaagggcacgugcuugaaggcagauaagccugagagugauggaggcagacaccugcccgacgucuuguucugcaucugugugugugugugugugugugugugugugugugugugugugugugugugcgcgugcguguguguugccacaccugcaugcaaacaccaugcccucacacaucucagaagucauuucgauuucccaucuguucaucuuagggaauaaauccuagagaaccauacacuaagccaaaaguauaagaagucaugacagaauaaacacuucuuucuccuuccuucucucugccacagugacacggauccagguuccaggcaguggccugagucugacacauucucugguucucaguccccacagucuguggggagugcagcugcggacaguggcacugaaugccucucagacucugccauggacuugccugauguaacccucucccucuguggaggccucagugagaauggagagauuucuaaagguaggcuggacagccaugccugcuuaucacucgauuuaaaaguuguccuucugcacagacuuaauucaauaaaugacuggcaugagaaaaaaaauguaaugagaaauguauugaaacauugaaugcugacuaaauucuugacugucccuucugaguaugggauacuuccccauaaagacacacccuugaggcaucagagugccuuuguguggggaaguuuugugaggaccucaaccuugaagcuucugauuucaaauucacaggcucuguuuucugcagagcaguaaggugggcucauacuacacugaucgacccugcuuguguguaagcguucccaacugccuuccugacaagugccaggacucaaaagcugugggacagcggcuguccaccaaguagacaguagcaaaagaguggaauuaccugucuccugcuugaaagaugucugcccuaggcucuugguucuguguuaaggauugaauauagagcaauuaguugauuuuaguuuaaauaacccugaaccaaguugcuuagguugaccugggucguccagacagaucugguucccucaguuuuccugccucuggcaacuuuguauucauuuuaaauuaauuuuuuucucaguuuuccacuggccuguaauggcuguuucuaagaguuaagauuuuuuuuucccaugacaaauaucaucacuuuaacgcuguccucugucuccuccccuucagagaacuaaaaaugugaagagacccugggugaacacaacccuagacuugccucaaaguaaagcaggggugcauguuauagaauguuauaagcacaaguguugggguuuuauauuuuagauggguuugggguuuaguuuguuugaguccuaaaaauauggaagugucuugaccaauguggaaaacauagcuuuuuuuuuuuuagaagccuucuuuuuaggccuacaaguccuuuagcgcagaucacuguaagcaucccgcagggacccuugcacucccaccacacuggccugaccacuguuugcuuuacagagaaguucauggagcauaucaucacuuaccaugaguuugcagaaaacccuggccuuaucgacaacccaaaccucgugauccggauauauaaccgguaaauacugaugcuugaucauugccaaguacucuacaguguuuaacugucacaguuuuccuuacuuuaaaguuuguggucgcauaaaugggcccacagacagugguuugugaggccagagcuucaggcuguugcugccucugaguucuugagacacuguuauuuuuucuauggguuucucagcucagagaaguuugguuuaaagcaagucuucaaaauuuaguugcucauuauuggaaagaaucaacaauuugauaaguuauuuuuuuccucuuuccucuagucuuccaacccucccucugccucugaccauccuucccaccaugcuuugcuucugacaccgucuguguaaugguuuugcacaaauuuuuguuucucauaguuacuacaacugggcguuggcugcucccaugauccuuagcuuacagguauuucagaagaguuugccuaaggugagugaugugccuuugaaaccuucuucaaaguaucuguaacauacagcagucagaaaguuuauauucuguauuuuuagguucuauucaagguuuugaguuuaguauuuuauaucagagauccaaauugcuauauucgcccacaaaggccauaccugacucgacaagagugaguggugcucugcacaucccccuaucccaucuggugcucucagucgcucaggaggaaaggcaguguacuccuuugggaauggcaaagcuccagggcagucugguggugcgaggccuuggugugggaacagggccaguggacgugggccuccaacagugucaguggcugccgugggcauaaauaaggcuuguuauaauaauguacauauuuugcguucucccuucaaggaauguccuuuuuguuaacauuaaugacuccauguuagucuaaaacagcaugagucugggaggugaugguguggccacugucucagcaaacugguaaacccugggaccuucaggagagcucuuaaggcuguggaaaagaacucuaaagaccugaguucaaaaauaaauaguuucucaacuaugcaaaauuauaaggaugugauaugaauuauaugaggguuucacaauucuaaaguaacagaggagcugcauuaaugagccagcuugucagaaagauacagaggcaggcagggucagccuugggcacaaggaguccaaucccagguauagugggaaugguaauuucaggacaggguccuacccagcuagcuuagcauguguagguaacagagcuaggcagaucucugaauucuuuugcaccauuaaagaaaacgugugcuugcugucuccuaagaaguggcuggggcuacacgaugcuuguucauagaauaaucaaaagggagucuggaggaaauagcugaagugauaguaaauaagaacgggacguuugcucugcuugagaugagcucgcagaaagcaguagcaauuuuuuuuaaagaaauuucucaagugagagcugagcuauccaaagauaucugaagagugaaaacagcucuucaagaguuuuuuuucuaacaggauuucugauuuuaguuggaaaauccauggaaagcaaacacagcucuuuuagaauuuuucugcuuucugauuuugaucggaaaacccaaagauuacuuguagaauuuuuuucuaacaggauuucugacuuagucagaagauuaagacuuuuuuauagcagcuuuucugacuggucagaaaacccaugagcuauccagauagcuuuuagaauuuuuacuagcagagagaguuguuugaagcagaaaacuagcugucucaaccagagaguuuuuagaauaggaaaagaaaaaaaaaagcaccugucuagaacagagcagaacacacacauacacacacacacacacacacacacacacagcagucuagaaauagaaagccaucucagcagaaccuaggccaccagcuuggacccacauuuugacuucaaagcaauucuuuucaccacucacaaacuuaucugugucaggacucgggccuagccgaggcugguccuugucccguucuguagucuacaggguaacagcguaaggaagcagugauuuacaacccagaucucauggauugacccucacuguuggcaggccaccguugaguccuggguuaaagacaagaugccaaagaaaucuggucgauggugguuuuggcggaaaaaagaaaguaugaucaaacagguaauuaauccgauuauuuuaaagcaauuucuucugccacuuauaagaaagcaggccagaggcacuguguagucacagcgcucagcagcugugugcccgugcuuuuuacagugaggcgauggagacugccauuuuugggauagcuggguggaccuggggcuaacauugaauuugacuccagagcucugcuccuucuacuuacuuccuaugucaugucugcggcaugagugagcagguacaauucuacacagaucugcaugcaaacgugaggaauaucacuuuagcagggcagcagaagagaaagcuuguucagagacuaacacucaaaugagucuucauuuuccaaagccuucaaagggagaggauucuguugcuuuucagauagcagagguugguccugccucaccaaauucauguguauaucaguguggucccuggcugccuuucucccuucugcgggugccaagcagguggagacaggacuagucacuucugcagggcaguccaggucgucuuacuagggaccugaccauugguccuguuauauaugugguuuagcauagugcucuuuaaguucccugcuagcucagcuuuuuauaagcagaauaugauuucugcccuucaagcuucaaguagaaaaaaaucuuaaguuuccagucaucuauugagauuuugcuuccuagcgaggacugcagcugaagucuggagaaacacuauacauugacgguaucuuucuuugcaguugccagagaccaaggagggaaaaucugaggucccuccagcaaaugaccugccuuccaaugcugaggagccaaccagugccagguggguacccuguccuuucuccuaccucguagcacuuggucaauuccugcuugacuguuaaagcaauucugcugaguauggagccagaaauaccuuuuugcuauagagagacaugauacuaaguggcuuaaugauacuaucucuugguaguuaagagcugccguucccaguuuacaggacuaaauacacacaucaguacucauaacugcugugccuaucacagagccaggaugcuaggaaaggcagagcuuugagaagguaucaugcuggacauaaucaggacuguuguccucugucucugcuccccugcuuuucagguguuagaggggacaugaaaaggccucugaaggacugguuggguacauuugaguuggccgagcguguugugugcuccugggcuuacauccccaaccccaugcgcuaauggcagucguaguuuaucuccuuggucuucuuacuuucucuuugguaaggaguauaaagugaacuuacuaacuuuagacuauucccugcuguguccagagaaugccauggggucuaccugcucguuugcuagugauguuuuaaaggacagagaaguaacugccugccacuuacaaagaggaggaagauagugcacugugacauuugugaugccaggaguuauggcauaaguaacuggauguggauacgugguggugggaacaguucuugccauccuagaaaggccugacggguucuguucugagaccaggucuuccuguacagcccagccacaagcagguccucugcuucugccuuagccuucucggggcuaacaguauggacguguggcauguguuuguuuucuuguccuaaauuauaaaagcucucaucagucagauacacugccuguuuguaacuaguuugauguuggauagaccugcagagaaugacacuucuagugacgaggggucacaggaguuggaagaaagcaucaaaguugaccccaucaccguagagacacugagucacugugggacggccucauauaagaagucucuccgacucuccucggaccagauaguaaguguccugcacuauaguuguguuuacguagcugcuccuccccaggagagcagcaccccacaccuggugagcuugugacauggcuuccuccccgccuagaccuugugcugcagcaucuggaaaugaaccaggaaauggcuguuuuuagcugguuccucuggugacucuuauuucacacucagcacaggaccaugggcugccucucaggacucaggacaguagagcaaugccuacaucgcacuugcacacauuuucacugugaaauggcuugacugugcugagccugaggcuguggccagagcagugauuucagugugauggaggauagggaaguuugguuuuguggggacaccaggaaauccuugggauuagaaaaccauugugacugugcuugaguuugggcugaacuacaugcuggcaccagagaaaccgcacgcccugaguuuuguugugaagcuuuaaacuguuccaaaguguggauuuccagcucucauuaauguguuuuuuauaaaaggcaaaacugaagcuccaugauggccccaaugacgugguauucaguaucacaacccaguaucagggcaccugucggugugcagggaccaucuaccuguggaacuggaaugacaaagucaucaucucugacaucgacggaacaauaaccaaguaagcgcaagccucugugaguggggagcgggaggcgcucaguccucaguggggagaaaguccuuaaaccgcaugcccuaaggugcccugaaggugcccaagggaagucacuccauggcuggagaggacgugugugcaguacaaaugcauucucaaaguuaacuuguaaaacuuggcuauuuagucuccacauucuaauguucagagaagacaaacuuaaaauuuuagggaugaggauagaaagauguguuaguaaauuaucucugaaaauaaauacuggggucuccuguaacaccguuuuuaaaaaugccucaguguguaucauuacaaggcugccuuuuggcuguauaaaaucaggauaaacccauccugauacauuguacccggcuugcacccccauuuagugcuuauuagcagccaguguggaaaaugauuggcucuguguguuggauuucugguaucugcuucuguuucuacccccuugccaggucugaugcuuuggggcagauucucccacagcuggguaaagacuggacgcaucagggcauagcuaggcucuaccauuccaucaaugaguaaguaccauucucgaguguccugccucagcuuagcucugacucaggccuggaaaaaaauaaaucgucaaucuauauacauugagaauuauggucugcauauuuguagcuuuguguucaagcaugugcuugguauccuaucaguuuuaagcucugcugacuuaccuguguagucauaauguuaauuauuuuuaccuagaauugauugggaaggcugguuuucaucuugguuauuuaaugggcagauagcacaggcauguauagaagacaguuccuuaaggaaacguuagcuguccuuucuggaauccuagcuuguccacggcccacagaucuggagagauagagugcccaucuuggaauagcaaaccaugauaggaaaucagcaugugucaguuccuuggcuguaacuuuucucccugccccagagaauaguguguguccaacacaguguccuuaaacuaagaccccuuggguaguuccuuugcagcaaauaccauaaagauagucaguuuugcccauccugggucuuuuucugagcuaggcgagcacucugucagugcucugcagguuaacauaauccguuugcacacuccucugucucccaguguguacaacccuaacuggguuucuucuaaguucaggaauuugauuuucaaacuaaaggagaagaacuugauuuggaucugauaaaagaaaauugucuuuucuucauccaaaagauauaccuaaccagguugcuuguguguguguugucuuuuaggaauggcuacaaguuucuguacuguucugcacgugccaucggcauggccgacaugacccgugguuaucugcacugggucaaugauaaggggacgaucuugccucgaggcccucugaugcugucucccagcagcuuguucucugccuuccacagguagcuuuccagugggugugcuggcuuccuccuuggggacaggggggugccagagcucagggcccagcaaggaagaaggcgacagugcccagagauuaauaaaauagguagcugugagcaugaaaucuuucuaagagcauacucuaguaaaaauuaccauuuugaauuuggugauugugucuuuuugucuuuagggaagugauagaaaagaaaccagagaaguucaaaauugagugucugaaugauauuaagaacuuguuugccccguccaggcagcccuucuaugcugccuuuggaaaccgucccaacguaaguguccauggcguugugugcagauccugugugagcggaauucaagaggugcacuuuagggcccagccaugucaugacucuauaagcagaguacaacggcuggucugcauggugggguuucacuugagguacaccucguacgccccucccucuggccacugagccuggagcuuugcauagucuaggcaugcgcucugcuguuggucugugcuauuccaacccuuuguccuuucuuaaauuuuaaaaauuauuuuauguauaugaaugauuugccugugugugugcgcgcgcgcgcgugugugcgcaugcgugcgcgugcauaccauguucaugccagaagaaggcauacaaucuccugaaacuggaguuggagauggcuuugagucaccauauggaugcuggaaauugaacccagguccuucugcaagagcaucaagugcucuuaacaaugagucaucucauuguuuuaauuuuuuuguugagacaagaucucagaaacuuacccaggcuggccuugaacucauuuuguagcguaggcagccuucuugccuuggccaccugaguagcuaagauguauuggucugcacuagagaugaggauuauucuaauucccuagcauuugggugaguccuguguucccuauugaccccaggacugugaacagaaggauguccccccacccuccaccccagguugaacauuuucucaggcacucuaccuacccucucacugguucucugccuuccuggugcucugugacccuuaaauacaguuccucauguuguggugaccccgaaccauggaauuauuuuuauuacuaccucauaacuauaauuuuugaacugcuaugaaucagaaugcaaauauuugauauguaggacacuuauauacaacuccucugaaagggucauuugacuccccaaagcaguugaguaccauaguucugacugguucugagccauacccuuggguccacaccagaacuguggugugaguucucuucucugccuuuuguacugcauccuaugggggcggucuccauaucgcagguuuacuaacaguguugguccauugucugaccuccuguguacucuggguuucucuagagacucccacuuuucagucgauggugugacucugacuugugaggaggcagcuaaguuuccauuucuucugcaggaugucuaugcuuacacacaagucggaguuccagacuguaggauauuuacugugaauccaaagggugaauuaauccaagagaggaccaaagggaacaaaucaucguaaguacacucaggcugcggccggcgcccugcagccagguuauagcugagcacagaugagagccaaggagggcacagccugaggagcaaagcucuacggcuuugaggguuuuuuuccuuguggauagcugcuuaaggaguguguguguguguguguguguguguguaucugaacccugagguguagugcuagcucuaagugguaagcaguccuccuuuaaucugaagagccagcuuuaccgcccagggucuuguuuuaugugucaguuguaaaguaaccacuugucucuugccugauuccucccagguaucacaggcugagugagcuuguggaacacguguucccacuucucaguaaggagcagaauucugccuuuccaugcccagaguucagcuccuucugcuacuggcgagacccaaucccugaccuggaccuggaugaccuggcuugaacaaggccucgauggcaagauggggggcacuggcacuggcccucuuacagaggaagacccaggagcugacagucaggaaccugcuuuccagaacagggacggggacccgaagcuggcacugccaccuucuuucagcuuccuaggccaccacucagcacuuagaguaauaaggggcccuggaccugcguuagaagcccgugcucuaaagccugcacuccuuuacuugugggcucucacgugcuucuguggaguuguguacugggcaccacgcagcugcacaucuaaaaaggaagaaaccagaaacugaaaaagaauagaccagcacauugcuacacaaaaguaaagaguucaaaucuccacuggucaguugggaucguuucucucucuaaccagggcuuucuccagagguccaguuagugcugccagcucugcgugcacacccuccucgggaugccuccacucucacucacugaacuaggacagcugcuucaugugccagcaccgugagcccaucugccccagcaugggcuguaaaguuggggggaaagcacccuagcagcagcgucuccucaccuguccccgccgcagugagaaagaagcgcuuuaagcugcuguuaugaccuagcagaagaacaaaugcacaguucaugucuggagugauggugagaccuugguuugaaucacaaagaaggcaguggcuucucagaaguguagaagggcaguugccugggguccugggaguccuguucucugacacugucaccugacuuaaguggcccuuggggcagauuauuucagaacaggauuuuugaaagucugggcuucauauuugcugaggagaaagccuuuggcuaguggcauugaccagucaucuggauuccaaccauguaaugcagucauggaggccugggagagagaggcuccugagugccuguugagagccacaccucagcagcagcagcagcccaucacucugacucacccucaugcaguugauagugcagaugaggccucguggggaugugggguacccccgcaccucccuggcggccucagacacuggccucguuaagugcucuugucaaauguuggagcagauggcaccagggagaguuauguccucagaucugcagagccuugcccagcugggugugggcaguuacuaagaaauccaucugaguucgaggucagccuggucuacagaguuaguuccaggacagccaggacuacacagagaaacccugucuugaagaaaaaagaaaaaaagaaaagggguggcuauuuuccagauuggagaguugaguguccuugccucauuucaguauugcaguugaaugcagagaccuugguaacaauguuuaauuaaagaaaaagaccauuugaaacauaguuguccguggcaagcccuggaggcacguagucccagagaagcaacgcaggcucccggcacugugcugauguuucccacaaguguucccucugcuccgugaguuacuuguguuagguaguagggaaacuuggcuauguucaugugacguucucgccaguuaagugaaauaagacucuacuaaagcagccacgggagauuugaagccuaagccaucaccaccacaguaagaauugugcacuuaaccugagcuugguagaauagccacgguacagaaaauccuauguuuucucuuagaccuucuguuuuuccuuuagggagucuuugccucacuagucuguuuccuuuuccuaacagacauuuucuuuggacacacgggccuuuucagaagguccagcguaggcucugggucuccuggccugugcagagugauggcuggucuuucuguccacgugucuguuagcgcgacacucgucccugcacauugaugaguggguauuuaggauaaugaauguaacucuuauuuaaaggagucuccuugcugagaguagaugaguacuauuacuguaguguaugaaguauuagguuugugcugaaaauccauugccauuuguuacaaaugacauuuguucuuucugugaaagagagaugcccuuaaguguguuugcacacaaaccccuggauggcuuguugcagugucaccuugucucgaugacaggugaugcugaagagacacuauggcagaccagccacccaguccuuccgucaguuguugcgucaguucagucuaauuuuaguguuugguguugaguguugaagcuugcacugcuguagaauugauggcugcucuccgucaggcugugugggguguacacguggaccuggagcaugcauguguaaccauaugaucaguacugcaguuccuguagucuaacccaucugcauagucaguuggaaaaagaaaugugcuguuguaguaacguagaacaaaagcugcuaaaacaauguagaguggaccaggacccgagcugagcagcaggagccucuguucccugcagccuguggggcggguccagccuucugaggugcccuucaaagccaucaucugagagaagaaacgguucaggcgacaugagcaaguuucugggaaacuuuguuugagagcaugcuaagguuuauuuaaaaccccaggaauugcucuuuccaggugaaaaauucuuuuuuugaccugaaggcagaggaaagaguucccugcuaaugauuccauucagcugaugaaguacuugauuauuagagagcagugccacuaagcagcuuuaaguuguccguaaucauuguaaacaucagugcaguaccuucaauaugguaaagauguugucuucagaugaauggcucauauuuuggugcaguguuugauguucacaaaaaaauguuacaauaauaaacuaacauaaacugauu

SEQ ID NO: 8724 - RNA, 62642 nt, Mus musculus
cuucaggguuuuauuuuuuauuuauuguauagaaaaugaaauaugguguuuuucuagcuccuacaacauugcugaaguucuuccaagaaacaaguuuagguacucauauguacacauuauuuaggccaugaaauggguuuucgauacauugauuuaugaaacaggcuucuccguuugguuauaagcccaucuguagaguuacuguguaaucacugacaaauguuucugauaguaacuagccaaacagucucaaaaaugcuuaaaaaacaaguucugagaaaaagcuuacagaaaagggacaguguuuaacauuucaacacuuuuugugaacaaacuguaaaacauuuguacagugugcauuuucuguuacagaagagucacauucugauuuuccacacagaccaugucccugcauugcuugacuuauucacugguaaaguggucgcacaugucaguacuguuuucagaauauauuaauuguuuuuuuuuucauuaauucaguguuaugaccuuaacuguucucucuuuuaaacuagcucuuuugucuucuaguuuaaccuuuuaagcugguggaggaaguucagaccacaccugaacugguaccugagaugacagcacugaaucugaagacaaagaaggaucaaauuagaacugacuauuauuagucacuacuucagaaagucuuuuuaccuuauuuugguauguuuaguuauuacuaugauuuguaugacuuuuacauguguuugaaaaguaacagaagcuaaaggccauuguacaacuggguaacagucccguuuucguucucuugcauuugguuugccauucuguagcugugacuccagcuugcuuuaguugagccuugucauucuucacucucugcaaaccauuccacggauuuguuuuucuucacaaaauuaguuucauuuucuuuguuugauugauggucauuggcuacugaaauaaaauaugcauuuuaagguaaauuguauguauuuuuuaagauaaaacuuuguguauuuuaaaauacuuuuuuacuguucuuuuuucuuuaucuuuguuuuuuccuuucuuucuugagacagaagugguaagccugccuuugaccccagcguuggggaggaagcagcagaaugaucaggguagacaaggcccuaucucaaaaaacaaaaacaaaacaacaaaaagauugagauaggaucuuacuguauagcccaggcuagucuugaauucuugauauuccugccucagcuuccuaagugcuagacuuacaggcauucaucacugccugaaccuaguacauauuuuaauuucuuauguggaacuuuaaaaaauaaggagccagacuuaguggagcacaccuuuaaucccagcucuugggaggcaggcaggcagaucucugauuuugaggccagccuggucuacaaagggaguuccaggauagccagggcucuacagagaaacccugucgagagagagagagagagagagagagagagagagagagagagagagagagagagagagagagagagagagagaaaagaaagaagaaaaagaagaaagaagaggaggaggagggcucagggagauggcuuaguguguaaaaccacuaacuagcucugcaagccugaguuugauacccagaauucauguguuuuuuguuuuuguuuuuaaaagcuggaugcaguaaugggcaucuacaaucccaacacuccuauagcagugaucccaacacuccuauagcagugugggaaguggagacagaagaaucugcagucuggccagcuagcuugggcugcguggggcagcaaacugccucaacaagguggaagacaugaacugacuccugaaaguuguucucuaaccuccacagacacacacacacaccguaaacaacaacaacaacaacaacaacaacaaaaaacacaccagggcuauaguaaauaguaggggagaacugaugggaauaauauaauuuuuaaaauuauaauaaagauguaacuuuguuguugcuuuugguucuggguacugaagccaggaccuugaaccugguacauuguaaaucauacuauuaauaggguuugcccucaagaccuaauaacucuuuuuguuugguugguuuuuauuuuuguuggguuuaaagauaacaucuaauauaacgcaggcuggcuuugaacuccugauccuccugcuuuccccucuacagagugcugggauuauagacauaaacuaccauguccagcuauauauaguguuauuuugagacauucuuauuccuuauucuagacaggccucaacuauugauacuucugccucagccucuagagugucaggauacgggcauguccuacuauacauugcuucaagguguaacaauucuuaaaucuuuuuagucugcucaaaucuugguuugauaugguuugagauagggucucaucuguaacuuaggcaggccuggaacagggugucuuggaacuaauagcaguccuccugcuccagucuccugagcacuggaauaacagaugugaaaugccauagacagaaucauuuaaccauguuuaaaggccaccaggacuaaugacauauaucaaaugaugugaaaaauguacuuuacacgugugaauuaggaauaggaauuauucaucgguaccaguuguuuuguauuuucuaauaacauauauguuuaaagaacuuuauucgccaggcggugguggcgcacaccuuuaaucccagcacuugggaggcagaggcagguagauuucugaguuugaggccagccuggacuacagagugaguuccaggacagccagagcuauacagagaaacccugucucggaaaaaaaaaaaaaaaaacuuuauucauuuuucaaccaacucaucuucaagguuauauuuuuauauaguuguacaguuuuuuguuguuuagcuguagaugcuucucuguuggcuagcuuucacaauucuggaggggagugcuauggcaagcugcagaagaagaaaccuacucagcaauggucugacaccucagugaacccugaguguuauaauauuaccggacuugaaaacaggcugugucacuggugaacugguggcaugauugcuaagggggucaucaaccacuuccacuccacaggaggggacucguuccugguauugccacccugcuccaaaaccuugcagugccgggaugcaggcauguccuaccauaccugguuucaagauguaacagcucuuuaaucucuuuucuuauacucgaaucuugguuugguuugguuugagacaggaucucacuuuccaggcuguccuggaacucauggcaauucuuagcacuagaauuacaggugugaguuaccauagaaccuuuuuaaccagguuaaaagaauaucagaaucaauauaacugguaucuaugaauaaucccuguuccuaacauauuucucccaucauuugauguaugucauuaagucugacauucuuuuaaccugguuaaaaugauccugucuaugguagcucacaucuguuaggagguugaagcaggagaacugccaugagucccaggccagcuugagaauauucuagcccaagacuggagaagucauuggcuuuagggagaaccuacuacuguuguuuugcuaaauggacaugaugucaaacugcuuuccaaacauucaaccccuagguuaguacucucaaccuuggucagagaaacccuuugcagugggcagugguuaaugcagaaacauauaauuggucaaagugcugagaauacaagaugguugaaugcucagcccuacaugggacaucuguauauuacucacauucacaauucagaaaggcugguggaaaggauauaaggggcaaaguucugugaaacccucuacaaaugacauaggccuggugcucacaaacccacggcagcuggguuucccugcacacgauccaaaccaucaauauucuagcauagauaggcgagagaggagaaucauuuuuccucaggagcauagucacuaguaaggugcccuugcuccaguaaaaaaauaaccccaagcccagaacauguaagcaaaccuaauuaaacuugguggguuaccaaaaacaaaaaucaaaaacuaaacaaaacaaagaacaauaaaacaacagcaaacccaacugaguaugauggaaaggauuuuucuuucaucccagcacucaggaggcaggggcaguuguauuucugaguucaagccaaccuggucuacauagcaacuucaggauagccaaggcuacacagugagauccugucaacaauaauaauaauuuaaagauaugaaauuaagagggggcuauauuguaaaggaggauucuagaaggagaaagugggguuaaaaaguggagaaugggaagcugagaguggucaaauacacuuaggagguagaggcaggaagaucagaaagagauuagaaucauugaucaggcuauggaggaccuuagaggccuucuaaagaguuugucuuuuuuuguuuguuuguuagguuuuuuuuaaagacaaggucucagauaaucucaguauguagcugagauuggcccuucucuguguagccuuggcuguccuggaacucacuuuguagaccaggcuggccucaaacucagaaaucaccugccucugccucccaagugcugggauuaaaggcgugcgccaccacugccuggauggcccugaacuccugauuccucuaucuccuaaaugcugggauuaugggugugagucacucugacguuauuauguaauacuggugaucaauccugugcuuagugaaugcuaaccaaguacucuacaaacugagcuauauccccaacccaagugugucuaucuuaaaacaaaacaaaacaaagccccugaggugccauugaaggauuuaauuaaggguaaucuacuuagauuuguguuugguuaggacauucuggcugcauuaaguacugacugagaaggggagcuauucugguguuauauugucuguacuaucuauaacuagagcuuugacacccauuaauugucaaguccuaagugucuauaagaagaggauggauuaaaggcagaggaaaauguuauccuuuaaccuguuucauuucaaacuaaguguacuuacuuucugcuuagcauauuguauucgauggauaaugaauugaacaauaccucucuaucauugugcccaucuuaauuuugaguugaaugguaaauuagcauguauuauuaaguaguucaucgagacacaguuuaaggccuuucucaauauguuuacaaucucgguaugggccagauguccuccccugcuaucugacagcauuucacucccuauagcucagacuaaccuugaacuaauggucuucaugccucaccaucccaaggauuaggauuaaaaucauacagaggacagaugcugacuaguguuagcuuacuuccucucuccuuucccggucucauacagcucaggcuggcgucaaauugguucucuauccaaggaugacccugaacuccuggugguccucuacaucccagaugcugcgacuaugggugugugccacaugccugccuuccuguuaguuuccugugugugucuggcccucuuguaucuaucacucucagauauugggggaucugguuuacaacugucuuccaguugcuuucuaggagacuugcuccaccucuacccuucccauccaguaaaugaucaguaaguuugcugguggcuuuaagugcacacuggaucauguauuguuucaucuauugacuuaguuauaguagaacauaugauaugacuaagaguguaaagggaacagaugcaaagacuacuuguagaaagaaccagauuagcuauugauucaguguaagacaaucuguauuggggcgggguggagggaggaagagauggaguuucucugaguaaccauggcugcucugaaacucacucuguagaccaggcuacccuccagcucagagauccaccugccugugcuucugagugcuaggauuaaaggcgagcaccaccacuaccuugugaucaucuauauuuucaaauuccuauuugcuauuccacucucucccuuacaucugcuagucucugcaaacacagugcucauuuacuguccugaacauauguuauuuguucuggaaaucucuuaccaacuuucucuuacacagaauucuguagccuauucauuuguuugucgaagacaggguuccuucucuauaguguuggcuggcuuagaacauagaguaauccucuguccuuaaccuccagaguuccgaguuuauaauucuguaaucuuuuguucucuuaaauguugcucauauagcauauuccugaucacauuauugacccuugucaccugcucuguuuauuuuuugguucuggggcuugaacauuguccagugccugccaaacaugcucuuccacugagugcuaucuuuagcccugauuauaucuuuguuaaguauaggcauaauguuacugugcacuguguaaagauuauccuuguauuauucaacuguugauuucucugcccccauaucugguugcaauccagacaugacauuguaaugcuucuucuaagaaccuccugucucaguguuguguaagcauugcuccccauuuauucucuaaucugucgauaaagcugaucagccaauggcuaagcagaggagauuauagggcuggauuucugaucccagccaaggaaggggagagagaaaaggagaaggggggagggaaaaggagauggaaggagagggagaagaagagaggggaagggagggaaagauuugucuagaggagagggucuaggagaggccauggaaagucaccuggagcagagaaagccagaugaacacuaaacugcaaguaucuugaggauuugggcugggagguagccagauuauuuuaaaggauuggaauagauuaguucagcuauuauguaucaaaagcuugauuaaauacaucuuaaagucuuugucucauucauuuaggagcaagcuggaaugaagaaaaaaaaacuaauacuuuuaaaaguuacauuagcaguuaagugccaagauuucaaacaggugauugugaccagaacagugaaugacauuaugacacaaaaugaaguucaaaaacaggacuuacuuuuaagaaaaauuauuuaguuauggguuaucuaacauauagacuagucugugccugucaaugccaaagguaaggcuuguuguauuuuucccuuuaucuuuauuuuaacaccucagguuugcagauaggguuuguccauguuucacuuggacuagcaaaggugcccugaggcagaagcagcauagaguaacuauagaaguguguuacagcuuugaagguauaaccugaaggaaagaccuaaguguagcauauauaaggcccuagguucaaacaccaauaccaaagcaaaaaguagaaaaguggggucuggagaaauagcucagugguuacaaacacuuggccacucuuccugagggcuuggguucaauucccagcacccacaugaugcaugguggcucccaaccacaugcaacuccagcucuaagggauccuauguuuucuuccagcuuccauggucacugaaaucacaugguaaacacacauacguguagauaaagcagucauuguuugcuguugcuuuagcugguaaugguguaacuuuucugaguuuuucugcaguaaaaugaauauuagccauuucaaaaugucuuggggguauugagcuuuuuagaugugauuaguaaaaggacuaguauaauacucauagucgugauaccucugacuucuuaaagaaugucacccccaaaguaguugacaguguuucccucuaucuugucaaacugacguuuuguuuuuaaaauguuauagguauuuuuguguuaaaauugcuuuuugguacauguuacuuugaaacaaacaacaaaagcaaucaaaccauuuuagucaugauuuugcgcaccuuuaaccccagaggcagguagauuucuaugaguuugaggccaaucuggucuauguagugaguuugagccacccaguauuauacaaugagaccauguauuuuaaaaaaagaagggaaaggagguuaggauggauggaagaaagaaaguuguuuucuuuuguuugaaagguagaacagugaucacauaaauuguaacaaagaccuggagccaagaccagcuccuugugugucuuucuuguaaaauguuggaaugaguuuuuggugacuauagaccauccaauccagugaugucucuccaguguaucccauccccuuuuaaaaaggaaauagacguuuagcucccaaagggcuuccagcuggggcucuccagccuugaccugagugcuguucccaaggcauugcuuccauaccuagcaauaguuuuucuuuauauuguuugcccucugacacuaacaaaugcuuuuaggguuaaccuuaagauucacaagaaaacuauuggauaaauauuuauucccuccucuaagugaugguggcacaugccuuuaaucccaguuuucaggaggcagaggcagggggaucuccggaaguuccaggacagccagaacuacauagugagacccugucucaagaaacaaaacaaaacaaaacaaaacaaaaaacuguagugagacccugucucaagaaacagaacaaaacaaaacaaaacuguugcuuccuaaaauagaucuauaaauccuaaauugggaauuucaucaauaaacaguuaaaagcacagucccuucuacaccuccccuauaucagugccuuacuuuuguuuauaaucacucaagggcuugcuuuaauuuuuuuaaauacauuuauucucucuuucuuucuugcucucucccuccccuucuuuccuucucucucucuucccccaaccccucacucccuguguaugugcuucguacacaauuacaugaccuccauguuucuguggaggucagagaacagcaugagagagacaguucuugccuuccacccagaacugaacucagacaucaggcuuagcaggaagcccuuacccacugacacaugcccugccucagcuuuuucagauagugacuaggaagccccuuacucccugcauucacuccaguccccuagugggugccaaggccuagaaucuaucuacacgcugcaaugauaucuacaggggcugcucaaaagaaaacacaaugauuucucuucuguuuucugaaauacagguucaaauuguuaaaaugugcuccuaacuuauucuacaagcauuccagaaggaaccuggcucuugguguuuccaucacuccuuuagcagucuucuuaacgacuccuaccacagcuuauuuucacugauaaaagcaggguuuuaucaaaggcaguagaguauaauugguaagaauucaggcuccagucaccagaccaggauccaaauauuacucuacaagccuuaugagaauuaacauaagccuugguuuccuuguuugccauguggagauaacaauacuuaaccuucagugguaguggauauuaaguguauuaugaauuaaaggagcuuuuuuuuguuuuuguuuuuuuccagagacaggguuucucuguguagcccuggcuguucuggaacucacuuuguagaccaggcuggccucgaacucagaaaucccccugccucugccuccugaguguugggauuaaaggcgugcgccaccaagcccagcucaaagaauguaaaaguaaaaaaaaaaaaaaaaaaaaccuaggagauagaagagggagaacaaaugacacuuuauaguugaguuaauaauuagccuauuuauugucaaauauguguaugacuaaaagaaugugcuuggagauguugaaaagcaagagacuauacugccagugaaauuuguuaagcaaauacuguguccaguaaaaggaacaggagcuaugcucuacugccaagggacuagagcagugguuuuccaccugugggucaugacccccaaacaaccaucagaaaacacaaauauuuauauuaggauuuauaacaguagcaaaauuauaguuaugaaguaauaacaaaaauaauuuuaugguugggagucaccacaacaugaggaacuguguuacaaugucacagcauuaggaagguuggaagccacuggacuggaguuuaguuccccuuuuagugacacuucaguagucauuguccuucucauaggaauaugguaaagauaaaguaguaaaaaucugacugauguaggucuguuuuuuuuuuuuuucuaugauaaaagagucuacaaaaaaaaucuggguuuuuuuuuuccuuuuucuuuuucuguuuuguuuucgacaagauuucucuguagcccuggcuguccuggaacucauugugcagaccaggcuggccucgaacucagaaauucuccugccucugccucucaaguucugagauuaaaggugugugugccacuacugccuagugaaaucuguuuuucaaaugagggaaaucuguaaggaguaaacaggaucccauugcagaguacuuuaguacuguuucaaaucuagcaaagaaaaaugacagggaaauacuacacauaaagauaauuugaaaauuauggcauaguuuguauuuaugguuaauuauuuucuaguuaauauaucauuguucuaaguaaucauuuagaacucaacaaugauauaugcaaauaaauuacacauaucacaauaagguuuucaaacacuaaaugacauaggaaaaugauucauaguaaauaaaaaaagcuagccuggcuaaaauauggccuaauuuuguuagaaauagaaaaguauagagaagaaaccaauaguuggauggugauuagaaguaaauuuauuuucuugaaaacauuuuuaaauaaaauaaacaugucauagaaacccuucaagccuuaauaguuggaccucguagcauagugaggugaaguuuaauauauguuacaauccuuuuuaguguguguaggcuagcacaacauggguauagauaggauaaaaagugguaacuugaagggggaaaacuuucaauacaaaugcaacgcaguuauguaaacuaugcaucccugccuguaaggucuaguagguagagagcaugcauuagucuaccugccauuaagccauaccuugagaauagguaugaggagggucaccugccguguccacugagaaugcacuguguaguuccugagaaucuuuuuccauuagcucuccugugucacuggaggaagaugaggaugaagacagucccagucucacguaucuuccuuuuuuaccacacagugagcaauccacugguguggcacuagguccccugggcaggugaaccucaucucuguuguaguuccuaacagcuccacugugaugcacagaccgcucucguugccagauguaauggguuggcgcaauggccaugaccuauagugaaaagguuacuuugugaauuuaauaacauuuuaaaauugaguaaaguacagaaauuguaaaauaacagccaaauuaccuaaaaaaaaggggggaaaaaggcuguugugguguacaccuuucaucucaacagagaggcaggugaaucucugaguucuaggcuggucuggucuacagaauugagcuccagggcuacacagagaaauccugucuuaggaaaacaacaacaacaacaaaacagacaaaaaacagccccucccagaacaauagaaauacuuaaguuacaaacuuuaaaucagcaacaucaaaucauccauagcagcauuuucuguagagugauuucuuggaucauuaauauuaauauugacaaaguaucuaaauuaguucaaguagauaauauaaaugaagcaaccuucucaguugcuauuuauuuagucagucaguuuguuuuugagauaaggugcucuaugcagaccuggcugucuucaaacucagucucugccuuugacugcugggauuaauggagcguagcaggguauuuauuuuuaaauuuucaaauauuucuaaguuuagaaaagauaauaauauaguauaaaacauuauauaauucuuuuguauguguugguaaaaaaugggcucuuaacuauguuaggcuaaucuuaaaauauuuacaguuauaucaagggauguguuauuuuuuaaaaacauguagauuaacuucuuuguccuucaguuuccuuauuuguuacacagagacaagaguauacuuuuagaaaguugugaggaaaggauacauuuuauaaagcacuuaagauuucucccugucaggcauugucauaagguuuuuaaaucaagcgugggcuuuaguuguagacuuucuuauccugguucuaccacuuguugacuauauaugcuacagagcaaauuauuuaaccuuucugagguucuguuacuucauugauaaaaugggguugcuaacuaccacaaauauuguuuugagauucaauauuacauguaaaauccuuaccacauaauuagcaucuggcaaaugauagccauuuaagaagucaagauaaggaaaaguauaauauauugaccuuaugaaauccaaaauaaugagauuuaagucaaagucuuuagcuguaguuaucaaugauccacaguaagugauaaguuauaauaauccuaaaaugaaagccaaacagucauacuauuugccuaaacuagugauuucuuaaaaauguuuaaaaauucugaaauuuuagagcuauacuggggaccugggagggacaagggaaggcagcauuauuagagaagcuguuuuaggagccuauguauaaggacuuauauauguuuuugaugagaaagaacucuuuuuguuguuacguuuuaagacauaucuguguaucucugguuguccuagaacuugcucuguagaccaagcugggggccagugaguggaaugucaugguuugaauaugcuuggccuagagaguggcacuauuuggaggugugugcuuguuggaguagguauguaugucacugugggcaugggcuuuaagacccucauccuaacugccuggaagucaguauuuugcuagcagcuuucagaugaagauguagaacugucagcucuuucugcacuauggaugcugccauguuccugccuugaugauaaugagccuguaagcuagccccaaucaacuguuguccuuauaagaguugccuuggucaugguaucuguucacagcaguaaaacccuaagacagaaguaauguaauuuaaguguacccccacccugagcuacccucacuuuuuuugcuccuuacccucccuauuaguucccuuuauauuuuuggugcuuuuauuuuuaaaaucaucaucaucaucaucauuuugaggcaggaucuucuuugguagccuuggcuggccuggagaccaggauuagucuuaaacucacagagauccaccugccucugccucccacaugcugggauuaaaggcaugugccacuauacccagcuguauuuuuucaugucagcuguacauauauguauauaagcuauacauuucuauaaaaaucuaagauacaaaaagugguauuugugauuuugaacccuguaaaguaauaagacagaaagggaaauuaaaaggauaaaaauaacaaaaagaagucaaaguauucauauuuccagauaugcuauagccagcuuacuacuaagucaugacaauuagaauuuuguagcauuucuaacacuggcgucaccucugaagcacugcaaucugguuucuaaacucuagcaaguuuagcuauuuccagcacauucccaauagagaaucgcuuuugcauaccuucauugucuuauucugcccaauacuauugcuuccuaauuuaucaaugugaaauaaaguaguaguuaacagaaguuagcuaugauguuacuguagcaacucuaccagagugcacaaagcagcauaaagaaaaaucuuucccuauaagcaacugcuauccucuguguuauuugaaaggcagggggaucgagucucucucaguggauaggcacccucucuaauauguggaccaguguagaaauuaagccaucaugaauguaaauuaauuccacugcaaaggaacaugucuaaaaaguaauaauguaagaagccaaguucagaauugguagggaaauagucuucauucuuuccagagaagccauuuauauacacacacacacacacacacacacacacacaccacaccacacuccacacacacacaccacacacacacacacacacacacucacacacaccacacacacacacacacuauguauguauauguacauauagaacguguguauuuuuuauuugcauacaauuauugaccaucuuucuuccaacaaauauucaagggagcugaacacacuaaggggauggggguuggagagagaguucagcuguuaagagcaguuguugcccuuucaguggaccuggacuggguuccuagcacacacaccgaagcucacaaauacuugugucuccaguuccagagcauuuaaugcuuucuucugaugugggcaccaggcacacaugugguaugcauacauacauacauacauacauacauacauacauacauaugugcagguaaaauacucauauauuuaagucuaaaaaaaauuuuuuaaauaauucauuaaacuggauccaaagagaaaauagagcucaagugagaaaaagcagacauagccuaauagaacaccaugcaguuaaucugguuauugacaauaguucuaaaaaaaaaaauagugggccaggcgugguggcacaugcuuuaaucccagcacucgggaggcagagacaggaggaucucuguaaauucuaggccagcauggccuauguaguaaauaaguuccugaacagccaaggcuauguagagagacccuaucuaaauuagaaaaaaaaaaaaagaaagaaggaaaagaaaaagcaacaaaucacaaaacucaguauuaccuaaaaagggagcauauguucuuuaacaauaguaacagaaagacaagucaugauuuaaugauacuuuuuuuaaaucugagaaauagaauaguuaugcuuuuuaauuccccagauaagauacaaaugaauuuucuaaguuacuauugaaaaguuuauauggaagcuagauaucagagaaaacagaacagugagaagucauuacauaugcagccagucaagauguggcucugguacuucuuugggugggcuuaaguaaauccuaauauccuuggguccauggucucaucagcuauaaaggaaaaaugccuccauccucagagacaucuuugugaggauaagcaaugcauauugagucauaauauagucuuaguuccuuuucuauugcuggaauaaaacauuaugaacaagacaacucauaaaguguucaauugggggcccacaguugcagagggacagaguccaugaccaucauggccacaggcagacaagaaagauacuagagcaggaacuaggagcucauacguugauccacuaacacgaggcagugagggugaacuggaaauagcacuggguuuugaaaccucaaugacguaccagugacacaccuccuccaacaagaccacacuuccuaauccuuccaaaacauuuccucuaacuggagacuaaugcucaaacuuaaacgccuauaggagccauacuaauucaaauacuauaaauuugaauaccacaaauacguauuacuauuauaagcacauugguagcuacuauuccacuuuaacuuaauuagaauauaaggcuaaagauuauuuugacugacaguaugcuaguaccaggauuucgguaacaaauguuuaggaugccuaauuucuaacaacauaucuuacuacuuagccucaaaguauucaaaccuauguggauucaagccagacaaaauuccagcacucagagguaaacacaaagucccaccucaaaccaagaggauccuuguaguugaugcuuacugggaaagagggggucauuuuucuccaguugaaugucacuggguguaucagccacaguuagggcugccguagagagugaccagugugcugggcaguggugacgcacgccuuuaaucccagcacuugggaagcagaggcaggcggauuucugaguuggaagccagccuggucuacagagugaguuccaggacagccaggguuacagagaaacccugucucgaaaccaacccccccaaaaaaauaaauaaauaaaagagagagaaagaccaguggaaagauccccaugccuacaaaaagaaagaaaaaagaggaaagaaugaaagaaaaagccaggaguagugguucaugccuuuaaucccagcagaggcaggcaguucucugugaguuugaggccagccuggucuacaaaagagaguuacaggacagccagggauacacagagaaagccuaucuugaaaaacaaaaaacaaaaagauccccaugcuuuccauuaagaauggcaagugcaaagauccuacacugugaauaugccuggcucaguugagagcaguaaggaggcugguguagcuggaagacugcauacaauggguuagaaaagagcacaaugaagaagcaagugagaaaggagguacagacggcaaggccaauguugucuuauacccuauaaaaggugggaagcuacugagagcuugggguggggacuagagagauggaccaguguuuaagagcacugaacugauuuuccaggaguacucaguuuuauucccagcacccaccugauggcuugcaacagucuacaacucuaguuccaggaguucugaugcucuguucuagggucugugggcaccagguacguauguaaaauaccuauacaaauacaacuuaaaaaagaauuuacuguauggaggcuuaacaaaugaugacuuucacaguuauauaaagagcagccuauaggagagaagauuaugaaacucuguugcuuuuguuuuaaggaacuagggauugaacccaaggcuguguguaugcuuggcaaacacucuaccacuaagguacauucuauguucagaaaacacuguuugcaaaguuaugacaauuaaggcaaccagugauaaauagugguagaaaugcuagaaauaguaggaugcuagaguuuuuaaauguaaauuuuauuuuuuguguguaaggguguuuggcugcaugugugccugcaccacuuguaugucuagugucuggugcccacauaggucagaaaggggcaucagauccccagaaaccggaguuacagacaguugugagaagccaugaaauugaacuaggagccucuggaagagcagaccugcuuuuagccauuuagccaucucucuagccuccugaauaguuuugaaagcaaggauauaagggggaagaaaaagccaaagauacaguuuugugacaugagcaauuagaaggauggagcugcucuuuacuaauauauagaagaguguaaaaaagcaaguuuguugguuuguguauaggaaucaggaauagacuuuuacacaugccaaguuuaaggguucagucggacaaugggauaaacaagcaaucugauaugcagaucugcacuuagaagauaccuuuagaucucuauguucaagucuucugaaaauauuuuuaugugcaugagcacaugccucuaggggccacucuuaggaguuagauuccuaggaguuagaguugcaggugguugugagcugccagauauggguguuaggaacugaacucuggucuucuggaugacuagcaagugguuuuaaagugcuaagccgucucuccagucccucauaguuaauguguugaagaugaacaagaucauuacuaaguuaauuccagucaaggcaagaaaagcucucaggacugagcucucagacaccuuaauaaggcuagcgagaugaaagggggcugacaauacguggggagacccucaaucccaauacucacugaagcacaugaaggcacaguagcagagaacuaagugugccaaaggcugcuaaggcgaggacugagaacuaaagcuagucuaugcuuuggcaacauaaagcuaucaggaggcuuugacaacguucuguugaacaguggagaagaggcuuuaccuaacaguucuaaagagaauggaagagaagggaacagaagcagaguagcaugcacuuggagaaaacuagaguguuuaaauagagcccucugucauucucagaguuggcaaguggcuauguaacugccauuuauuucuucuugagacagggucacacuauauaguccaaguugaccuugaacuuuagaucccucugccucagucgccugaguacugagauuacaggaaaggacuacaacauugacccaaguagagacauaucaaaggcacacaagcaguagagagagccauaacuuacaagguucuuucaauaucauguaacuggauugaguucaguuugaaugacaguacauuaauuuuagaguccuuguauaggcaacuuuuaucuuuucccauugaauuuaacuuuguauagucuuggccugcuauauagucuuucuuuuauuuucugcccucuguuauuucugaauccuugcaguuccuccaagagucaauaauccgaauuuaaauaugcauaauuguaucuucucuuauuaacaauuauaauuaacaacacuaauucuggggaaaauucugugacaugcagcuaaagucuuuacucaaguucaaaaucaguucaucaguuugggcuccuuuguucuaugguuauuuagcuggguaggauuuaauuacagaauuaucuaguuuacauuucucaaaguucugaaacaguaauacaagaguugacaauaguuguugcuuucacuugauuuuacucuauaacuuuuguugucuaaaauacuaauaaaaacauuugguuaaaauaacuuacuuauaaauaaaaguaucuuaauaaacucugacauuaagaaaacaaugugcugggcaugaagguacauaccuuuagucccauguauugggagacaaagacacuaugaucuuugugagcuagccuagucuacauagacaguucuaggauagccagggcuauagaggcccugucucaaauaaaauuuaaaaaaauuaaauuuuaaaaaagaaaacaaugcauuuuuaaaacuuuuaucugcauuuauuuuaugcuaaauuuauucccaugccauaaguuuuuguugcuucaguuucuucugggauaucuuuuucuuuuugugcacccuccucuucuggcuuugagacaauuuguuccuuucagugaggaucaucucaucaaggcagggaaagcucacguauccagccauaagcucugggaguuuguccacaccuuaggugcuuuguucacaguguaugcucaacgacuggagaaucuacaucuaaauccuuaaguucagcauuacucuauggacuuuuaagcaugugcagcaaaaauucagcacucauuuuugaccaacgacccuguguccagcacuacuguuuagccugggcacaccuaccaacucuaccauuuauacugcuucuuuaaaguaacaucuuucagauacuugguuacuuuucagguaugauacccuugauggccugggcaguuuaauggauguucuuagagugaggaagauuugaccucuugauuugcaugauuuuguaggguuucuggauuaagagaguagcagaccauccucagaagucucuggccgcuuacaggaagaggaagugggaggauuacugggagaauucaugagaccucaacuucucgcaaaagaauauauucuuugagaaaagagguauggauuuuagacauacuuaaauuuauuuaauuuauauaaccaugcuguuggcgucaauguugaaaacuugaaaauucaaauacuuuagugauuauuauucaacucuuguuuuauaauaauaagaugcuuuaguauauccacaaacauuuuaccaggauacuggugaucuuuuagaugggaggagggggacaguacaauaagaauaauauagaaguagucuguucugaaaaauggauauuacaauuuugaauaaaugugauaaaauucaaacagaaacaaaauauaaaaguugcagucauaauaaugaccgaggcuagugaucuccauacauaaagacagacauagaucauuaaaaacuaaguaggaggucauagugucaugauauacuuuuauccuaaaacugaagggaacagaauaggacuaugaguuccaaggcaggcugggauaauugcaggaaucuaucuccaaauaaggaagaaaaaaaacaaaaccaaacuaaaauaaauaaaucaaggaaaauuauauaaacgacgauagauuauaaaaagugauuuuaaacacucaccucuucacagcaucgccugcuuacaauagcccuauagucaauucugucccagaguuggucccuuaacuuuaagaaauuagggaacaguuuucuccaguuuuucccuaaagcccauggaaaaauuucauacuuggcuucuucuucaucuucuucaaccguauuagccagauaccuaacaaauuggaucaacaauccaaaacagauauggguaagggcaagaacaauagauaauaauaauaaaaaagaaagacuuaccaauacauaaaggauacucauaucuaaaaugcguaacagaagcagugauacaaugaauuguauaccuuguugcaccuucuaggugucucuguaauccuauaaauuuugaacuuuguucugggaugcaaguaaguuacauugaaacaaucucucuugagguauuucugacuuuguagaugaaucuguaaacaguguucaaucuggaccuaguuagcuccuucccaaaucaagacuuuucuagacuauuuuucuuacuauuccaggaacuguggcuuuuuuacccuggcugagaaccguuuauaauuauagaugaaugacuguaagguagguauucucuuuuuuuaaacuuucuuugggcuaucuucaaacagcucccucauacacauuuggaagucaguauuuugccaaauacuugaggggaaccagacauaaaaagcagcagaaaaacacaaaccaugaggagaauaaucaaucaaagccaacccacaacugauacauaggaggacaccaaaacauuuauaacuuuuuaauauaauaauuuauccuuauuuuauguuuguuaguguuuugccugcauguguguguuugaggaugucagaucuacuggaacuggaguuacagacacaugugagcugucaugugggugcugggaacugaacucaggaucucuggaagagcagccugugcucuuaaccacugagccaucucuccacccacuuacuauaacuauccuuuauacucaaaaauguagauaaauugauacuguccuuguaguugaauaauaaaugaauaagaaacaagaaaccacacgaaaauuauaugauggcacaccauagcugaauugcucaaaaauauugauaaaaaucuuuaaaagcagucagaaaagaaagacauauuaagcuaguguguuggcacacaucucuaaucccaggacuugaggaguccagacaguggaaucaugaguucaaagcuauccuuagcuauauagugaguuugauuccagacugaggcacaugagacucuguuccacaaaacaaaaaugaggcaagauauuaauacaugaauaaaguuaauaauggaagagauucccaaucagaaacaguucaggcuccauaagucacuuuuacaacaaaaacauuccaaacacacacacacacacacacacaaacaaacaaacaaaaaaaaaaccaagacaacaugagcagagcagaacccaaaauuuaaacagaauacaaaaauaacagucuaugggcuggagagauggcuccauggugaagagugauugcugcucuugcaaaggaccuggcuucaguucccaguacccauaucuggcaccucauaccucuaacuccaacccagagaaucucacacccucuucaaaccuuuccagccaccagccuguaaaugguacauauaaacucacacauauacauauucacauacucaaauaaagauaacuaauauguuuguaaaauaagguaauuuaaaaaaaaagaaggcuaggcaagguggcacacuccuuuaaucccagcacuugggaggcagaggcaggcggauuucugaguuccaggccagccugaucuacagagugaguuccagaacagccagggccauacagggaaacccugucuuaaaaaaaaaacagguaauaaauauauaugaaaaauuaaaaauaguauacauaaaauacauaacaaauagaaaaaucaaauucguaauaguagauaaauuuaagaaauauccaaaauguagcucagagaaacaaauauacaaaauguguaacaucauggugguugccacuacauugaguacuaucaacuaucuaugugaaucuaacugcuucuuuuguauccuccaggcaaaaggcuagaaacagucauuguugccugugucagauccugaguagcaugaagcuuauauaugguucaaaguuucccauugaagauacacaagccacaagcuacccugcagcagugacaccaaacaauaauguaguuccuuaacucaggccaugacuacaagauccuucauauauacugccacuguaccacuaaccugggagcucuuuaucuuccccuccuccgaauccuaugucuacucuccuguucagaaggaaugugagcauucaggggcagagggcaagggcucuaccuucacuccuugagcccacccaguaauaccuuuccuucauguccuugaugcccagggugcagacauuguacaaagguuucuuucuuguucuuuuuguuuguuuguuagacaaggucucacuaugaugucuuggauaccuggaaccugcuguguggacuaggauggcucaaacucacagagacugagugcugggcuuaagucacgugccugugcaucugguggguguguggggugggcuaagacaggaucuuucuacaaagcucaagcuagccuggaauucccuguguaguccaagcuacaucuagggucauucuaccucagccuucugcauacugagaguguuacaggaaugggcuaucgaguguguaaauuccuagacagaaacaccuacacacauuaaaaucugucaguguuugggcaaaauaacuccaaauuauuaaacagauuuggaaagcagaaugcagcauauaacagcauauuuaauggauuucaauggaagcuaacagaggagauagggaaaacuugaaggauaguagcuagaauuuucuaaggguucuuuguugaaagguaucuuuaagucaaggaaguucaucuaauuccaaguagguucuaacaacauuuuuuaaaaggcuuaaaguuagauagaaaggaaggcuaaagaucucaagcauauuaggcaaguguuuuaccaccaacuaaauuccauuccucuuuuuaccuuuucuuuuaaggaaagaucuuucuaaguugcuuuggcuggacuugaacucauucgauaacuagguaaaggagaaagagcauguaacuaauaaaugcaggagaggaugugggaggaugaaggaguacugcuggcauggucgcaaugccugucaccucggcauuggcaggaaggaggaucaggucaagaucauccuuggcuacacagggaguuuggggccagccuaggcuacaaauacuugucucaaaagauuuuaaaaaacaacaagaagaagaaauucagguguuacaagaauacugaaagaaaaaauuacaugacuauauagaaagaaauugugagcuuuagaacuguggcuaagagaggcuuaaugaaaagagauacugagucuacauaugauuagacacaggauggaaauuauaauucagguuaccuaaaauauaauauaauacaauaugcaaugcagucuucaaagauaacuacacaguaaaagcuaaauagcacauuaauggcuauaaccacaaaacaauugaaacaaauccaauuucauacuucuacauggauuuacacuaaagccauuuuuggcuugucuuuaauucuuagguggagaaaaacuacagaauaguaugguauugaauaugguacaauauugaaacauauaaauggaaaauuaacagcauuaaggcugaguuuugcucuugagaauaucauacaugcauuucuauaucauacaugcauuugcaucucugcuuuuuuuucuugcucaggcuggccucaaacgcacgcucccaucucagcuuccuacauguugggaguauagguguauaccacaauagcuggccuccuuaauaauuucccugaccuucaaagugcuuuauugucuauaaagucaaaguauuuccuugucuauaaaacaggaauuagaaauguauuucacagccgggcguggugacgcacaccuuuaaucccagcacucaggcagaggcaggcagauuucugaguucgaggccagccuggucuacagagugaguuccaggacagccagggcuacacagagaaacccugucucgaaaaaaaccaaaaaaaaaaaaaaaagagagagagagagagagagagagagagagagagagagaaaagaaauguauuucauaagaagccuaaaugugcugggcugagguggugcaugacuuuaagcacucuggaggcagaggcagguggaucucuguggguuugaggccagccuggucuacaggaguucuaggauagccagagcuacacacagagaaacccuuucuugaagaaacaaaaaacaaaacccaagaaaacuaaaaguauaaguauauaagauguggugauuuauacauaccauucagaauuagcuauuacuauuaaauucuuccaguuuaccaaucaucaccagauguuaaauucagcucauuuuuccuauguucuggaaaaugucucucuaauuaaucauagaucaagcucuucuggccuaauuucuuuaccaauucugauucugaauuaaauagauguugaguuaaauaaaacuuauuucucaaugcugacagcuauugugauacuccaauaucguuuuauuuauucauuuuuaugcauuugagugucaugccugcauguauaucugugaaccauaugugugccuagugcccacagaggccagaagaggccaucagauucacuggauuugaugguugugcugggaauugaaccccaguccucuagaagagcagccaucuuaaaaugguugagccaaucucuccaguccccaauacugcaaugcuuuuauacaguucccuaauuuaacauuuaaaauuauguacauacauucuagcugcaucguuguauccaaguauaggguagaaaaaggauauucuuugucuuuuucauuuuugguuugggaggggggguugcuaguaacugaacccaaggcuucauguauauaagggaagcacucuacuuccuggcacaccacaaguuccaaaauguacucuuaaauuuaagcuuuccccuuauaaaaaaccaaaacaaaacaaaaacagugcugaaugaagccaggcagugguggugcacaucuuuaaucccagcacucggcaggcagaggcagguagaucucugaaguuaaggccagccuggucuagagaacagguccuaagacagccaggucuauacaaagaaacccuguuuuggggugggaggggggcagugcugaggagugaccccagagcuuacugcauacuaggcaagaauuccaucaccaaguuuuaucuccagcucugaaauuauauuuuuccuaacuaaauuaugccuauaaauuagagaagcacauuauuagaaacaauuuaacagauagcaaagcuaagacuaauuaaugugauaucaacagaaaaucuggaauauaaacaauauucaguguuugaugacaccaucagugaacauggaaguauuaaguaugcacaacuccuuuuagauacagacuacaaagaacauaugcaaaauauuuuccacaaaggcucacauuauaaaaguaagaugaugguuuuauuacauacuaacuggcaauuuaaaggaaaauaguuggagcuggagagauggcucagugguuaagagcacccucugcucuuccagagguccugaguucaaucccagcaaccacauggugacucacaaccaucuguaaugagaucugaugcccucuucuggugugucaaaagacagcuauaguguauucauauaaauaaaauaaauaaaucuuuuuuguuuuguuuuguuuuuuuccagacaggguuucccuguguagcccuggcugcccuggaacucacuuuguagaccaggcuguccuggaacucagaaauucgccuaccucugccucccaagugcugggaucaaaggcaugcaccaccacgcccagcuaauaaaucuuuuuuuuuuuuuuuaaagagaauaaucuguugcuggaugugguggcacacaccauuaaucagcacucaggaaguagaaguaguggaucucugugaguucaaggccagccuggacuacagagugaguuccaggacagccagggcuacaaugagagaucauuaaaaaaaaaaaaaaagaaacaaaacaaaaaucccaaugugugugugcaugugcuugugugugugagagaaagagagacagacagacagagacagaaagagacagagaaaguguguguguuggaggaauuuauaugagagcacuguaaaaaauguaaaagacacauuguaaccugaagugggaacaacaaaucuuuggcauguaauguaaggccaaugaaaagaacauaaaacuauccuauuaaagugaaaaauacauaauuuucccacacaagauggccuauuaacaauagccauaaaauuuuaacauuucugcuuuaaauuacaagucacauauauuaaaaugaccaauaaaacucauuuaguagaaaacauacuuacagagcaauaaagaaauuuauccugguaugcucauuuauaguaaauuuagcucucuugaaauaaacaaaggucauagccaaaagauacuacaaggaaaaguuagaaauuaguauuaaugguuugcuuucucuaauaucacugcuauaaaauaguugacuuuaacccuuaaauauuuaucuguauacagucaccugaguacuuauuuuuugguccccagaguuaauccacuugaaucguuugagcugccaauaauuacaguuaccaauaauuuauuauguuuagcuaagaggauuucuaauuuauuuuuauagcuggugcauuuuaaaacuaaaacuccauuuuuuuuucuaucuuaaauuucaaacuuauaaagaaguugaaauaguucagugaguagccaaacaucuuuuuugauuuuuguuguuguuguuguuguuguuuuguuuuuguagccaaacaucuuucauggaaauucaccaauaguuuuaaaacuguauagcaaggccuaauuuucacugagaaaacacauuuuaaaugucuuauuacaaagacacacaauuagcuuauuagaauauaugccaagaugaucuaaugguucaaauuugaaacaaguuacaaaaugaauauuguuuuucucucucauacuuauucacuaucuugaugauuccagggcuucccuucauuucugaguaaaggauuuuugaaauaauauagucaagaauucuggguuaguuacuuuucaaacacugcccccugcuguacaccaacauuaaagcacuuaaacuguacuguuugccacuguacuguuuacucaguucuaaagaaacugaguauuugauuauauaauuacuguuuauuugaaaagugauacuuuggggcuggagagauggcucaguaguuaagagcacugacugcuauugcagagguccugaguucaauucccagaaaccacaugguggcucacagcuaucugcaaugaagacugaugcucucuucuggggugucugaagagagcaauggugaauacauaaaauaaaaaaaaaaauuuaaagaaaagugauacuuugauuguuuuaaaaauuuacauuuuuggagauauaguuuuacacuuacuuauauaucuuuauuuauguauguauguuauaugucagguguggagaucagagaacaauggaagccuguucccuucuucccuuccacaugugaaaccugggaucaucuuauucaucggcuuuaccagccaaugcaguuguauguaucccaccagcaccaaauuaucaaauguuaugauaagacauuagcaugcuucagcuuuaccucaaaauaauuuacauuccagagaagaaacaagaauagucacauugauuauuuuuaagagccacauggaaggucuuuguuuuuauuauacguuguauguacuuuaauuuuccuaaauuaguuuccagaggcugcagagaugccuaagucacuaacagcacuauucuuccagagaacacaaaguuugauuccuagcacccaaaugguggcucauaacuaucuauugcccuaguuuuugggaauuuaauacucuuuuaguuuucuuucuuaauuaauuuauuuauuuauuguccucaaacaccagaagagggcaucagaacccauuacaaaugguuaugagcugagaauugaacucaagaccucugggguuuuuuuuuguuuggcuguuugguuggguguuuuguuuguuuguuuuuguuuuuuguuuuuuguuuuuuguuuuugagacaggguuucucuguguagcccuggcuguccuggaacucacucuguagaccaggcuggccucgcacucagaaaucugccugccucugccucccaagugcugggauuaaaggcgugcgccaccacugccugguuaacucaggaccucuggaagagcagucagugaucuuaagcacugagccuucuguccagccccagauuuugguuuuuauuuaugucuauguggggggggggagaugugugcacaugaguguagaagccugaggaagccggaagucaucagcugugaagcuggaguuauaggcagcucugaguuauuugauauggguacuggaaacugaacucagguccucuggaagaauaggaagugcucuuaaccauauucuccagccucccaaauuaaaaaaaaauaaacauuuuuaucuuugucacauuuaugaaauagccuucauuuugacauuuacuaugaaaucacaagcuauucuucugaacauuccuuuauuuuuauuuuaacuguuacugaacuugauauaugacugcccauuaucuaaauagguaucuacaaaaauaaaaugacaacuauucagcagacucaaaaacauagaaacaaauauugaaauauguccacaaaaaagcauuuaucaucacuauuccuaauauauuaggcaguuuaugggguuugauaucuaacagagaacaugcuaaacuaauuuuauccuguaagauuaccaggaagaggauaaugagugacaagucugaauaaaaauaaaguagaugggcaucauggcacauuccuuuaauuccaucacucuggaggcagaggcagguaaguaucuuccaguucaagucuacaagaaaaguauuaaaccagccaguguuaaauaguuaaaccaggggaaaaaagaauaauaauacacauggaucaagaugucacaaugacgggcgugguggcacacgccuuuaaucccagcacucgggaggcagaggcaggcagauuucugaguuugaggccagccuggucuacaaagugaguuccaggacagccagggcuacacagagaaacccugucucgaaaaaacaaaaacaaaaaaccaaaaugucacaaugaaauucauuucuuuguauacuaacccgaaauaggaugauccauauuuuuaaaauauuuuaaauuacguguguguguguguguguguguguguguguguguguguguaaauaugcccccuaggaucuggaguuacaaguaguuguaagcagccagaucaagcaaacuugaauucucuggaagagcaacaagggcuuuuuacugcuaaucuauauuuccauccccaaagccauuuguuuuauagaguaauucucaauuuucauuugucgauacuguuucucaaaaaauguaacagugcugaucuaaggcuuugaucuagcaguaaggaagccaacauggaauaagagauuauuuguacuauuauaaauuacagcaacagcaacuuaauaccuauuaaaauaguaauaaaauuguuuuaaaagacaauggauuuuuugacugaauuacuuaugaaauauuucacauuuacagaagacuuccuuaauggaaugagucucaagaucuuuuucuccacaccaauuaaaaguaguaauucuaaccacaauguauugaaucuagcugagcacagugauaugucuguuaacccagcucuuaggaggcuggagugacacucuacccuugcacuucccccaccgaaguaugaaaucucuauugauucuuguuuccagacaaauuugguaaaaauuaaguguaagaauucugcuuuggggccagugagaugacgcagugguaaaggcacaugcugucaagucugaugauuugaguucaauuccuaggucccucgugguggaaggagagaaccgacucugucuauaaauugucuucugacuuucacauacuggcuauggcauacaugcuaugacagacagagacacacacacauacaaauaaggauaauaaaagaauuuugcucugaagaaagaacccagguuagcuauuuuucucgcuguaaugaaggcgacaauucucacuguagcucacaaaaugcuaauggcccaguaccacgacagugaugguuuaggguuacacuguuuuuaguuuaccuugucugcaaucuugcagcagcaguccauccacaagaaaucuugaauuaaaucaucaucuauaacaaaagauaacuuugacuuaucuuuuuuaaaaagguuuccuuuugaagaaauaauuucuaaauugggacauuuaaaaguaauguuuagaaauuaaauaaagcuguuugcuaagguguaguuguuaguuuuuuaguaucuauaucauugcaaggacuaugcauuucccaucugaugauauguuuauuuauguauaugcucagcuuuaaaggagaauaauauauuuuguuuccugaguauccaacagguuguuagcucuuuguucuuuugcagugucaauuuuaagaggcagaaauggaaucuggugcaagauaauucaucuuugaagaaaugcuguucuaaggguauuauuuuucuauuacuuucuccucucaaggaacaggauuugugggggagggguggaguggaccuuuccuccuaauuccucucuagucuacuuauuauucaaacaaaaauauaaccauguauauauaaauaacuucaaauuuuacuuagauuuauaauuagcauuuaauuuugggaaaauugauuaggauugcaagaucaacaaaaucaagaauaauaucuaucccagagugguggugcaaaccuuuaaucugcacuugggaagcagaggcaggaagaucucugugaguucaaggcuggucuggucuacuccaggcuagccagugcuauauggugagaccugucucaaaacaaaaacaaaaagaaaauacaacaaagaccaacaaaaaacaaaaacaacucugguuuugauucgaaagcauuaaauagauaaucucaaaauuguugaaaacuaucagaauauaaguaaauccccuucauuuuauuaacaaggcaaaaguucuuuauguucauuuugcauguuauaaauuauaaaauuguaauuaauauuuggaaaauuguagggauaacuauugauuuuucugagaauucguuuuguuaauucuguuucuauuucacaagguagcuaaaauaguagaaucagguguuuucuuaggacagugaaaaauauucaaaaaguuugugguuaagggcuggagaugacuaacaaaauaggaauuuggcuuguugaucccaguauugguaggucaagguggaaggauagaaacucaaggucauccguggcuacauaaagaguugaaggcuagccuggccuaggugagacccuuucuaaaacaaagucaggggaguaaagaaaaguuuguggguaauaauuuuauuuuuaauuaggagaaauggaaacauguuaacauucucuauucugauggggaaaucuuuauaacuuauuuauauuccuuacauauuuuaugucauguuuuaauuuugauauucuuuauaucuuaccaaguuuguuugaaugcacauagccuucuucuauaaacaaggaggacuguggguugugugguauuauuugauuucuuaucaggaaacaucaacacuaucccuuauucuaaugucuaccuugcugccaugcaugcaaaacaggcuccuuugucugguauaaauacuacaaagaagucucuauuugucuguuaauaaauguauaaacaaaagaguccuauauaauaaaaauucaauuuaaaccucauuauaugaacauguugauaaauguucuuacuuuuucacaauguuccaaauaauaagauugaagcuuucuagauugaucaauguuccuauuuugcuuuguuuuagcuauaaaagucuuggaaaacgcugggcauagucaaacuggguuaguaccucaucugaaucucuauacucuuucaggucaaacaaaauuuguuuccugaauugcucaaaauacacacuugacauuuagauuuaaauagccuaaacagaucaauuugaauauuuucauuauaaaaugacaaaagagggcuaguaagauggcuuggugggcaaaagcacuuaccaccacgcuugacaaccuguguccaaucccuaggacgugcaugauggaaggagaggaccuacucacagcaaguuguccucugaccuccacaaaaaugccggaugugugcauuccccaaccccgcacaaauaaauacacuguaaauaacugacaaaauagauuuacauuucgauauuuaagaaugcuagacuaacaaaauguuuuacaccuaccaaauaauuuaaagaaagcagucauuuccuggcgcuguaugauuagacaaggcccucugggccgcuuagauuuguuauucugagcauuguuuucagaugcuucccaacuaucuuuaagaauaggacguuucagacuaauagguuuucugguuugaugugaccuauuugagccugauuuuacaugaauagugacaguagguggugucucacaauacaucugauuaugccgcauuuuagcuucccaagauuccuauaaaaauaaaaauacaagauuauugaucacaucaugcauuucuauauaaaaacuaacugcauacuaucagaugcagucauaucaaauguugauuuugcuauuaaaauguuaguuguaacacuggaucauguuagaaacugcucuuacaguacucagaaaugcucugcugcuucugaguaaauacccccucuccguccauuuugcuuugguuauucuggaacucaaaaucaaaucggaaacuuguuuguucuuuuuuuguggucuuccuucuuuccugguaaguuuuucugggucacaaagucuccauauucaauaagcaguuauugguauuuucugaaaaguuuuagcaaauaaauggcacaugugcuuuguaggguucuuacaaauugaugugcauaugugugggggggggcggguguuguugagacagggucccaauauguagcccuuggcuggccuggaacuaauuagauagacuagguuggccucaaacucgcaagagaucugcaugcuucugccuccugaaucuggguuuaaagcuauguaccaugcccagcucuaaaguaauuuaauuuuuaaaguuguuaccauccuaucugaauggcugacuauaagcauauauuaauauauagugcuauguaagucugaaaugaaaguuaucugucauuauucaacaauaugaguguucauuacuauuugggauuuguuggugacuaguggauauuauuacaauuaauauuaccuuuugguugaauuguuucauaauaauaaggaaucgaaaaaugaauaaauaaagugagaacaacuccaagauccuaaugagacccucugaucuaugacucacagugacccaggcagccacacuacccuuggcauucagagaguuauguacagauuuucucuccugacucuuaaaagcuuuccugcuggaggugaggcuauaccuaauauaaaaacuagcuggauaccuucaaucugagagucauauccauauuuuauauuuuguguuuguuuuuauuuuaugugcauugguauuuugcuugcacaugucugagaauuucagaugugcuggaccugaaguagcagacagcugugagcacaaugugggugcugagaacugaaccuggaucccuuggaaaagcagacagugcucuucaccacugaaucaucucuccagccccccauaauuuuauauuuuuuaagcuguacuaaaaaaaaaaccaaacaaacaaacccacgagggcuggaacuauagcuacuuguuuaggacacacaagaguugggcucaauccucagcgcuaaaaaaaaaggaaguuaauuuuuguauaucuaauacaauagagcuaacauauaauuuuaacaucuaaucaauauaaaauuaaugaaaucauuuugaaaucauuaaugaaauccuaaaucauuuaagucugguagauuuuuaaugccuuauacaugucucaguuuugaugcugauuaguaaauaguuugaaauacagucauauaaaaaugaaguagugcugggcagugauggcacaugccuuugaucccauaacuugggaagcagaggcaggcgguccucuguaaauucaaggccagccuggucuacaaacugaguuccaggacagccagggcuacuauacagaaaaacccugucuugaaaaaaaaaccaacaauaacaaaaaaaaauuauauaggauaguauuuuacacuccuuucauuuuauauuuaaauuaaguaaaaaucaaacuuuucuguuguaccgggacaaauucaaguguuuaauggucacauauggcuagugguuacuguauuaaccaguguaggguuagauuauaaagaauuaggcagagagccuagaaagauggcucaauaguuaagaacacucaccauucuuccacagaacccagguuugaaucucaacacucacauagugauucauaagcauccaacuccaguuccaggggauucaaugcccuuuccuggccuuagaaggcagcaggaaugcaagagguaggggugugugugugugugugguguagaaaggaagaaagaagggauggagagggagaggaggagagaaggaaggagggaggagagagagggggagggggagaggggagagaagaggagaggggagaggaggaggggagagagagagggagaggggagaggaggaggagggagaggagggggagaggagaggaggggagaggagagggagagggagagggaggaaaguaucuuuagucugagaccaggcuagucacagcaucuguagccacagcuguaucuucagucugaaaccagcguggacaacauauaucucaaagaccagcauggacaacucaaagcgaaacaaacagaacuaaccaacaaccaaaauagauggaaauuauaauuaguucuacaauuauuugucuuuugauuccuucaucugccuuucuucuggggggggggggacgacccaacaacaaaaaaccaaacagucauuaaguuucucaaaaaggaccagggcagggcuagauucagagguaagacagauauaucagaaugcagaacacugugcuacauuguccaggagcuaaguuuuacucaaugguaagugacuuuuaaacaauguuuuuauauugaaacaaaauaagaaaaugcaaacuucauguaucagauuauuucaucuaagacuugagaaaacagggaaaggaaauggcugaaauucccaaauagagauucacuaaaguucauaaagacugaaucaaaguuugugcaguuaagagcuuacgaagaaaaacugcagccugugucaaauucuacuuugcuguauuuuuuuuaaauuuagcucuuuguuuagaugcaucaaugaguaagaguucuaaugcaagagggaagaaauaaagaacaagugaaaaaacgaugaggcauuucucaagagaaagagugaacggggaaauaagagaagcucgcugauugucuccaaacaagacacauucuguccuaaagggaagcugcuuaagacgaaguaacgaaacaagacucagaaaaauaaacaacucccaagagucgacaggccccuguccaagguucuaaagcaguaaggacggcagcuuucccagggcuuccccugagcuggguggacuuuucagggacgcagcuugagccacacaggcucuaucugucaguaagcccucucccacagauacccuuguaaacccgggcuucaccaaagcggacuuggguggaaucccuacuuugcucugucacgaaugcccugucuagggugagcagauauugaucgauuuggaccucugaaggaaaagucucacaacauaaaaguuaaagauccuucaacucaguggcaugcauucgacccaacauugggaaaaaaaaaaucacagcaaaauucauaaagacgauguccgggugugugaggucugggguucuguuugucugguacauacagcugaauucuguaagcaucugaagaaacucuggcgacaggaucauauguauguguauggcuagugguuacuauauauauuacauauguguguguguguauacacacguauacauacacacacacacacacacacacacacacacauauauauauauuagaaauaguuucuccgugugagcaucugacagucaaucgcugacgacagggggcagguaggcaggaaaacuuucguacuuuuggagaaaguggcuaaaggugucgcgaugagacgcgacagcucagaacuccagcccgggaggacucgggccgggggcgugggacacgggacacagcggcaggacucaucccucagccccgugaagaggccgagccucgcuccccaccgcgcaccaaccccgcgccacccgccggagccgcacugcccggucucccuccucucgccccgcaccgccaguucccguccccgccuccgggaugcccggcccuuggggccggcggggcugcucgaggccgcggggauguggggcugaggcguccccgccuccucacgcaggacugugggagcgagagggagggcacaggcgacacccagaaccccgccaucaggccccggcgggcgggcgggcaggugaagguaccugcgcaggccggcgaagagcgagcggccccacagccuccgccucagcgaucuaccucaggcgguugcgugcugggucgcuagccgcaggccgcaaaacccgccuaagaaccucaagcggagggccgggagcgcgcggccgcgggagccaaucagagcacgggaaccgccgagggcggggccugcgcuaucgccccgccccgccccucgcugaccgggucgccuccgccuucugccguuauuccgcuccagcucucuguaucuugaugcggucgcgcuuucccucgaacgcuggcugugcggagcgguugaggagccccggacaggacgaggggacugggcugcccugaaggaccagggcugcuugccguucccccucccugccucucugcucgcgccuuggaccugggugcuucuucccuugugcacaaguguguaagaggagaaagagcccacgcaugcuagcucaaaaggugugaaauaaaguggccuuuagugagcaaagggcaacguucuuccauucacagcccuaaaugcuccuuuugucaugcccgugccuuccugagacuccugggauauagcuggugcauaaucaacgcuugccagucccaccccuccaauucagaaucugcuuuauauauauaguaugagagcaccauacaguucugacuuguuaucaaacucaaguagacuaguaacugaacugguaauuaagacucucuguggaauuuuggguugguccauacauccagagauuaacagacaacaugaguuggguuguggaaucuucccccuuuuagcuaccuguacucaguguuuuguagaacuuccuuaaaaugugacugaguagauaaaaccaaggucaugguaauguuaauggcuuagacaaaaguguuaccagcccauuagaucuucaaccucucucaggcuaucaauucaccuauaaaaucucuaacaagaaacacugagucaggaacuuaaggaaacugaugcuacgugaugcugaaguacacugaaaagguauguuuccauaauaauguaaaaaauauucuaaacauacauacaaugagcccuuugaguaggagcuaauucgacuguuguuaagaucucagguucagggauagagagacagcucuaugguuaaaaguacuugcugcucaaauuccuagcacacauguggcagcucacaaccaccuguaacuacaguucuaggguauccaacaucaucuucuggccuuugcugacauaaggcacacauguagcacacaugcauacaugcaaacaagacacucauaagcauucaauuuuuaaaaaugaaaaugaguaaacaucucagguccauuagcaaauggcacaacagaaaguaccuuaaguaaggaacccaaauagaauucaguucuuuguuuguuuguuuguuuguuuuuugagacaggguuacucugaauagcccuggcuguccuggaacucacuuuguagaccaggcuggccucgaacucagaaaucugccugccucugccucccgagugcugggauuaaagguguacgccaccacgcugggcuagaauucaguucuuagucuccagccaccccaguuaucccgaggaccugcucccucaucuuagcuguaucuucacaagcauguauugaggaugaagcaagauauugguaaacugggaacugugcacacagugcuuuagcacuuccaaggaugugacaacuuguagagagaaucucuuauguacuguguggaagcaucaccuguuagcugaggcaggaaauagaagguaggacaucuggcagagaaagaaaggauucugggaaagauccaagagcaguuaaggucggccaccuggacuaagaggagacggacauaugaaacugaggagagguaaccaaccauguggcagacacaaacuagaacaaacagauuauauaaguuauaaguuaguuggaaaaugagccaaaacuuauggccuaggcauuuauucauaaauaauuaagucucggagucacuucagaaccagugccagugggaaaccccgagccugcaacaaguugguggugcaugauaggaaaagugagaggacguagaaacuccuucaaagaaugugaggcccagggcugaggguggcuuagcaguuuagagcacagguugcucuucuaaaggacaugguggcuuacaaccaucccuccagaggguccaaugauucuuuuggccucugcaggcaucaggcacauaacagugcacauacauacauacacacauacaaacaaacauacauacauacauacauacauacauacaaacacccaaauacauagaaauaguauuuuuuaaaaaaauuaaagaaaaggaaaaaaaacguaagcugguccuuugaaauaauuaagagucuuuugaaucauaugaguagaaaagccuuaaccucauguguucuugaaacuaaaaauucuuucaggguuuacaucuagggucugguauggugaugcaugccuggaacccaguguaagaagauuaaaguuaaaggccaaccuaggcuacauugugaguguccuucccaaaugaugaacugccucuagaguggguugcuugaaaggggagacuugggaccccaggggggaugaguuugagaacugggauggacacaguagguaacucccacauggagggcagagcaggggcaacaauuaagccagucucaagcuagguguggccuugguuuuauuuuuaaagcagagagucaguaugugggcauugcagcccucgcuccucaucugccaaugaaaagcauuaagucagagccaguguaggcucagugguacugcucucgagcaggugcuugguccucugguuccugacaugaauagcagagcagccaugacaaguuugacucuaauuugcugucuguuuuaaaaacugaaauauucaccuguucuacucuuuuuaaaagagaaaucuggccgggcagugguggcgcacgccuuuaaucccagcacucgggaggcagaggcaggcggauuucugaguucaaggccagccuggucuacaaagugaguuccaggacagccagagcuacacagagaaacccugucucgaaaaaaaaaaaaucuuugaguuauuuucuaauagcuuuaacuuguaccugucuaagcuaaaauacauacacuaaacuuacaugaacucaaaaacaaaaaguacuaaaaauaaaacaaaaaguacuagaaauguuuguuguauauuacugcauaagcaaagcuugaaaauuaacuauauugaaucauucagauuuuccccaccauucagauuuuccccacaaauacaacuugggguugauauguuuuugacucuaaaauguguuugugcugcccucuacuggcauuacagucaaacugcaauuaauagacuaagggcaagacuaaaccuuuucccucucuuuuuuuaaaauuuaaauuauuuauuuuuuuauuggguauuuauuucauuuacauuuccaaugcuaucccaaaaaucccccacacgcucccccacccacucccccacccacccacucccacuucuuggcccugucguuccccuguacugaggcauauaaaguuugcacgaccaaugggccucucuuuccacugauggccgacuaggccauuuucuguuucauaugcagcuagagacacgagcuccaggaggguacugguuaguucauauuguuguuccaccuauaggauugcagaucccuuuagcuccuuggguacuuucucuagcuccuccauugggagcccugugauccauccaauagcugacugugagcauccacuucuguguuugcuaggccccggcauagucucacaagagacagcuauaucaggguccuugcagcaaacgcuugcuaguguaugcaauggugucagcaaacgcuugcuaguguaugcaauggugucagcguuuggaagcugauuauggggugaucccuggauauggcagucucuagaugguccauccuuuugucacagcuccaaaauuuguuucuguaacuccuuccauggguguuuuguuccaaauucuaagaaggggcaaaguguccacacuuuggucuucguucuucuugaguuucaugcguuuagcaaauugcaucuuauaucuuggguauccuaaguuucugggcuaauauccacuuaucagugaguacauauugugugaguuccuuugugauuggguuaccucacucagguugaugcccuccagguccauccauuugccuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaguagagcauguguccuucuuaccaguugaaacaucuucuggauauaugccuaggagagguauugcgguuauccuaaaacaaaaggauauaccuucuucucagcaccucaugguaccuucuccaaaauugaccacauuauuggucacaaaacaagccucaacauauacaaaaauauugaaauugucccaugcauccuaucagaucaccauggacuaaggcugaucuucaauaacaaaauaaauaauagaaagccaacauucacguggaaacugaacaacacucuucucaaugauaccuuggucaaggaaggaauaaagaaagaaauuaaggaauuuuuggaguuuaaugaaaaugaagccacaacauacccaaacuuaugggacacaaugaaagcauuucuaagaggaaagcucauagcucugagugccuccaaaaagaaacuggagcgagcacacacuagcagccugaaaacacaccuaaaagcucuagaacaaaaggaagcaaauucacccaagaggaguagacggcaggaaauaaucaaacucaggggcgaaaucaaccaaguggaaacaagaagaacuauucaaagaaucaaccaaacgaggagcugguucuuugagaaaaucaacaagauagauaaacccuuagccagacucaguagagggcacagggaaagcauccuaauuaacaaaaucagaaaugaaaaggggggcauaacaacagauccugaagaaauccaaaacaccaucagauccuucuacaaaaggcuauacucaacaaaacuggagaaccuggaugaaauggacaaguuucuagacagauaccaggugaaagacucugagaggagccccucgcucaggccucaggacaauagcggacacccaagaacucacaauagaccgagcuuguugcaaaccacaugaggcuuuauucggggaaagccagagcucuggggacgacauaucccacgcagggguagaggagucgaucuugaggggaaagaggacccaguuuuuauaggcccucgggggggggggggaggagaaggggggaguaagaaauuuccagauauaaacaauaucuauucuaaaaugauugauuccucaagaaauggguaugggagggguacaaagaaagagucuaaugaaggugcagcacuccggauuggccccgacuaugguugcuggggagauuuccugacucuuugccagcaaccaauaucacaaacaccuggcagugaggugcagcauugggcacacaccuggucagaacauuggcagacacacagguuugaggaguggccagagcauugugcaccucuauuuuucuaaaucagugaaacuaauucugcuagcaaugaaaucuaucuugccaauuucagggcuucugugaccuuuuacauucugucaggaucuuucacagguaccaaaguuaaaucaagaucagguuaaugaucuaaacaguccccccuaaagaaauagaagcagucauuaauagucucccaaccaaaaaaagcccaggaccagauggguuuagugcagaguucuauaagaccuucaaagaagaucuaaucccaguucuucacaaacuauuccacaaaauagaaacagaagguacucuacccaacucauucuaugaagccacaauuacucugauaccuaaaccuuuucucuuaagaguaaucuucuuuuuuuuuugggggggggguuguguuugagacaugguuucucuguauagcccuggcuguccuggaacucacuuuguagaccaggcuggccuugaacucagaaaucugccugccucugccuccccagugcugggauuaaaggcgugcgacaccaccacccagcuaagaguaaucuuuaaacauuuuuaugcuauuuuaaaugaaaugacaaauagauuaaaauuuauuucagaauaaaggcuugagauuuuaaagauuuuuuuuuuuuuguaaaucuuuaacagcaaacuguaaacccuaagacaaauggcuuaugcacuaagcuuugguccauaccaaaugauaaacaaaauucaaguauacaaauuagauuuccugaaaguacaaccgauauuuaauauuuuuuucucaaggagcaguaaaguucacuuucauccaggucacagaccaaugcauuaguagcaauuuugcagucccaaaggugagguuucagaggauccuucuaggacaaagaauggucaaacacauauggauauuucucaaagguacuguaaggacucccuuguaaaguuauccaagguaacagaaacccugaguauacuuccucuuguuuguggugugucugcauguguaucugugcucuacagucugauacaggcacagaguauguaaauaccauagugugccugccaaggccagagcagguauccucucucguggcucucugccguacucccuucagacaaggucucucacugaaccacaggcacagcauuuggcuggccagggggcucucuaggacgcgccucucucugccccuauugaggggcuugcuggcacacauaccggccuggcuuuguacaugaacaugaaugacucaccccaacucccuuaaguucacuuuccuauguuuucuuuuccuagcucaugaauuauguccugcaaacguaaaaaugauaagcggaucauagcucucuugagugguagcuuauagaccuucucuugcuguuuggugguuuuguuuguuuuguauuugccuuucuuuuuaaguaguaaugaucgaauuaauaaagucuuuuucugaagaaguuaucuaaaaaauaaaccuugaauaucaaauucagaaucucaaggacuuccaugaccaaacucaaauuugaaaacgugagcauugguugacuuuuaaauacacucuaugcaaugaaagcaguccuugccacucugcaguacuccauguuguuacucacucuuggaaugaggguggcaggggaagaguucagacaaccugcagagcagcuaggccacgacucacacucaugggacacauggaagccgcugcccagggccagcccuucccacccaucugcugcucaguuacucccaaugaggaguguaacccugagcacucagcuggagggaacggcagcaucagcagcugacugcccuuguuacaaaauggcagucugucuucagaagaaaaaaauuacuacauucagaggguccuagacacugccauuauuugcuuggcuccugguuuuagaacaagcaagggauuuucuggcucugaauccuaaaucugagggcaauacaaggccacucacugaacugcaggcccuaacgucuuucaccuaacggcuuucaccugucacguccacaacuggagggacacagagagucaagaaaaucuaaggugauguaaacuaaccugugcucgauuucauaaauucugcugugaauuuucuacaacauuucagaauauuaaaacaaacauccaauucauaagcguacagagcauucaaucuaaauucaacccuucucugaauaguuuccaauucugacaguucuguuucacagaaacauacgguaagaggcgguuugugugagugaagaacacagggcacacugacaaucaacuucugaucuggaaccaggggcguucuuacaucuacauuccuaauuacaacacaacaaaagaaccaacuguuacuuaaaggauaacuuuuuaaaauaaucuuuuuuuaagaguuauuuauuauuauaucuaaguacacuguagcugucuucagaugcaccagaaaagggcgucagaucucauuacagauggcugugagccaccaugugguugcuaggauuugaacucaggaccuuuggaagagcagucgguacucuuaaccacugaaccaucucuccagcccaggauaauuuuuaauuuuaauuauaugcuacaguugcauugauuuuucuuuugucuuucaaauaauuaauucuaguaauaaauuugaaaauagaaucaauagagaaaucaauuuaaaaauucaaacauuuuuagaauguaauuuuuuauauuaacuacuauagccuugauaaaacaaaagcuaauauaaauuuuuauuuauuauauaauauacuuuucagauuucaaaaguauaaaaauuaaagaaaaucagugauuacuguauuaauuuuaaaagcccauauucauauaauuuugaaaaauugcuuuucuuaccuuaaugcuaaagcaguuuuuucuuuaacucucuccaguauaagacauucauaaggcuuuuugugaggagaauccaaugggaacacaaacucuccugaauuugugaucugaaaggaaggaaccaaggagaaccauuauuuuuuuaaccauuauuauuauacaguuuccuccagcaaaaagugguuauuaaaccucuaggcuaguauuguccaauaaaaaauauuguaugagccacaaaugcaagccaccuauauaauuuuaaauucucuaguaguaacauuagaaagaaguuaaaaaaaaaagagaaaaagaaugcaagguaauuuaccuuaauugcauuuaaucuagcaugucuaaaacagaauuuccacaugcaaucaguuuuaaagguaucaugauguauuuuccuccacagugggucuuucaagucuagcacauauuuaacacucaacaguaccucucuaucugaagggcacaagucaaguacuggagagcuacaagucacggcagcuaccauacuggacaauguagcuauacaguauguuugaacacucacauagcauggauacuuuaaauauauuguauugucaucucgcacauaaacaaccucuacuuuuuaugauuacauguuccuggaaaccaggccaucgauaacucagucauuaauucgaccaaaggacauucacugguuaccagccaugugaccaaguaguuaaaacuaaagccuucagagucacaguuuagucagggaagagagugggauaggugaugagguagaagggaccuggugcagaggcuggcucuuggugcuauaaauucuagccuggcaacuuagcaagauccuaucuccaaaauaaaauaaaccuagaaggaaccuggaagccuggaagguagcuaaccaucauuauauagguuuacggucauccuuggcuacauagcaaccucaagacuguggguuacaggagacccuguaucaaggcgaaaaaaaccagagaaugaaagauucuuggucccugcgccuucccguccucuccacagugcucuuacuaaucuuuguccucauccccauaaauagggagaaacuauggauaaugcaaagggcaaugagauuuugguauauggaggagagaauaaaggcaaggcagcccuaacuuccuauucauucaacugcaguugcaggauauuccauccaccccaagacuguuauuuacuggaaaaaaucauccuuuaauucaagagcuuucugcuugaauauuguauacaggauuaaauaaagucaaccauaggucaagaggcagagcaagcaaucaguugauaggaagugaacauaggguuauuaagaaaaaaaccacagagaguaagagggagucaggaggacugauagagagagacacauaguuugaaagagguuuuuugagauggugugagagaggggauuucuugugggaugacugcuaaggaggaaggucagcugggugcuuucucugucucucugagcuagcaggccuucgcccuagcaucuggcucccaagacuucacugguaaaacugaacgguuaagauuuuguuucaaaaaaaaaaaaaaaaaaaacaggcuagcaguuugggagcccacuacagagacacgggauaaacaccuugagagcaggaagaccgguguucagauacaaagcauggacaguucuugucagagccugaggaggacagcagugccgcggacacaccgagaagagucagcaucuuccugggagugaagagugaugcugagcuaacagacaagcuaacuucugaacucacuuuuacccaguaccacucugcaacaacuuccacagaccacgaaggauauagcuccuccuucacaaaacacagauguuucugcccauuggucacccaaguaacaaugagacagucagcagcagccacuuagggacaggcauucgcuuuaucugcuguggugauaaacuacuguaccuaaaaaugaacaauaacaacaaaaaaaaaaaacuguaauaaaauucaccccaagaaagacauguaagcagggaaaagaccccacaaauacaaaggccugggagccgcucccacguggcuaacuguggagucccacugauguggcuaacuguggagucccacugacaccuggugacucacuguacuuacacauguaccaacuuucccaucuuccuaauuuuaaauugccaagguguauggcuuuuguuuuuuaauuucauaugauuugcauuucaguaauuuuaccacaucuaauaugccuuuuuucucauucagaauuaaacaaauacugucuggauuucgucauccuguguuucacaugagccccaucagaguaaguuugaaacuaacugaugucccaauaaccaaaugacacaaaagaagcacuggcucugaggccagggaugcaagagugggaugacuucagcaaggagccuugccucacuguaagccucaaguguguaagccucaaguguguaagucucaaauguguaagucucaaguguguaagccucaaguguguaagccucaugucuugcacacaccacugaccccuaggucaccuaugauuucacacaaccucauguucccuuuacaguuucaaggccccgucuacuacugcacuccuuuggccuguuuaaucgguuccacugggcucucucaagccuucauacucugucucaucuuauaggcccauugucuuauaccuccuggccauuaacaauaucaaagaaacuugucuggcuaaaccacauaacuugcucuauaaauauccaaacaaauacaacucuuucuccaacauuccccauacaaauggagaugacacaaacuguauucuaaugucccauuauugcuucuagacucuuucaacuuugacaaaaccuccccuucucuuuaagaaguacauuuaccagccacacuagcaccaaaccuuccucaaugaacacauuuuguccucacucucaauauucagugugucgaaucucugagaucccucuaccucaaaggaaaacuuugacacuauucugagcaacuucaaagcacaaccauauaauguacacucaacuguuaaucugccaacacaaacaacuacacucagccucccacaccccaucccaauuacauaagcuaggccuugucaucaugcaugcaugugaugugugcauguacauauacaugcacacaauaggaacugaaugcagggccugugcaugcaaagcacauacucugucacugacguaucccccuguacauaccaauaccgcaauggaauucaacuucuucauacagagaaaugaagugaaggaaaacacagagcaaaagaaacuuugaaucuauucucaaguucuuaaaacaaucauagauucuuuuaucuauccaugguuaaauacuguaaaauccuuaccgcuuuucagguccucugcccaugccuuggcaggugaaguuaucucagacuuuaguuaaaauaaaagccaccaggucucuucaccuaccaaauuaucucccccccucuuuauauacuucaucuaucuagaucaacacaccuucucuacagggaaauauaugacauucucuacuaaaguuuauccuuccaacacugucuucucauuuauauacucugacauccuguaaugccaaucacucaccugcuucugcaucuuuaaccccugugguuguucacuauaaaccuguaagcauucuuggauuauacaaaagaaaagaagacaagggacgugaaagagaugaagaaaggaggaagaagaacggauauaucaggcuuuuuaaaauaaaauuuguuuguuuguucauugauauagaugugugccuauuguaggauguguguggaggucagagaacaauuggaaggagucaguucuuugcuuccauccugugaauuucaggaacuaaagucagaucgucaggcuggguggagauugugauuugccagugagccaucuuguaggcccaaguauuguuuuaacccuggacagucccccaccaaugaugagacagcacgucugcuggcucacuguugaauguucagucuggauuguggugcuauucuaaagacgagagagcccuaaggguggagacuggcuggcugaaauagaucaauaggaggggugagguaucuuggaaggcuaagcccaccccagggucccaaccuagugcucucuacuuccugucugcugcugcaugcuccuaaagaugugaaaggaggugccagccuuuccuaauaagauggacugacaucucuaaaugcauggggcaaacucaccuuuccuucuguaagcugcaucuaauggggauuuugucaauuuccucugaucaguaacuaggcuaggaacgcauggacuuaagccuucccacuaccuccgcuuuguuucauuccucaaucaacucugaagaaacgugugcaacucuacuuacuuagaaaaaaaaaugagucucccagagggcaggcucaagcaucugguuucugauguagguaacacuacauuaaaggagucagaaauggcugacaacccuuucuuauuaagcagauaaaugaaagaacucagacugugugcccccugggcuccugccauccaccaucacacucccagcacagcaggugucccuuucucacagggaagacuuucagagacucuucugucaccguaggaaaaguguuaggucaaagcucugugcugacauguuuccaauggcuucauuccuuaacuuugcuuaacuggacuguuuggaacuaaggaaauuuucacacucccucuggugucucaaaauuuuaaggauagauuuaucacagggcacagcaacuuuauaccuagguuuaaguguccaagagaacuaaaauguacugccauagcuagcucaacuacaagguuugaaggcacaguuuucacaacugaacccacuuuuaaaaccaacuauucaucucuaaaaucaccuuagacucaacaaucugucagaaaguuucacagaacuuccuaccuguuauuacagcgcaguuaugagucacagaggaaccacuggacccugagggcauacauuucagcacagaacaugauuacuguuucuguaugcuacaaaugcuuucuaccacaacuggugagcucugaauaaacacagaugacacuaauguguccauaggagcuucauauuaaugucaguuaucuacuugacaaccacaugaugaugaagaugugcagcaccucugcuucuuuuacauuuacaccaauuuuguuuuuguuuuuguuuuucaagacaggguuucucuguguagcccuggcuguccuggaacucacucuguagaccaccaggcuggucucaaacucagaaauccgccugccucugccuccugagugcugggauuaaaggcaugugccaccaugcccggcuuuacaccaaaaauuuaagaguaacuuucucuuacuugggggcuggagagauggcuaaguggcuuagagcacugucugcucuuccaggggauguggguucaauuuccagcacccacauggugauucauaacuuucucuuauuucaagauuuuauauuucaguccauacuucaagucuauauuacuucauaaaaauauaaagacauacauacucagaauagauacaugaauucuuugcacaacucuuacacacaucauaagcauauuccuaaguaagcuaaagauaacucuuaaagaagaacuucagucuaauuuuacaacaaaacaggaauuauuaugacugguaaacugaaagcugaggagaaaauguaccuggaagcaaucauuagaagcaggaggaaaaguguugucaaguuauaaggauguuacuaaaaguaaaggccaucccaguaccuaaccgagcucacccugaggugaccuaaacuaaaaauacagacagaggaagagcuaggugaacucccacccagcacgugguuauaaacuacaaggauggcacaggucuaaguuucaaacuucaacaaaggcaaaggcaaauggaagccuuggugucacugagugaugugaggccucagugacagcugcagacacuguuacaucaguuauggagaacuaauauauagagacacauagaucaccuccaguucaaggaccuagaauugaggaacuuaaucuuuugaugggagcaugugaugggagcauguuaguggcuucagauaacagacaucacgucuaaaguguacucaaccagaacgaacaaggaacugcaguucuagaauacaaucccacacaccuguuccuucuuuuagccgauuuguucucccaugaugcaucaaucacaauugcaucaaaugucuuacuaccugaaaucaaaagcacaauuucagaaacacccucuguauaugaugagucuaagagcuaaacauggagacugaggacauccuauagagcccacacucucauaagcaaagcucuggucugaauacgcagaauacuucaaaaacaaaaacuaaacauguuccccaaaauuacagcacacgcauacacguacacaaacauacacacaugugcuugaaugugcaugcacacacacacacaaauaaaaauacuguuaagacaacaaaguuuaaagagcaagaugaucagcagguaaaggcuaccaaauguacuaauccgggcugguucuccagaaugcacauaaggagccgggcggugguagcacaggccuuuaaucccagcacucgggaggcagaggcaggcagauucugaguucgaggacagccuggucuacaaugugaguuccaggacagccagggcuauacagagaaacccugucucgaaaaaauuaaaaaaaaauaaaaaguggcugcauacaagaaaugucaaacaaaagaaagcugcuuugugguggcaacagguauuuugucccauuaaaguaaucauuuuggaaaagguggaguuguuuucaaugaucugugaggauaaauccagcucuauaacagacauaucaccuccaaucaacuguaguguuugaagcuccacuucauuuaaggaaggcaaauguuuugccaucucacauaacucuguuaaacuguaggcaucaagugguaaaguuaugugucugcuacuuccaugcuguuuuucaacaaguggguaaaggaaaccacuucugagaccuucuuggauuaacugggaagauccauccaaaaucagcucucugaucuguucaaaaaaaauguuugaaguacauuaaaaugauauugguuuuaaaaucauuuuccagggacuggagagauagacuagccguuuaagaguauuggcugcuauugaagagaaucugaguucaauucccaacucccacauaaucguggacauccacccuuaauccaauuuuaagagaccugucaccuucucuggucuccaaaggcaccaggcauauacauauaguaugcagacaaaauaucuauauacaaaaaauaaaauuuaauuugauuuaaauuuaaauuuuuuucaaauaauuaaauuucuacuguacuuugaauaucugauuauuuucaaaaccaacuuucuuuucuuuucuuuuuuuuaaagauuuauuuauuuauuauaugucaguacacuguagcugucuucaggcacuccagaagagggcaucagaucuuguuacagaugguugugagccaccaugugguugcugggauuugaacucuggaccuuuggaagagcagucgggugcucuuacccacugagccaucucaccagccccaaaaccaccuuucuuaaguguagagugauugauuuuauaguauaaugagacucuaagacuacugacagcauacuuuugaagucuacagaaugaagcacacugcauaaacucacagcuaagaaaugugacaaucaguaugugaaaugcugaaacuuggagccaaaaauguuuuuuuccuugcuuggguuguuucugucagacaucuggauguggugaggagagagauaacuaccacguaugcucugcacagaaaagccucacaacauucuuguaggauacggggaacaaaggucaccugugaacauaaagcagagccacagaguucucuguccuggcccagacacuccauaucuucugccaccaucucguucacuugcuaaaaucuuagucuucacaggagugcugggaaccacaucucacaucucucaauaugugagaaauacucacauacacacuguucgaaacccaucuuuuaaaaccuaccacuaggacauccagggagaaaaagaguucuaggauagagcuaggugggagaucuuccugggaagaugugagcagacagacacuugguaccugagcacagggaaccagccacaggacauaauguagauuaaaauaaauggguuaucauaaguuaugauucuagucugagaagagccuagcuauauggcaaagguauauguaaauauacuuugaggcugagucuuauuucugggcacaugggacugagagguagaaccaagaccuaacuucaacaugaaugucccucccuucuacuuccuguguaucucucuacccauccuccuuucucuuacgcucuaugguauuuucccauguucacucucugucaacuguuugcuuguuccaccucuugaccuaugguugacuuuauuuaauccugauaacaauaagcagaaagcucucagauuaaaagucugugcgagggcugagccacaccacaauuagaaacagguuuuccaguaaacagcacagucucaggacucaccgugugaucaaacauccugcaaaacuucccaguaagaguagaacaacuaacacaaaacacaauuaacaacacaaaaaucacacagauaccaaaauccucaauacuauacauaggagcacugcaucuagaaguuaccgaacauacauuauuuuuagccccacagauuacaaucuccaagauaauucauauccuggcccaugaaacaacgcucuuuuacagaacuagaauuuauuuuuaaaccccaaaugacuuaaguuggaaaucaagaaaaaaaaaauacuaagaucaaccacaaaugcaaaugaaauaguucucuucugaauaauucaugcaggucaaagaugaaaucaaaggagacauuagaaaacauuuuucucacaauggaaguaaaaauauaaaaugccaagauacacaaaauugucacaagaucacauucauauacauuaggauggcaauuucaaaacaaaacagaaugcuuuggugaaaacacuggaaacuuuaugcacuguuaguggcagcuauaaagagcacaguaguaguuucuggggggaaaauaauucaauauguaaaauugucagcauccuuuucauaauuccccguguuauauauuucauccucacaucauuucuaauacugaaaauagagacugugcagacuguuuacaagcucuaauucagucuaugcaaucuuuagcaggucugacucugcaaaagcacauuacccugcugaccucgcauauaaaacagccucguuccacucuccuggcacugguccccuucuuacccccagauaacccucuguuuucaugucauauguacagauauacagguggagaacagucuacgcucagcuguuguuguugaacuaaauucaacacaugaauggaagcaugagaaaguuagaacacugaaacaucuuccaugaacucaaccaacaacacaaggucacagccaccaaccaccuggcugauagaagcaugcguaguauuaauaaaauuggcuuaacguguucauuacaaagaaaaaacaauaaagcacuaucaaauucuaacucugaccaaaacaaguucuuuauuucuaagauacuguuguauuuauuuuggucuuuuuuuaaugcuacuucacacuaauauuccugcaugaucaauauuuuuguccuaccuuuguaugauacuccauggcauccaauucaccuugauugaaagcaacacaucuuuuacguuucuaagagagggugaugagaaaaaaaaaauaauguuguagucuaccacaauacugacauuuugaaacccgcuagauuuuaguuuuauacuacauuuuuaaauauuguuucuauuuuuuaaagauaagagguuccauugagaucaaaaucaaugcaaaguguacuagugcccauggaauaagaacugugguucuucauaagcaguugccauaguuacccaucaguuuauaugcauaugacauaucuucucucaacuuucuucauuucugacaugaaccaucuacaagcuaucaaaggaaaucuagggcuguagcaaaagacccgugcuuaaaagcagcacugcucuugcaaaagacccaggcuuaguucccggcauccacuugguggcucaugacuaagauuccaguugcaguggaucugacaccuucuccuggccucugcaagcaccagacauacacacgguacacagagguucauacggguaaaauacuuauacauauuaauaaaucaaaagcuagaaagaaagagaauggaagggagggagggagggaaggaggaaggaaggaagcaaggaagcaggcaagaaagaaagaaaucuuaaaaccaaguauggcaucucaagccugcaaaaccaggaaaugaauggagggcaugaaggguagggguucaaggucauccucugcuacacaguggauuccagaacagccugggcuaccuggauccuguucaaaaaaaaaaaaaaaaaguggggggugggggaaggggaggaaagacagacagauagaucccaaguauugcuauaaucccagcagccaggagguaggagggucaaguucaaagaaaacauuagcaacauagcaaaagugccucagggggggaaaugucaauuuuaacauauuuuaaaugauguuuagaaugcuggcaagaugauacuuaucaccagauccaccauugugcaagaacagagcuccugaaaacuguccugugaccuccagaugcaaaccauugcacaagugcaccuacacacacacacaauaaauaaaugcaaauguuuaaaggccuucagacuugaucugaggguuauaaggcaagccaguguuacuagcaauauucugcaccugacuacaccacacaacagagcaugagagcaggaacacagagccauaacuucuuuucauugcugauugcuacucacauagucucaaauucucaacaggcuaaaauacauguuaauuacauaaaaaaauguaagaguaggcuagcuagguaacuucguuagcauaucagaaaugaucaguuucauuaugauaguauuaauuacauaugcugaucuguaccuuccacauuaaaaaugggaagucugucagguggcaugcaccuaucaugacagcacugcagaggcagggacauaaguuuaaaacagccuggucuacacaguggguccaagacagccugaacuacauucacaugucauuaaaaacaaacaaacaaacaaacagccgggcaugguggcgcaagccuuucaucccagcacucgggaggcagaggcaggcagaguuugaggccagccuggucuacaaagugaguuccaggacagccagggcuacacagaaaaacccugucucaaaaaaccaaacaaacaaacaaacaacccaaccucuuacccauacuaaagucaaaugcuugguggucugaauuaguaacagugauaccucugagguuuucuuuucuguguuucacguguagaugaaucaauacauacuuguugaaaaggaaaaacauguccaaaaaaaaaaaaaaaaaaaaaaccaaacaugcauuucugacagcauuucagguaccucccacaguggcagagguuacucugaguaacuuccuuacucuaacucuucgcaugcuucccucauuuuuuuaaccaguucugagguacaauagauaaaggcacugugcucaucuugcuucaucauuaugcacaaacacagauggaaggagcucacacauuugccaaaugaacaaucauucauucuuaccccuaacgagacaguaucuacagggaguuuguacgaucaccucuggacuacuggaacacacccaaaagauuaaagcguaugucgaaggugcuugcugcugagccggacaacuucaguucaauccccagggccuauggucaacaugguagaagcaaagaaaaacccuacucccaccauuugauccuguagaguaugcucacauaucuauuuuuguuggggggaggcuguuguuuuugagggguguuuggcuuuuugggagaggaucucagauagccugagccgaccaugaaccucacugugcagccaaggguggccuggagcuccuguuccuccugcuucuaccucccaaaguguuccaauuacaacuguguaccacuguaucagacucaaaugccuggaaaacugccccaaaguauauacucaaacacauaugcuggagagauggcucagcaguuaagagcaccgacugcucuucccgaagauccugaguucaaaucccagcaaccacauacuggcucacaaccaucuguaaugagaucuggcgcccucuucuggagugucugaagacaguuacaguguacuuacauguaauagauaaauaaaucuuuaaaaaacauacacacacauaccuuauaaauauguauauuccauagaagcuuuccuauuaccacuagaaaacuuuccaaaaacacccuucucucaaacuuuauuuauaggagccuauuccuaaaacaaggccuuuacaauucccuaaaagccacugaauaacuggaaauuguuucauagaaauuuuaaaagcaaaaacagguguaaaaacauucaguuaacuauuucccacgcuuguuggcagugacaccugggagaagaaagccaauugaugaggcagauuaaucucucaugugauagccaaguuuauuaguuuaucaguuuaucagaguauuggaaaauuuauauucugaggguuaagagucacgugaguaacagguacaaucacaaaggcaagccaaaugagguugacaagcaggauaugguaaaaacauaauuuuccauaaaggcauauaaacaaguaacaaaguccagucgugaugaauaaauucccuuguaucugcuacaccugagagggacacaaaagcacauuccaagaacaauuucaugauuuucaagcaucugaggucacaagacucuuguuuucuuuuagguuuucucacaagcauugagaauccauuuauuuauucaugcauucauugugcacuguggggaggggugcauagccacgacacccaggcaaagguuagaggacaacuuccaggaggcaguucucuccuuccaccaagugggcccucgugaucaaacucagacugugaguuucagcagcagggccaccucuccugacaucuguuuacuuuuugaaacaugcaauguguuguuuaaaauagcaggauguuagaaaguaugauuaaaggugacugacggcaccugcugagaaccccagcacuugggaaguggagacaggaggauaaaaagccugugauucucagccaggcagugaguuggagggcaacccacaaucgcucuuggacaugcuaacaccuucugcauuauuaacucuuuuauacuuagaaaaugggggggccuagcaaacacagauguggaugcucacagucaacuauuggauggaucacagggcccccaauggaggagcuagagaaaguauccaaggagcuaaagagaucugcaacccugucgguagaacaacauuaugaacuaaccaguaccccagagcucuugacucuagcugcauauguaucaaaagauggccuagucggccaucacuggaaagagaggcccauuggucaggcaaacuuuauaugccccaguacaggggaacaccagggccaaaaaaugggaauggguggguaggggaguguggggggagggacgggggggacuuuugggauagcauuggaaauguaauugaggaaaauacguaauaaaaaaaauaauaauaaaaaaaagaaaaugggaagauguuugagauacuuaaugaaauuuuuuuguuucauguuuaaaaaaaaagacgcuuaacacuuccuacuuucccaacagaaacagagcccucuuguucauccucauucaguagauuuucgguuuuguuacuuuguuggugcucuuagugaacagcuggaauuauguaagguuuggugacauuaaauagcucagaucggaaaacauauuuuugggugaucauuucacaacuuccuccauccucacugcccgacacaguaguggagucaggagcaaagcauguagcagaagcuccaaaaggagaccugggauccagcugaagagaauccauguagacagaagaagugggguuguuuuuuacuacaaaaacgcucuugacacuggggaaguugacaguuuacuuuguuaaugaaaugacaagaugauccaguaaccacccaggaggcaaaugaugcaccacagacauucucauaaaaccaaaccaaaccaaacaaacaaaaaccugauaaucaagaaucacaaccagagggcuggcgagauggcucagagguuaagagcauugacugcucuucugaagguccugaguucaagucccaguaaccacaugguggcucacaaccauccauaaugagaucugauacccacuucuggugugucugaggacagcuacaguguacuuauauguaauaaauaaauaaaucuuaaaaaaaaaaaaaaagaaucacaaccagggcugggaguauagcucagcgugcggguccuggguuugauaccaauguuguaauuaaguucuuacuguccuguauaucgaugauguacuuuguacacacaaguagguuuuauauuuaaacauacaaggugaguguguacauaccaccuuuaaggaaaaaugcgauacuuuaaaugucuuuuaauuucagaauuggucauucaaauuuuucagccaacuuagccaaagaugcuucuuaguuugauccuccuuucuucgggugcccucuaugguccuuuuuugguccuugagucaaggcacgaguccacaugguccaaguauucaagucacuaaauccuuaaaaggugagugucuugucaagucaaaggauaguaauuaccuacaagaauuuacccuuuuuuaaaugauauaaaucuauuuagagagggccacaggaaugaaaggaaagacagcuguugugcuuucaaacuacaauugccacaggaagucacuccauuucucagaucccugcccuaccuaauccuuaucaguuguagggcaguaagauuaaaagagugcucuagccaaaccaagugcagcaugaauaguaaucagaaguucacaacuuaacuaguuugcuaggucaaaacuucaagauuuauaaucuguuugagccacacuccaguaacuagguuuuacagaacauuuuuaucuucacuuaagauauguuuugcauuucuggauauagcuuuauuauaauguaguggaaaccuuaagagaaaaccgaauaaaaaauaaauuaaaggcucgucuaauagcauuuauagucaaauuucuuaugcaacugacugcagaauaguguuuguuucuuaaagacagagagucacuagguugcccugguguaugccagguccaucaaacuggccucaaauucaagacucucucggguguggacccugccccacauacaaacuaaagucauugaauucacugagccucaaaauuaucucuuuaguuuuuggaguuguuuguacguguggguuuuguuuggggugguuuugcuuggguuuguugguuguuuuguuuugauauagugucuauguugcucuagcugucccggaucucacuagguaaaccaggauggucagagauucccccacaaccuacccccaccccacccccgcuuccagagcguggaaauuaaagguguguaccacaacgcccgacuaaaacgaucauuuuuauguucuaaugccauuaguuucaagaaguaaaugaacugccgcuuacagagucugaaauauaaugccugcuaauauaucugcugacuacuauuuggugauggagaucuucgugauaccugagauuuugguuucccaguagagacguaaagugaggagucacugugaccgcuagggaaccucaaacucaaaaaaggacugcuuagcucaaaacuagcuaacggcacaauaaugccgagagccaggaaucuacacuuuagcccagggacaggccaccaccauccgggaacuaguaacgccugcuuguuguuccgaggcugggcggcgggaauccagagcacuugaggaagccugauguuaaauaucccucaggcucguccaccgccacacucgacagccucuccuaacgucaggaaccucacgccgccucauaggcuuggguccuggccuccauccuaucggagacaaacccgcgcuuucuacuuccaggacgcagccauauugcuguacggaacuugauuccaggagggcucgggccgcuccgcccggacagcccuacucguccuagaugccagcuucccggacagggcgggacucccuucgggucaccgacgcuaacgacgaccugggaagagcccagagcucgcuuggcccccgaugcggacacuuccggcgacgagggcgggcg

SEQ ID NO: 8725 - RNA, 41756 nt, Mus musculus
cgugugcgacagcaccugcuccggacgucaggcucucuaaggacgacgugguucuuccuugugagguugaggcgcccgagaggcgaucagagcucagagccgauucauuccugcuugacuuugggucggugccucgugagcgagcucauuucccgggguugcggguccuugccuggggacacgcgaguuggagagcgcgugcaccggucguucccuucccgugcugcccgcguccggaucgucgggacccgguugucucuaguauguggaaaggcucgggcugggaacuucgagggaggaguuacccccucgagauccggaggaccagagcggagagcagggccacugagacccuacaggauaugacuccgaggaucgcgugcuggacacgaguggcuaccgagcccggagagcuucgcgcugccuccuccuggucccuuuccagaggacucuuuucagucggggaugcuuauuaaagcucuggcgggaaagagagaaucacaauuaaagaaauuaguccuacucugcaacgucggacacuuuaauaguaacuggggagcgauugcguucagggagaucgaggacaaguauccuggccagauccugacauguuuucccgguaagaguucucugcggaggccaccuuuggaggacucuguauauugauggaagagggaacgccggaaccuaucccaaaaguauugucaugggaauuagguguguguggguuccaggaagggcgaggacggacggcgcacuaccacaguccgaugaauguucucaucaccgaccuuuggaguuuuucagcauguuggauuuuuaaacauguucagguacugauaauuuuagaaggaaacagaauuuacauuugauauuugccacucccuuaucuaaaaugaagauuaugccaguuuacuagcagaaugguauggacucgcuaaacagagacguaccuguuuguuccccacagcucugaagcguauggguauugaucuuaggauguugaacuguuuggggguacauuuuguaguaccauuguaauaauaccauauuuuuuuguuuuuaauauuuggggagugggcccugaaugagaacuugcaaacaguguggaggucagaggguaacucucccagagucucuucugccaccugggauccuggaauaaauucggguuaccaggcuugccuucgugucuacuggcugagccaucucgcaggcccuguggcaguauuuuaauaaugauacuuaauaaggaauguuacuggaaauccauuaucgcauacauauuuguauuaggguuagggauguaacuuaguaguagaaggcuugccuagacugcaccaaaagcccugcauuccuuuccucagggagcggcacauaaauggcuauucaccucaguuaggacaccaacagaccauuccauccaaguccaguuuguuugguuauugggguuaaagccagugugauuauugaguucaguacugcuguguagacaugccaaggagucuggaaaagccccauccaaccauggaugacuccuuccuaaagucacagcccuggagucccaaacccaguaaaccuaccucuuguaagcugugccacccuaagaccaugugaaacugccauggggaggcggggaaguuggcugguuugggugggugagcaggaguugguggcuaaaacacacacccccugccccacuucaaggagggaaggugaauaggccauccaugggauuuuugggggucucaguugaauaaucacagcuacucugauuucaagauuacagagguccuaucugccuaaaggauggaguuccauuacacucuaccccagccccacaaaaggcagcaaagccaugcagauguuucaccacuagugaaacuagugucuaggcucuuuagcuuuuagacaacuagcaggcuauuguggugaaugccuuaagcacauagcaggcagaggcgggaaaugcauugugauuuuggguuagccuagucuacauagcaagguucuaaacucccuaauauuauaguucuaaauuaaaaguuaauaguuuccuuuccuccucucuuccuccuccucuuccucuucuuccuccuuccccuccucuuccuccuccuccuccuucuucuuuuucuucuucuucuuuuggauaggguuucucuguguagaccuggcuguccuggaacuugcucuguagaccaggcuggccucgaauuauuagauccaucugccucugccuccugggauuaaaggcaugugacaucacacucuggcaaauaaaaguuuguuuccuuauauauuuuauguauaagugcuuguauguaugucugcacaucagaagaggacaucaaaucccaguacagaugguuguaagccacagugugguuguugugaaucaaauucagggccucugaagaucagagcagccagugcucuuaaucacugaccauaucuccagcccaucucuucucucuucuccucuucucuucucuucucuucucuucucuucucuucucuucucuucucuucucuucucuucucuucucuuuccucuccuccucuccucuccucuccucuccucuccucuccucuccucuccucgucuccuccccuccccucccuuccccuccccuccccuccucuccucuccuccuccccuccucuccucuuccuuccucuucuucuuccuccccuccuuucuucuuuuccuucccuucccuucccuccuucccuccuucucuucccuucuucccuuccuuccuucccuucuucccuucccuucuuuucucuuucccuccccuccccuccccucuccuucccuuccuucuuuccaguacacaguucuuacccaaacagaguuuucuuuguuggguugguaugcagugguucauacuuguaaucccagcauguggaagugggggcaggaagaugaguucaguuucuuggcuacauagucaguuugagacuagccuggggaacauugagacccccaucucaacaagggagggacagccaauuucuuggucaaguuccucuucugcuuacauuggauuuuuuucauuauuucuagcaaagggugucuaauaacuugauaacugauuuuuagucucucaucuauuuccuugccauauuaaucuucauaaaauacccuuucuguagccucaggaaugugcccuaacugcuuaccaggccaagugcaaaugccucaggcuggcuuuuaagucugucuccccuccgaagggagcagugcacauccuuccugugcuguguuuaaaaccaucccuacucugagaguuuucuucaguucuccugauaguucgaagacacuagcugcucugcugccucugagcccuuauggcccucaucuguaauuucucauugguucuguagugcugcuggguuugcuaauugaucucugaauuuucacuuuaucaagcaaaauauaaauucuugggcagggccagaaucuaauucacuuuccauuccuguuuuugacccucugacaguaguguaaggcaagaacgagugcucagcauguauuuaugagucauccacacuguauuuccaucauaggauauaagugauacuaacgacaucaaccaggggacacuguuuuggaagcagacucaggcucugguagaaugagcuaauuuuuauccaaagcaguaagauuuggaguaaaggacgacuuggggcaggugggucuccagagaucacuggccagccagucuagcagaaucagugaacuccagggucagugaugugacccugucuggaaaaauagggaaagcaggagaggaagacauccaguaccaaccccugaccuucucccacacauauauacucuccauaaacauagacacccaaggaagccucaaccuuagccauagauguaaaugaaaauuaugcaaugcuagaccagguauggaagcacauaccuauacucucagcauuggagagucaugaguucuggguuaaccuggguuacuuaaugaguucucgaauagcccgggcuacacaauaagaaaagaaaagaacaaugacaaacuucacauuuuagauucacacauaaaauauuagauaacuguugggaugggaauggagaaacaggcacucuaguguaaacuauacauauuuuuuuuaaauauaaaacuuuacguacccucugagcuuaauuuguaucugauggccaugacacauuaggcaaaagaauguucccugaaguauuuguaugaagguaagacuagaaacagguaaauguuuaucauuuaccuaaauaaaucauggaaugcaguaguugaaaagaauacaguguuugcauauugcugagaugacagcgucaacgagaaaaguaaaagauggugugauuuaguuguacuguggauucaggacacagaguuacucgcagauuuguauaaauaaagcugucacaggaagggcaagggccaaauacuauggcugccuccaaagaggaaaauuugggguuaggggauugggaagagauuuuuguaaccauggauauuugacuuuuuuucuggggacauuuaauaccuuugcaaaauaaauucuuggcaguuuguaaacuaaugcucuagaauaucaauuauuuuuugcugaaguccgaucacaagggcaaguccuacguuuugagauaugaaagaccaucgcgauaggguuaagaagaauacgaacacuagcauaauucauggagcuuaaguuaaacccgaguggccagaccaugugaauuuuauuuauagugauauuucaaaagcaaagaagauauaaagucucaaacauuugcuacacuaaguuauuuuaaaugguuucuauguuacugaguaugaagggaaaaaaaaagauuaaggccagcaggcuguugccaccaaggcugacuuucagucccaaaagcccauacauuaggagaacuccuuuuaaguugucuucugaccuccauaaacaugcaguggcacauguauacuuccuucaacaaaaaaaaaauuuuuuuuugagacaggguuuuacuagguagcucuguguguccuggaacucacuauguagagcaggcugaccucaaacucccagagaucuguagacuuugacuuuuuuaaaaccugcuuuuaauaaggguacuuaaauguuugaccucccuuccagcccaccauccaucagagguaguggaaaugaaagguuaauagggcaaaggaggggcuggagagauggcuccgugguuaagagcacuggcugcucuuccagagguccugaguucaauuuccagcaaccacaugggggcucacaaccaucuguaaugggaucugaugcacucuucuggugcgugugucugaauuacaaaauaaauaauauuaaaaaaauauagggcaaaggaggauguggaccuguguagaaauaguucuuuggagagaauccaaucugcuugucaggacauuagcaguucaucucacucacacagaucccuaauguagcucuacccacucgcaaacaacagcaguuugaaccagaagaaaccacaaggcucugcugauugguccaaguccuuggaaguggcaagaagccauuugaacaccacuagagguucuuuggggcauuucucucuaugaauucacaacaaacaaugacagugaagacaaaacccaacaaccagcaaagaacgguaaggcacauguaccaauaccacacagcaucauccacugucugucggguuacauuuaugcccuuuccaacaucucaugcucucucaagcaucugcuccagcaaacaucaccuguccuuuguccaggcagcuuccagaaaaacaucacauaacacaacugagucuccaaagaaaccagaaaucuacacuuuggagaucuccuugccucugccucacaagugcuuguauuaaaagcgugugccaccaugcucaacaguaaaaaauuuaaauuaggaggaaaaaaaaaaagcaaacaaggaucuuccuucuuuuguaugggcaggcagucuucacuguguuuguccuuuucuccagggcugcaaagaauccuuuuauuuuaauaugcuuagaguuggguccuagagcuacugagucaggugacagaagcacccaugaauguugaauaauggcaagaaguaaaagcugggcacugugaaccucacuauuugcaggauaagucaagaauuugggcagguggagcgcuaaguuccaggccagccuggucuacacagugaguuccagacuagccagggcuauauaguaagauccugucuccaaaaaaaaaaaacgacaacaaaaauuuaaacaucauuaacaugugaauuuuuuuuuccuuuucauucuguuugaggcagaaucuuuccuugcccuggcgagccuagaagucaaucuuucugccuccaccucccgagugcugggauaguaagcauaagccaccacaccuagaaaucaugugaauuuuuauugccaaagcucagcugaaacaguuaugcagaaacuugagcaguaggaauucauaggaccuuggauauauuccauuuuuuguuuguuuuuauggcacuucuuaaaauuggcaauauugcuaauacagguaucauuguacucacguauauauaaccaaagaaagauuccuuauucaagauacucuguuaggauuguuauguauugcucaguacuauaucauuguguaguaauaaacacaucucuuugaggagcaguaacauagcaaaaugcaguucccuuaccugcagaauugcuuuuaaaaugugaauucccugaguucuucuaaagcgaagguagguugauccgcagcucucuuucuuccccacaaguaacuuuggauguauuagauccucaaguugcuuugcuugccuugaucccaaaucuuaaauaauggcgugcgugcuggauacuuggcaaagugaguaacaggguagcgggaguggggcuuuuguuguucauaucuggguugcuagagaucgaaucuagaaccuugcacaugcuagcugugugucuuaccacugagcuacagccuguggguuuguuuuuguuuuuuuguuuuuguuuuuguucuuguuuuuguuuuuguuuuucgagacaggguuucucuguguagcccuggcuguccuggcacucacucuguagaccaggcuggccuugaacucagaaauccgccugccucugccucccgagugcugggauuaaaggugugcaccaccacgcccggcccucagccugugauuuuuaaauuaucccuuucuucacacacauuuuuaacuuuuauucuuugugaauuucuugucaugcaccccaaucccauucaucuccccauccauucccauccacccucccaaaauaaagugcccucccuaaauaaaauagaauuagaauuaaaaaaaaaaaaucuugucauaaaagcuguagugugucacagugugucccacaguauacccuuuucuccacacauuguaaugagucacugguuguuuucaaaccucuggcuuccgcuauugcuauacuaucaauacugggucaucacugggacuccgcagacaucaguuguugccauggagaucuuguaguuuuggaucugcagcccuuucacagacuccagcaguucauguuggggugggccaacuucaaaguucuagaucugccugggugguagcugcaguagcucccccucauaaccaccaccagggccagcuuuacuguacugcccaggcaaggugcagggcucacucuccugcagcuagcaaagagucgggggccagcuuuuucaccugccucgggucaagaggggugagagaaacucccuagguuuuaaagacaggcuccuacucuguagcccaggguggucuggaacuucaguucacugucuagucuagacuguaacuuuccuugcuuaagcuuccugaugaaaaauuuaauuuugguuauaugucaggcuaaaaugaucauuucguguuaggcagugguggugcacgccuuuuaucccaguacuugggaggcagaggcagguggaucugugaguuugaggccagucugaucuacagagcggguuccaggacagccagggcuacauagagaaacuauuuugaaagacaaaacaaaacaaucauuuuguaacuuaguaagauguacaugucauuucauaaaaguguuauaaaaugaccaugcaucccagauuccaucauauugcuguuuaaauaaucuuuuacaaaaaagaauuaaugaggugauuuuuuucugacagguuggaaaauugagaguguaauguuaacaguaaagguaaguaauggucugcuuugucacuuacgacuauaaagcggcucaugaccuggugcuuugguuuguuuguuugguuuuuuuuguuuuguuuuguuuuguuuuguuuuuugcgguuacauggugccaggcaaacauguacgacuaagcugcauccccaccuaauuugcccuuuuaauccuuccuuucauuuaacuauuacaucuagauuuagguaauagcauuuaaauuuggauaugaaauguaguuaaagauacuauacacucacuuuuuugaucaaaauaucaaauccacuuuucacguuucugagagcaucauacaggguacugaacuucugaaugugacugccucugugaacugcucucucgugggaacagagaagugaggucagaaguggaauucugcuuccaaaagucagaacaaccauuaacacaaauuuacaguuacauucucaaaaggaaauugaaguuggaaaugaagaguuucacaaggagcaccauggugcacuucaguuucauuuuaugcuuguauuuuuaauaauaaauacuauagauucuuaaguguguauuuuaauaauaaauacuauagauucuugaguauguauuuuaauaauaaauacuauagauucuugaguauguauuuuaauaauaaauacuauagauucuuaaguauguauuuuaauaauaaauauuauagauuuuuuaaaaaauauuuauuuauuuauuuauuauauguaaguacacuguagcugucuucagacaccccagaagagggcaucagauaucauuacggaugguugugagccaucauguaguugcugggauuugaacucacgaccuucagaaaagcagucggcgcucuuaacugcugagccaucucuccagcccauacuauagauucuuaaguaugcugaccauauugacuaacacauucauauaauaacuaucagauacucuucaggguuuuauuuuuuauuuauuguauagaaaaugaaauaugguguuuuucuagcuccuacaacauugcugaaguucuuccaagaaacaaguuuagguacucauauguacacauuauuuaggccaugaaauggguuuucgauacauugauuuaugaaacaggcuucuccguuugguuauaagcccaucuguagaguuacuguguaaucacugacaaauguuucugauaguaacuagccaaacagucucaaaaaugcuuaaaaaacaaguucugagaaaaagcuuacagaaaagggacaguguuuaacauuucaacacuuuuugugaacaaacuguaaaacauuuguacagugugcauuuucuguuacagaagagucacauucugauuuuccacacagaccaugucccugcauugcuugacuuauucacugguaaaguggucgcacaugucaguacuguuuucagaauauauuaauuguuuuuuuuuucauuaauucaguguuaugaccuuaacuguucucucuuuuaaacuagcucuuuugucuucuaguuuaaccuuuuaagcugguggaggaaguucagaccacaccugaacugguaccugagaugacagcacugaaucugaagacaaagaaggaucaaauuagaacugacuauuauuagucacuacuucagaaagucuuuuuaccuuauuuugguauguuuaguuauuacuaugauuuguaugacuuuuacauguguuugaaaaguaacagaagcuaaaggccauuguacaacuggguaacagucccguuuucguucucuugcauuugguuugccauucuguagcugugacuccagcuugcuuuaguugagccuugucauucuucacucucugcaaaccauuccacggauuuguuuuucuucacaaaauuaguuucauuuucuuuguuugauugauggucauuggcuacugaaauaaaauaugcauuuuaagguaaauuguauguauuuuuuaagauaaaacuuuguguauuuuaaaauacuuuuuuacuguucuuuuuucuuuaucuuuguuuuuuccuuucuuucuugagacagaagugguaagccugccuuugaccccagcguuggggaggaagcagcagaaugaucaggguagacaaggcccuaucucaaaaaacaaaaacaaaacaacaaaaagauugagauaggaucuuacuguauagcccaggcuagucuugaauucuugauauuccugccucagcuuccuaagugcuagacuuacaggcauucaucacugccugaaccuaguacauauuuuaauuucuuauguggaacuuuaaaaaauaaggagccagacuuaguggagcacaccuuuaaucccagcucuugggaggcaggcaggcagaucucugauuuugaggccagccuggucuacaaagggaguuccaggauagccagggcucuacagagaaacccugucgagagagagagagagagagagagagagagagagagagagagagagagagagagagagagagagagagagagaaaagaaagaagaaaaagaagaaagaagaggaggaggagggcucagggagauggcuuaguguguaaaaccacuaacuagcucugcaagccugaguuugauacccagaauucauguguuuuuuguuuuuguuuuuaaaagcuggaugcaguaaugggcaucuacaaucccaacacuccuauagcagugaucccaacacuccuauagcagugugggaaguggagacagaagaaucugcagucuggccagcuagcuugggcugcguggggcagcaaacugccucaacaagguggaagacaugaacugacuccugaaaguuguucucuaaccuccacagacacacacacacaccguaaacaacaacaacaacaacaacaacaacaaaaaacacaccagggcuauaguaaauaguaggggagaacugaugggaauaauauaauuuuuaaaauuauaauaaagauguaacuuuguuguugcuuuugguucuggguacugaagccaggaccuugaaccugguacauuguaaaucauacuauuaauaggguuugcccucaagaccuaauaacucuuuuuguuugguugguuuuuauuuuuguuggguuuaaagauaacaucuaauauaacgcaggcuggcuuugaacuccugauccuccugcuuuccccucuacagagugcugggauuauagacauaaacuaccauguccagcuauauauaguguuauuuugagacauucuuauuccuuauucuagacaggccucaacuauugauacuucugccucagccucuagagugucaggauacgggcauguccuacuauacauugcuucaagguguaacaauucuuaaaucuuuuuagucugcucaaaucuugguuugauaugguuugagauagggucucaucuguaacuuaggcaggccuggaacagggugucuuggaacuaauagcaguccuccugcuccagucuccugagcacuggaauaacagaugugaaaugccauagacagaaucauuuaaccauguuuaaaggccaccaggacuaaugacauauaucaaaugaugugaaaaauguacuuuacacgugugaauuaggaauaggaauuauucaucgguaccaguuguuuuguauuuucuaauaacauauauguuuaaagaacuuuauucgccaggcggugguggcgcacaccuuuaaucccagcacuugggaggcagaggcagguagauuucugaguuugaggccagccuggacuacagagugaguuccaggacagccagagcuauacagagaaacccugucucggaaaaaaaaaaaaaaaaacuuuauucauuuuucaaccaacucaucuucaagguuauauuuuuauauaguuguacaguuuuuuguuguuuagcuguagaugcuucucuguuggcuagcuuucacaauucuggaggggagugcuauggcaagcugcagaagaagaaaccuacucagcaauggucugacaccucagugaacccugaguguuauaauauuaccggacuugaaaacaggcugugucacuggugaacugguggcaugauugcuaagggggucaucaaccacuuccacuccacaggaggggacucguuccugguauugccacccugcuccaaaaccuugcagugccgggaugcaggcauguccuaccauaccugguuucaagauguaacagcucuuuaaucucuuuucuuauacucgaaucuugguuugguuugguuugagacaggaucucacuuuccaggcuguccuggaacucauggcaauucuuagcacuagaauuacaggugugaguuaccauagaaccuuuuuaaccagguuaaaagaauaucagaaucaauauaacugguaucuaugaauaaucccuguuccuaacauauuucucccaucauuugauguaugucauuaagucugacauucuuuuaaccugguuaaaaugauccugucuaugguagcucacaucuguuaggagguugaagcaggagaacugccaugagucccaggccagcuugagaauauucuagcccaagacuggagaagucauuggcuuuagggagaaccuacuacuguuguuuugcuaaauggacaugaugucaaacugcuuuccaaacauucaaccccuagguuaguacucucaaccuuggucagagaaacccuuugcagugggcagugguuaaugcagaaacauauaauuggucaaagugcugagaauacaagaugguugaaugcucagcccuacaugggacaucuguauauuacucacauucacaauucagaaaggcugguggaaaggauauaaggggcaaaguucugugaaacccucuacaaaugacauaggccuggugcucacaaacccacggcagcuggguuucccugcacacgauccaaaccaucaauauucuagcauagauaggcgagagaggagaaucauuuuuccucaggagcauagucacuaguaaggugcccuugcuccaguaaaaaaauaaccccaagcccagaacauguaagcaaaccuaauuaaacuugguggguuaccaaaaacaaaaaucaaaaacuaaacaaaacaaagaacaauaaaacaacagcaaacccaacugaguaugauggaaaggauuuuucuuucaucccagcacucaggaggcaggggcaguuguauuucugaguucaagccaaccuggucuacauagcaacuucaggauagccaaggcuacacagugagauccugucaacaauaauaauaauuuaaagauaugaaauuaagagggggcuauauuguaaaggaggauucuagaaggagaaagugggguuaaaaaguggagaaugggaagcugagaguggucaaauacacuuaggagguagaggcaggaagaucagaaagagauuagaaucauugaucaggcuauggaggaccuuagaggccuucuaaagaguuugucuuuuuuuguuuguuuguuagguuuuuuuuaaagacaaggucucagauaaucucaguauguagcugagauuggcccuucucuguguagccuuggcuguccuggaacucacuuuguagaccaggcuggccucaaacucagaaaucaccugccucugccucccaagugcugggauuaaaggcgugcgccaccacugccuggauggcccugaacuccugauuccucuaucuccuaaaugcugggauuaugggugugagucacucugacguuauuauguaauacuggugaucaauccugugcuuagugaaugcuaaccaaguacucuacaaacugagcuauauccccaacccaagugugucuaucuuaaaacaaaacaaaacaaagccccugaggugccauugaaggauuuaauuaaggguaaucuacuuagauuuguguuugguuaggacauucuggcugcauuaaguacugacugagaaggggagcuauucugguguuauauugucuguacuaucuauaacuagagcuuugacacccauuaauugucaaguccuaagugucuauaagaagaggauggauuaaaggcagaggaaaauguuauccuuuaaccuguuucauuucaaacuaaguguacuuacuuucugcuuagcauauuguauucgauggauaaugaauugaacaauaccucucuaucauugugcccaucuuaauuuugaguugaaugguaaauuagcauguauuauuaaguaguucaucgagacacaguuuaaggccuuucucaauauguuuacaaucucgguaugggccagauguccuccccugcuaucugacagcauuucacucccuauagcucagacuaaccuugaacuaauggucuucaugccucaccaucccaaggauuaggauuaaaaucauacagaggacagaugcugacuaguguuagcuuacuuccucucuccuuucccggucucauacagcucaggcuggcgucaaauugguucucuauccaaggaugacccugaacuccuggugguccucuacaucccagaugcugcgacuaugggugugugccacaugccugccuuccuguuaguuuccugugugugucuggcccucuuguaucuaucacucucagauauugggggaucugguuuacaacugucuuccaguugcuuucuaggagacuugcuccaccucuacccuucccauccaguaaaugaucaguaaguuugcugguggcuuuaagugcacacuggaucauguauuguuucaucuauugacuuaguuauaguagaacauaugauaugacuaagaguguaaagggaacagaugcaaagacuacuuguagaaagaaccagauuagcuauugauucaguguaagacaaucuguauuggggcgggguggagggaggaagagauggaguuucucugaguaaccauggcugcucugaaacucacucuguagaccaggcuacccuccagcucagagauccaccugccugugcuucugagugcuaggauuaaaggcgagcaccaccacuaccuugugaucaucuauauuuucaaauuccuauuugcuauuccacucucucccuuacaucugcuagucucugcaaacacagugcucauuuacuguccugaacauauguuauuuguucuggaaaucucuuaccaacuuucucuuacacagaauucuguagccuauucauuuguuugucgaagacaggguuccuucucuauaguguuggcuggcuuagaacauagaguaauccucuguccuuaaccuccagaguuccgaguuuauaauucuguaaucuuuuguucucuuaaauguugcucauauagcauauuccugaucacauuauugacccuugucaccugcucuguuuauuuuuugguucuggggcuugaacauuguccagugccugccaaacaugcucuuccacugagugcuaucuuuagcccugauuauaucuuuguuaaguauaggcauaauguuacugugcacuguguaaagauuauccuuguauuauucaacuguugauuucucugcccccauaucugguugcaauccagacaugacauuguaaugcuucuucuaagaaccuccugucucaguguuguguaagcauugcuccccauuuauucucuaaucugucgauaaagcugaucagccaauggcuaagcagaggagauuauagggcuggauuucugaucccagccaaggaaggggagagagaaaaggagaaggggggagggaaaaggagauggaaggagagggagaagaagagaggggaagggagggaaagauuugucuagaggagagggucuaggagaggccauggaaagucaccuggagcagagaaagccagaugaacacuaaacugcaaguaucuugaggauuugggcugggagguagccagauuauuuuaaaggauuggaauagauuaguucagcuauuauguaucaaaagcuugauuaaauacaucuuaaagucuuugucucauucauuuaggagcaagcuggaaugaagaaaaaaaaacuaauacuuuuaaaaguuacauuagcaguuaagugccaagauuucaaacaggugauugugaccagaacagugaaugacauuaugacacaaaaugaaguucaaaaacaggacuuacuuuuaagaaaaauuauuuaguuauggguuaucuaacauauagacuagucugugccugucaaugccaaagguaaggcuuguuguauuuuucccuuuaucuuuauuuuaacaccucagguuugcagauaggguuuguccauguuucacuuggacuagcaaaggugcccugaggcagaagcagcauagaguaacuauagaaguguguuacagcuuugaagguauaaccugaaggaaagaccuaaguguagcauauauaaggcccuagguucaaacaccaauaccaaagcaaaaaguagaaaaguggggucuggagaaauagcucagugguuacaaacacuuggccacucuuccugagggcuuggguucaauucccagcacccacaugaugcaugguggcucccaaccacaugcaacuccagcucuaagggauccuauguuuucuuccagcuuccauggucacugaaaucacaugguaaacacacauacguguagauaaagcagucauuguuugcuguugcuuuagcugguaaugguguaacuuuucugaguuuuucugcaguaaaaugaauauuagccauuucaaaaugucuuggggguauugagcuuuuuagaugugauuaguaaaaggacuaguauaauacucauagucgugauaccucugacuucuuaaagaaugucacccccaaaguaguugacaguguuucccucuaucuugucaaacugacguuuuguuuuuaaaauguuauagguauuuuuguguuaaaauugcuuuuugguacauguuacuuugaaacaaacaacaaaagcaaucaaaccauuuuagucaugauuuugcgcaccuuuaaccccagaggcagguagauuucuaugaguuugaggccaaucuggucuauguagugaguuugagccacccaguauuauacaaugagaccauguauuuuaaaaaaagaagggaaaggagguuaggauggauggaagaaagaaaguuguuuucuuuuguuugaaagguagaacagugaucacauaaauuguaacaaagaccuggagccaagaccagcuccuugugugucuuucuuguaaaauguuggaaugaguuuuuggugacuauagaccauccaauccagugaugucucuccaguguaucccauccccuuuuaaaaaggaaauagacguuuagcucccaaagggcuuccagcuggggcucuccagccuugaccugagugcuguucccaaggcauugcuuccauaccuagcaauaguuuuucuuuauauuguuugcccucugacacuaacaaaugcuuuuaggguuaaccuuaagauucacaagaaaacuauuggauaaauauuuauucccuccucuaagugaugguggcacaugccuuuaaucccaguuuucaggaggcagaggcagggggaucuccggaaguuccaggacagccagaacuacauagugagacccugucucaagaaacaaaacaaaacaaaacaaaacaaaaaacuguagugagacccugucucaagaaacagaacaaaacaaaacaaaacuguugcuuccuaaaauagaucuauaaauccuaaauugggaauuucaucaauaaacaguuaaaagcacagucccuucuacaccuccccuauaucagugccuuacuuuuguuuauaaucacucaagggcuugcuuuaauuuuuuuaaauacauuuauucucucuuucuuucuugcucucucccuccccuucuuuccuucucucucucuucccccaaccccucacucccuguguaugugcuucguacacaauuacaugaccuccauguuucuguggaggucagagaacagcaugagagagacaguucuugccuuccacccagaacugaacucagacaucaggcuuagcaggaagcccuuacccacugacacaugcccugccucagcuuuuucagauagugacuaggaagccccuuacucccugcauucacuccaguccccuagugggugccaaggccuagaaucuaucuacacgcugcaaugauaucuacaggggcugcucaaaagaaaacacaaugauuucucuucuguuuucugaaauacagguucaaauuguuaaaaugugcuccuaacuuauucuacaagcauuccagaaggaaccuggcucuugguguuuccaucacuccuuuagcagucuucuuaacgacuccuaccacagcuuauuuucacugauaaaagcaggguuuuaucaaaggcaguagaguauaauugguaagaauucaggcuccagucaccagaccaggauccaaauauuacucuacaagccuuaugagaauuaacauaagccuugguuuccuuguuugccauguggagauaacaauacuuaaccuucagugguaguggauauuaaguguauuaugaauuaaaggagcuuuuuuuuguuuuuguuuuuuuccagagacaggguuucucuguguagcccuggcuguucuggaacucacuuuguagaccaggcuggccucgaacucagaaaucccccugccucugccuccugaguguugggauuaaaggcgugcgccaccaagcccagcucaaagaauguaaaaguaaaaaaaaaaaaaaaaaaaaccuaggagauagaagagggagaacaaaugacacuuuauaguugaguuaauaauuagccuauuuauugucaaauauguguaugacuaaaagaaugugcuuggagauguugaaaagcaagagacuauacugccagugaaauuuguuaagcaaauacuguguccaguaaaaggaacaggagcuaugcucuacugccaagggacuagagcagugguuuuccaccugugggucaugacccccaaacaaccaucagaaaacacaaauauuuauauuaggauuuauaacaguagcaaaauuauaguuaugaaguaauaacaaaaauaauuuuaugguugggagucaccacaacaugaggaacuguguuacaaugucacagcauuaggaagguuggaagccacuggacuggaguuuaguuccccuuuuagugacacuucaguagucauuguccuucucauaggaauaugguaaagauaaaguaguaaaaaucugacugauguaggucuguuuuuuuuuuuuuucuaugauaaaagagucuacaaaaaaaaucuggguuuuuuuuuuccuuuuucuuuuucuguuuuguuuucgacaagauuucucuguagcccuggcuguccuggaacucauugugcagaccaggcuggccucgaacucagaaauucuccugccucugccucucaaguucugagauuaaaggugugugugccacuacugccuagugaaaucuguuuuucaaaugagggaaaucuguaaggaguaaacaggaucccauugcagaguacuuuaguacuguuucaaaucuagcaaagaaaaaugacagggaaauacuacacauaaagauaauuugaaaauuauggcauaguuuguauuuaugguuaauuauuuucuaguuaauauaucauuguucuaaguaaucauuuagaacucaacaaugauauaugcaaauaaauuacacauaucacaauaagguuuucaaacacuaaaugacauaggaaaaugauucauaguaaauaaaaaaagcuagccuggcuaaaauauggccuaauuuuguuagaaauagaaaaguauagagaagaaaccaauaguuggauggugauuagaaguaaauuuauuuucuugaaaacauuuuuaaauaaaauaaacaugucauagaaacccuucaagccuuaauaguuggaccucguagcauagugaggugaaguuuaauauauguuacaauccuuuuuaguguguguaggcuagcacaacauggguauagauaggauaaaaagugguaacuugaagggggaaaacuuucaauacaaaugcaacgcaguuauguaaacuaugcaucccugccuguaaggucuaguagguagagagcaugcauuagucuaccugccauuaagccauaccuugagaauagguaugaggagggucaccugccguguccacugagaaugcacuguguaguuccugagaaucuuuuuccauuagcucuccugugucacuggaggaagaugaggaugaagacagucccagucucacguaucuuccuuuuuuaccacacagugagcaauccacugguguggcacuagguccccugggcaggugaaccucaucucuguuguaguuccuaacagcuccacugugaugcacagaccgcucucguugccagauguaauggguuggcgcaauggccaugaccuauagugaaaagguuacuuugugaauuuaauaacauuuuaaaauugaguaaaguacagaaauuguaaaauaacagccaaauuaccuaaaaaaaaggggggaaaaaggcuguugugguguacaccuuucaucucaacagagaggcaggugaaucucugaguucuaggcuggucuggucuacagaauugagcuccagggcuacacagagaaauccugucuuaggaaaacaacaacaacaacaaaacagacaaaaaacagccccucccagaacaauagaaauacuuaaguuacaaacuuuaaaucagcaacaucaaaucauccauagcagcauuuucuguagagugauuucuuggaucauuaauauuaauauugacaaaguaucuaaauuaguucaaguagauaauauaaaugaagcaaccuucucaguugcuauuuauuuagucagucaguuuguuuuugagauaaggugcucuaugcagaccuggcugucuucaaacucagucucugccuuugacugcugggauuaauggagcguagcaggguauuuauuuuuaaauuuucaaauauuucuaaguuuagaaaagauaauaauauaguauaaaacauuauauaauucuuuuguauguguugguaaaaaaugggcucuuaacuauguuaggcuaaucuuaaaauauuuacaguuauaucaagggauguguuauuuuuuaaaaacauguagauuaacuucuuuguccuucaguuuccuuauuuguuacacagagacaagaguauacuuuuagaaaguugugaggaaaggauacauuuuauaaagcacuuaagauuucucccugucaggcauugucauaagguuuuuaaaucaagcgugggcuuuaguuguagacuuucuuauccugguucuaccacuuguugacuauauaugcuacagagcaaauuauuuaaccuuucugagguucuguuacuucauugauaaaaugggguugcuaacuaccacaaauauuguuuugagauucaauauuacauguaaaauccuuaccacauaauuagcaucuggcaaaugauagccauuuaagaagucaagauaaggaaaaguauaauauauugaccuuaugaaauccaaaauaaugagauuuaagucaaagucuuuagcuguaguuaucaaugauccacaguaagugauaaguuauaauaauccuaaaaugaaagccaaacagucauacuauuugccuaaacuagugauuucuuaaaaauguuuaaaaauucugaaauuuuagagcuauacuggggaccugggagggacaagggaaggcagcauuauuagagaagcuguuuuaggagccuauguauaaggacuuauauauguuuuugaugagaaagaacucuuuuuguuguuacguuuuaagacauaucuguguaucucugguuguccuagaacuugcucuguagaccaagcugggggccagugaguggaaugucaugguuugaauaugcuuggccuagagaguggcacuauuuggaggugugugcuuguuggaguagguauguaugucacugugggcaugggcuuuaagacccucauccuaacugccuggaagucaguauuuugcuagcagcuuucagaugaagauguagaacugucagcucuuucugcacuauggaugcugccauguuccugccuugaugauaaugagccuguaagcuagccccaaucaacuguuguccuuauaagaguugccuuggucaugguaucuguucacagcaguaaaacccuaagacagaaguaauguaauuuaaguguacccccacccugagcuacccucacuuuuuuugcuccuuacccucccuauuaguucccuuuauauuuuuggugcuuuuauuuuuaaaaucaucaucaucaucaucauuuugaggcaggaucuucuuugguagccuuggcuggccuggagaccaggauuagucuuaaacucacagagauccaccugccucugccucccacaugcugggauuaaaggcaugugccacuauacccagcuguauuuuuucaugucagcuguacauauauguauauaagcuauacauuucuauaaaaaucuaagauacaaaaagugguauuugugauuuugaacccuguaaaguaauaagacagaaagggaaauuaaaaggauaaaaauaacaaaaagaagucaaaguauucauauuuccagauaugcuauagccagcuuacuacuaagucaugacaauuagaauuuuguagcauuucuaacacuggcgucaccucugaagcacugcaaucugguuucuaaacucuagcaaguuuagcuauuuccagcacauucccaauagagaaucgcuuuugcauaccuucauugucuuauucugcccaauacuauugcuuccuaauuuaucaaugugaaauaaaguaguaguuaacagaaguuagcuaugauguuacuguagcaacucuaccagagugcacaaagcagcauaaagaaaaaucuuucccuauaagcaacugcuauccucuguguuauuugaaaggcagggggaucgagucucucucaguggauaggcacccucucuaauauguggaccaguguagaaauuaagccaucaugaauguaaauuaauuccacugcaaaggaacaugucuaaaaaguaauaauguaagaagccaaguucagaauugguagggaaauagucuucauucuuuccagagaagccauuuauauacacacacacacacacacacacacacacacaccacaccacacuccacacacacacaccacacacacacacacacacacacucacacacaccacacacacacacacacuauguauguauauguacauauagaacguguguauuuuuuauuugcauacaauuauugaccaucuuucuuccaacaaauauucaagggagcugaacacacuaaggggauggggguuggagagagaguucagcuguuaagagcaguuguugcccuuucaguggaccuggacuggguuccuagcacacacaccgaagcucacaaauacuugugucuccaguuccagagcauuuaaugcuuucuucugaugugggcaccaggcacacaugugguaugcauacauacauacauacauacauacauacauacauacauaugugcagguaaaauacucauauauuuaagucuaaaaaaaauuuuuuaaauaauucauuaaacuggauccaaagagaaaauagagcucaagugagaaaaagcagacauagccuaauagaacaccaugcaguuaaucugguuauugacaauaguucuaaaaaaaaaaauagugggccaggcgugguggcacaugcuuuaaucccagcacucgggaggcagagacaggaggaucucuguaaauucuaggccagcauggccuauguaguaaauaaguuccugaacagccaaggcuauguagagagacccuaucuaaauuagaaaaaaaaaaaaagaaagaaggaaaagaaaaagcaacaaaucacaaaacucaguauuaccuaaaaagggagcauauguucuuuaacaauaguaacagaaagacaagucaugauuuaaugauacuuuuuuuaaaucugagaaauagaauaguuaugcuuuuuaauuccccagauaagauacaaaugaauuuucuaaguuacuauugaaaaguuuauauggaagcuagauaucagagaaaacagaacagugagaagucauuacauaugcagccagucaagauguggcucugguacuucuuugggugggcuuaaguaaauccuaauauccuuggguccauggucucaucagcuauaaaggaaaaaugccuccauccucagagacaucuuugugaggauaagcaaugcauauugagucauaauauagucuuaguuccuuuucuauugcuggaauaaaacauuaugaacaagacaacucauaaaguguucaauugggggcccacaguugcagagggacagaguccaugaccaucauggccacaggcagacaagaaagauacuagagcaggaacuaggagcucauacguugauccacuaacacgaggcagugagggugaacuggaaauagcacuggguuuugaaaccucaaugacguaccagugacacaccuccuccaacaagaccacacuuccuaauccuuccaaaacauuuccucuaacuggagacuaaugcucaaacuuaaacgccuauaggagccauacuaauucaaauacuauaaauuugaauaccacaaauacguauuacuauuauaagcacauugguagcuacuauuccacuuuaacuuaauuagaauauaaggcuaaagauuauuuugacugacaguaugcuaguaccaggauuucgguaacaaauguuuaggaugccuaauuucuaacaacauaucuuacuacuuagccucaaaguauucaaaccuauguggauucaagccagacaaaauuccagcacucagagguaaacacaaagucccaccucaaaccaagaggauccuuguaguugaugcuuacugggaaagagggggucauuuuucuccaguugaaugucacuggguguaucagccacaguuagggcugccguagagagugaccagugugcugggcaguggugacgcacgccuuuaaucccagcacuugggaagcagaggcaggcggauuucugaguuggaagccagccuggucuacagagugaguuccaggacagccaggguuacagagaaacccugucucgaaaccaacccccccaaaaaaauaaauaaauaaaagagagagaaagaccaguggaaagauccccaugccuacaaaaagaaagaaaaaagaggaaagaaugaaagaaaaagccaggaguagugguucaugccuuuaaucccagcagaggcaggcaguucucugugaguuugaggccagccuggucuacaaaagagaguuacaggacagccagggauacacagagaaagccuaucuugaaaaacaaaaaacaaaaagauccccaugcuuuccauuaagaauggcaagugcaaagauccuacacugugaauaugccuggcucaguugagagcaguaaggaggcugguguagcuggaagacugcauacaauggguuagaaaagagcacaaugaagaagcaagugagaaaggagguacagacggcaaggccaauguugucuuauacccuauaaaaggugggaagcuacugagagcuugggguggggacuagagagauggaccaguguuuaagagcacugaacugauuuuccaggaguacucaguuuuauucccagcacccaccugauggcuugcaacagucuacaacucuaguuccaggaguucugaugcucuguucuagggucugugggcaccagguacguauguaaaauaccuauacaaauacaacuuaaaaaagaauuuacuguauggaggcuuaacaaaugaugacuuucacaguuauauaaagagcagccuauaggagagaagauuaugaaacucuguugcuuuuguuuuaaggaacuagggauugaacccaaggcuguguguaugcuuggcaaacacucuaccacuaagguacauucuauguucagaaaacacuguuugcaaaguuaugacaauuaaggcaaccagugauaaauagugguagaaaugcuagaaauaguaggaugcuagaguuuuuaaauguaaauuuuauuuuuuguguguaaggguguuuggcugcaugugugccugcaccacuuguaugucuagugucuggugcccacauaggucagaaaggggcaucagauccccagaaaccggaguuacagacaguugugagaagccaugaaauugaacuaggagccucuggaagagcagaccugcuuuuagccauuuagccaucucucuagccuccugaauaguuuugaaagcaaggauauaagggggaagaaaaagccaaagauacaguuuugugacaugagcaauuagaaggauggagcugcucuuuacuaauauauagaagaguguaaaaaagcaaguuuguugguuuguguauaggaaucaggaauagacuuuuacacaugccaaguuuaaggguucagucggacaaugggauaaacaagcaaucugauaugcagaucugcacuuagaagauaccuuuagaucucuauguucaagucuucugaaaauauuuuuaugugcaugagcacaugccucuaggggccacucuuaggaguuagauuccuaggaguuagaguugcaggugguugugagcugccagauauggguguuaggaacugaacucuggucuucuggaugacuagcaagugguuuuaaagugcuaagccgucucuccagucccucauaguuaauguguugaagaugaacaagaucauuacuaaguuaauuccagucaaggcaagaaaagcucucaggacugagcucucagacaccuuaauaaggcuagcgagaugaaagggggcugacaauacguggggagacccucaaucccaauacucacugaagcacaugaaggcacaguagcagagaacuaagugugccaaaggcugcuaaggcgaggacugagaacuaaagcuagucuaugcuuuggcaacauaaagcuaucaggaggcuuugacaacguucuguugaacaguggagaagaggcuuuaccuaacaguucuaaagagaauggaagagaagggaacagaagcagaguagcaugcacuuggagaaaacuagaguguuuaaauagagcccucugucauucucagaguuggcaaguggcuauguaacugccauuuauuucuucuugagacagggucacacuauauaguccaaguugaccuugaacuuuagaucccucugccucagucgccugaguacugagauuacaggaaaggacuacaacauugacccaaguagagacauaucaaaggcacacaagcaguagagagagccauaacuuacaagguucuuucaauaucauguaacuggauugaguucaguuugaaugacaguacauuaauuuuagaguccuuguauaggcaacuuuuaucuuuucccauugaauuuaacuuuguauagucuuggccugcuauauagucuuucuuuuauuuucugcccucuguuauuucugaauccuugcaguuccuccaagagucaauaauccgaauuuaaauaugcauaauuguaucuucucuuauuaacaauuauaauuaacaacacuaauucuggggaaaauucugugacaugcagcuaaagucuuuacucaaguucaaaaucaguucaucaguuugggcuccuuuguucuaugguuauuuagcuggguaggauuuaauuacagaauuaucuaguuuacauuucucaaaguucugaaacaguaauacaagaguugacaauaguuguugcuuucacuugauuuuacucuauaacuuuuguugucuaaaauacuaauaaaaacauuugguuaaaauaacuuacuuauaaauaaaaguaucuuaauaaacucugacauuaagaaaacaaugugcugggcaugaagguacauaccuuuagucccauguauugggagacaaagacacuaugaucuuugugagcuagccuagucuacauagacaguucuaggauagccagggcuauagaggcccugucucaaauaaaauuuaaaaaaauuaaauuuuaaaaaagaaaacaaugcauuuuuaaaacuuuuaucugcauuuauuuuaugcuaaauuuauucccaugccauaaguuuuuguugcuucaguuucuucugggauaucuuuuucuuuuugugcacccuccucuucuggcuuugagacaauuuguuccuuucagugaggaucaucucaucaaggcagggaaagcucacguauccagccauaagcucugggaguuuguccacaccuuaggugcuuuguucacaguguaugcucaacgacuggagaaucuacaucuaaauccuuaaguucagcauuacucuauggacuuuuaagcaugugcagcaaaaauucagcacucauuuuugaccaacgacccuguguccagcacuacuguuuagccugggcacaccuaccaacucuaccauuuauacugcuucuuuaaaguaacaucuuucagauacuugguuacuuuucagguaugauacccuugauggccugggcaguuuaauggauguucuuagagugaggaagauuugaccucuugauuugcaugauuuuguaggguuucuggauuaagagaguagcagaccauccucagaagucucuggccgcuuacaggaagaggaagugggaggauuacugggagaauucaugagaccucaacuucucgcaaaagaauauauucuuugagaaaagagguauggauuuuagacauacuuaaauuuauuuaauuuauauaaccaugcuguuggcgucaauguugaaaacuugaaaauucaaauacuuuagugauuauuauucaacucuuguuuuauaauaauaagaugcuuuaguauauccacaaacauuuuaccaggauacuggugaucuuuuagaugggaggagggggacaguacaauaagaauaauauagaaguagucuguucugaaaaauggauauuacaauuuugaauaaaugugauaaaauucaaacagaaacaaaauauaaaaguugcagucauaauaaugaccgaggcuagugaucuccauacauaaagacagacauagaucauuaaaaacuaaguaggaggucauagugucaugauauacuuuuauccuaaaacugaagggaacagaauaggacuaugaguuccaaggcaggcugggauaauugcaggaaucuaucuccaaauaaggaagaaaaaaaacaaaaccaaacuaaaauaaauaaaucaaggaaaauuauauaaacgacgauagauuauaaaaagugauuuuaaacacucaccucuucacagcaucgccugcuuacaauagcccuauagucaauucugucccagaguuggucccuuaacuuuaagaaauuagggaacaguuuucuccaguuuuucccuaaagcccauggaaaaauuucauacuuggcuucuucuucaucuucuucaaccguauuagccagauaccuaacaaauuggaucaacaauccaaaacagauauggguaagggcaagaacaauagauaauaauaauaaaaaagaaagacuuaccaauacauaaaggauacucauaucuaaaaugcguaacagaagcagugauacaaugaauuguauaccuuguugcaccuucuaggugucucuguaauccuauaaauuuugaacuuuguucugggaugcaaguaaguuacauugaaacaaucucucuugagguauuucugacuuuguagaugaaucuguaaacaguguucaaucuggaccuaguuagcuccuucccaaaucaagacuuuucuagacuauuuuucuuacuauuccaggaacuguggcuuuuuuacccuggcugagaaccguuuauaauuauagaugaaugacuguaagguagguauucucuuuuuuuaaacuuucuuugggcuaucuucaaacagcucccucauacacauuuggaagucaguauuuugccaaauacuugaggggaaccagacauaaaaagcagcagaaaaacacaaaccaugaggagaauaaucaaucaaagccaacccacaacugauacauaggaggacaccaaaacauuuauaacuuuuuaauauaauaauuuauccuuauuuuauguuuguuaguguuuugccugcauguguguguuugaggaugucagaucuacuggaacuggaguuacagacacaugugagcugucaugugggugcugggaacugaacucaggaucucuggaagagcagccugugcucuuaaccacugagccaucucuccacccacuuacuauaacuauccuuuauacucaaaaauguagauaaauugauacuguccuuguaguugaauaauaaaugaauaagaaacaagaaaccacacgaaaauuauaugauggcacaccauagcugaauugcucaaaaauauugauaaaaaucuuuaaaagcagucagaaaagaaagacauauuaagcuaguguguuggcacacaucucuaaucccaggacuugaggaguccagacaguggaaucaugaguucaaagcuauccuuagcuauauagugaguuugauuccagacugaggcacaugagacucuguuccacaaaacaaaaaugaggcaagauauuaauacaugaauaaaguuaauaauggaagagauucccaaucagaaacaguucaggcuccauaagucacuuuuacaacaaaaacauuccaaacacacacacacacacacacacaaacaaacaaacaaaaaaaaaaccaagacaacaugagcagagcagaacccaaaauuuaaacagaauacaaaaauaacagucuaugggcuggagagauggcuccauggugaagagugauugcugcucuugcaaaggaccuggcuucaguucccaguacccauaucuggcaccucauaccucuaacuccaacccagagaaucucacacccucuucaaaccuuuccagccaccagccuguaaaugguacauauaaacucacacauauacauauucacauacucaaauaaagauaacuaauauguuuguaaaauaagguaauuuaaaaaaaaagaaggcuaggcaagguggcacacuccuuuaaucccagcacuugggaggcagaggcaggcggauuucugaguuccaggccagccugaucuacagagugaguuccagaacagccagggccauacagggaaacccugucuuaaaaaaaaaacagguaauaaauauauaugaaaaauuaaaaauaguauacauaaaauacauaacaaauagaaaaaucaaauucguaauaguagauaaauuuaagaaauauccaaaauguagcucagagaaacaaauauacaaaauguguaacaucauggugguugccacuacauugaguacuaucaacuaucuaugugaaucuaacugcuucuuuuguauccuccaggcaaaaggcuagaaacagucauuguugccugugucagauccugaguagcaugaagcuuauauaugguucaaaguuucccauugaagauacacaagccacaagcuacccugcagcagugacaccaaacaauaauguaguuccuuaacucaggccaugacuacaagauccuucauauauacugccacuguaccacuaaccugggagcucuuuaucuuccccuccuccgaauccuaugucuacucuccuguucagaaggaaugugagcauucaggggcagagggcaagggcucuaccuucacuccuugagcccacccaguaauaccuuuccuucauguccuugaugcccagggugcagacauuguacaaagguuucuuucuuguucuuuuuguuuguuuguuagacaaggucucacuaugaugucuuggauaccuggaaccugcuguguggacuaggauggcucaaacucacagagacugagugcugggcuuaagucacgugccugugcaucugguggguguguggggugggcuaagacaggaucuuucuacaaagcucaagcuagccuggaauucccuguguaguccaagcuacaucuagggucauucuaccucagccuucugcauacugagaguguuacaggaaugggcuaucgaguguguaaauuccuagacagaaacaccuacacacauuaaaaucugucaguguuugggcaaaauaacuccaaauuauuaaacagauuuggaaagcagaaugcagcauauaacagcauauuuaauggauuucaauggaagcuaacagaggagauagggaaaacuugaaggauaguagcuagaauuuucuaaggguucuuuguugaaagguaucuuuaagucaaggaaguucaucuaauuccaaguagguucuaacaacauuuuuuaaaaggcuuaaaguuagauagaaaggaaggcuaaagaucucaagcauauuaggcaaguguuuuaccaccaacuaaauuccauuccucuuuuuaccuuuucuuuuaaggaaagaucuuucuaaguugcuuuggcuggacuugaacucauucgauaacuagguaaaggagaaagagcauguaacuaauaaaugcaggagaggaugugggaggaugaaggaguacugcuggcauggucgcaaugccugucaccucggcauuggcaggaaggaggaucaggucaagaucauccuuggcuacacagggaguuuggggccagccuaggcuacaaauacuugucucaaaagauuuuaaaaaacaacaagaagaagaaauucagguguuacaagaauacugaaagaaaaaauuacaugacuauauagaaagaaauugugagcuuuagaacuguggcuaagagaggcuuaaugaaaagagauacugagucuacauaugauuagacacaggauggaaauuauaauucagguuaccuaaaauauaauauaauacaauaugcaaugcagucuucaaagauaacuacacaguaaaagcuaaauagcacauuaauggcuauaaccacaaaacaauugaaacaaauccaauuucauacuucuacauggauuuacacuaaagccauuuuuggcuugucuuuaauucuuagguggagaaaaacuacagaauaguaugguauugaauaugguacaauauugaaacauauaaauggaaaauuaacagcauuaaggcugaguuuugcucuugagaauaucauacaugcauuucuauaucauacaugcauuugcaucucugcuuuuuuuucuugcucaggcuggccucaaacgcacgcucccaucucagcuuccuacauguugggaguauagguguauaccacaauagcuggccuccuuaauaauuucccugaccuucaaagugcuuuauugucuauaaagucaaaguauuuccuugucuauaaaacaggaauuagaaauguauuucacagccgggcguggugacgcacaccuuuaaucccagcacucaggcagaggcaggcagauuucugaguucgaggccagccuggucuacagagugaguuccaggacagccagggcuacacagagaaacccugucucgaaaaaaaccaaaaaaaaaaaaaaaagagagagagagagagagagagagagagagagagagagaaaagaaauguauuucauaagaagccuaaaugugcugggcugagguggugcaugacuuuaagcacucuggaggcagaggcagguggaucucuguggguuugaggccagccuggucuacaggaguucuaggauagccagagcuacacacagagaaacccuuucuugaagaaacaaaaaacaaaacccaagaaaacuaaaaguauaaguauauaagauguggugauuuauacauaccauucagaauuagcuauuacuauuaaauucuuccaguuuaccaaucaucaccagauguuaaauucagcucauuuuuccuauguucuggaaaaugucucucuaauuaaucauagaucaagcucuucuggccuaauuucuuuaccaauucugauucugaauuaaauagauguugaguuaaauaaaacuuauuucucaaugcugacagcuauugugauacuccaauaucguuuuauuuauucauuuuuaugcauuugagugucaugccugcauguauaucugugaaccauaugugugccuagugcccacagaggccagaagaggccaucagauucacuggauuugaugguugugcugggaauugaaccccaguccucuagaagagcagccaucuuaaaaugguugagccaaucucuccaguccccaauacugcaaugcuuuuauacaguucccuaauuuaacauuuaaaauuauguacauacauucuagcugcaucguuguauccaaguauaggguagaaaaaggauauucuuugucuuuuucauuuuugguuugggaggggggguugcuaguaacugaacccaaggcuucauguauauaagggaagcacucuacuuccuggcacaccacaaguuccaaaauguacucuuaaauuuaagcuuuccccuuauaaaaaaccaaaacaaaacaaaaacagugcugaaugaagccaggcagugguggugcacaucuuuaaucccagcacucggcaggcagaggcagguagaucucugaaguuaaggccagccuggucuagagaacagguccuaagacagccaggucuauacaaagaaacccuguuuuggggugggaggggggcagugcugaggagugaccccagagcuuacugcauacuaggcaagaauuccaucaccaaguuuuaucuccagcucugaaauuauauuuuuccuaacuaaauuaugccuauaaauuagagaagcacauuauuagaaacaauuuaacagauagcaaagcuaagacuaauuaaugugauaucaacagaaaaucuggaauauaaacaauauucaguguuugaugacaccaucagugaacauggaaguauuaaguaugcacaacuccuuuuagauacagacuacaaagaacauaugcaaaauauuuuccacaaaggcucacauuauaaaaguaagaugaugguuuuauuacauacuaacuggcaauuuaaaggaaaauaguuggagcuggagagauggcucagugguuaagagcacccucugcucuuccagagguccugaguucaaucccagcaaccacauggugacucacaaccaucuguaaugagaucugaugcccucuucuggugugucaaaagacagcuauaguguauucauauaaauaaaauaaauaaaucuuuuuuguuuuguuuuguuuuuuuccagacaggguuucccuguguagcccuggcugcccuggaacucacuuuguagaccaggcuguccuggaacucagaaauucgccuaccucugccucccaagugcugggaucaaaggcaugcaccaccacgcccagcuaauaaaucuuuuuuuuuuuuuuuaaagagaauaaucuguugcuggaugugguggcacacaccauuaaucagcacucaggaaguagaaguaguggaucucugugaguucaaggccagccuggacuacagagugaguuccaggacagccagggcuacaaugagagaucauuaaaaaaaaaaaaaaagaaacaaaacaaaaaucccaaugugugugugcaugugcuugugugugugagagaaagagagacagacagacagagacagaaagagacagagaaaguguguguguuggaggaauuuauaugagagcacuguaaaaaauguaaaagacacauuguaaccugaagugggaacaacaaaucuuuggcauguaauguaaggccaaugaaaagaacauaaaacuauccuauuaaagugaaaaauacauaauuuucccacacaagauggccuauuaacaauagccauaaaauuuuaacauuucugcuuuaaauuacaagucacauauauuaaaaugaccaauaaaacucauuuaguagaaaacauacuuacagagcaauaaagaaauuuauccugguaugcucauuuauaguaaauuuagcucucuugaaauaaacaaaggucauagccaaaagauacuacaaggaaaaguuagaaauuaguauuaaugguuugcuuucucuaauaucacugcuauaaaauaguugacuuuaacccuuaaauauuuaucuguauacagucaccugaguacuuauuuuuugguccccagaguuaauccacuugaaucguuugagcugccaauaauuacaguuaccaauaauuuauuauguuuagcuaagaggauuucuaauuuauuuuuauagcuggugcauuuuaaaacuaaaacuccauuuuuuuuucuaucuuaaauuucaaacuuauaaagaaguugaaauaguucagugaguagccaaacaucuuuuuugauuuuuguuguuguuguuguuguuguuuuguuuuuguagccaaacaucuuucauggaaauucaccaauaguuuuaaaacuguauagcaaggccuaauuuucacugagaaaacacauuuuaaaugucuuauuacaaagacacacaauuagcuuauuagaauauaugccaagaugaucuaaugguucaaauuugaaacaaguuacaaaaugaauauuguuuuucucucucauacuuauucacuaucuugaugauuccagggcuucccuucauuucugaguaaaggauuuuugaaauaauauagucaagaauucuggguuaguuacuuuucaaacacugcccccugcuguacaccaacauuaaagcacuuaaacuguacuguuugccacuguacuguuuacucaguucuaaagaaacugaguauuugauuauauaauuacuguuuauuugaaaagugauacuuuggggcuggagagauggcucaguaguuaagagcacugacugcuauugcagagguccugaguucaauucccagaaaccacaugguggcucacagcuaucugcaaugaagacugaugcucucuucuggggugucugaagagagcaauggugaauacauaaaauaaaaaaaaaaauuuaaagaaaagugauacuuugauuguuuuaaaaauuuacauuuuuggagauauaguuuuacacuuacuuauauaucuuuauuuauguauguauguuauaugucagguguggagaucagagaacaauggaagccuguucccuucuucccuuccacaugugaaaccugggaucaucuuauucaucggcuuuaccagccaaugcaguuguauguaucccaccagcaccaaauuaucaaauguuaugauaagacauuagcaugcuucagcuuuaccucaaaauaauuuacauuccagagaagaaacaagaauagucacauugauuauuuuuaagagccacauggaaggucuuuguuuuuauuauacguuguauguacuuuaauuuuccuaaauuaguuuccagaggcugcagagaugccuaagucacuaacagcacuauucuuccagagaacacaaaguuugauuccuagcacccaaaugguggcucauaacuaucuauugcccuaguuuuugggaauuuaauacucuuuuaguuuucuuucuuaauuaauuuauuuauuuauuguccucaaacaccagaagagggcaucagaacccauuacaaaugguuaugagcugagaauugaacucaagaccucugggguuuuuuuuuguuuggcuguuugguuggguguuuuguuuguuuguuuuuguuuuuuguuuuuuguuuuuuguuuuugagacaggguuucucuguguagcccuggcuguccuggaacucacucuguagaccaggcuggccucgcacucagaaaucugccugccucugccucccaagugcugggauuaaaggcgugcgccaccacugccugguuaacucaggaccucuggaagagcagucagugaucuuaagcacugagccuucuguccagccccagauuuugguuuuuauuuaugucuauguggggggggggagaugugugcacaugaguguagaagccugaggaagccggaagucaucagcugugaagcuggaguuauaggcagcucugaguuauuugauauggguacuggaaacugaacucagguccucuggaagaauaggaagugcucuuaaccauauucuccagccucccaaauuaaaaaaaaauaaacauuuuuaucuuugucacauuuaugaaauagccuucauuuugacauuuacuaugaaaucacaagcuauucuucugaacauuccuuuauuuuuauuuuaacuguuacugaacuugauauaugacugcccauuaucuaaauagguaucuacaaaaauaaaaugacaacuauucagcagacucaaaaacauagaaacaaauauugaaauauguccacaaaaaagcauuuaucaucacuauuccuaauauauuaggcaguuuaugggguuugauaucuaacagagaacaugcuaaacuaauuuuauccuguaagauuaccaggaagaggauaaugagugacaagucugaauaaaaauaaaguagaugggcaucauggcacauuccuuuaauuccaucacucuggaggcagaggcagguaaguaucuuccaguucaagucuacaagaaaaguauuaaaccagccaguguuaaauaguuaaaccaggggaaaaaagaauaauaauacacauggaucaagaugucacaaugacgggcgugguggcacacgccuuuaaucccagcacucgggaggcagaggcaggcagauuucugaguuugaggccagccuggucuacaaagugaguuccaggacagccagggcuacacagagaaacccugucucgaaaaaacaaaaacaaaaaaccaaaaugucacaaugaaauucauuucuuuguauacuaacccgaaauaggaugauccauauuuuuaaaauauuuuaaauuacguguguguguguguguguguguguguguguguguguguguaaauaugcccccuaggaucuggaguuacaaguaguuguaagcagccagaucaagcaaacuugaauucucuggaagagcaacaagggcuuuuuacugcuaaucuauauuuccauccccaaagccauuuguuuuauagaguaauucucaauuuucauuugucgauacuguuucucaaaaaauguaacagugcugaucuaaggcuuugaucuagcaguaaggaagccaacauggaauaagagauuauuuguacuauuauaaauuacagcaacagcaacuuaauaccuauuaaaauaguaauaaaauuguuuuaaaagacaauggauuuuuugacugaauuacuuaugaaauauuucacauuuacagaagacuuccuuaauggaaugagucucaagaucuuuuucuccacaccaauuaaaaguaguaauucuaaccacaauguauugaaucuagcugagcacagugauaugucuguuaacccagcucuuaggaggcuggagugacacucuacccuugcacuucccccaccgaaguaugaaaucucuauugauucuuguuuccagacaaauuugguaaaaauuaaguguaagaauucugcuuuggggccagugagaugacgcagugguaaaggcacaugcugucaagucugaugauuugaguucaauuccuaggucccucgugguggaaggagagaaccgacucugucuauaaauugucuucugacuuucacauacuggcuauggcauacaugcuaugacagacagagacacacacacauacaaauaaggauaauaaaagaauuuugcucugaagaaagaacccagguuagcuauuuuucucgcuguaaugaaggcgacaauucucacuguagcucacaaaaugcuaauggcccaguaccacgacagugaugguuuaggguuacacuguuuuuaguuuaccuugucugcaaucuugcagcagcaguccauccacaagaaaucuugaauuaaaucaucaucuauaacaaaagauaacuuugacuuaucuuuuuuaaaaagguuuccuuuugaagaaauaauuucuaaauugggacauuuaaaaguaauguuuagaaauuaaauaaagcuguuugcuaagguguaguuguuaguuuuuuaguaucuauaucauugcaaggacuaugcauuucccaucugaugauauguuuauuuauguauaugcucagcuuuaaaggagaauaauauauuuuguuuccugaguauccaacagguuguuagcucuuuguucuuuugcagugucaauuuuaagaggcagaaauggaaucuggugcaagauaauucaucuuugaagaaaugcuguucuaaggguauuauuuuucuauuacuuucuccucucaaggaacaggauuugugggggagggguggaguggaccuuuccuccuaauuccucucuagucuacuuauuauucaaacaaaaauauaaccauguauauauaaauaacuucaaauuuuacuuagauuuauaauuagcauuuaauuuugggaaaauugauuaggauugcaagaucaacaaaaucaagaauaauaucuaucccagagugguggugcaaaccuuuaaucugcacuugggaagcagaggcaggaagaucucugugaguucaaggcuggucuggucuacuccaggcuagccagugcuauauggugagaccugucucaaaacaaaaacaaaaagaaaauacaacaaagaccaacaaaaaacaaaaacaacucugguuuugauucgaaagcauuaaauagauaaucucaaaauuguugaaaacuaucagaauauaaguaaauccccuucauuuuauuaacaaggcaaaaguucuuuauguucauuuugcauguuauaaauuauaaaauuguaauuaauauuuggaaaauuguagggauaacuauugauuuuucugagaauucguuuuguuaauucuguuucuauuucacaagguagcuaaaauaguagaaucagguguuuucuuaggacagugaaaaauauucaaaaaguuugugguuaagggcuggagaugacuaacaaaauaggaauuuggcuuguugaucccaguauugguaggucaagguggaaggauagaaacucaaggucauccguggcuacauaaagaguugaaggcuagccuggccuaggugagacccuuucuaaaacaaagucaggggaguaaagaaaaguuuguggguaauaauuuuauuuuuaauuaggagaaauggaaacauguuaacauucucuauucugauggggaaaucuuuauaacuuauuuauauuccuuacauauuuuaugucauguuuuaauuuugauauucuuuauaucuuaccaaguuuguuugaaugcacauagccuucuucuauaaacaaggaggacuguggguugugugguauuauuugauuucuuaucaggaaacaucaacacuaucccuuauucuaaugucuaccuugcugccaugcaugcaaaacaggcuccuuugucugguauaaauacuacaaagaagucucuauuugucuguuaauaaauguauaaacaaaagaguccuauauaauaaaaauucaauuuaaaccucauuauaugaacaug

SEQ ID NO: 8726 - RNA, 43139 nt, Mus musculus
gcuggguaaagaugaguauuuauucacuuuacaaagagaaugguauuaaauugccauaaacagcuccauuuauagacaaauaacaacuguacaucagucgcuccagcagcuugcccaacaugcccuucccgcuucggcugggcagccugcucugccccgguggaaguccucccagagagcauucuuacagucacgggugggaaagacacgcaucugcuuaguccugcagaagggagcucuccgucugcaucccuugcugaacaccaaguuaaguuaguacuggcccacuccuuagaaacaagacaaauuacugguaauuugaaaaagcuguguagcacaccaaaauacuuauuuauacauacauaaaaaaucuugagucagauuuaucauuuugaaagauaaacagauacccuagcccugccaagagugggcaaugaaaaggaacgaaaacguuaaauuauugaauuauaaaaauaguuucuuuggaaaaaaauuccaguaauguuauuauuaauaucuaaaaccaaagagaaaaaauaaacaauuguucucugauccauuagcaauuuaaauaaaaauggaaaccucuucaaaagcagcuaggacugaaggguuacagucgcacgaugagcaggucucaucuguacacugaugagucucuacacucugcagacaagaaaccccuuaguauggcugaagcuuugcuucuuuaauuaccauuauuuuguuuuguuuaaaaaaauaucucacaugacgcuuuaaaaaauaagugguuauuuggggaagcacuccaaccacccaacuggaucugagucagaccagcauugaguggacacugggauuuuauuucuguaaaucacaaccauuuucacuuuaacuuaguuauuccuucaugaaaacgugucaaauuagacgugccggauuaagaacaauucauuagugccgcuugcauuuuggacuggaugaaagauaccaaccugagaugagaaccgacuccuuuacagcauucaguuccuuaccccuaugguaugucuguauucaccuaaaucaguuuccaacagaaccaaucauaccagaguauuauauuagaaaaauauaccauauauuggacacucaugucaguacauugcagaaagugugucuauuuacuguguaaaguuuauuaacauuugaaugaaacacucuuauuuacacaguuaaagucuggggcacucaggacaggaaggaagugugggaauugccugucaacuuggaagcauaugguggccucuuguuuucuggcacagggcaagccucccugggaggaugcuauaggcagcacugggcaaggcaagccaggccucucgugugacuggcuggcugcaucugucuucauucuucuucacucucguuuucaggaucuaaauccgaaucuccauuuaauucuuuuucacuugacacuucucuguccuccucauucucuucuuugucuuccauguccucaucuuccuccucauugucuucaucaacgcccucaucuuuuucacugucuuugucuucaucuucgucccaauuauccugguggaaauagcaaagaaaggaauuugugaagcucccugacagugaggauagaaaaacagacggagcagaagacaucacucacaucagaauccuucucuggaaccucaucgucagacuccuccucagaagacucuggaagacaacagcagaacagugcugagaccaagugugcacuggucagugaguagcucucuugcugucugcgcgguuacaucaggacacuguguggcccagacgguccuggggcuugcagucagucgcccugcuucagccaccuaggcugagauuacagguauagggcauacauguucuaaguucagcuucuaacguuacuaugacucucaacccccuuguuuuuucugaggcaggguuucucuguauagcucugccuguccuaaaauucacucuguagaccaggcugacuucaaacucagagauccgccuuccucugccuccuuagugcugggguuaaaggcgugcaccaccaccaccuggcuuauuacuccuguuuuuaaaauuuaucuuuauuuuaaaauaaaacaaaaugugcgugcauuuguguagaugccuuaaagaguagcugccagcagaaacacgaggguaccagggagcugaguuuacaagaaucuaauggggaugcugggaaugaacacacucuuuaccccugagccaucucuagccauaacauuaauauguauaugcacagaaacauuauuucaaguaucaacagccuauacaaucucaccuuaaaauauucaaucauuuuuggaccaccaaguagacaguggguguguaaauauucuacauaaaaaaaugacgggcuauauaucuaucuaaaacaacugcuucugcugcacgguuugugaccuguaacaacaacaaaaguacuauauacaggaaaacaaccuguuguuaauugaacaguuuugagaaaugaaacauucuagauuguuaccuaagcaccugggaaaugcagggaggaacaagcugaaugggcucuuguuuaaggcagcacaaagaugaaaaaccaccugcaggguggacuggaaaccugacucagccucccucaucaaguucaaaagauuuucagcauuuucaggauaaacugaaguacuucaguggcuaaaggacauuuucuuuucuuucuuuuaauuauuuucuuuauuuauuauuauauguaaguacauuguagcuguuuucagacaauccauaagaggacaucagaucucauuucggaugguugugagccaccaugugguugcugggauuugaacucaggaccuucagaagagcaguuagugcucuuaacugcugagccaucucuccagcccccuaaaggacauuuucuacucuuccagagguccugaguucaauucccagaaaccacauggugacucacaaccaucuguaaugugacuugaugcccucuucuagcaugcagauguauaugcagaaacagcauucauauacauaacauaaauaaaauuuaaaaaacaaacaaaauccacaaccauacacagaagcagucuauggaguuaaauggugucucuucaguaagucuccaccacuaggaccugaaagacuuuuacaagccagguuuaaugccaggucaaggcucgagucugguaugaauaagcagaaacacuuuauacuuaauaagguuuuuuguuuguuuguuuguuuguuuguuuguuuguuuuaaaaaaggaaagaaaagaguaaacuggcacaggauaaaguuaaggcuccauucccaguaccaacaugacagcuuacauacauacauacauacauacgugcauacauacuugaauaaauuaaucuaaaaacaacuaaggaaguagccaggcaugguagugcaugccucuaaucccagcacuugggagacagugggaggcagaucuccgggucaagccauggcucuaaaaugaaacacuguuuuucuuuuucuuuaaggcaguugauaccuaaaaauuguauuccuacacuugaucuuaaauauccugaccauguuuauuuauucuaaagaaaauaaguucuauaagccacuguaugcccacacacaugcugcugcucaguaaugagagacacuguggucaugaguuaugugugugucuccaccuggggcucuugcuaguauaucaugugcguauuacaugaugcugugcugggggaauaaaccauccccacuaaugaagaacuguucuguuuguaauuguuacaguauucuauaaauaagacuauaauggucaaaucaaugcaacucuucuuacucgaguauuuuaaagcccguuuucuccagccuuaauauacucauuugcaaagcugaggaucccccaaugauuuuauuuaugaguuaaguaucauaaugagauauuuaucucauuaaaaauuaaaauccaauuuuuaaaugugaaaauauauaaugcaauuacaaauauugcuguccaccugauauauauuuuaaugaaaaauguuuucaaaggggggccucuugguggugcuucacuuuuuuauuuuacuuuuuuacacaaacuucuugcggcugcuuccuccuucaccuuuugaaauucagugcgccauuuaaauuuucuuaagaaaaccuagcuccaagcaguaagaauccagagaacaucagaccauaccagcccauggggcccugcaagcaugcccgagcugcgcugacaucacgucaggcacuugcuucaacuccuagaagcacccaaaucaaagugggugcagggacauuccauuacaaaggacacacagacacgcacgguccccaugagcucccaccaaccuaacucugacauuuacaacaugucacuguaugaagugcuacccaaggacgcagucacuauacuuuuacacuuaggaggcuuuuaaaaggcaugaaaaguaaaguguccagugugacacagcagccuucugcaccuccugaauggucaguguucgaagcacuuccugcuaggcuguugccucugacacagccugucauggacgcugccugccaacagcccacagcccacaguucuauaggucagggcuaagucacacuucuaccccugcucaccuacaacacaaguacugugaucaucuugacucacuuaagcaagcaaaauauuaaaguauuuuagaaguuacuaacaacuuuaaaauacagggaaaauuacuggaauauagaggaauauuuuuuucuauaaacauucuacuucacguuuagacaguuucuaguauuccuaguuuugacugcugcuauaagguuuuucucuaaaaacuuucuaugaaguuacugggauauaauaauccuuuuugcuggucuugguguuuagaacacuugcugauuuguguaucaccuauuaacaacagcugacugaagauucugugucugaagacagauacaguguacucauauacauuaaaaaaaaaaaaaaaaaaaaaaaaaaaaaccacagucagcuauuggauggaucacacggcccccaauggaggagcuagagaaauuacccaaagagcuaaagggaucugcaacccuauagguggaacaacaauaugaacuaaguaguaccccggagcucuugacucuagcugcauauguaucaaaagauggccuagucggccaucacugcaaagagaggcccauuggucaugcaaacuuuauaugcuccaguacaggggaacgccagggccaaaaagugggaguggguggguaggggagugggaggggguggguaugggggaccuuugagauagcauugaaaauguaaacgaggaaaauaccuaauuaaaaaaaaaaacccauaacaaagccuaucacugcaaccaccacccuaaaacauuaauuguagaaacaacuguccacgccauuucuagaaagggaggggaagcacagacugagaggaaaccaaggccaccagccaccagccaccagccucuaggccaaccuuuaccuucuucauacaccaauuuugccuucuguccgggagaggucauuuuuuucgauuuuucugaugcuguaaccugaaagaagcaauuacaaagcaauuacaagcuucuuccaaguauagacauuaacacaccuacuuuauccuccccaacuggccucuuccauaggaaugaaggacccaaaacaaucuggaacaaacaugagacaaauauaaaagggaaagugugacucuguaaguguucagaaacugggcagugguuagacuaucuuacugcacacuguuaacuagaaacccugugacucacugcucacgguaagcucagcuaaacgcacaaugcugagucugggcauguagcucaguugaugagugcucgccugggcuuugugcaggccugcagcuggagguagaggcaggaguaaaaucucagcuacagaggcucacagccagccuggggaagaaggaaugaaaaagaggcaggguguggacugucugucacucagguaacucccgaguucaagcugggacucugacuugccaacuucuuacugaacucggucucucacuacuuggguaacucuucauuguccucaccacccccaggugggaaccccaaaccaucugauuugcucacuugcgugacgagaagaaugaguuuuccaugcagguuugagaguuucuggaaaguuuugacucugcuuuccaucagcugguagaguguucccagcugcucuacuaggucaggcaacuaggagaagacagacagacaaauaagcacuuggcaucaucagcacauucuaaagaggacacaggagccagcccuacacaagcaggugucacaaguucuagcaacagaggguuuggacacagcccagcaacaacaaacuuucaaagaaagcccuuggucuauccuggcaagaaaaucaacucaaaacacacaaaacauuagguagagcagguggcagcaugaaaucucauacauuguucaauuauuucagauaaggucaacagaggauagauauaaaaaauacuucacuacacaucccuuaagggccuuuccugacucuugcucggucggaacccagcgcaucaucuacgcuugccauaggcucugaagagccaggcacuccuccuagcugucaggacagagccauggaggacaaggugaaccucacauaccacacugcacacaccacuccuauuaaugaaucccaucaaucacacugaagaauucaacaggaauccuguagaugggaaaggaugcuauacuuugcccuuuaaauuagccuuuccuggccuuauuucugacauuugaacacaaaaccauuacugcuuguucccccuguuccagcauucugucagcacucaucccagacuuacaauagaaugugugccuguuuggaagcacuguaggaaaggagccuaagguacaauaaaauaaaggagccuaagguacaauaagcaggcaggacauuaaugagacuauacagggagaggcaagcugagcugcagugauggcucagaggcuagagccacacaaguagauccucagaaccgguauacuugucaggugggagggacagccugcauacaauuccagccucaacuggcaagucuugguuugaaugagaccuucccucaaaaauuaagguggaagaguaacaaagauuccugacaccacacacauguaaugugcacacauauagucccacauauucgaaugcauacuauagauauacauguaaaggagggggggaaccuauaacuuaauuauggaauguuucccuuaagccauauauuaaaauuuucgaggaaaauguaccauaaaugcuaagcaaauaaaauuaggauuuuuuuuaguuuaaaaaucuaacugacagccauguguggcagcucacgcuuguaaccgcaguacaaagacaggucuggccacacagcgaguuccaggccggcccaaacuacagagugagacccugccucaaacacaaaacagaacccucaggauggggcugcagagaggacucagcaguuggagggcucggauuugguuccccacacacgguggcacacagucauugcuaacuccagacccaggauagccaaugcucugcuccacaggcaucuggcauauaugcagacaaaauacucauacacagaaaauaaaauaaagaaaaacaucaauacaggccagugaaauggcacaguaaagugguuuauugguaagccugaugaccugaaucugaucaccaaaaccuacauaguagagaaagcucugcuguccuccgaccuccacaacucauaccaugggcaacccucaacacagauacaaauaaacaauuucuuuaaaauuaaaaacucaaaacauaacaaacaugcaaauauaccaaagaguccaaucuuauuauaacagaaaaaacuuauuuuccugguauuaagauuuuuccauuuacuugauauaucuaucuauguauuuauuucgguguuuugugacaugguuucucuguauaaaauagccucagcugucaugaaacucacauuauagaccaagcugaccuugaacucacagaaagucaucuuugccuccuaagugcugagguuaaaggcuugcuguaagauuuuaucuccuaccaggaggugauggugcaugccuuuaauggcagagccaggcagugcuccgcuccgugaguuccaagacagucuggucuacagagcaaauucuaagacagacagggauacggaaugagacccugucucagaaacaaaccagcaagcagcccagcagcccagcgaugaugaugaugauggugaugaauaaauaacagacucuaagcaaagggcagcuuucacaucuaacccuuacuuagccuagcuggguuguucacccucagaagacucaccguagauagguaugaugcauggaucgucagcacacacuucagccacugaaucauuaaagcagcacuagcaaagaggagaaagccaaguaaagaagauguucagggguucaaaaccaaauauaacaaacuagaacagaucagugaaggcaggcaaccaucaaacacuguaugucccaggccauuuguuccaccauagaugaauccagcagaaaugucucuaaaauauuagcgguugcagguucuacuaacaagcaagacagugcccccccuccccaucccaauuaauacuucaagacugaagaccaggcuugaccucauauaauuaauuuauaccaggacaggaacaaucauccaaacacacucaaccgacucccguuuuauagccacgcgugagcccagcucaagagcuccacacuccucccucugcuggaaccaagugugcacugcugcucuuaauuuaccuacaggacagucauucaacucaggcagucgcacacaccuuugcuaaguucuaugccaguaaguuacauaguaaggcucggugucaaacaagaagaaacuuaagucgcugaaaacagcuuaccuauugggaugucccuguaaccucuucguaagcuaaaggagagaaaauacaauuaccaucagcauugcaaagucaagcuuucuccaccaacuccccagggcaugagagcuacagaagcuauccaccuggcaaucuauuuuuacucaacacaacaaauuugaauucauuuucauaagaguaauuaccugacagaaauagagacuaggguuugaaugaaugaaugaucaauaggcaaacacacuaagaccaaauauagacuggugacugccuauaaauaugaaggccugggaaggggcguacaaggucacuacuaaagggaacaagauucuuuuuggaaugacacuaggacaaucuaugaacauaugugguccuuuugagcaacugcacuguacauaggaaagagcucacaacuucacgguauauaaacaguauguccauuuuuaagauacauaaaauguauggaaaaaugcagggaaggcaaauuuuaauuuaggacagacaauaacucaauacaugaguaaacgucucuacacuuuuaaaauguuuccuauuaaugauguaaaaauaggauauacuauuaccaaaaccacucucacaaaaauacuucaucauguuaaaaaaauauaacuacucaaauacaacuucuauuacaaagcaguucuucuucuaggcuaauauuuaauaauaagcacccaauucuauuucaguagaauuauaguuuugaaaaauaaaaaguauauugcaaauguucuuuuaaaggaaauuaaguuuucccuacuauaacuagugaccaaacacuuacacugaacucagcacagcuauggccuugaagucuacuuuccugaguuucacccaaguaacacuuggugccgcuuagugcuucugcuaaguaucccacacuccucucgucaccuagcggcucccuaccuuugcuaauacaguuaaagagagucacugaagacagggcagaacuagcucugcaggaaucaugcaaguuacuucuggugucagauguugggccaacuagguaaucuuaauauuuuccacacagugggacuaaagcacacaggauuaagaguacuccacaaacaaagggagaaagaaagacagcaaagugggcuccguuacaaucgcacacagccacacugugugcagucuucccuggcucacuuucaacagcagccguuaccucuugcaacaguggaauaacaacacgcaacgguauccucagcacaguccucuuuauuagguuuacauucuuaguuugaagcacuuucugugaaaaaauaagugacaaugaagacaggcacacuuccaauaaggacuccaccuggaaacuuaguaacaacuggaaagagaccaagguaauaaagcacuggccugacggagccgaucaaaucagaaauaaggggacacucuacaaaacgucggucucuagacacuuguuuaaaaacaagaauaugacauuagcgaugcucuccaacuuccauuuuacuaaaguagagaugucuccacagagugagcuaaaaguuucuguuucaaagaaagcucuuuuaaauugucaucauuugauaaaaauguaaaccaaucaaaugauaaauagaugcuucaaccaaagcccuuuaaggcuuucucucugggagaagccagauccaacucuggguuauagagaagaagaucaguguuccaggucagagacagaggcauuucagagaagcagaggaggaggagugggagaaaagagcccauucaauguccuuccuaaagacacugucucuaagugacagggcaccaaaggaaaacacaguuagcuuccaguuaauuccaguuccuuagaauccuuucagaauccccaucagauuuuacuugcuuauaaagaugaccuuuaaaccaacaugacuccaccgacuaccucuaaacgucacauaauuauaagauuucuuuaaucccagcacuugggaggcagacgcaggcggguuucugaguucgaggccagccuggucuacgaagugaguuccaggauagccagggcuauacagagaaacccuggcuugaaaaaccaaaaaaaaaaaacacacacacacauacauacacaaucaaucacugggaaaucgaggcauaaaauguccugaucuaauaauucuugauuaaacuaaauuucauucauucauucuuuauuucuuucuuuuaaaaauuauuuacuuuauaugaauacacuguagcugucuucagacacagcagaagaggucaucagauccuauuacagaugguugugagccaccaugcaggaccucuggaagagcagucagugcuccuaaccugagccuucucuccagcucccuaaauuucauuuucaaauaaacaauauauaaaguccaaagcaaacuaugaaauuaagcacagaggcgggcacuguaaucccagcuaccuggaggcuaagguaagaaggucacaaaugugcccaguauggccacuuaccaguauaaugucuuagcauuguuuuaaaguucuaagggaaggccacuugucuggcauauauaaggccaagggcuugauuucagcacugauuaaaaaagaaaaaggcgagaaaaaaaagcugcaaacaauccucaggccucaggcgucuaaggcuagccuggacuacacaguucuauacugacucaacaauaacaaaacaaccacagacauaacccagcuagcauacauacacccuggcuuugagcaucagcaauaaaaaacaaacaagaaaagcuuacucuacuaaaacauaaugagcugauuuaaaacuuuaucaauaaagcugaacaugugugaugauuuuaaacauuccuaaaauaaccucuauuauaaucugugaucaaaguucuaaucauccagaagcucccaaaaacaucuggauauuuauugucacuuucugucaauggcugcaaccguccacucacucaggaauccacugucuuaaugaaagcaagagaguauguaguggagcggauauagaagccagccugccgcuccuguguuuuaaaugaagccucaucacacucuuacugcugugucugccuucuuugugguuggauaaauaagccucuuggggguggggguaggggacaacacaucgcugcauauauagggcccaaagacaaaaagaugcacaaacacacacaaggagccagacaugaggcaugccuguaaucccagcauccaagaggugaaacaacauuuaugcauuuagggauauauauaaugcacuaguaaagaacuagacugugucucuagacaaaggacacauagaaaggacuaaagcaaacaaaagggagcaugauuaagaaaaacaaaaccaagaggauaucuguucaaggccaccugggcaauacagugagaccaugucuaaaucugaauggauggauguuugaauggauggauggauggguggauggguggguggaugggugaauggaggcuggggggugugccucgguugagugcuuucuuagcaugaaggaggucacacaaauucaguagaaccacauuaauucuauauccuaaaagcagggaguucaaacucaaccucaacuacaucaccaggccaaaaaaaggaagggauggagggaauaaacacgggaacaaagggaaggaaucuccucccuuuguucccguguucauucuaaacagaaugcucguguacuuguucaaucugaacagcuugggagaauggaagaggcuaguauuaauaaucagauagacaacgagccaccagaaagaugcuaauuaagauugaggccuaacuacuuggauguaaucugaaacuucaaggcagagaaaaaguuuuaauaagcuacccaauaguucuaaacuaagcuguaucagugcugggugugguggugggcacaacuuuagucgcagcccucagagggcagaggcggcagccggaucucuaguaugguuccaggauggucuaccaagcaagcucuaggacagcggaagagagagagacgcugucucaaaaacagaacagaaaccaaucagcuacagcagcuucucucgaggucacauuuaaagaaauggcucuauaagucaguuacaacuauuagaagauacuacaagaagauaacucuagcaaagagacuuuuuuccucucacaacuuuacuacacaacuaagaauaaaacauuuaaaaauaaaguauuuugucaaugugacaagcacauuuuuccaggaaacaagcaguuuaagaaaguucuauuaucucuagauucccugggacuuuuacaaucucuccuuuaaauuccacccgaacacagccacuguuuucacacgggcaugcauuuuccagagucuauuauguaaaagucucccuugucagacuuaacccuaagaguauauacuuagcaauucauccacaucaugagucucuaaguagcacaauccuugcacugauagaucuaaaaaguugucugcacuggcaauaaacauucaggugccagauucugcaagaacacacccaucagucucuuggugaauaggagcagagaagcaggugugugcauucuucauuuuuaacucaaguuguuuuucuaaaguagccauuccauuucauacuguaacagcaaggcaugguuuucagcugcuaaguauccugacaauacaaugucaucauuuuacaucuuaaacaauauauagcaaauauaacauauuuaaauaucaaugaugccaggcagugauggcacacaccuuuaaucccaguacuugggaggaagaggccagccuggucuacagaguuccaggauagccagagcuacacaguaaaacccugucucggggggaaaaaaaaaaaaaaaaaaaacucacugauuuugcuuugccuuucuguguugauuaaugucguuuaaacaacaacaacuuuuuuccaugugggcuggugaaauggcuccaaguacaaaggaucuuacuaccaagucggacaaguaaaggucaccccuaggacccacaugguggaaggacagaagcaagucccaaaguuguccucgcccuccgcaugccccugcagcacucucuaguauguacaacaagcaagugcacagcaaacaaauguaaaauuaacagucagcauuggcugcacacuccuuuguccaucugacuacuggaugcugucuguucauauugcuagugauuuuuuaaaugacaucuuguuaaagaauuuguauauauacuggguaaaaaaacucugugaugcuaagcagacaagugcagccugcagagugcugauccauagugauguucugucucacaguccuaacacugugaguugguuugcuggaauacacucuugcuacgucacaaacaggcuagcuugaaaagcacaauccuccugccucauccuucuaugugcacuauaaucuagacuaucauugucuuuuuuuugagacaggaugucucuauguaacucugacuguccuuggcuaugcacaucaggcuggccuuggucuuugccucaccucaacugcugagauuaacaaauggccccaauaccuccagcaucuaacgcgucuucaaaaacagaaguucuugcuagagauauuacccaaggagcuaaugggaacugcaacccuauagguggaacaacaauaugaacuaaccaguaccccggagcucuugucucuagcugcauaugcaucaaaagauggccuagucggccaucacugcaaagagaggcccauuggacuugccaacuuuagaugccccaguacaggggaacgccagggccaaaaagggggaguggguggguaggggauuggggggguguggauaugggggaccuuugggauagcauugaaaauguaaacgaggaaaauaccuaauaaaaaaaauuaaaaaaaaaaaagaacagaaguucuuuacuucuuuacugauaaaguguccaaaugacaauuuauuccuuugauuuuuauacccuaugauuuuuauacacauacuugcaacucaaaugaugcuuaauaauaaaacauuuuuuuaaauugccauuagcuuucguuaggugugguaacacauugugguucauuuuucaaaggccuauuuauggaugaaacaguauacaaucguuucuaagcuuuauuccacccacagaaacauaugaacagauaaaugaacacgaggggcaggcgagcauuugugggagcuuaugaaccugacagguggauuucuggccaucugcuauccugugcuagaacugguucaucuacugaggaagguuucagaucauauucacauaaccgcugguggcaggcaggcuucacugugcucaaagguacugccaaacaaaugcuuugcacagauuuucaucaaaucuuucaucaaauuugucuagguuuccaagacacauuaaacuaaaauucaccuaaaauauaucaucagaaacuacuuagaaaguaauuugagguuuuuagagcugcugguuuccucucuuuauacaaauuauaaagaaauauuagauaagcacauugaaaucuauuugaaaaucagagacagcauuuacaggucaccauuuuaaugucaucuauacugacugaacuaauacugcuaagucaggaagacaggacuuaacaaaugaaaaucacauuaaucuuaucaggcaguacuuaaagacuauuuauugcguuucaauuuuucuguguaaacugaauuuaagaggcaaaaugaguagcuucccacaagcagucaccaacuuacacagacaaauguuaauguguccuuaagucucuacagcuaaacaacaacauaaccccaacccucuucaaucuccccccagacuccuacccauugccaaggcuccaccucacugcccccucacggccaggggaaguaaguuucuggaauccagaguaaaaacucaggaacgcauuuuccuacagaaagaaauauaaauugugaucuauaaugcugaauguuauaguucggcugcacuuuauacaggcuuuugaacccaacaauucaaaauaacauuucuaugagaaaaugcauuccagguuuaagagaauuagcauacccccaugguagguuggugacugacuguauauuaccaccaagcauaacuaaccucuaacugaauugaccaaaaauuaagucacauguugcuauauaaugugacucuucauucuacaaauacagguucaacaauuccuacuuucucaauucauugaaaaucugucacaauacuuacguuuaauauuucaaaaucauugcuuucuaagcccuguguaaggaggacugcaaagcuguuugucugaaggucguccuuccuuccuuuucuaucuagguccauggcaccaaggcgcuccucgaugguagccuacagaauggaaacaucacuaaguuagccagacaaggagagggggcagcguagggugguuugcaaacaagcucagauucacaccucaggcacagaaugacauucucaacaccacaacaguacugugcaaggaaagugacaauaguucccacagucuaacaaaaaccagcuaccuaagagccacacugggaacugaagaaauagcucagaagugaaacugcucccccugagaacccucguuugauucccaacacccacaugucaacuaucguuagaacacuacuaguuccaaagaaucugaugcccuccucuggucuuuacaggcacugcaugcagaguacacagauagacauauaugcaaaacaacuauacaaauacaauuaaaauugguuugguguuuacaagaaaggcacaugcccugaacauauaaaucacaaguccucuggaaagacuaaaauaugaaaggacuggggcuggagagguggcucagcgguuaagagcacugacugcucauccagaaguccugaguucaauucccagcaaccacaugguggcucacagccaucuuuaaugggauccgaugcccuuucauggugugucugaagacaguguacucauuuaaauaaaaaaaaaauauuuuaaaagaaaaagaaaacaugaacaaucccagcaucuuacucagguacaagaacagagcugccagccugagcuucccuaacacagccccucccucccagcuauccaucagcucaaguuugucaagaagauaaagcuaucuggcaagauggcucaggcagguaaagaggucugccaccaagcccaccaaccugacuuuaaucccuggaacccaugagguggaagaaaaaacaacugcgccagguuguccucaaccucuacacacaacaggcacaccguaacacacacacacaccucaaaaaaaaaaaauaaucaauuuuuaaaaugccaaaaugcagagugauugucaugcugucucagugagcaugaccaucacaguagcagaccagcagcacauagccagccagggcugcucagacagccaagagaagaggcaucaugggaacucagcaauaugcgaaacccaaugacagucaucacagcaagcccugacuucaucgagucagucaauaccugcccagcuaugaggaaaugacaacgucugcuucuaguuaagacugggaacagaagcaagcucugcaagcuucucagaacccagcccacgaugcucccuacuucucagugcucggacccagcuaaguggucauuaccucaguacugcccaauuuccucuuguucucggccuccuugggcugggcgggcggcagcuugauuggcgcaugauguccaggaaucccgggcaccaaaacuuuugcuucagaauucauuacugguguuuuuaccugucacacacagugccaggguauauacaggaaagauguaacuuaggucuugugcuuccuacuaaugaaagcaagcagcccuccaaaggcuuuuccaucagacagugcaauaaaaugcacucacuaaaauguacgacagaaauucaagacaaacuguuaacugaauauuggcaaacuuaaaauacugguuaaaaacucaugguuuuaaagucuacaauaucucauuuagaguacaaaccaagaaaaauaaagccuaccaaauacugugugauuuuuaaaaauguucaaguuacauaucucaaauccuccagaauuaaauccuugccaaccaugcucaaacagccaagagaaaggugucaucucugagacucagacagacgcgaaaccaugaggauaucaucacagcaugaguuggcuuuccuuccuguuucauaccaaacaagguaacuacguguccacagcaagucacacucaaagcagaaugccucaaugauagucugagcagcaaggaacuccagugccacugugguugauuuuuccuguaaacauuuugcuaaccaaagcugugcucuaucaaguugggauaagcaaugcuggaaucugcuauucgcacucaauccuggaguucccugcccagaccaucaugcaccacaucaacagcacagcguggagcuuuacagugcugugucuacacgcaguccacacuucuaagugagaagcgagagaacagcagagaauaaaacgagagccagguaugguguggucaugcacacaccugaaaccccaccacugaggcugaagaaucacgaguuuuaauccagaccaaauaaacaagcuaucucagaggacaggagagaaacaaauucaucaacucaaucucacacggcagcgcucauagaauucaccauacauuuauuaauuuaaccaaaucugucauuuuaaacauaaaaccuaucaugugcucaccuugguuauagcaguuucuacuguuggagcccagcaauuugaaauaucucuuuccaaacauauaugaguaucuuuggaguucaaagccuggacaugguuuuucaaaaggagauggaagaaaaaaagauugucaaacaaagcaaacaucaauaaugcuguuuucauagaguaugucaccagucagccagucaccacugagacccaugcagcugagcacaggcacagguugaaggcccuggugcagcaugcucuuccuuguuuaugggccaccugaacguucauuuacagaaaaagggucaagguccaacauucuuauaaauaaaaauccacacauaaaacaacugaguccuacccuaaacaaguuuguucuacaagcaaguugaggacagcucugcuuacuaacaggccugcucugagaggaaucagcauguccaggcuggugcucuaggagggaacaggagccacaugcaaacuacuuacgucccagaaaaguuccaugugagcauaauguuacuauacacuacauagauauuauccuuauauuauucaaaugcugaccccccacccacccauggucaauaaaagcugacccaccaguggcugggcuagacuucugauccucacuguaaagcuugauuaaauaaaucuuagucugucucauuuacuugggagcuagccaggaucacuuuuaaaacugcuuuaacaccacaugccuggaaaguuacaaucuguaaaacccaaacagacuuuuuuuuaacaaaggcuauuauuuggaagggauuccccauauagcuagcagaugaguuuccagcagcauuuuuuucuccuugcuuaauuaagcuguuugucuacaaucaacuuuucaaaguacuucuuggauugacagacaccugaaaucccagcacccaagaggcagaaacaguagagccccuuccacauccacagccagcagucccaccuaacaagagccuguguccgugguacagagguugucuagcaugaaugaggcacucaguuuaauuauuaccguuaucaggaagaaaaaacaauguucuguaauaaacucaagagagcuuauuuggcugcccacgagccuuacuuagcaaguaaagcauuauaaaaaaucaaacuugggcuggugagauggaucaguggguaagagcacccgacugcucuuccaaagguccagaguucaaaucccagcaaccacaugguggcucacaaacaucuguaacaagaucugacgcccucuucuggaaugucugaagacagcuacaguguacuuacauauaauaaauaaauaaaucuuaaaaaaaaaagaguaacaaauauucuuuaaaaaaaagauuauuauuuuaaaaaaaaaaucaaacuuaagcacuuacuggacaagaccaagaacuugcaagucuuuacagaauauucuguaguaaaaaaaaaaugucagggcacuuccauuccauuucuauguagagaaacagugggugccaccaagggcuacugguaagaaaugcauuuuauggaacaaggcagaauucaacuggagucauuugcaugcugacccucagucaaaaccaguaugcaguagaaacaggaaacuaggacuacuuuaaaguuaguuauauagaaaacaucagauuucuuaaacaaaauaccaaaauaacacucaguaucucuugggugaaggaaaauaaaaagaauucuaaaaaaugaaaccaaccacugaaaaacaguuuaacuagaggagcauguuuauuuucucugaaguauccccaacgaggaacaaaaauaacuccuuugaaaaaucugaauuuuuguauccaaaguagcaucuacuuaccacucgcucaaugguaggcugaaaccaauuuccauacaccagcaauaaggacauuuugucuaagcaaaagcuagcugcuagaauagggauggguuuugguguuacuuucuugcccuuuccagguguugcgaucuggauugugcaauuugaagucaagggcuuuuugcaaugucuagaaauaaagggaaaguaagauuagagaauccagugacaacacaagacccugcccucaucuccacagcaccacagguagacagaaagacgcaagucucuuucaaagcuuuacaugcccuaccaacaccagcccucaaacucuuaugccccugucacauacugucagacaccaaaagaaggcuccacacacccaaguaagcucucagugcacugaaggucaggccacacacacacacacacacacacacacacacacacacacacacacacacgcacgcccuuucaguuacucucuccucaaugccucaccacucugguaccuagcuaagacugcucaaagcccuccaagcuucucaggcccugcccuguucuggcucuccugggcagccugggcagcagcugucuucucacccacacucuagaccaggaacuuuugcucuccacuaauacucuaagauauuaaucucuccuucccacgaccuuugaauugucugccacaccagcuacuucuccauccugcagccaucuguggcucacucccagcucuccuacugaugaacgucuuccugagguuucauacccaacacccaaccugcagauccuugggaaggaaacucuggucuccuaauuccugacucaggcuccucacugcaccccaaccacacauuuucucccaaugcucuaacuucgcuacccuacuucuuccuggugagcucacacugucuaucaccuaauuuaacugucucuaggcccuggacugugcaccuguucuuccuugacaucucuuuaaacuauuuucaacagcuuggacagaguaacucucuugaaccucaggcccugaagccucugcuagggggauggagaagugaagagcacuggcuacucuuuuaggacucagguuugauccccaguaccuacauggcaacucaacgguuccagggcauccaagaccuucuucuggccccaauguacaccaagcaugcuagugauacauauauaugcauggaggcaaacacccauauguaaaauaauuacaacaaaacaaacuuuaauggccuaccugugccaaagagaaaugugaaaauccucagcagccggugcuauuuacaagcuggaaagcauacccugcacacacacuacugugcuaacucaaggacuacacauggaaaugcuacucuuuaagagagcuaaauggaaggagaugcaaacuuccugagcgucuauuuuuaacccuucuugguaugcuagagaccaagcccuggcacugugcagccuaggcaagaccacaccccucgcccuccagaauguuccaucgcagugcauacugcuucccuaucagucaaacaggacagggacgcuucacccagugacaugcacaucaacacaggcaaauaaaccacgggagaaaacaagcaagucccucccaaacuuauuauuauuaccggcauucacuauauaugcaccccacgaaaagccgcucuccuaaccacaaagaaaagacacagcccaucacccccacacuugaguucuucacauagucauaugaaugugcaaccaagaauguuuucacaauaaucuaacagaacaagcaggaauacaaugcaaagcgggagguuggauuauaacacaaaagaacacagaaacaagcaggcuuuuaaacucuaauuuaaaaaccucuuacuuacccauuuaauauguguucaaaaagaugaacuugaccaucucugcaaacaacagcuaacuugacaggcuaaaagagaaacacgguugauuaauucuaggcagcuaucuaaccagucuucagguuagcucgugaacacggaacucuugcccuaacuccuuaguaacuagaauaaaaaccacuauccggggccagacagauggcucaggcaacagguagacauuuguuauacaaggacagcaacuuuaguuuagccgaccaaaaucuauauaaaaauggagagaacugacuauaaaacuguccucugaacacacagaugcauacaagcaaacaaacuugggaggguggauagcccagaccauccuagaacuaucguagagcaggcuagccuaugccucuggagugcuggauuaaaagggcacaccuucacacuuuacuugacucacacaauucuuuaacgaaaucugucucucuuacaaauuaacuguuguucuugucaagacuggaaaauaauguuuaggccaagaagguggcauaggcacaaagcagccuccaagguaaacuagagaaugaaugacucuggaaugucccagucccagcagucaggacugaugaaaacacagcuucgcauccauagaggaggugggcgcacuggcuccucuggcccccuggucugggacucccguccaucacacuuuugcuaucagcuuccugugcagagaacugaacugaaguucugaaacuuccugacaaaaucuuucuuaauauuuaguaaccaacaucuugccauuuguaucguucaaaaaaauuaaaagaauucaagaauucaaagaaugcccagcacacuaggaaacacugaaguacaggcaggguaaacaugagggcugggcuggagagauggcucagagguuaagagcacugacugcucuuccaaagguccugaguucaaaucccagguggcucacaaccuucuguaaugagaucugaugcccucuuauggggugucugaacacagcaugugauaucuagauagauagacagacagacagacagauugaucuuuggaccagggcagagauccugaguccaauuccaagcaaccacaugauggcucacaauuaucuguucagcuacaguauacucauauacauaaaacaaauaaauuaaaucuuaaaaaaaaagaaaaagaaaacaugagggcgugggaagcuuucaggauuagaccucaggaaguaaggaugcuccugaagaaaugucaguuguccuugaacagauucagucaccaaggaaaggccauccucacaucaccacauuuaagacuucccuuuccacaacuccuacgauacgucuauccccaaacuacugguaacuagccaguguucccuagaucagaaucaacgcuuuauuuuggaccuuaugacuaauuaguaauuacuacuuaaaauaauaauaagacuuagguuucuugggcuggagagauggcucagcaguuaagagcaccagagauccugaguucaauucccaacacaaccaucuguaauggggucucuucuggugaagagagcaauggagguguacucauaugaauaaaauaaauaaauaaacguuuuuuuuugaaaaaggaaaaacaaaaagacuuugaaaugcuuuuuaaagagccugugagggaccuaggaguagguucagucagcuaagugccugccacacagguguaaggaccugaguucaguccccacacccacauaaaaaaagccaugaggaucugaguucaauucuagcacccacauaaaugcaggcaugcuggcaugcgcucuuuaaucccagcacuaucaaggaagagacaaagaagacccccguggcucauuggcaguucagccagcuaaccucauuacccagcuuacauuuuguuguuacucccuaauauccaugauauuuggauuauuaagccagcauucaguaaggguauuaggugugggcuaggcacagcuuaguugguaguuugcuagcaugaacagaauccuggguuccacccuaguuccucacaaacuagacuugugguuuacaucuuuauccuugcaccuguaaguagaggcaggagcaugagacgcucacaguuauuaccguuagcaauagaguaagcugaagggagcugggaauagagaccuaccucaagacaaaacaacaaugaagaugguaauuaauugggcauucggguacaugccucuaauccuagagccugggagacugaggcaagagacugccaugaauucaaggccagccugagauacacagcagcugucaggcuaagcaggggcuauacagcaagacugccucagggcuggaacaacgacccagaggacaggaacagaaggccugagaucaaauacccagaaucaacauaaagagccagacaggauggcaugcacaccugugaccccgggacugggaaggggaagggaggaggcaggaggaugccagugauugcucaccaucacccuagcuccagcuuagugagaacaaacucuacuucuaaagauuaagcaagaauggcagagcaggauacccgauguucucgggugguucccauguguacaugggcaugugugccugcacagacacacagacauacauacacaccaaaaaguucaguaacuaaagagaaaaacuguguguggugugcaugcaugugcacagauguggugccaaagcuguuagguagcuuccucaauugcuuuccgauucauuuauuaggacaugaucucugaugaaucuuuacuucccaauugcuaggcuuacuagcagcaagcacaccugcacggcuccaacauggguucuggagauccuacacagcuaacaauuugcgcacuucuaaaaugaauucucacaccaaaccacuuaccucuucuuuguuuucugacaaagucaagucaacauagacaggcucgucugugacuguaaaagacaucacugcacucuucuccuuguucucugaccggaccugccuagauaacagaagcagccauuagguaagagaacagauuugccgagccacuaggcagucguggccugcugcccacagcacacaagccagaagggagagggagcagauucccugcaccuggagcuaugaaccugguggcucuguaaaagcagcaggaauuccuaacugcugaaccaccauuguuccagacacaaagauuuuuuuagcgugucuaaaugugugugcguucacaucgacacaagcacaauugugucaugccuaacguuuuuguaaguuugaauucacuuauauguauguauuuauuuguuuaugggguuuuguuuuuguuuuuagacaggguuucgcuacugagccuuggcuguccuggaaccugcuuuguagaccauacauaccugucuguuccuccaaagugcuaggauuaaaggcuugcaccacuacuguguggcagccaccacaacucucuaaagugguagcugaagaccaaacucaggccuuguuugcacugcaagcacuuauaaucuacacuaucuccccaggcucaaucuguacacuuauacacuuuacacucuacaucaauagagcucgguacaaauuaaaugauaaaaaaaaaguuaacaugugacugaaaagugugcuucugggguuggagucauagcucaguguuaauagcucaguguuaauagcauuugucucucuuccaaagaaccuggauuugaccuggagcacccuuguacuccaaguuaaaucagaucuagaggugcaguguaaggagaucugacacccucuuuagaccccaagcacacuaggcacgcaggccaaacacccauucacguaaaagaaaagaaaaaccagggcuggacagauggcucagcaccggcucucuuccaggacugcauuccauuucuuccagaggacuguauucaauucccagcacccacaacucauaguauuaaaauacacacacacacacacacacacacacacacacacacacacacacacacacacacacgaggacagugggccacuuacaacagucuguaacuccagucgcaagggaucugacacccucacaaagacaugcauguacagaaaacacaaaugcacauaaaauuuacaaaaaaaaagaauauuaaaaaauaugcuuuaaauuuaguucuauugagaauuuauuuccuacuaaaucuuauauuuagucuaaaagaacauuaaguuaacuuauaugcaguaaauguacaaauacuuuccuuaaaaagauguucuugugaaaauuauaaauuauuucaaaaaaacaaguugaaauuacauaaaaagcacucuuaaguucuuaauaagguccaucgaacucaaacuuaauucugcgucaauuugaguccaacaaucaaugcaauaaaccaacuaguuucucaucuauacugacaccauaggcugugacagauucuucaagagcaaagcuaaauccccaacccaaaccacuacauaccagacauuaaguaaucggucguguacggcuccagacaagaaauaaaggccuguaaucccaucagaaggcuggcucucauuaggucugauggucgugaaccuaagcgacgaaacaggugucgcauguccugugaagugcuagaggaaguuaaaucacguuuaggagacagacuagaaacagugcaaaaauaagugcuuacauuacacaucacacacagccgcggugccuacagcacagaaacaguuaaaacucacccuaacaaaacucuacuugcacuguaugccuuucccuucucaaaagaaagacacuugagcauuaaaacacaauuuagaugccucuccuaucccuacccaccacuagcuucucuccuucucaaucagccuugccugguuuuauucucuccucucaucuuuguucugcuucucuccuccccaccccugucuuuaaaauaaauaaauaaauaaauaaauaaauaaauaaauaaauaaauaaauaaaacaggacaagaucuugcuggguaagcuauguugcucugcuguccuagaacuaugcagcccagguuugccucagccucuuaagcaugggauuagaggcaugaaccaccauuugagacuugauuugguuuuuuuuuuuuuuguuguuuuacaagagaggguuucuccauguaguccuggcuguccuggaacucacucuguagaccaggcuggccgugaacucagaaauccacuugcuucugccucaugaccugauuuuaccauuucuaaaggggugcucuggugcucagacacagccaaggaacuguagguccucacguuacucucagugagucgaaaccacaauuuuaaggcaucaucacagcaccacagcuucaacaccccugagcacaacuuauuuaaaaauccuuauagcaaaucucuacaaaagguagguuacacacuaaaauacacaacuauaauuacuguauaaugaagguuuuuaaauucaaauuccacuuguuuuucucauuugaaaauguauauaaacgacugaauuaguuaaugcaaaaaaaaaaauuagauuugaaaauguuaugaauucuaucauuuauuuuuaaaaucauguuggguguauaggggcuuugccaacaugucugguuguauacugggcgcacaaagaggccaggaaagguaucagauccccuagaaccacaacauggugcggcacugaaccgaaguccucuggaaggacagcacgcacucucaaucucugagucaacucuccaguccuaauuuuauuauuuaagcaaaugacucagcagcugauaacuuuauuauauuauuucugaaaagaucucuuguagcccaggcuggccuugccacagacggucugagacucauccuccuccuuuugcuuucauugugcagccaugcauuacaauauauggcuuacugggugcuagggauuaaaccccaugccuucgugcuugauaggcaagaacucuaccaacugagccaaaacugagcccuaguuuaaucuaccuacaaauaaagaaccuaguuuuuuguuaguuuguugagacugaaucuuauuuguuaucucagcagcuagacccuuaaccuaaucccuccaucucccaaugggaaugcagaugcacguggccacauuacugcgcuugggcaaguaucuauacucugugugugugugugcgugcaugcguguguuuguuguuguugcugggcuguggugcuaggacugaacccaaagccuuauacaugugaggcaagcuuucuacuaagagcuaggauccauacucuuuugacuccaacuucuaaauacuugcuccauagaacuauaauuuuaaaaacaaugugaucaacucacucuguagacuucuuuggucuccaaaacccauaguuugauuguucgaccagcugaaaguaacaucuuuccaucugggcugauacacagggaacugacgcugcuauugucuccuuuccauuugcugaauuguggaaagaaccaaaacaccacaaugaacagaggacaacuuuaucaagaguaggaaauaacaaaagaguaagucagacauuaaguuaguaaccccagacacaccacuaggguacggccucucuaacaagguuaguccucgcuuuggcaaacacaagaagaccuccccggagguaucaggagguugguggacaaaugcugugagagaggugugugccgugugacugugagguggacugucaugcccaggagacuacucuucuggugauccuaacccuagaguccuguuggucucucucaggcuggucucuaauucccuugacaacacaaggcuucacugaaguucccaaagguuauuucuauccuagaucuaaauuaugaaauccuggcaugucuaauuuucuguauauaguaaugcugggauacgcaauggggaacccggcucuucacaaucaaauuauacauuauaaacaagagacaauacuuaaaugauuaaguaauagcuccuuuguaucaguaagaacacaaaugaaaacaaaggguauaaacaggcaguuaugagacaaauauugcugaaaagcagaaaacacucaaaccuaccaauaacaaaauaacaaaguacaaaaguccucuuuauccuuacuggcuuuuaaauguucccaauuucuuaucaauuuccaugacuguaaggcucuuuuacagugauuacucauuauguauucagcaugaugauacauacuuagagggauacugcucaagccccaguacccauauuaaaaacaaccauaauaucaaucaauucguuaaacagaacaacacuaagaaaggaaagaggacccuuaggggcuuacugaucagucuagccaaacugacaagcuccagguucaaacacaacacaacaaaaaaggcagaaagcaucugaugaagacacucugaccucccacgugugcacaagcacacaagcacacgcacacacgcacgcgcgcgcacacacacgcacgcgcacacacacacacacacacacacacacacacgaauccuucacacugccgugaaaccagaaaaacuccuaaaucugcccccauaugaagaggauaguaccaaugugcccugcaaccccugcugccaaucacaacuaaagaaaacuaacucgggcuggugagauggcucaguggguaagagcacccgacugcucuucugaagguccggaguucaaaucccagcaaccacaugguggcacacaaccaucuguaaugagaucugacuccuucuucuggaguguuugaagacagcuacaguguacuuacauauaauaaauaaauaaaucuuuuaaaaaaaaaaacuaacucuuauucugagaacuuuucaucaucauagauggccaaggcucugccuacuauacuagaguagaucuguuggcacauggaaaauacacuagaguacacuuuuaaucccagcacucaagaugccagccugaucuacacaguaaaucccugaacagccagagcaauagugagaaaaccuguccucuaaaaaagaggagggagaagagcuaaagugugucagcggccaagagcacuggcgacuccccaggacccagguucgauuccuagaacugacauggcaguucauaaccaucuacaacuccagucucagggagccgauguccucuuccagccuccaaaggcacuuccugcuugugauguacauacauacauacauaaaacauacaggcaaaaaacccagacacacacccagaaacaaaauaaacaaggaauuuuuucuuuaaaagcaaaguacuagaguagagcacacccuuuggaggaguaugacaggucacagaguaauaauccauauaaacugacaccuuaaagaucuuuaggauugcucuacagauaaagggacacacacacacacaccuaggauuucaauucugcuuuuaaacaauuucauuucaaauaccaacagaaagccaagaaucuucaacaauuugaagaaugcuuucaacaugaaaguaaggaacuacauccaacaauucaacaggcuacccucacagaaguacaaagagaaauguaacauaagaacaaacacguaagauggaaagucagagaaaauucagaauauuggaaagacaggauguuaacaccaagcaccaaugaguuuccuucaacaaauaggaagccauggugguacacaccugugugacagcagccaggaaguaagggcaggaccaccaguucaggcuucugaacacacacacaagcacaagagauacuggggccuacaacacggcucaaugggaaaagcgcaagcugccaugccuaagagccuaaauuccauccccagacccacggcggaaggaaaggagaacgaugcagguacagcuguaaacucaauuauuuuaugagauagcaguuuaguagaaaagaggucaggcauuuaucuaaccuauuuauuucuuagcuguguagcagggacacacuaggcucauguuaugacuaaguacagugguaugucugauacgcuagacaguuuugaugugaacgaucaugaacucuuaccuaucaagaggacacagaacugcaagccccccacccccacugucaagacucucccugcgucucuucuggcaagucaccagcauguaaggaugccuggcagucacagcagagcagacacugguccacgcaccuuccuuagauguagacccuccuugccaccauacacacugggucuuucuugucuuucacuauaguuguauaaaaguucuccaaaccuuuucccucuucagacccuaauuccucuaacuaaaggauacuuuuauccucuacugucuguuauucccuagggcacccgccucuaaaauuaauuuauuuacuacaaaguuagccuuuuacuuggccuuuguucuggccauaucucaaugucccuuugcccauucuuagagggcuuauccaccuuucccuauccaaacuuaucuauccuagguucacccggccaucccaacuuuaccuugaucugacaaacaaccucaugccaccucugaggcuucuuguuuucacuguguaccacuuagcuguuuuccugcgacccaacucuccuuagccuccucuagcucacuuggaugcaguaaaagcccgaauguccaauucgacucaaaguuccuggagaaccaucuacauaaccuuaugaauguauauauucccuacugggucccaaaagauucugggccgaccuccacgcccaggcauugguacucaccacuuuacuuugcaugucuguguacuccacuccacaauauacuuaucaucugaacaacuauauaagcagucauugucuugaugccacuguaugcaauucacucuguuuucaugcccaccacucuacagauuaaaaaacaaaacaaagucuuauauaauaguaugaauccuggaauuacgaaacauuuaccucaaaaccuuaguccuuaaacuaaggccuuaacuacaucuuacccauuuuaguaucccaacaucaaaaaugagguaaaccagcaagaucuuaaaaugcuaauuuucccuguuucucuguaggaaaaaccuacuucuacacccucaaaagguaccagacuaaaugucaauugcucaggauagaagugcuagcauaagauaugagccguacgagaaagaacuaguggacccaaaccauagaguccagaaacagacuucuuuaucagacagggacuggccuagcuaguuuuagguaagauaaaaacugcuuguauuauaacaaugaaaacaaaagccagaauacuauuaaugaccagauaaaagcuaucuucuuuuagucuauguauuaagcauagaaaaaccacaaauaaacaagagaucucucuugaugagauucauaugcaaagccuuuuuccguuuucaauuccaggucaucccaaauucccuaugguagauguuagaauggaaacuguacugccugccuuuuucucucacacaguaagcacuccucuauccauccagugaacaagagcacacugugacagacauugccccaagcagcuaugcuagacucucuucaaugggcugugaccugcagcagagaucugccuggccgcuggauccacccacugcccauguguuucaaggaaacauggcuagaaggacagacggccuuauuucuuccauccucgugugcaccauuccaacaguuggauucuucaccggugauaagacaaacugaagccaacuugcaaucuuccugaaguguccucucucccuucggagacaucaggaagcaguggcacucuccagaaaugugcacccaaucccauggagccacugguccucaguguuagcaaagucaacucauuuggucucagucucagcagcaacuccaagugccgccccuguucccucuaagaagcucaauggucuuccugaagcugcuaccugugccgacuugcaaguccuucugauaccuuuugacuucagccaaaguucucuguacucuaacucacaaguaggaauuaccuacuuuuacaaauaucaugcaguuuucauggaauggaauggaaagcuuucuacauagagcucgucaauaucuuggagcauuuuuaauagucucuaauaauuaguuucugucgcaucuuuuacauaaauacauaaauauacuuacuguuaauuuacugugcaacucuccucuuacuguacuauacaauaaaaugcuaccaacugccgugccaagagccaacaggucagccugguccuuuguuccuguaacuuccgauuuccuuuuuuuccuuugaugacuuuccuggaagaaaaaguaaaaauaacauuuuaacuuagcauuucaaauauacaccaaacauuaacaaugcauaaacgcuagugccugugcacuuuuuaaguuuccuggcccacguuccccccucuaaagagguaaggcagcaaacuggaucacuucauaugcucucagcacuuacaacagccccaacgguccuucuacuucuuaaacaccaacaauucuuccuaguaagucugaggaaaaucucucuucaagaaaagagauccauaccacacaugaacccacacauccaggcccaagcaacgaacucuuccauuuuucucaagcucuagccucacuuucuagagaacacagacaguuuuauauucacauacaucugagucaaccaagagcuuugaguagcagcauaagcuggucaguggcugcgugacgacuaaucugguauuuuccugcaaggucacugcgucuacugacuuugaagaccccgcuauccaucuaauggggaaaugacaucagacuuguuuauuucaaauuugauaugauacagcucaugucuguccaucagaaauaacuagugagcaggcugugguauaccaaccaucuaagcccaacacucaggagacagagguaggagaauuaguucacagccagucuuggcuacaagacagccugccucaacacuugaaaaacaaaaauuaaugacuuugcugggcaugguggcgcacgccuuuaaucccagcacucgggaggcagaggcaggcggacuucugaguucgaggccagccuggucuacaaagugagcuccaggacagccagagcuauaaagagaaaacccugucucgaaaaaccaaaaaaaaaaaaaaaaaaagacuucaacuuaagaguaccauuacaucagagcuuguggugcugaaaauucgauuuuauuaacuuccuucaggaauuuuauaaguguaugagcccacuuacaugugugugcaucaugugugccugauauccacagaggccaggagaagacauuagauccucaggggacuaaagauacagcuaguuguuaaccuccauguguguacugggaacauaacuccaauacugaggagugcuuaauggcugggcuccaacucccuucuacuaauuucuuugaccuuuccaacuuauagaaauauuuaaacuuuaguauaaggaagcccuugaaguccauucuuuuggcaugaagaaagacuaauauucuaggaaaggaacugcucuuacccaggcagggucucggcucuacaguaacagaaaccaaaaacaaacacaaauccauucaacucaagagucacuggugaagacuccagcauugccuaugcggggggggggggggggggggggggaagacaccaaggggcagaagcagcagcggcauagcgugcugccauccggacacgagucccaggcuagccuaagcuucauaagcaccucucaaaauaauuaaagcaggcagacaggugacagggagacagaugauagauagauaaaccaacugaucaaggauuucauuuuuaugaucgauaggugacagguagaugauaaguaaaucaauugaucggggauuucuuuuuaugauaggugguaagauuuuuauuuuaugugcauugguauuuugucuguauguaugucuaugugaagguacuggauccugaaguuacagacagcugugagcugcuaugugggugcugggaauugaaccugggucccuuggaagugcagucagugcucuuaaccacugagcccucucuccagccccucaaagauaucuaaagcauauuuuccuuuucucucucccuauuucuuuuuuguugucuucaaaggauacauuugaaaaauuauuuauagaacauuaauuuaaaaaaaaaaucaaaauaguuaacaaaaguaacuuuucacuuuaaacaucuuugcaaguucuuagaaauguaaccauauuaauaaauccaacagcaguuacaagaaaaaacaaauauaauauagaagucucagcuugaaacacugaaguuucugaauuagagauaugcuuagcccuuuuucaguuucaugguuuuuaaagugacucuaaauggccccaaggcacaaaugugauuucuacacaaagaacagaaacaccuauugagggguaaggggcacuaaccuaaagaguuucagauuuucgauuuucaguaaagugaaagcaaauauuguaaaaucccaaacuuccuaauucugaaacaccuuacaaucacuacugccguaccuaaguuucuccuucccaugugggcauagccccagucuccauuacaggagagcuucaagccagcccggguuaucuaaaacucugucuaaaagaaaagagcugggcauaguggcacaugucuuuaauucaagcacugacuuaggaagaaucucugugacuucaagggccaacaucaucuacauagcaaguuccagaacaggacgggauagccaggggugcauaguaaaagccuaucucaaaaaauagaacaaaaaauuuuuaaagauuuauuucauguacgagaguacacuguugcugucuucagacaccagaagaggggccaucagaucccauuacagauggcugugagccaccaugugauugcugggaacugaacucaggaccucuggaagagcaaucggugcuuuuagcugcugaaccuucucuucagcccaaauaaaauucuuuaaaaaacaaaaaacaaacauaaaaacagaccucuuuuaauauaccuauaaucccacaguuaaauccucucucucagaagguuggggggaaaucaaagaaaacuuuccuaaaauauauucacuuaauuggguggugguagcacacaccuuuaauaccagcacucaggaggcagagccaaguggaucccuuaguucaaggcagagugaucuacagaacaaguucuaaaaccagggcuacacagaaaaacagucaaauaaaauaaaauaaucuaaaccaaaucauuuacacacuaaaguuucucaaaguauaaaacaaaaauuguuccaaauaugcuuuaccacagauuuguuuuuaagggaaaaaaagguuaaacaguauuaucaaacccuuauuugucucaccuucagaccuaucucuagaagcaauaccucccacuuuaaugguacuuaacucuggugguauauguauuucauaagagugaagaaguauacaccccaucaaauuacaaauauaucaaaauacaugacuucagguuucuguacaacuucauggaucauucacuggucuacagcuaacgcuauuuaaaacacucaacccagugcuggaguagggaagauagaaagagcaugggcuacucaguuccacaccggccugagccaauaaauaaacccaucucagaaaaaagaauguuauuuggagcagggcucaggguuaaagcauuuauguagcaagcucaauuccccagcaugcgcgcgcacacacacaaaaguaaauccaacuacacauaucuacccacauucaacaugggaagaucaccagguccaccacagaucgcaucaaccaaaucaguaauuugcaugaccaaugugcccuuuaguaaaagacaauggcuuaauaaucauugccuguaugccuguauauaagugccccaagaggcaagguauauccuuugugcucuagcgauaggcauuugugagccacccaaugagggugcugagauccaaacucaagcccugugacuaggccauaagugcuuacucccaauuccuguguuaccucaccacccccaaaucuaauguuauaagaacaauuccacccaaauaguccugaauccagguuggcacuacugauuccagcuccauucuaauaccaugcucucuaaacuuuacacacacuuuuccuccagaaaucucuugcuucucuuaaguuggacuguggggcuggagagauggcucagcgcucuccagaagguccugaguucaaaucccagcaaccacaugguggcucacaaccauccgaaaugagaucugaugcccucuucugguguaucaaaaguguacuuacauguaauaauaaauaaaucuuaaaaaaaaaaaguuggacugcgcaggaccagucaauccugagcuguccaucugucagucaguuauucccucuaaagaacguaauaccgacuguacauauaaagcuuaaggaaugagaaagguuguugguucaagaaucuguaaugggagaucugcaugaaggcacuaggagugaaaagucuuuacuaacgucuuacuacuuuauuaagacugauuucuuagaguaaagagauuuccaacaugagcuaagcaagaaccaccaaaagcccaucggauccagggcaucagaaagccgaggcagccacacacgugugaugucaaaaagccacaaacugagggcaaggauuuaaaaagcauaaccgggcggcuggagagauggcucagcgguuaagaccacugaguucaacucccagcaaccacaugguggcucacaaccaucccuaaugagaucugacgcccucuucuggagugucugaaggcagcuacaguguacuuacauauaauaauaaauaaaucuuuaaaaacauaaucauaaccagacaagcagagucugacugguccugucaacaauuacacaacggcuuuucagaaugagacuguagagaguuugcauaacacauggaggcccaaacacacucagggauacaacuaaaacaugaagguuucaaaaacagaucugggcgugagacacucagcaaacagaggcaggccaaucucugaggcccauaucgucuacaaagugaguuucaaggaugcccagggcuguuccauagggaauccugucucaaaaaaaaaaaguuucacaggaaaacuuauccucaccauuccauucuaucucacgaaacacuauuaauagccugcuaaaucuacuucaugacccacuaaugcaucaaaccagccuuaaaaacugaccuuagacacugaaaauuauguucaauuauuaguaaguaguuuuaaaguccauuuuugacccauuuuaaugguauuuacucuggcauauguauuucauagauaagagugaaaauacauacaucucaucaagucacaaauauaucaaaacaaauguucuucuaccaauagaaccugaucuguaaccuuuaccuucugucuuagggcuucuauuccugcauaaacaucaugaccaagagacaagugggggaggaaaggguuuauucagcuuacacuuccacauugcuguucaucaccaaaggaagucaggacuggaacucaagcaggucaggaagcaggagcugaugcagaggccauggagggaugguccuuacuggcuugcuuccccuggcuugaucagccugcucucuuauagaacccaagacuaccagcccagagaagguaccacccacaagaaacccuacccccuugaucacuaauugagaaaaugccuuacagcuggaucucauggaggcauuuccucacaugaaauucuuuucucucugauaacuccaucuugugucaaguugacacacaaaaccagccaggacaccuuccuuugaaauauuaaguacuugagaccuccagacugucaggaauacagcugaauuguuguacuguaucuccagagaggguacugaggagagcuuaaacuuuuccuagcaauuucaccagugucucaguugugcucuaaugcauucuaauaccuaaaaugcccauccuucaguuagguccuaggcuguguuuauucauguuuccacaaagcauguggaagugaacuauggucccaacaucagacagggucagacuuccagguuuuauuaccagaggaugaagaaaaacaaguuugagagaaagauaguggguagcaacaggaucaauuucuagguggcuuaaauguguggcucuagccugcuacuagcauaacagguucaauacaaacauaaaccagagaagcgcuaaaucgaucauggcauaaacuucaagguauuaugaucauucuagaaacaggaaaaagccuuuuaaacauuuaugaaacaccacuacaaccuauuauucaagaaacacaguauaacuuuaccuuucucuacugguagaguaccaaacauuguccuuguagcaaauugcccauuccuaaaccaagggcaggacacucaauaugacuucauuccauucaauacagcacugcaugagcacaggaguccagacagaacaauaaccacuauggaccaagucucaccauaacaaucauuuauguguuauuaccucauuuaauccuaagagcucuggaagcaagaugucuacgcugggcagugguggcgcacgccuuuaaucccagcacuugggaggcagaggcaggcggaguuugaggccaaccuggucuacaaagugaguuccaggacagccagcuauacagaaaacaaacaaacaaacaaacaaacaaacacaaaaaaaaaaaaacaaaacacauaugccaccagaguaaguaccauuuaagugggagccacugcuucuagaaauaggucugaaggugagacaaauaaggauuugggggaaaaaaaaagauaguaugucuacuaaaucccauaccaaaccauaccaauguacugggaacgugggcuuuauaauaacauccauuuuaugugucacacuuuaaacacuuaaaaauguaaaacagguuuaguaugaugaucaucugaauacuuaaaauaccagggcacacaauccagugagccccaaagcggaguuugagcggcugccacaaacucuaagccacacacuaccuggaccuguaagcccaccccagcaccaagcagaccaguuaagucuaccgcugaacuggaaaaaugcugcuuccgugagucacaugcucaggaugggaacugacagcucugcagccauccaugaugaagugcaaggguaggaguucaccguguaaggggcuaggcugggauccuagugcuaccgcuuguuagugaccaaccaugccguuuagcuuccugagcccugacugcuuuucuagcucugauuuugugguacuauugauucaauccagggucuuucauaugcuaggcaaguuuucuaucuuugagcuacaucccagccuaagucuguuuacuaauucccagacauuuaguaguugcauagcagaaauggcaacauauagauaaaaagaaagugaaacuuacuggcacuugaaagcagggcuugcuggggacugcaccggcacucuggggaugcuaaccacugggcacauccaauccagcacaccacuugggaaccaggacucgggucaucuugucacauaaaguugcuuuaauuugaggagcuuuguugaaaaguuaaaguugggcuccuuuaaaaaugguuguaucccuacuguaucacaguggaugaaaaucuccaaaccgcuauuuuugaaauuuggauuuuguucugggacauagaagauuggaaaugaguaucuaauacuaucuguugaggacaaccaagaacuucaaagacacgaguuccgagucuaguuccuguuggccuuuauugaaauugcuugcuuugacauaccuuguggacuaaggacaaaaauacaagauacuaauaccacuaguaauuagcacuucacuuaaggcgcuauacacuauucuaagugauuauccucauguuauaaguagggaacaaaaaacacaauuauuacagaggcuggacuccuacuuuuacagccuggcuacaagcacuuagcuaacugcucucucuguauuucugaguguuaguaaguacucucaccacuuuacaggacuguuaaguuaaaaagaaaacuguauaaaguuaaaaaaaaaagugcagcagcucuaaugcugacaauuacauaacuuucacaaaucugauuauguuugacuuauagggccucauaucugcucuuugucaccaagaaaagcuggaauccgguaaguagcuaaccacugucacacagaguauagcaacuuagauaaaauaaauuuaugugaaaguuuacucuugggaugggaaggaguaagcuaucccaacaacuuuaacaucagugacagcaaaacgucacauauuuuaggauaccuuuuacaccgguuccagauuuuugccugccgacugccuaaccacgugcgugccgagaucuaaccgggugagucaacagugagcagcauuuaccugacagcgaaaaggauucccuaacuaagcaguuucccaacuacgagagaaaaaaaaaaaaucaccaggaccuacaucauaugcccuacucuauuucacuguaccuccgcugagaaagaagggaacuuagaaauggaaaagaguuugugggacgacgaaucccacaaccuagaggcagaagggaacacguguugaacacgcauccgagccgagggaaggggcucccggaaggaacuuaaccuagacgugcgcauuccaagugcccaaagcaaaaccaauaccgggguccgggaugcggaagcgcgagacgguccuaaagugcgcaccggguagcucugauggggacccaggccugggaagucugaggccgccccccgggggagcagaggcuucgaugaacauggcggcccagaagcagccggggugcagaccucguggagaccgcgggaucgggccgcacccucccgcagccccccucgggccaggccgcacuuugcagccgcggcgccggcccaagcgcgccgccggcccggcuccgcgccuccucucucccgggacgccccgggccacgcgcgccaggggugccacgcgccucgccgcccggcccgggaugccgcagcccggcaggagguccccguccccgucgccguccccgcucauccuaccuuggccugcagccgugcuggcgcccaggccaggcaggugcagguaccgcugaggugcgcggaaggcacguacuccuggugcagccgguuguuggcggucucccauacucgcagcugaccgucacuagaggcuaaagcgaaguaggcuugacuguccggcgagaaggcgcaggggacccccgccggggccaaggggucguagcuaccgccgccuccggccgccauugcugcucuggcuccgcggcagccacguguucgcccgggcgcaggcgcaccggcgcgggguggggccugcagggaggaaguggggcggagggaacgcugagagcccaagaaguggcuggucgugacgcaggccagcguuuagccgggcccacccuguggacgguggcucagugggguccuucuuaacuuguccugcgaaggaagcgcgaggggaagugauuugcauacuaccgagccagauccuucuuuuaaaacuacguccuaugaaacaacuagacgaaauguuuaaaagaaauauuuacuuacaucuccgagauuguaacagcuguuuccauguuucuuuagucucuucgaggacguggccaug

SEQ ID NO: 8727 - RNA, 902 nt, Mus musculus
uacuuguugguuuuuuuaaugcucagggcuuuaacaugauuagcaccacauuccagacuucugacuggggccucaguucccacagguaugucaacggggaagaaucgguguggggucaagguggacagguccugcaguggugccucggggucaugcuguaggaaaaugggccaucuggagcccaggaacguagugccaacuucuuaguuuagaaaaagugacuccagaugcagagcuuagcaauggcgcuagauaaaaauugcaggugucagaacuauacugcuuauuaaaaaaaaaaacuagaaauguuuggaaauaugguaaccuacuugaauuugaagucauacuguucugaaauguuucuucaaacugcuaacaaagcacuaacacuaacccauacucuaugcacaacaguauuccaaagccagauagcauuucuuaugccccaaagcugucugccuuuagcuuagauuuuucauaaaaugaggaucauuguaauacccuaugcauuguaaugagaauuagacuuuaacaaugccuaucgcacaguaaaagaccagcaagcucuauuuuaaauuauagaugccuucauugcucaucucuuacuaagcauuguuauauuaguuacuuuucuguugcugagauuaaaaaaacaaaacaacaaaaaacaacaacaacaaaaacccaccuaauuucacaggcaaucaugagaaagaguucauuugggcuuacaguuccagagggagaguccaucaccacaagagaagcagaggaagccgagagauuacaucuucaccugcaaacacagagagugaaugggaagggggugaggccauaaaaaccuaaaggucgccccuacugaugcacugccuccagcaagccucugccucccaaagauucua

SEQ ID NO: 8728 - RNA, 3469 nt, Mus musculus
ugagacaggguuucucuguguagcccuggcuauccuggaacucgcuuuguagaccaggcuggccucaaacucagaaauuugccugccucuuuucgugucuguuguaauucuacccugcuacaucuccuaaaaggcuccucaaagacucagcuuuguauguaguugugucaaauuaggucgcugccccuuagcacucccugccuguguguguuuugcugguuuuaccuaccguauugagugggagagagggggaggagagaaagaggaaagccguuuuuguuuguuguuuguuuuucacuucaccucaggccuggugaaaagauaaguuacugauuuuuugguuauuuuaugucacuugucaggggcaccuucuuuccaugccccaaggaaaauacaguagaauuuuccccaaaugggucccaauauuaguauccccagggaacugaccucaguaaccaaaggaacugagucucaaaacgguagaguaggucaaggcugucuuagucuccguccuugagagggcgcugcucccaagucaaauccccagggcugggaaagaaaugccugcgcuuucccacaggacucuggcagcagcuuuuugcagauagaguccgcgcggccgcagagcgccugcccauagacauggcggcgcccuccuuggcuucgcgucgcccugaccguggagcuggccggguuuugccaguucucggggacuuccugcacgucuggcauuuaaacgcgcgccgggggcggcgggaugcugcugcggaugcggagcugugugagccgcugccuacccggcgcagccugggcuccgcaguagcggagcucgagcauccuuuagucaucuaucuggggagaccuggaacucaggcuucggcuucccggcagguuugucuuuaauuuccaagguugcaguucucuugacacaauccacagcauccuucucuccaaccgggcuguggaugaaccugggacuggacugaauccagcagcuggggcagcccgggccauggugcgucugagccccgagcucugguaaggcaguaguggcggcguuguucgagcuaggcgggugccacucccgggagcuuccucccagcugucacaauguucaguuggcuggguaacgaugaucgccgcaagaaggacccugaggucuuccagacggugagcgauggacucaaaaaacucuacaagaccaagcugcugccucuggaagaguauuaccgcuuccacgaguuccacucgcccgcccuggaagaugcugauuucgacaacaagcccaugguccuguuggugggccaguacucuaccggcaagaccaccuucaucaggugagccucaucugggugcugagccuuccgggugacguggaaagucuuccauuaagggcucugaagaaaucccugugggaggccucaaaaguugauccuacuaccgagucccccauugauuccuauaugaugucccuccucaguucuuagcccuggucauuuuauuaagagucaucccuguugucugaucugggcacugaaacugaggcacagaaggaaccagacuccuaaugaagguggggauaccguaacccuccuuuugacuagaaucucuuaucucgugaagggcuugggauuaucccggggagccuuaccuuugcagccgaguuguucucauggucgcgggccuggggaugggggugaacuggagacccuggggucauuuauucuuuuaccguuuuuccuucucucugacagugcuuuuagggcugucucuuagagaagcagaauacuuuuaauaaguuucuucuuugaacuuaauaguucaauaauaauaauaauaauaauaauaauaauaauaauaauaauaauaauaaagcagcuuacagaaguagaggagauacuaagaugccucaucuggcccuugacuuugcaggugagauagcagaggugaugggaggauacgugaugguuuagagcugcacaagauggaagcagcccucggugccugugaaaaauguuagcuacgugccuguaacuuuaacagggagucuuccauuccguugaaugauagauuuugggggcugcaagcauucagagagaaagucagaaaaauccaauagcucugaagaacaggccucucucaaucuuuacugcauacagacugcaaagccaggcugcccuuuucaaagguugagggguacacauauuccaaagguuggaggcugcuuauggcccuuugggcuaagaggucacacucuuacaggugccguauccucccagagucaagggcacccaucugcagagggcuuuaaagcagcaguccucauauuucuggauuggcaucaugaucuacagagccacgugcuuugcuugucaaggagagcagcagaguugacaaccuggugacucauuuuucaguuucucgugucucccgcgcuaagcuucugggagccguguguguaccaugcuaaccuguccugucugagcagagcaccaaaucauuugucuuuguggaguggacagucuugggcugucaacuugaccugcagcuuugcaaggucaaaugauuucugaaguggggaccuggggguuguggcuuauuaacucuaauauauuuuaaacaugagacauaaauccauuguggguuuuuuuuucaccuuguuuuuaaaaaucuaaaucacuuuucuuuuaaaaaaaaaaaaaagaaagcuguagcacucucuuuagaaaacuccacggauacccuauguuuaccuguaguguugaauggauuuaacugggaacacagagggagaaucuuggauucaaagucaacccuuaauuuuauuaaacaccaauuggugccaaaugugcuucagagauaccuggguugugcacacaaguuccuuuguaucgcuguucuccacccuuuuggguuuaugccucaugggaagugugggcaaucugcaaacuguucuuggcuucgcaccgccuucccuggcccucugaucauccuuggucaugacccugaggacauuaagcuacuggaccaucuccuucccgcaguaaaggcacuuugguagcuucuggaccugagcauguccagggacuaagcucuggggaguucccagcagccaucuugcaaaaugggagggaagaaaagcaaauguguuuuaagagcagggucccccgaacacuagaaaguuuaagugccucugugugggauacccucuggauuuugccuaagucaccacaggcuguuacuagauccaagaaaguggaagagugagaugccccacauuaucccuuaucugagggaggcagaucccucuuccuucuuauccuccuaguucaaggggcccccuuccuccucauaacaauaacugaauuuagcucgugcacccaaagccguuuccccucuagagagagggcaagaguggagcgagucaaccgucagggguuuuccccaaccaaacugcacauuuuucucu

SEQ ID NO: 8729 - RNA, 970 nt, Mus musculus
cucagagcaggaaggggauaaugggcaugcagaggggcagguaguugcagaacuccuacagguagcugugaugcuugcacuuggcccagauagucaucugggugaagcccaccagggagaagagggccacugggacacacugagucaagauggcaaagccaauccaggagcgcaccucauaagugcagcugggacaggacaccaacagaaacagccaggugaaaggguucuuggagggguaugggaacuuccugguuuucgacccagccgaaggucccgaagaaccauguggauggagagguucccaagcugguagaucacaaaaacggccagugccagcuuaaccugcugaacuccauagguaggggguguguagacagggugguugauguaagaagccauccaugcagcaaagccccaauuguaggugcaguuuuugaagauguuuugcaaaggcgcgguuccgugagagaaucggugcacgaagagagucuccagcaggcauuugauguaguggaaugaguggcacaugcaggugaggggcaccaccauaugccgacuggauguaaaguuguuugugcggccauaaaugaaggguacccgguagaagagcagguagaugaaaagggggccggcauacuccaucaggaaaaccgucacccagcugaucugggcccugaggucccagaaguagagcguggcuguggugcccacaggaaguuucugcaagacaucuucaucuuucagggacuuccccuugggguccaggcggagggacuggcuggcaggauaccacuguggaugugucuuggugaaaagggucuugauuucagaaaugguggccugaggcucuaccuuguccacgaaccacagcuucucucuugucuuugcaucccgaacccccaccucauagugcuucaugguucuuccacaggauggcaccugcucugcugcagcugaguggccgccc

SEQ ID NO: 8730 - RNA, 970 nt, Mus musculus
gggcggccacucagcugcagcagagcaggugccauccuguggaagaaccaugaagcacuaugagguggggguucgggaugcaaagacaagagagaagcugugguucguggacaagguagagccucaggccaccauuucugaaaucaagacccuuuucaccaagacacauccacagugguauccugccagccagucccuccgccuggaccccaaggggaagucccugaaagaugaagaugucuugcagaaacuuccugugggcaccacagccacgcucuacuucugggaccucagggcccagaucagcugggugacgguuuuccugauggaguaugccggcccccuuuucaucuaccugcucuucuaccggguacccuucauuuauggccgcacaaacaacuuuacauccagucggcauaugguggugccccucaccugcaugugccacucauuccacuacaucaaaugccugcuggagacucucuucgugcaccgauucucucacggaaccgcgccuuugcaaaacaucuucaaaaacugcaccuacaauuggggcuuugcugcauggauggcuucuuacaucaaccacccugucuacacacccccuaccuauggaguucagcagguuaagcuggcacuggccguuuuugugaucuaccagcuugggaaccucuccauccacaugguucuucgggaccuucggcugggucgaaaaccaggaaguucccauaccccuccaagaacccuuucaccuggcuguuucuguugguguccugucccagcugcacuuaugaggugcgcuccuggauuggcuuugccaucuugacucagugugucccaguggcccucuucucccuggugggcuucacccagaugacuaucugggccaagugcaagcaucacagcuaccuguaggaguucugcaacuaccugccccucugcaugcccauuauccccuuccugcucugag

SEQ ID NO: 8731 - RNA, 4349 nt, Mus musculus
uuuuuuucuuuuuuuuuuuuuuuuuaaagauuuauuuauugauuauauguaaguacacuguagcugucuucagacacucuagaagagggagucagaucuuguuggggaugguugugagccaccaugugguugcugggauuugaacucuggaccuucggaagagcagucgggugcucuuacccacugagccaucuugccagcccccuccuucuuucuuuuugagguagggcuggucucagacucucagagaucugccugccucugucuccugagugcugagguuaaaggcaugugccaucacucccagcucaagggccuauuucuuaugugcauguuugugcaugggcacaagcgugggugugugcugaugcaggagcaugccagcuaaccuuggugucugucauuccucaguuguuauucaccuaguuuuguuuccuguuuaagacagucucugacugccuggaaccugucccuaagccaggguggcugguaaaccccagggauuugcaucuucaucucucuuuguccugggcuuuuuauuuuuguuuuuuauuuauuuugcauguuaguguguuuauuuuaucuuauuuuauuuuuagaccguggcuuuuggggcucaagcucaagccccgcuugcaaagcaacaacugccuucccagcugagcuacuccuugcccucaugacuguuuauugauuggguugauauuuuuguuuuguuuuuugaguucuuuguauauucuauuaguccucugccaagauggaaggcugucucuucgcucacuuaacuucuagcuuugcugugcagaagcuuuuuggugucaugagacccauuugcugcauuucauuauuuccugagcaaguguagcccucuuauuuaggaacaucuuccuugugcuuuuuaucagcuucauagauuuccgucuuauguggggauccuggagaguuaacggucucauuucauucuacauuuagaugcccauuguuggagacaccaucucuucuccaggaucuauuuuuagcaucuuuauaaaagaugagguggcaguaguuacacaaauuauacuggguccucuuuuuggucuauugaucaugucugugcaacuaucuuguugauuuguuauuguggcuuuggaauauacuugaagugagauguggugacacuuguaggcuaaucauuuuugcucaggauuaaugacuaucugggucuuuuguauuucagagagcgagcgagcgaaagagagagaauuucuauuucugugaaugacauuguaguuuugaugggaauuguacugguucuauugcacugaacuuauaguuucugcuaguauaugguaguauggucuuuuucacaauuucuucuaaucuauguggguggccuuucaucuucuaauguaucuuuugauuucucucuucaguguuuuguuuuggacucuugcuuccuuagguuuauuccaaaauauuguguuuuguuuuguuuguuugcuuuguuuuguuuuguuagaggcaguauugaaugguguuugcagauuucuaaacauguuuauuacuuguauguaagaaaacugcugauuaguagaaaugaaaucuaaguaagccuucaaguuacugacgccugaaguuugagccauuugccaguacugauuuaacugaggcuggaauaagccaggcauuguauguggaguuuguaccugcaucuacaggacaguguugcuuaacucauggaugcgcuaagugcaaugagguauguacacaauuuacaggugggcugcuuuugcugccguuuguaguuauuguugguucucauuguuuugagguucuccuucacucugugaacccagcuggccucucuuggugauuugccuuagcuucgccuggcuagacucagugcugugugcugaaaugcccagguauagguuuucuuuuuuuaauuuuucaaaguguaugauauuuuaauauuuucauguugaguauuuucaguuauagaaauacagauacauauguaguauuuaagcuguugcuaguuucuuacuuacgaggcacuuugcucgguuuaguauaugauaguagcuuauauauaguaaaguuacauuucauuuaacuuuuuaacugagaagccaacugcauagaauacagugguuuggacaaaugcauccuaacacauuuuaugguauugucaguacuucgugguuacagaaacuuuuaucuguuugagacugcuagcucugucucuccuccagcuuccagcuucuucuuccucacguuccuccuuucuuuucccucccccauuucuaaugacugucuugccauugccaugucuucagguucaaacaguugagcuuugaaaggaaagggguuuuguuucuuuuuuuuuuuuuuuugaguuuuagucuuucuacccaagaugaacaguacuaugaugagauauuuuuacuucucccaugaccagacuuacagcauugauuauucauggggggguggggggguugggggaggaacuuccacuaagauauacacucauuuggucagcacucucacaguaacaugauaaaacaggaggauugucuuguguuguguuuuuaaaaaagcaggaccaauuaaauuguguaucccuaggaaaauagcaguggagugauuuuauauucaggaccaugaaaauaucaagaaacaugucuuagcaccccucuuuuaaauuaauugucacagguaaucggugguagucuugcugguuaaaaugcugugaaggaugccccauuaccugauaaaguuaaagacauuuccuuuagcacugggaacacuacugaaaaauaaaaacagcugcugucauucuccuucccucucugauguguuuugcccuuggauacaaaagacuccugaaacaagagcagaagccugcuuuuauaaucuugaagaggcugcuugaggaagcugccacuuugcuuguaaagcuagcuuccagucugguuucugagaguagguaauucacuuguccuuugauguccuuagugacuuaguagaguggcccugacaacucaggagaucagaugcccacauggcuuuccugugugugaguuugcuauacauucucucuuauaguacagugcuucccauucccgccaaaucuguaucccucuuccccuuuccuuucucaccuuuguuucuguuuuucucuuugcuuugaaauacaggaaagagaaaaacucaaguaugcaauugaacuucaugcuuuuaguuggcacucaugacuuugacuuucaguucuuucucccaggagaacagcccuguuguccaccauucuaguggaaguucaucucuguguggguagggguguggggugugugugugugugugugugugugugugugagacugauugucauuuuaaauaguccuacccauucaacagaguacuggauuuaauaaaugaauuggagaggaaaaaauaauguggcuauuuacuuauuuauuuauuuugauuuuuugagacaggguuucucuguguagcccuggcuauucuggaacuugaucuauagaccaggcuggccuugaacuuagauccaucugccucugucuccuaaggaaauaauguuuuuuuaaugugcuggguuuuauuccuuacaguuaauuauauuuuaauguuuugucaaagcuuuuuaaagaauaauuuuuguagaaauguuuauaaacauguaacuauguuguaugcuucuacaauuacuaauaaaaucguuuuaaagauuauuuuugaaugagauuguuuuguguguacuacgacaaauuuugugagccuaaaacaguauuucgaucuggauuucuuuuaucccagaucagaagagauacagcuucuguuuuguuuccaucuuuaacuguggccuccuauccuuaaagaacaauguucuuuuugaaccuuauuuuuggauagguuaugccucuugccugugauguaguuucauugguuuuaaaucaguucucgaaaagagaacuaacuucuuugcagagggacuuugcauccaccgugcauuugaugagcuagucauucagcacuguguauauugggauagugggcaggcauggugucuguguuuggcaagcugcccauucauuguggucaugucuuuacgguugugugcuugguguagggucccacacauaggaaggaaauaaagcuuagauguaaaugacaagaauggugauugaugcaaaaagauuuggcccugggccgacacuguucauuuugaguguuugucugauucuuuacuuucccagaaugcccucggaaugcuguacagcaugcaagccuucucagacgggcugcuuuccuauacuaacauaugauugguaguuaauuucuuc

SEQ ID NO: 8732 - RNA, 3234 nt, Mus musculus
caccugccuuccacacagcaaugacuuuaaaagguuaaaaguaacucacgccuagaaucccagcauucgggaggaugaagcaagagaaugaauucucuuggccaaucuggguugcauauaguaaguuccagccagccaaaguuacauuguaaggcccaccucaaaaaaaccauaaagaaaaaaauguaugaugguccgccucagugucggggagcaagucaggccugccgcugccacauggggcugccucagcccugggccaggacccggccgggcagaagcacagaacugcugagugcccaccaagggaagggggaguugccacuccuccucccagucuugagccagcagcaacacaaacacgcgcuuccuaggccucccuccccagcagucagggcaucuguuaugcaccuuaagaagaaagagugcccucuugagaucagcaggaacacccugagaacgccuaugagccacggaaaggccaaaggugaugucaaggccagagccagcuacaagaaacccaccguccuuccuucagccucccuugucaaagcaucaucuagaaaaccuuuugggauccuuucuccaaauguucugugcaguaugaguggggagaguccuguggagaacagcuugaauguuaaagcaaaaaagaaugugcugucugcagccgugcaccagagggaggagggacugccugggaccugggcuauugucaaaccuggaaaaacaaaggagaaaacugcauucuuugcagcccaccaggauagcaauaggauaggcucuaugaaaauaaagaguuccugggauaucgaugggagagccacuaaaagaaggaaaaaaucaggagaucuuaagaaagcuaaguuacagcuagaaaggauaucaacacccagugcuagcagucugagccguuuguguguggucgagcacuguucugugcauuacaacagcagugcuagcagucugagccguuugugugugguugagcacuguucugugcauuacaugagugacaguggggacggugucugugcugcgaggccucugucagugauacagaugguugccuuccucgagcugaaggccacugcucugcuagcuagcuagcugcacaaaaaacugcacaaauacgccugccauugugaagauuucuggccagucccgagguauaccaccugcaccugagcccuucucugcuccagaaacuugugaagaacccaaggaacgagaaaauccggagacuggcagaucccagggugagccaguccauguccuugacauaguagccagguuguagucugagugccugaagcaccagggccagcaggaaccugggagcuugucacacaauaacaguuuccaucgaaaugcacgaaguguaggcaggguguugcucacuaaugguucucaggcuagcaacaaaagugaagagggcucugcagacacagccaacccucaggagcaccccuugcagccgguaucugugggugaagaacccuccguaacugagcaucauucuguagggaagcaggccugggauggcacuucucaaagcugucccucauugccagccgcugugagcuuccacacggacagcacagaucuagagccgggucagcaaacagcugugaagaacugcaucugggaugacguagaaaugguggaggaauuugaugaauugccuacagaugcuguccgucgcauaagaagagagcuuguaacacucacaaagcacaguccugagcagaggcaggacccgcugugcaucagcaucacugugugcacgguagagaaagaccggccagcggcuuuagacucccuugaggagccucuucccgggaugcucuuucugucaucuggacaggaccagcaagcgcacccccagcugagggaacacccagcaccagaagccucagaggccagucagccucaagaugcugcugagggcagcagugcaugugaggagaaagaugccucuguggagccgcuccucccagcagccucuccgggagggagcaccucacaggugcuugaggcagccacgugcaagaagcaggugucacaggacuuccuggagaccagguuuaagauccagcagcuucuggagccucaguaguacauggcacgccugccccaccacaucauagugaaaaucuucagguuacucccuacccugaguuuagccauucuuaaauguaccugucgcuacuucaaguccaucauugaauacuacaacaccgggccagcagauucucgguggguucgaaacccacgcuauagagaagacccuugcaagcagugcaagaaaaaguaugugaaaggggaugugucccugugccgguggcaccccaaacccuauugccaggcuuugccauaugguccuggcuacuggcugugcugccaccagucucagaagggcuuuccuggcuguaaguuaggccuucaugacaaucacugguuaccugccugccauagcuuuaaccggacaauccauaagaagucaagagggagugagauggaagaagagaacugaaguccacgugacagggaagcaagaggacugugaaacacuugggccaaccuccaggguugcgagcucgcccgguccuuccugaucucugcucagaucugacugccauugcucaggcauuuuaaacuguuucccagcuguacaagaaauuaguuccaugguuuuguaugguggugccucacauuaaaccuauccagcuguaaagaacucuugccuguuuuccuccaucaaggacauucagaggucaccaggcagucuccacagggggauccugaggugguccaacacuggcucugcacuuggagugagugaggagggaagcccacgguugagaauuaugccucagaaagaaaaccagacgccuuucccuaggccuguaugcucguucccgugaguggugacugcagaccgacaugcccugugcuguuuacaguguguauaaugguugugcuugcacagggcugugaaccugcacauuaaacccgagcgccuuuaccuguagaugagugcuuuggccccucuguaaauaacaugauuaaaauucaguaucguagacuaugaacagcugacuaaauguaaucaccacagaagacaauaucauauaauagauuaaaauguugugcauccuuuugucugguuaaaaaaauuuuuuaaaaacuucaauaaaaaaauaaacguuuuuaaaaaaaaaggaaaaaaau

SEQ ID NO: 8733 - RNA, 3234 nt, Mus musculus
auuuuuuuccuuuuuuuuuaaaaacguuuauuuuuuuauugaaguuuuuaaaaaauuuuuuuaaccagacaaaaggaugcacaacauuuuaaucuauuauaugauauugucuucuguggugauuacauuuagucagcuguucauagucuacgauacugaauuuuaaucauguuauuuacagaggggccaaagcacucaucuacagguaaaggcgcucggguuuaaugugcagguucacagcccugugcaagcacaaccauuauacacacuguaaacagcacagggcaugucggucugcagucaccacucacgggaacgagcauacaggccuagggaaaggcgucugguuuucuuucugaggcauaauucucaaccgugggcuucccuccucacucacuccaagugcagagccaguguuggaccaccucaggaucccccuguggagacugccuggugaccucugaauguccuugauggaggaaaacaggcaagaguucuuuacagcuggauagguuuaaugugaggcaccaccauacaaaaccauggaacuaauuucuuguacagcugggaaacaguuuaaaaugccugagcaauggcagucagaucugagcagagaucaggaaggaccgggcgagcucgcaacccuggagguuggcccaaguguuucacaguccucuugcuucccugucacguggacuucaguucucuucuuccaucucacucccucuugacuucuuauggauuguccgguuaaagcuauggcaggcagguaaccagugauugucaugaaggccuaacuuacagccaggaaagcccuucugagacugguggcagcacagccaguagccaggaccauauggcaaagccuggcaauaggguuuggggugccaccggcacagggacacauccccuuucacauacuuuuucuugcacugcuugcaagggucuucucuauagcguggguuucgaacccaccgagaaucugcuggcccgguguuguaguauucaaugauggacuugaaguagcgacagguacauuuaagaauggcuaaacucaggguagggaguaaccugaagauuuucacuaugaugugguggggcaggcgugccauguacuacugaggcuccagaagcugcuggaucuuaaaccuggucuccaggaaguccugugacaccugcuucuugcacguggcugccucaagcaccugugaggugcucccucccggagaggcugcugggaggagcggcuccacagaggcaucuuucuccucacaugcacugcugcccucagcagcaucuugaggcugacuggccucugaggcuucuggugcuggguguucccucagcugggggugcgcuugcugguccuguccagaugacagaaagagcaucccgggaagaggcuccucaagggagucuaaagccgcuggccggucuuucucuaccgugcacacagugaugcugaugcacagcggguccugccucugcucaggacugugcuuugugaguguuacaagcucucuucuuaugcgacggacagcaucuguaggcaauucaucaaauuccuccaccauuucuacgucaucccagaugcaguucuucacagcuguuugcugacccggcucuagaucugugcuguccguguggaagcucacagcggcuggcaaugagggacagcuuugagaagugccaucccaggccugcuucccuacagaaugaugcucaguuacggaggguucuucacccacagauaccggcugcaaggggugcuccugaggguuggcugugucugcagagcccucuucacuuuuguugcuagccugagaaccauuagugagcaacacccugccuacacuucgugcauuucgauggaaacuguuauugugugacaagcucccagguuccugcuggcccuggugcuucaggcacucagacuacaaccuggcuacuaugucaaggacauggacuggcucacccugggaucugccagucuccggauuuucucguuccuuggguucuucacaaguuucuggagcagagaagggcucaggugcaggugguauaccucgggacuggccagaaaucuucacaauggcaggcguauuugugcaguuuuuugugcagcuagcuagcuagcagagcaguggccuucagcucgaggaaggcaaccaucuguaucacugacagaggccucgcagcacagacaccguccccacugucacucauguaaugcacagaacagugcucaaccacacacaaacggcucagacugcuagcacugcuguuguaaugcacagaacagugcucgaccacacacaaacggcucagacugcuagcacuggguguugauauccuuucuagcuguaacuuagcuuucuuaagaucuccugauuuuuuccuucuuuuaguggcucucccaucgauaucccaggaacucuuuauuuucauagagccuauccuauugcuauccuggugggcugcaaagaaugcaguuuucuccuuuguuuuuccagguuugacaauagcccaggucccaggcagucccuccucccucuggugcacggcugcagacagcacauucuuuuuugcuuuaacauucaagcuguucuccacaggacucuccccacucauacugcacagaacauuuggagaaaggaucccaaaagguuuucuagaugaugcuuugacaagggaggcugaaggaaggacgguggguuucuuguagcuggcucuggccuugacaucaccuuuggccuuuccguggcucauaggcguucucaggguguuccugcugaucucaagagggcacucuuucuucuuaaggugcauaacagaugcccugacugcuggggagggaggccuaggaagcgcguguuuguguugcugcuggcucaagacugggaggaggaguggcaacucccccuucccuuggugggcacucagcaguucugugcuucugcccggccggguccuggcccagggcugaggcagccccauguggcagcggcaggccugacuugcuccccgacacugaggcggaccaucauacauuuuuuucuuuaugguuuuuuugaggugggccuuacaauguaacuuuggcuggcuggaacuuacuauaugcaacccagauuggccaagagaauucauucucuugcuucauccucccgaaugcugggauucuaggcgugaguuacuuuuaaccuuuuaaagucauugcuguguggaaggcaggug

SEQ ID NO: 8734 - RNA, 876 nt, Mus musculus
ugggaagucaggccucuuuuucgugacgccuccuaggcgcucggcugugucaaaaugaagcugaacaucuccuucccugccacuggcugucagaagcucaucgagguggaugaugagcgagcgcaagcuccgcaccuucuaugagaaacgcauggccacggaaguagccgcugaugcucuuggugaagaguggaaggguuauguggcccggaucagcgguggaaaugacaagcaagguuuucccaugaagcacgguguucugacccauggcagagugcgccugcuguugaguaaggggcauuccuguuacagacuaaggagaacuggagagaggaagcgcaagucuguucgcggaugcauuguugaagcuaaucucaguguucucaacuugguuauuguaaagaaaggagagaaggauauuccuggacugacaaauacuacugugccucaucggcugggaccuaaaagagcuaguagaauccgaaagcuuuuuaaucucuccaaagaagaucauguccgccaguauguugucaggaagcccuuaaacaaagaagguaagaagcccaggaccaaagcacccaagauucagcgucuuguuacuccacgcguccugcaacacaaacgccgacguauugcucugaagaagcaacgcacuaagaagaacaaggaggaggcugcagaauaugcuaaacuuuuggccaagagaaugaaggaagccaaagaaaagcgccaggaacagauugccaagagacguaggcuguccucucugagagcuucuacuucuaagucugaguccagucaaaaaugagucuuuaagaggaacaaauaaauaaugaccuugaaucuuaaaaaaaaaaaaaaaaaaaaaaaaacccc

SEQ ID NO: 8735 - RNA, 8423 nt, Mus musculus
gccacgcgcugcugcuccagccagcccugcguccucaacgucccaguuucuuccuucgagccccgggagugguaucggcgggaguuccgcccugcgcguggcagggaggguggugcugggcccugugcauuuccgcuaggcaaacccgagcccgcgcgacuugucugguacgcccagaggccccuucguggccagggcggcugauucccagcgguucccagcacggggcagaggaggagggcguugcgggguggaggcgagauccggaaguaggccucuaucauugcacacucugacaagccucuucauuggaacugaaccugauuuuuuuuuuacgacgccugcccuaguuucagauuuuuuuuacacuugaucuuagaagacugagaagcgauaguuccaaaucuuuuaauaaacagacaugcucauuaaugaggugcuggacacauuacaggucagccuaguguagcucauugcaaaggauuuacaugauuuuuggugggguguuguggauugcccuggggcuaauuauauuugaugucaauucuguucuccugugaggaguugugaacaaggaaugagucagcacuuaggugauuucuuguaaaccuucccaccuuaauuuguaaaauaaaggaaagcugaugauugggcagagaaagggaaaguggaguggaaagaaaggaaggagguuugagacagagaaggcagaggaggaggaagaagaaaagcagaacagaagaacauggccuggagaaaacgcaaguucuaaguggucucauagauguggaagaugguaguguagugguuguagaucugcccaaucuaggcgcacagcauguauucauacuaauugugucguguuuucauugccagagcauaauuggguuggagagauuugcuguaacaguggaguauccuccuucguuagauuugaaagaacaucuuucuuaaacuuuauguugaaacaguuacuugucagucagucacuuguaguuacaguguagcggugccuggguguggucucgcauaccuagaaucccagucugaaacaguaaugcuaagaauucugggcaagccugcgcuauuuaacaagauccuuuccaaaaaaaaaaaacuugaggcaauaaaaaauuguuuggugccuggugaugguggcccacgccuuucaucccagcacuuggaggcuguugcuaccagaagcuagagguugaauucagcaguugguuuggaaccccaugcugcuuacacaagcuucccucucaaaauacgucuuuauuuaaaggaccgaaguuguucaggcuaggacugcccuauaccacuacucaagaaaugaguauccuuuuuuuggucuuucgaaacaggguuucucuguguagcccuggcuauccuggaacuuacuuuguagaccaggcuggcuucaaacucagaaauccgccugccucugccucccaagugcgccaccacacccggcaugaguauccuucuuuaaaccaccagcaauuauguagaaacuuuaaaggcuacuauuugaaacuguuuuuaaaaucacuuuugaccaaacuauccuuuaaucagaccucuucugguuagcaugccgauacaaaucaagacacugucuuguuguugguaagggaauccagaaacuagaaugcuacauuuaaacuaaguggacuuuaguggacacuacuaaggagaauuaagcaacaguugucucuuagucuguguaacauuuuguuuguuugcuugcuuguuuuccagacagggucacacuauguagcccuggcuguccuggaacuauguagacuaaacuggccucagaucuguagagauccaucugccacucaagugcaugcauaaccuuuuuuuuuuuuuuuuuugguuuucccgagacaggguuucccuguguagcccugcuguccuggaacucacuuuauagaccaggcuggccucaaacucagaaaucugccugccucugccucccuagugcuaggauuagaggcaugcaccaccacgcccagcaagcauacacucuugaaagacauuucaaaucucacucuuuuuuuaaauauuuauuuauuuauuauauguaaguacacuguagcugucuucagacacuccagaagagagcaucagauuuuguuacagaugguugugagccaccauaugguugcugggauuugaacucaggaccuuuggaagagcagucagcaaucuuaaccgcugagccaucucaccagccccucaaaucucacucuuuaggguaacuuguuucuuuuuguaacuguuuuaaggacugagaucccaaaggcuacagguucgagacacaaguuuagguuuagaaguaauaauaaaacuggaauugagcccccaauggaggagcuagagaaagcacccaaggagcugaaggggucugcaacccuauagguggagcaacaauaugaacuaaccaguaaccccagagcucgugucucuagcugcauauguagcagaagauggccuaguuggccaucacugggaagagaggccccuggguauugcaaacuuuauaugccccaguacaggggaauaccagggccaagaagcaagaguagauggguaggggagcagggggggggggaauagggaauuuuugggauagcauuugaaauuugaaauguauauaaagaaauaucuaauaaaaaaugaaaaaaaaaaaaagcaaaacuggaauugaagccgggcacuggugacucacaccuuuauucacagcacucaggaggcagaggcagauggaucucugacuugaggccagccuggucuacagcgcgagcuccagaaacccugucccugccccacccccaaaaaaauggaauugagaggcuggggacaugguucagcaguugaaagcacuacuagcuagacuucgagaggaccaggguucaauauccaccacacacaugguggugguacacaaacauaauuucauucagaaagaaauccugcucuggacuccccuggcaccagacacucauguggugaacauacaggcagaacacccauacacauuaaagaaaaaaaaaucgccgggcgugguggcgcauaccuuuaaucccagcacucgggaggcagagggagguggauuucugaguucaaggccagccuggucuacaaagugagcuccaggacagccagggcuacacagagaaacccugucucgaaaaaccaaaaaaaaaaaaaaaaaaaaaggaaaaaaaaaucuuacaccagucuaagcuacauaauauacugaguucuaguccauccuggguuagaaaaugagauguucuuucucauucucguaaaaaaaaaaauuaagugguauagagaaaaauaaaagaaaaauaauauuggacacaacaucagcuguggcacugguguguuucugcauaugcuguugagagcaaauacucucacagaaaacaauacugauuuucauggcuaggcuguuucccuguggcagccuguggagggcuuuagccaaaccauuuugaacacagaggauugcccaaaggaaguggacaauccccacuggcagucauucugggaaggaauuuccuggaauuaaagacaaagacaaaaacaaacaaaaaagugcucaaaaauaggccugccugacacagaaagagcauuugacaaaauccaacacccauucuggaauaaaauagcuaaaaauagaagacauuucccucuacuugauaagaagauuauacagcugggugugguggcauacacuuuuaaucccagcacuugggaggcagaggcaggcagauuucugaguucaaggccagccuggacuacagaaugaguuccaggacagccagggcuacacagauaaacccugccuugaaaaaacaaaacaaaaccaaaaaaaaaaaaaaaaaaaaaaaaaaagauuauacaaaaaaaaaaaauccugaugcuuugauagcacgacugaggaaacaaugaggcugacaaaugucuuugucccccagcccuucacaucaaagccccuaaaagaaaaaaaaaugauuugacaucccucauugugcaaacacacacacacacacacacacacacacacacacacacacacaaacucuuuccuguuuccaguauuuccaaggaaauacugaauucuuuuccucaaacguuauggagaaggaaaggacagcuacucucucaauuuucaaacauaguaccuuuuuuuaaaauuuauuuuauguauaugaguacaucuuugcugucuucagacacacaagaagaggauguuggaucccauuacagaugguugugaaccaccaugugguugcugggaauugaacucagguccucuagaagagcaggcagugcucuuaacugcugagccaucucuccaggcccucaaacauaguacuuaaaguucuagaauuuacuggggggguggggaaucauugcaacugugcaugagaaggaaaugagaagcagagaggggcaguuucucacucuuccucuuuguucuugugcagcccuacugagaaccaggcagagagggaacccagaaaguccagacggguugcugauuagcacacggugagugaagaaagacacacuagcccagugguucucagccuucuuggugcuccucauuuugcgguaaaccucaaccauaaaauuauuucguugcuacuacauaacuguaauuuugcugcuguuaugaaucauaaugcaaauacccauguuuuccaacaauguuaggcaaugccugggaaagagucauuugacccagcaggagucaugacccacaaguugagaaccacugcacuagggacagaagacauagcuugcugguuaagagcauucuacuccacuacuuccacuggaccagaauuugauacuuagccauaugacaaauaacugucuauaacuccagcuccagaggauccaaugccccuuucugaccuugggcaccuucacacacacacacuaaaaagcuuaaaagugaagcuagaaagaugaucagugguuaagagcacuggcuccccuuacagagguugcagguuugauucccagcauccaugugguguccgcagacaucuguuaacuccagaaccagcgaaucugaugcccucuucuggcaccuucgggaacuacacacaugagguaaacagacaaaauauguaggcaaacacccauauacauaaaaaaucuaaaagaaugguuuuucucaauuuaaaagaggcacccgguuaugaacuuuacaccauacacauagcuaaaagaguuuuuuuaugugaaagaggcucacuaauuaugaacuuuacagaguaaagcuuccacuccuucugauucacacacacacacaaagaagcccuguagaugcacaaggcacaugggcaagacccgagguuuaaucucuagcacagcagagagaugcagacuaugauguugauaacuaguaagagggacucuggaauguaaacuagaaucugggcagacugaaaauuaccacagaaaaaacuaacagaacacacauauauaaacuauugagccaugcauaaacacuauauuuaaaaaugguucgggugagauggcucaguggguaagagcacccgacugcucuuccaaagguccagaguucaaaucccagcaaccacaugguggcucacaaccauccguaacgagaucugacucccucuucuggagugucugaagacagcuacaauguacuuacauauaauaaauaaauaaaucuuuuaaaaaaaugguucaugagggcuagagagaugacucagagguuaagagcacugacugcucuuccagagguccugaguucaaaucccagcaaucacaugguggcucacaaccaucuguaaugagaucuggugcccucuucuggacugcagccauauaugcaggcagaaugcuguauacauaaugaauaaauaaaucuuaaaauaaaguuuaagaaaaugguuggugauaauaaaaacaucucuagggcuggcaagaugguucaguaagauuguuugccaccaagucuaaagacaugaguucaguuccauaacuuuuauuguuaggagagaaccaaauccuauaaguucuuucucucucucuagcucacucgcucccacgaucucacucucucucucucucucucucacucuauugcgcacacacacacacacacacacacacacacacacacacacacaccagcacuugggaaguagaggcaggcaaucuaguuuaaauaaugaguuccaggucaagaaacuaccaaauauagacuaucaccaugugccuugguugucuccuauaacauaaagguaagguccaauuuuuuuaagacuucguagagaagguaagugugggaugcgaaccaaaacugaucugucuacaaggcuuggggagccuuguggaaaagagggaagcaacaguacaagagcuagaggcaaagauuucugcuagcuagugucuucccagacaccacagaugcugcgccugggaaauuccaacaauaugcuugcuuagacaagaccaaggagaaauguuuuuuuuccuaacaaagaugguccagcaacuguucauauuuccugaaccuucuccccauuguacagauuagccaacagaaucagacaugaagucauccaguucccaccaguggucggagaugcagacaacacuuacaucagggauaaaaggcagaagccaucucacucccucaccacuuacuaacauaaccacuuacuaaccuaaccacuuacuaaccuaaccacuuacuaaccuaaccacuuacuaaccuaaccacuuacuaaccuaacccaguuuggguuuugguacaccuguuguuguugcuguuguuguugcuguuguuguugcuguuguugcugcugcugcugcuguuguuguuuguaacgagaaucgccuuugaagcuaccuuccuucuguuugugucccugagugccacagugaauucucuauuucuaaccaccaguguacguagucuaaggccuuaccaccuugaauaacaucaguggacaugccaugccaauucagauugggggaguuccacaaggccccauuuguagaugaagugcuacaggcaaucaaagguugcugaaagagggggaauugggcuucuucagggacaagacccuugauaaauaaauuaucgcaucccaaauauacagccauaaacuaaaugggcucuguagguuuguguguguguguguguguguguguguguguguguguguguguguguguguguaaaacauaucauuagauagauagauagauagauagauagauagauagauagauagauagauagauagagauagauagauaaugauauguguuacaauaacaauuauacaagaagaagaggucaugaacuugacaggaaauggagagagguagaaaauuuguuuuggugaugugguggauugguuucaagacaggguuucucuguauagaccugucuaucauggaauucauucuguagacuaaguuggccucugacucagagauccaucugccgauuucugcuuccccaaagcuggaauuaaaggaaugcccuaccauacccuucagaaaagauuuaaaugcaguaaguauguaugaaauucucaaaaaaaaaagcacaaaaaaauuuaaauuaaaauaauaauaaugcaaccgggcagugguggcgcacgccuuuaaucccagcauuugggaggcagaggcaaguggauuucuuguuuuguuuugguuuuuuuuuuguuuuuuuguuuuguuuuguuuuguuuuuguuuuuuuuuuuuuugagacaggguuucucuguauagccuuggcuguucuggaacucacuuuguagaccaggcuggccucgaacucagaaauccgccugccucugccucccgagugcugggauuaaaggugugugucaccacacccggcuagcagguggauuucugaguuuaaggccagccuggucuacagagugaguuccaaaacagccgggacggcacagagaaauccugucucagaaaaccaauaaauaaugcaaacugacugacagugaccccuguacucacuacacucaggaaggugagacagaaagauugcaaugaguuuggggcuagauaauuguuagccaggaccauguugauuuguaaagcucuuuuauaaacuugucuuuccagauucagauccuguacacgugucccaggcuaccagacucccucccuuccccugccaaccaggaaccagccugacuacaauuacuuacuauggaaugcccaucagucacaugguauagagccagcucccuccucugaaauguauaagaagggacauuauugugccacaugggccuacacucccuucaggguacccacaguugucuuucagucaaucaaaauugucaacucgauuaauaaaucuuugacccgaag

SEQ ID NO: 8736 - RNA, 175481 nt, Mus musculus
cgcaugcuccacccccugggcuccggccccuccuuuggugcggcccucucuccccucccccgccagccugcgagcucgcuuggccuggccggccuggcgggcgacguucccugugcgugcaggcgcuugacuucacuuccggcuaacgcgcuccgcuuugcccccuggccccggauggugacuggcuguggugcugcaccucccgggacugucacugagcggcuucccagugugauugugcugagcgcaggccggaagauggcggcugcggcugcggaggccucgggcccgagcugcuccuccgcggcggcggcggcaggggcgggggcggccggggucuccgaguggcuggugcugcgggauggcugcaugcgcugcgacgccgacgggcugcacagccucuccuaccacccggcgcuuaacgccauccuggccgucaccagccgcgggaccaucaaagucaucgacggcacguccggggccacccuucaggccucggcgcucagcggugagcgcggcacgccgggcgggggcugggcugggccggccgcgggcggagacggguuguggggaugcugguggaggaagccucccagccuccgggaucgggaucggccucggagggacagcguggagcgggagggucggagaggcccggaagcuacggccgaggaccuucggacucggaaagcagcagcuuuuggggacgggaacucgguuuggcggggugcgcugcgaguugcuuuucgggccuuuugcaucugaaccggccugguccugugggagagauguggaggccuuggaggucggugcuggugaggaccgggcccucgcuggccucuuggacgagauuuugggcuagcuccgggcuggaccagagggaagggcuggcagucuuggcgguggcgggagagauggguggccggaggcaaggggcgggaagcguccaagccggcugucuugcccucuuuucccggcgaguagcggcccgccgguugucgucugguccuguaggugcggggaccuccgaggguugcgcuuucgcacagggggcgggcuggagugggcacugggauggggaggucaguaggagagggaaggccagcugccugaacugugcuugcuggacuaugggacucgcagagugcaaaaaaaaaaaaaaaaaaaaaaaagaaaaaaaaaagguuaguaucgguccucuagcucugagugcucccuccuuccagugucaagaagccuaggccccuuguaauuagguggaacuucaagcccuuucaacuuguuuuagcauagagagcuagagauugguaguuguaaguaugucugggucuccuccaccuuggaaggagagcacuugggugguggagacguugguucacauauuggacuuucaggauguaccaggucaaagcucguucaguggacauacuggaguguuuugggauagcccuagcuaaguuauuugcugagaugacauuucauuuguggaugaauggugucuuaauuuuggcguuaaagguuaaaauuuagaauuugauguauuaguggguuuuaaacucaugcacagagauaaauuguaucgaagugcacuuagccaaauggaaguaauuauguguucuaccaauucaccuuguguuauuuuacacagacauacacgaauaaguuuacugugugaguaaugucauaagauuaaauggcaguauaggaauacaaagaugaaauuagagauguuaauuuuuguugacuuaugaaagaacugguuauguauaguuacagcauguaaaccuguaauauauuuaagagaugccuaagagaaaguuuuugguggugguaggcuuguaaauuucccuuuucuuggcuuagguaaaugacaauaccgaugguccagaugcagcagcaaugcuugcuuacugcaacuggacauaacagguugucagcugugucugagagggagauguucaugaacaggugacucuuuaauggaaaggaauuaaaaauaaugguccuguaguccccuacuugccauaagaaauaaaaacauugcaaauacacaggguaaaccccuggcuccugaguuacauuucacugacucuauucuuccuuuccccugaguuaaauguggucgugucacuuucauacauguuauacuuuuaaccaauuacccaauaguuucaugauuucuaauuuaggacgaguggugucuuuuucuuucauugguugguuuuguuuuuguuuuuagacaggaaauuauguuugauggcuggccucaaacaggagcuccaccuacaucuguccccaaaguguuaggcuuaagagagugagccaguacuccaggcuuggauuuguuuuccuuuauuuuauuuguauuuguguauaugagugugugaguguuugacaugagugugcaggcguccauagaaguaggaagaguguauggguccccuggagcuugugagugucugaccugaguguuuggacuggagcuccgauucucugggaaagcagcaaacucuucaaggaugaguccuuuguccagccugaguguuagcauuucuacaaaaaguuuuauuaacaagagugcaggaguugcagggcguggugguccaagccuuuaaucccagcacuugggagucagaggcagguggauuucugaguuuaaggccagcuuggucuacaaagugaguuccaggacagucagggcuauacagagaaacccugucucgcaaaaaccaaaaaaagaaagaaagaaagaguacaggaguuuuaaauaguuuaauugggauguuuuugugucugcaggccauguucuagaacaauauguacaucuauguuuauuuaaaugguuuuauauuuaccugcuguauacaggaaggaaauguucaccuuaguguuaaaggaggaagguugaagguguaugauaugaaugcaaaaauaguuguauuagacagcagugaagaauauguacuuguauaaggucaugcauaaggacugaguaugugguuacaacuguguagcuccagagauggcuuagugucuaacacaacaccacaugcugcuuuuccaguggaccugaguuagcuuucuagugucugucucuuuuguggguguuuuuuuuuuuuuuuuugucuuucucugacacacacacagacacacacacagacacacacacacacacacacacacacacacagaggaaaguuuagggcuaacaauaaaaggacuguaggaaagcaguuggaaguaaccguugaccaauucugaagcauuuuacauaugcaaacuaaaguuucuuaugaauuaugcuuaacagaggcuguaggauuuuugugugugaaugaugggugcaggggcgaugcauuccacgguuaaccuggaauaguuauuuuguagguaacaguucuaagaaauagcaaauaacuacuuugaccaugguucuaauaaagcuccuuuuuuucaauucaagggaagugaacugccuucuuuucuguacuagagaaugaugccuuugucugaggggauaaauaauuagguaaccauauggaauuuuauuagguuacaguaauaauauucggauucaguuuguagagguuguggguagcuuguuaguguagacuggaaguuaaagaauuggaguaggauuuacauagaguuucugaguuugauaaucuucccacccccagauaggguuucucuguguagccuugacuguccugguacucacucuguagaccagggaggccuugaacuaggagauccacccaccucugcuuccaccuccugaguguggugauaauuuuuaaacugucucuggaucuguguuuucaaauuaccuguaucugauacaaagucuguauaaauagacuuuuaccagauuaagaguugucaggaaccuuuagucccaguuggauuucugaguucgaggccagccuggucuacagagugaguuccaggacagccaggguuauacagagaaacccugucucaaaaggaaaaaaaaaaaaaaccaaaccaaaaaaccaaaacaaaacugagugaguuugaggacaucuaaggcuucauagagaaauccugucuuuauuuauuuauuuauuuauuuauuuauuuauuuauuuauuauauguaaguacauuguagcugucuucagacacuccagaagaaggagucagaucucguuacagaugguugugagccaccacgugguugcugggauuugaacuccggaccuucugaagagcagucgggugcucuuacccacugagccaucuuaccagcccgagaaauucugucuuaaaaaaagaaaccccccccccccaaaaaaaaaaaguuaguauuguggaaacuaaguauggugaccuuaaccuagcauucaggaagguaaagucagccuggucuacauagugaguuauagaccagacagugauaacauagagagaccaucuuaaaaaguauucuggggacuggagagauggcccagaagcucaauagcgggugcuucuuagaggacccagguaugguucccagcauggugguuuauaacuaucucuaaaucuaguuguugcaggggaucugauacccucuucuguccuuugugggcuguguacacugugcugcacuuccauucaugcgggcaaaaugcucauguauuaaaaccuuaagguuuuggagaguuuggcggaugauccauuggcauucagcuaaccacccccccucccauccccagcucuucuccagucuuuugccaugucuaguuaauuuugugaaguggacuuauuuuucuucuuuuucuuuuuccuuuuccuuuucuuuuucuuucuuucaguuuuucaagacaggauuucucuguguguaggucuggcuauucuggaauucauucuguagaccagggugacuaugacuucccaugacuucccaugacuucccaugacucccaagugcugagaucaaaggcgugcgccaccacacccggcuuaauuuucucuucuuugcucuuucuuagaauguuccucuaguuaacuaaaauuuuuuaaaaaguuuuuuuuuuuuuaagauuuauuuauuuuuuuauuuagaugaguauacugaagcugacuucagacacacuagaggagggcaucagauccuauuauagaugguugugagccaccacaugguggcugagaauugaacccagguccucuggaagggcaaccagugcuuuuaacugcugcugagccaucucuccagcccugccuaaucuuaaucuuaacucaagauuugucugguuuuguuuuguguuagaguauuacucuagcccuggcuucccaaauguugggauuuuaaaugugagcuaccauaccuuaccccuacucagauuuuaagaccugaacauagcuuagcuuggagauccuguuagucagaaaagguggugccucagcuguauaggaagaauuccagcuucugauguuugcaccucucaagugcuauuaaaccuugcucaggcuuguuuuucuuucccuucccuucuuccuucuuugauacauacaguguauccuuggcugggcugacagugcccuauagaucaggcuggcuucaaacuccugucugccugucucuggcucccuaguacugggaucaaaagauggccagcacccguucucaguuuuguuuuaauuugcaguucuuuaaucauucaugaugcuuaaccuuucauuugcucaguugccucuuuuuuguauuuauuugcugaguuuguauccccuaccuccuucuuucauuagggagaagcccaugaaccugggccuugcccaugcucugcaagcacuucaccguugagcuguauacuccaaaccaugacuggauucuuuuuuuuuuuaaagauuuauuuauuauuauacauaaguacacuguagcuggcuucagacacaccagaagagggcgucagaucucauuaugggugguugugagccaccuguggucgcugggauuugaacucaagagcagucagugcucuuacccucugagccaucucaccaguccggaaguaucuucuauuauugaugauuuuucucuuguucacugaaauagcaccaccacuagcaauauaugguguauugauuauuuauuuauuuauuuaaguucuuuugaggauauucagaggcagcuuugucaguagccguggguuuugaauuauagccauaugaacuuucugaaucucaguuucuuuauuuaauaugaugcaugugaagauuaaguggucagacucuaaauccaucaguauccauauaguagauauggagugaaugaaugccaguuuuauugugucuuuugugucuuuaguauugucaugcuucucuugauuauuuaaaacauuucauuagcuuauuguuaggcuuagaagauagauguuauucaaauguagauggaacuaugaauguguuaacuuuguaauuuacauuuggauaaacauauuucuguuuuuuuuccugucccuccaccuccuacuggagauuaaauuuuggccccuuacacauguaggcagguauuuuaccagugaguuuuuauuuuuaguccuaaauaaaacacugcuuuuugguggcccacgccuuuaaacccagcacuugggaggcagaggcaggcggauuucugaguucgaggacagccuggucuacaaagugaguuccaggagagccagggcuauacagagaaacccugucucgaaaaaccaaaaaccaaaaaaacaaaacaaaacaaaacaaaaaaaaaaaaacaaagaaaaaaccacuuuuuucugggaaagauuuauuuguauuuuuuguguaucaguguugugccggcaugcgcaccaugugugugcagucccuaagcaggccauacgaggggguugcagucacuggagcugcaguuacagaugguugugagcugagccauuguguugguccugggaacugaauccaguucuccucugagacuaucaagugguucuaguuguugagacaucuuucccaccccuggauaaauaucuuuuuuuuuuuuuuuuuuuuuuuuuaaagauuuauuuauuuauuauauguaaguacacuguagcugucuucagacacuccagaagagggagucagaucuuguuacggaugguugugagccaccaugugguugcugggauuugaacucuggaccuucggaagagcagucgggugcucuaacccacugagccaucucaccagcccugauaaauaucuuuuaaaguauauuggugaggcuaaauaucggaaugaaguuaaagcuguuuguuauauaacuaguuacauauguguacucauuggucauguauauguuuauaauugugauauaaauguguggauauuaaucagugguugugauuuuuauauguauauauguguauguauauacacacaugcauacgcacgcacacacauacauauauaugaagaaaucugauuucuuaaauuuccaaaguggguucuaacccuaacccuagcccugaucuguguugcaggggaaagaauaugggcuacacaguauuuguuuguagcuaaaauuucugagaaccuuuugguauuuuggucuuacuauguagcucugacugguguugaauuccaggccaaccuggucuacauauuuagcucuaggauaucaagggcuacguagagagacccuguuaaaaaauaaauaaaagggaaagagaaaaaagaaggaaagaaugauguaguauuugcaaacaagaaaaagaucuuugugcucuagucuggcuuuauuaaaguuuagauugcauauauuuuuucgccuuauacagguuuugauuugcaucaggcucuugcuaguucugggcaaguacucuaccacuuagcuacauagcaaagcugcuuuugauaauuaacauaauuuuuuuacauuuauuucucuguguugggauggagagggagaggaagagaaagagaacacacaccauugaacuucuggaggucagaggacaacuugcaagaguugaucuuauccugcuuguauggguucuagggaguggcuuuaggcucucaggcuuguuaguauugauguguuucauuaugacauuuucauguauguauaucaugugcuaauacccugccuauuuugauuugauugguuugcucuagaucaguuuuuguuuuguuuuguuuuguuuuuugguuuuuuuugagacaggguuucucuguauagcccuggcuguccuggaacucacuuuguugaccaggcuggccuugaacucagaaauccgaaauccgccugccucugccucccgagugcugggugcucggcuuagaucaguauuucuuaaucucccuaaagcugugacccuuugacacaguuccucauguuguagugaccuuuaaccauagaauuacuuucauggcuacuucauagcuguaauuuuguugcuguuauggaucauaauguaaguguuuuccauggucuuaggcaauuugugugaaagggucauugacuuccauagaggugccgaccuacaaguugcgaaccaguguucugcucuggaugcugaaccauuuauauuucuuuuuauuuuacuuuucaaaaauagggucccaaauaucccugauuggccuugaaccagcugagcagcugagggugaccgaccuucuuacccuccuucaucucuuccugagugaugcguuauaggcuccguguuugugcugcugagguuuccuacgugcucaacugagcuauaucuguagccccaguaacaaaucuugaucaaaauuggagcccagaguugccuauuugaagacauuuuggagccuauguaaaaauaaauuucuuucagugauggaaaauuuaagcaguucaaaccaguucuuuuuucuuucuuuuuuaaaaagauuauuuauuguuauauguaaauacauugcagcugucuucagaaacaccaaaagagggcgucagauuuguuauggaugguugugagccaccaugugguuucugggauuugaacucaggaccuuuggaagagcagucagugcucuuaacugcugagccaucucaucagcccucaaacuaguucuuaauuaaauugucugacuaacuugguacaugaagcuuacauucaguuauuuuucaagagguaguaaacaugauguagaauuuggacuuuaguaauccuuagaaaauagcuaucuuuuggauacauuuguguuauuuauuuguucuuguguucagaaaaauuauuuaauuagcaaaguuuccaaaacaacuaaaauugcaagaaaagcuaagugaauauuaucuguugggauuuccugcaccucagacagucauucauagccucgguuuucaucucauucccaucauucauauccucaugggcuuugcacaguggcucugaagaagagaaaaggacacuuaggaagcuugcucuucauuauaagccuguggguucuuacaagacuggcaugcaccacaguguccuuuuggacuaggaguaugcacuuggucuguuucacuugauagacuuugcugauguuaaaugaugaccuaguuuaugucaaauguuuguuguccuuucccauuuuauuagcaaaauaccuauaaucagguucuuugaucucuuuuuucuucccuccuuuuucuccccucccucccucccucaacccccucuuggcagggucuuuauguagcccuggcuuuucugaagcccuuguaaaccagucugccuugaaacccagcauccuucugcuggcugcugcuuuuccucuuccuccucucuuuuuuugagugcugauauuggcaugagcuaccauacauguauuucuuucuuuucuucuucuuccuccucuuccucuucuuuuuucaaagaucuuguauacugauuauccaaauuuuuacuuuucuucccagguuuuccuuaaggauggucuuauucuaacagaaaauguauccuaaucuuucagacucauuaaugauuggcauuauaagagcucacacucuggagcccaacaucuuaagcauuaguuguucauuauuguuugggugcucucucucacuccuuguguguguguguuugagugugugcaugcaugggugcauucguaguguguaugugugagacaggucuuacuaugaauccuuagcuagccuggagcucacuauguagcaugcaugcaagggcaaggguuaucugaacuauuucauacuauucaagaaaugccugaaugcuuacucauauauaagcucuuuauacuguugugaacuguugaaauccagaauguuuuacuugguaguuuguaacucucagugaugcagauauugcucucaccuagguaguaagagcacaugugugaucccggcggcacucagaggaagcagaaggaucgggaguuggaggccggcuuaagacacacaaugagucuuaucucaaaaaacaacaacaaaaacauauuguucuaauuugcauuauaguguaccuagauauuucuuuuguucaugggaaacuggagagggauaguuucaguaaaauaccuacagcaaaaacauaauauacuuaucaaccucucuuuccuuuaaagauuuauuuauuuauuuuaugaaugugaguguacuguauuuguacagaugguuguggggagcuuucaugugguuguuggaaauugaauuuuuaggaccucugcucauuccaguuaaccaaaauuuuauuuuauuuuauuauuauauauaaguacacuguagcuggcuucagacauaccagaagagggugucagaucucaugggugguuuugagccgcuaugugggugcugggaauugaacucaggaccuuugaaagagcagucagugcucuuacccgcugagccucuuucuuucuuuuuuugucuuguuuuguuuguuugucuuuuugagacagggcuuacuauguggcugugguuguccuagaacucacaauguagaccaggcuaguaucaaacucacagagaucugcuuccuucccucuaccuucuuggugaccuuucagauagccacagauuaccacaggaacuuaaacaagcaaacaaacagccccaaauccaaaauauauacuauauagaagacauaggguuuuuuuuucaacuguuuaccguaagaaaguuuuuuauuuuuuauuuauuuuuauuuuucagauagggucuuaauguagcccaggcuggcuuuagacucacuguguagcuaagaaugaccuuaaacuucugguccucuugucuuuccuugggaguuuauagguguguauugucccccccccccccaauuccacucacuuuuauguaggacuguggaucaaaccuaggacuuguugaacauaagaagaacuuauggucaguuuugauagaaucagugggaggaaaaucuuaagauuguaaguaccgugcagagauaauauugaauucacagaaacaccuuucuguucggauuaacauugaggguuuaugugggggugagucugagcugagacugagucugggccagggcaagaucauaaaugaggagacaucugugagugugaggccagguugcuguacauaauguuaaacuagcgagggcgacacacugagaccgugccuuuaaaaccaacaguuaaagacauugggcuggggcuuuugcucugugguuccucacuugccuagcaugcucagaguucuuuucccagguaggaaacaagucugaccuugcuguucauaguagggagccguuguacauuauggugaaauuacaguugccuuuagaagguuuugauguugugaaaagugaugugagcuccauggaaguuaguggguuuugagauagggucucauuauguagcccuucuggccugcaacucacaggucuuccuguuucucuuggggacaccaaacccugcucgugauuuuuagguagaaaauauaaguuagugaauguuagggagaagagaaauugacaacaaggugaaaguuaccuuuaaguucugacuuuuauugcuagaagaacaauguuuauuaauuuaaacacgugaugaagaaagcugugaaauaaagcugauagagcuucucaguuguaaucuucuuuuuuuuuuuuuuuuuuuuuaaagauuuauuuauugauuauauguaaguacacuguagcugucuucagacacuccagaagagggagucagaucucuuuacggaugguugugagccaccaugugguugcugggauuugaacucuggaccuucggaagagcagucgggugcucuuacccacugagccaucucaccagccccuguaaucuucuuaaggugacgugaagaacagaaggcacuuagaaguucaagcuagggcuaggcacgguaacucaugccuguaaccuggaaggcagaggauagaggauuaaugguaguucuaggucauauagugaguuugacagagugagcuggaggcuggcuugugccauaugagauccguuuucaaaaaaccaaggauggagggaaucuuaguuguuugguaggcuaagcaguagauuuuugaguuugaauccugcuugagcaacuaagaacccuuuaaagaaagugcuaagaguggugaacggacauguaugcaaguaaaauaacuauacauauaaaaugauaauuuuuuuuguuuguuuuuuguuuuguuuuuuuucgagacaggguuucucuguauagcccuggcuguccuggaacucacuuuguagauagaccaggcuggccucgaacucagaaaucugccugcuucugccucccgagugcugggauuagaggcgugcgccaccaugccccacgauaauuuuuuuuuuuaagugcugaggauggaguccagugguagacugaacuauacuugcuuagcauaaaugaagcccugguuucaguguucagggaaaauucaagguagaaagguuuggaaauauggcagagggaagagagcuuuccuaaugugcaugagguacccugguuccgucuucugaccaccaaaacacagggacaagacggaaggaaagaaagaaagagguacaagguuggagugugaagauuuggagggcgcugguguuuacuggaaguccagucuggugguacuauggaguuuggcucugcugaugcuuuuuuguguacuggcuuuccuuagcauguuugaaccuuuuugggugcuccauaaguaauacauaacucauuugguuuauuggaaagguuaauaaauucguuguauauuugugacacuucuuggccuacuggucaacacucagcacuauuuguauugguguuaaaaauuacaguucaguccaacaaauguguaucugcacaugggguugauaagaugguaagaugguucuuaucuuuuuagugugguuuuuuguuuguuuguuuguuuugagacaggguuucucuguauagcccuggcuguccuggagcucacuuuguagaccaggcaggccucgaacucagaaauccgccugccucugccucucgagugcugggauuaaaggcgugcgccaccaugcccggcucuuuuuuuuuuuuuaaaagacaggauuacucaacauagcucuggcuguucuagaaauuuauguagacuagacuagucucaaacacacaagcuccaccugcuuucugucuccagagugcuacuacuagagggguguagcacaauauguagcuguuguuauauuuuaaaccuaaaaacucaguuaaaggugaccaauuuaggauacuauuaugagaggagcagcaagcuuucuuuauaaauugugaagauacugcugccuaguaaguuuaacuuuagccuuuauuuucgguuucuuuuuagacagaguuucucuguagccaugguuguccuggaacucacuauguagaccaggcuggccucaaacucagagauccaccugucucugccucccaagugcugggauuaaaggugugugucaccacuaacuuuuuacaguuuuuaauuuuuuaaguuuuugauauuuucgucagauaaaugauauguuacaaaaucuugcuuuaccuaaaagaagcacauuguacaaugaacaagaggauuggaguuaaaaacacugaaacaguagcuuaauaucaugagaagagacgaagaugaggaagauaggaugggaauggagggcugcuagcauaggggucagauagcuaaaaugaaggcuuccuugaugggcauggaggaaaggcagggaaauccuacuucacguauggaugccaguugaucuucaugguugggggaaggacagcagggcuggagugaugggaggagagugguuuagacaaauuagggaacaucugccuuccaaccuaaguuuuguuacuguaaucuccucacuuuuaaauuucauccuuauagguggaacaacauuaucaacuaaccaguaccccggagcucuugacucuagcugcauauguaucaaaagauggccuagucggccaucacuggaaagagaggcccacuggacuugcaaacuuuauaugccccaguacaggggaaugccagggccaaaaagugggggugggugggugggaggguaugggggacuuuugggauagcauuggaaauguaaaugaggaaaauaccuaauuaaaaaaaaguguaaaaaaaaauuucaucuuguuuuauuuaugugaguacucuaccugcauuuauguauauguuucagauucccuggagcuggacuuaacaaaaagcagugagcugccauguaggugcuggggauugaaccuagauccuuuggaaaaacagcuaguguucuuaaccacuuaguuaacuuucuaguccucuuuguuuuauuuauuuauuuauuuugcuuaaugccuuuuuuccuuauugucuuuccagugggagcuugggaggggccauauaagauggauauaguuauaucuguguagaagugaaaagcucuagaugugcugagauuguugauuauuuaguacuuacuccuaaacgcugcagguuucuguaauguaaucucuuuuuuguuuuguuguuguuguuguuguuguuuuuuugagacaguguuucucuguguagcccuggcuguucuggaacucacuuuguagaccaggcuggccuccaacucagaaauccaccugccucugccucccgagugcugggauuaaaggcgugcgccaccacugccauuuagggaagaacuuucuuguacacacauggagagagggaaggagcgaggguagaggaauggagggagggagggagaggcagacagagacugacugacugaaugacuguaguaugccagguggugauaacauuuaaguuaguagggaaugaaaucuuggguggcuaaagcaauaugugaggacuaacuucuuugucugaugcuguucaaagaauccauaacuaucuguaaauaaauuguugcuguuugacagaguugccaguguaagaaguaacugugcugcaaaucagaacaauccuauuuggacuaugcccaugugaauuucuauuugcagcucaugucugaaauucuguuugggacuuaauauagcuaacacacacccccagcaugccacacaggcccuuuaucauuccuuacagagcccuuauuuuaaggcaguccaagucacacuuuauccagcuguuuguguguacucugcacaggagaaaguucccucgcuagcucugcuucucuccucaucacuuugcucuuucccaaaacuguuuccgacaaagauguuaauccucacaugugcuugagcuugagcauaguccugaggggggaaugcguguucugagaugcugccgagaccuaaccacggcagugcacauacaaaaggccucggcucccuugcaggcagcaguacuaggucuuagaaugaacaccucgauuauacuuugaaaacuuugucagcuggguuuuguggcucaugucugugauucugauacacuugggaggaugaaacggaggauugcugugggguucgaagcuuggaaaaaaaauagauguaauuauacuuuugugcuuucuacaguguuaauggaacugauuguacaguacacagguuuuuuguuuuuggugcugaguauugaaaccagggagggccugggcauauaguaagcaagcacgcacgccaucauggcccuagaccuuggccaaccauguuaccuuuugauccuggauucguguuuuagcaugccuuuguaauuuauuaacauuguuaugcauauugcauguugauuuauuuuugaauacuauuccauuauuauauacuguuucuuuaagccugccuuuuuuguuauuuacaguauuuggagauugaguagagcugucauaagcgucugaguucaagguucuaugugauccuaaggcuuugcugucugucuuccggcgggauggagaggccugcaggacucccacacuuaacuuuauuuuuaaagagcugccaaccacugugauugcauguuguaucuccauuagaaacacaucaauucuggucccuuuauguucuugcagcccuucauaauaucuguauauugugacaaugucugcauucccugcuacuuagucagcuuucugacccuauaacaaauaucugggacaaucaaguuaauaaguaaaaagauuuauuuaguaacuuuuagagguguuuuuguuuguuuguuuguuuuagguuuuccuagauaggauuucuuugaguagcccuagcugcccugaaacucauuguguauaccaggcuggccucaaacucagagaucuuccugccccaaguugggguuaaaggucugugccaccaccaccaagcuauuuuuagagguuauaguguuugggcaugauggaaaagaauacagaguggggccggacuguuuuccuggcugggaaguaaagagagaaaggaaguuccgauuucuccuucaggguccuaaaggggauugggauuccaugaucauacauacggucccuucagcuucuaguggccuuucauuggaagcaaggucuacacuuuauagaucuuuggagcauauuuaauauccagauuuuagcaucacccagagugaucuguuuauucuuugcaauugucaaaaucccaauaaccauuuuuucagaaauuaaaaaaaaaaucuuauuuaaaauuuauaggggauuuuaagggaauugcuuuuaauauucaaaguaaucuugaaaaagacaaaaguuagguaggaauguaacucagucaguacuugggaaggagacugaugaauuuacacuuccugaucacuaaacuaaacugcaaagcuacaguaauuaacauagugugguacugaggaaagggauauggcucaguaauacaaggcuuggcuaguaugcacaugugcugggguggcucaucaacugcaaaugcaaacaauggcacugauguagcuguggacaggauguagagcaugaugggaauggauaaagagucuagagacauauccucaaacauaaugguuuaugauuuuugacaaggguucaacuccauuauuugggggguaaggaugguauaaaacaaaugauucugggauaccuaguugaaucuguguaugcagaucucugucuccaucccuguucucucagaggaaaagaauauuaucgaaggauaauaugguagaaauaaauuuccugcaauuccuuuauucaacucacuuuaagguauuuuaccacaucugcucuuugucucauguagauuguucccccacccucauacggucuuaguuuuguagaaaagguugccuugaaauuucugcuucugccuuggauuccuauuggcugggauugcagauggguauccccaugcucaacuguguauagagcagcaauauagcugccaaguuaaaauccguuucuguugagacugacuauaguucauacuccagucugcucuaaucaugguuuuuaaacuucuuuccaguucagugucucagucaggauuguugguuuuaaaaucuuaauuguugaauuuuuguucuuuuaacagcuaaaccagguggacaggugaaaugucaguauauuucugcuguggauaaagugauauuuguggaugauuacgccgugggcuguaggaaggaccuuaaugggaucuuguugcuagacacugcucugcaaacuccaguuucaaagcaggacgaugugguucagcuggaacuucccgucacagagguaagcagacacacaugccauguguccuugucaguggaaaccucagaccucugaguagcaagugaauuaaguuguccuuagggcguaagguuuguaaguuguacuuuaaggacauugcauaguuacucccauuaaaaacaaaggauugagucaugagccacaccuuuaaaaacuuaccuuucucugcauaaccuaacuggugcuuguugaaguguuuuagguaugaacuguucuuuggccacaggauaagcagcuacaacaaagauuccaaaauacagugaauuaaaaaaacacuauggcuuauguguaguaauagcccagggcugguuguggagccuacucugccagucucaacauuuuggcuagcuggugauuuguggacaguugcuccaagucccaccauuucuaaguuguaggagaucaguggagcacaucuuuucuuaauccccacuucucaguuuucuccuccuuucucuuucaccucuguuccuucugucugucuuuuuucccaacacccuuccccucuccuucugcucuucuacucuucuucauucccuucaaacuuuucauaauggacacaauuuaguuacacaacauaacaagacugagaaacagauuagaaaaauuugagacugucucacauagcccaggcuggcuucuagcuuacucuguaguuaagaguaauuuugaacucuugaucuagcucucaaauauuggaagauaggcaugugccaucauacuugacucuugagcucuggcuguccacugacucagagaucuuucugccucugccucuacagugcugggauuacaguuucaaccaacacaucuggcuuuuuuuuuguuuuauuuauuaaaaacauuuuuuuguucuuuuuguuuuugaagacaggguuucucaguguaucccuggcuguccuggaacucacucuguagaccaggcuggccuugaacucccugccucugcugagccccgggauuuaaagcuggcaccaccgccucccagcuuuuaaaaucccccuuacccagcugcucccacguguuccccaccuccuuucccacccaaauuaaaauuucucgaucuaaaauaaugacagaaaauaacaaagcaaaaguacagaaaaaaaaaaaaaaaacccauacaacccauuuuguguuggagcuauucaugggcaugaaaccuguccuggaguaugguugauagagccagugacacgucauugauuuuucucuugcucaucacauuccaauuacaaauaacuuggcaaaggguaggaguuugugucuacuaccccuuaacuguggauuuuuucuuagugcuaaauaaaguauauucagguaguguuguaagucuagugaaacccuagauuuagacugugggacacguaggaagcuuuagguuugaucccauuacugagaaaaagcaaagcaaaagaaaacauguacacuuagauuuuauaguuucccucccucccucccucccuucuuccuuuccuuccucuuucucuguuuggguuuuagagacagaguuucucuguguggcccuggcuguccuagaacuuucuuuauugaccaggcuggccucgaacucagagacucacuuggcucugcuuccugagaacugggauuaaggguguucaccccuaucuggcaaguauuuuaagaaaaauacuuuaaaauacuguccucuccucuuaccacguaggucacagggcuagagcucaggucagguuugguggcaccuaccuuaaucugcugagccaucuccuugggcugcagauauuuuuuagguaauaucauuguaaacauuucuucucucuagauggcauuuacucugucauauuaguuuuggaaguuaagaaugggauucuagauuugguuugaugacuugugaaugcaugguguuuuuuuuuuuuuaaucagccauagguuucuguuacauuuuaguugaaucuguggcuagcauugcugagacugucuucucauacugcucguugaguggcuuuguguuagaagaaucuuguauuuauguuuaaaaguugacauguuucacuuuugauuauaguuuuagguuguuuauuuuuuuuguuuaauuuaugguaauuacuauauugauauauugccuucuggcuacuacauugaaugcauugcuuuaauucauuuaaaugauuaccuagguuuauauaaaauuaauuguaagguuaagcuuuguauaguuaaaacuaucacaagaaagcugaauaaagacuguuuuauuguguuuaauuuuauguuuuuuuuuuuuuuaaauuuaggcacagcagcucuuaucagcauguauagaaaagauagauguuucuaguacagaggguuaugauuuguucaucacacagcucaaagaugguuuaaaaaauacaucucaugaaacugcagcaaaccauaaaguugcuaagguaagaauuacaguguauuuggggcuaggauggacuaaguuccuccucuccugcucuuccuguccuguccuagagaugugcuaacugccccuuucucuucuuacgagagauagcaucuucuaugauaugguugaaacaccagugucucuguggugcugagacugagccaccgucucagauaaaugguaggcuagugcucuaccaucgcauuguaauuauugcuagauaaaagcuaugcuguugaggguuacucuuuugaaaaaaauuugaaauaugcauaaauguuuugccuucauacaugccugugaaccauaugcauauaggacccauggagccaaaagagggcauuagcucuucuacaauuggaguuauagacagcuguuagccaucguguagacacugggaauugaucagaggucuucuggaagugcucguaacuacuucagccucaaacucaguuuauucuuuuuucucccuugacucacucucacucacucacauucucauucucucucucucucucucucucucucucucucucucucucuguguguguguguguguguguguguguguguguguguauuuccugcaugcauauuuguguaacacucaugugcuuggugcucauggaagccagaagaaggguuucagaucaccaagaauugguguuauacaugugagcugccauaugaguguuggguuuugaaacuggcuccauuggaggacaagccaggguucuaaaccacuuagccagcuuuccagcccuuuagucuucucuucucuucucuucucuucucuucucuucucuucucuucucuucucuccucuccucuccucuccucuccucuccucuccucuccucuccucuccucuccucuccucuccucuccucuccucuccuccccuccccuccccuccccuccccuccccuccccuccccuccccuccccuccccuccccuccccuccccuccccuccccuccccuccccuccccuccccuccccuccccuccccuccccuccccuccccuccccuccccuccccuccccuccccuccccuccccuccccuccccuccucuccuuuccuucuuuccuuuccuucuuuuuccuucuuuuuccuucuuuccuucuuuccuucuuucuuuccuuccucccucccucccucccucccugccucccucccucccucccucccucccucccucccucccuuccuuccuuccuuccuucauuuuuguuuguuuuugagacaagagucuggcuggccuggaauccacucugcucacucuguagacugggcugacuucaaauucaagagaucuaccugccucagccucccaagugcugggauuaaaggugugcucugccaccaccacccuacuuuuaauuucugugagugcuucuauuuauuauguguccaggcuucugugacuguccuuagugcguuguauuaguugagagguuggugaaugaaccuuagaugagaauggaaacauagcuauggaaauguggucuuuuuucaaaaaaaauuaagcuacuuacuaauguguaugugggaggugugagggagaggaagagagaccaagagacugcaugccaccacaaugccugcauuaagcacaagcugggagucauuucuuuuaucacgggaguucuggggauugaacgcugaucaucagacuuaaauuggcaaguacccuuaacuguagauuccuaucaguagucccauucucuuuccuuuuucucuuccuucccccuuuccuuuccccuuuccuuucuucuccccccuccuccauucuucccccccccccccccccgccugugcuuuugaggcaagccccuacuguccaccccugccugucuugagauuacuaacccugguuucccucuccugaguacuuggacuacacccuguguuagaacaccuugcuuuguguuuucuuugaaauuguuuuggcaaauuaggugaaaaauuucuuugaguaaaauccuuggauauaauuaauuuauauuacucucagauuuucucuuaaguuguaaguauaauagauaacaacagauacagguugaaauuaaaaauuguuuuccuaaaaguaaaauuuccauucacacuuuucuuucaagcacaguuagcuuacuuaaauaguggucuuucucauuuuucccucgguuaucucuuugguauguuuucaugcucauccuuaaagagagauaugaaauuuuaaaaaaauauuugcauuuauuuucuuauaaugaaaaagccuccugucacacugcugacccuccugcugcaguuccuugaugcuggcauuacauguguaugcugccauucuuguccuaauauuugcauugaauuuuguuuuguacuuuuaccauguuuuuucuaguuuguaacuccagcaaugaaacauuuuguuuaauaaagccugaguuauacugugauuuuuagucgaagaacuguauuauaagaaauugauuuaagaaauauuagagagcuaagcuucaaaaagaaagcugugacacaaagguggcuccuacaggaagcagggacagagaaagagguuggggcuguuggaauugacgugaguccucacuuuaugaccacagugauauuguagugcagugcucuugcacuuagugagagcacaccccacucccaccugcacccccaccccuguggcuauaacaucuuuaguaggaaagcguggcacuagaauacaauaauuguguuauggggggguggcucuuagacagcugaaauaagcuuuguuguuguuguuauuguuuccccugugguucuacaaauccuuuugauaaggaagcuuuucauuuaucaacagguuagauuuagaaaccaagauuuuuauucuguuucucuuuuuuuuuuuuuuuuaaaagauuuauuuauuuauuuauuauauguaaguacacuguagcugucuucagacgcaccagaagagggcaucagaucucauuacaggugguugugagccaccaugugguugcugggauuugaacuucggaccuucggaagagcagucgggugcucuuacccacugagccaucucaccagccccuauucuguuucucuuaacauuaaaguaauacuauuaaauacugaaaucacauacacauauauaauuuuguguguauguguaucugucugucuaucuggccuuacaguuuacauauugguucguagaacuguaugcagaagucaguucuuucacuauagguucuagagaaucaguucaggucuuagugauaggagcuuugucccucaaaccauugcacuggccaucaaaucuuguuuuuucuuuuagcagauuuuucuaguuacauagugcguagaggccagaggucagcauuuaguguauuccucucacugaagcugacgcucacuugugagguuaggcugacagcccaugagcuccuggcacucccugcucccuugaccccauuguugggucacagacauguagcucugcaucaggcuuugauuugaacucagauucuccacucaucuucccagcccuaaagcauuuucuuaauaaaacucaacuucauuaaaaacaaaaauuaaagcaaagcaaagcaacagcaacacaggaagugcugcaaguagcuagagacucgagaguuccaugaggguucuuugucuggucugugagcacuaauccaguuuucucauuaguucuuucuggucaugcaguuuguucuuugccuguccauuuaguagcagaaggagcuuaaaauugcugggcauccgucucagccaauuugguagaacgauuguauuuuuccuggauuuuucuuuugugcaaaacaaguuguauagcuuacagcauagaaaagaagaaaaagccugugaccagcucuauuaaauggugcacaugcuggagugcauggucgcgucuaacuuguguuaugagccuaugacuagaguccugugauguggacuucauuuucaggggucacuagaguuaguuaacuauuuaguggucauguauuguacauuaccuucuucagaaaaaagacucuuuuuggauacuauauuaaguaaauuucaucaguaagagcccauugcuggaacuuuuuuucuuugagauacuuuccuuggucagagaugaagucuggaaugcuaacaugguacagacaugguacaugucuguuguucuccaugcucuagugugugugauguuuuggaagaagcacugugagcugaacagguacuguacacauacaacacagcuuugcuauagggaaggaaguacaugcugcucagccucucugcaucuauccaguacaguccgccuggcuagcuggcucuacccucaaaacuagccaguggcagccucauuauaaucuauuaauucaaauaaggcagcaugcucaauaugcuaaguauuaacccuauggggcgauuuucugacaugcuggauccuuuauuaagaagguucauuaagguuguacaucccuggguuuucuugggaauuguugacccuuuuuugccugccaugucuuaauagaacauuuaaguucuuagccacugugucuuccaguuugcuauuaauggcauaaguggucuguagaagauauuaggaagauaaggauuuuuacaagcuggauuacagcaaagugcaugagacaggggcuuaauguuaaaccaggaguacucaguguggucccugccagguaaaagucguguuuaagauuaccagagacagguuucugacagaauuuuauaacugccuacgagguaucugagaauguguugauuugcuuugauaaagaugcucuuuugggucagaaucugaaauguuucauacuugguagcuuauaauuuuuaaagauguuuugguuuucugagauagagucuaguuacauagcccugguuguccuggaucucacuguauaguuuaaaguuuaaacuggccccaaagucauagugauuguccugccucugccucacaagugcugggauuaaacacaacuaugcuuuuuguaauccccagucauuccuggagauuauuggcauuguacaaaggccagcacacacagguggacuaacuggagcugagaauuuaauuacuaccucuguuacuuuaccagugccuuacccaguuguuaaucucagcaguuuccucaggacuaaguauugcuuuuguuaaguauucugguaggaauagaaugauccaggagcuucuuggccuuugcuguccuagugguccuuggauaggaacugucuuaguguggcuaguuucucgcuugcuugugcuauaucucuuccauuuaugucuuuagaaaccugagaaccugugguauggauuguuggacccauaccuuucaggaaaagaaaggacacuugaaaggguggggauuugaaaacuuaacaaaaauagaguucagccguaaaggcacuuugcacuaaguuugauacccgaguguuaucucuaagaccacgugguaggagagagcugacacccgagaguuuuccucucaugcaaacaauuguagaaacacaaaaagaaaggaaacagacaauaagaaaauaaggaagcagguuugugguggugccuuucauuucaguacucaggaagcagaggcaggcagaucagaguucaaggccagccuggucuauagagugaguccaggacagccagggcuacacagugaaacccugucauaaaaaagaaagaaaggaaagacaggaaggaagggaagggacuaaggaaggaaggaagaaaacuaacaaggaagcugaagguaaaggaucucccuuugucucagacagccauggcuaucacaugaugucacuaguccucacaucaaagcccacaccacgcuuaguuaguucauugcuacuuucguacagcgccucacuccaucaacccauggcuaguacuuguaguaaaaugaauugcucacaaguccuucugggggacaaacuucaagugaugauuuacaguauguaguuggaauugggucuuuccaaguggccgcuagacuucguucuuuuguuucuguuuuaccuucuucuuuuuuuuuuuuccuggugcugaagacccuuucaaugaguaggcuucucaucuauuaacagguuaaguuuagaaacuagguaagagauuuccauucuauuuuuuucuuuucuuuuuuuugugugugaugugcauguauauguaugugcguaggcauguuugugcaugugugugugugagugcauguguguaugugcacacgugugcauguggaggccugagguugccaucagauuuauuauucuccaucauucuuuauaaacugaagcagggucucagucaaaggcagaacucauccauaugcuuggucuuaugagccaguuugcucuggggauuuucugacuuuaccuucccagacugaacuugaagucagcuccacccagcauuuagaugggcuucuggcaguagcucaaaacuaguagcuuuacuuuugagucaucuccccauuguguggugcugggaauugaaccuagggcuucgugcgcacagggcacgcacucagcuauuaagccauaacccagucuucaucccccccccuuuuuuuuggcaauucaaaugauauuuuuuaaacuuuauaguuuaauaauaguuuaugguuuaguaauauuauacuagugugcuaguguguacuggacugaauggagacaguuuuaauacgugaucucaggacagagcaugaagauggaauuaauguauagauuuauuucucugggaaaaauacaauuggaaccuuucuagucuacucccugccgcccgccuuuguuuuccucuuguuuguaauaguauauauuaauauuaauauucauuauauucauuaauauauaauauugaauaaugguuuuggguuuuuuuguuuguuuguuuguuuguuugagacaggguuucuugauagaacucugaguguccuggaacucacuguguagaccacgcugccuaagggcuccaagugacccaucugucucugccuuucuuucucucuuuuuuuuaagauuuauuuauuuauuuauuuuuuuauuuuuuaaagauuuuauuuauaugagcacacuguagcugucuucagacacacuagaagagcgcaucagaccccauuacagaugguugugaggcaccaugugguugcugguauuugaacucaggaccuuuggaagagcagucagugcucuuagccgcugagccaucucuccagucccugucucugccuuucaagugaugggauuaagugugugcccuaucucucccagcacuauucauuauuguaaauauguguguguguguauauacgugagugccgguguucucaaagacuggaaaugucgggucuagggcuacaggccauugagacaccugauguggggcauggauuuuauccauaucuccagcuucaauaauauuaacauuuauuggauguuguuugugauggaguugggcuaggacuuaauguuugugaauacaaagcucaugcuuauaauaauuucaauuucuggguuaugaugagaagaacacagacauaaaugugcuaagauggauuaaaucaucgguuagagcaguaaugguaguuauccaaauuccucuuacuaauggaggacugugugccugcccaccuuguauuuaacguucgucacucggggugcuguagcuuuuagacugcugggcuacaucauacugugcuuuguuuuuggggaagaggauuugagagucucauucuguagcauaggcuagccuggagcuggacaguucuccugccugccucaggcuuauaaguguuggaauagcagguguggccuaucuuacuuaaaugcuguuaucugcuaucuuguccuagguugucuuuuucagaguaguuaggguuucagguuuuuuuuuuuuuuuuuuuuuuuuuuuuuuuuuuuguggcucugggaauugaacuuagggccuuguuuaugcugggcaagugcaaggccauugagcucauguaaaauuuuuuuuaaacauuaaauaaaaauucagcuuucugggugugguggcacacaccuuuaaucccagcacuugggaggcagagauagguggaccugugaguucuaggucagccuggucuauauagugaauucuaggaugggacuauguagagaaccugucucaaaaaagaacaagaacaauaacaaaaucaagcaguaacaacaacagcaacaacaaacaaauaagcccugacaagacaaaccaaaccaaacaguuuuuaaaaugaaauaaguguuuauauuuaugugaugcaaugugauauuuugauauaucaauacacuauggagagauuaaagaaaaugaaacauuguaucuuuaccaccuuacagguuuguuucuuucuggugaaaauauuugaaaucuguacuuuucuuacguuuaguauacaauaaguuguauuguauguauguaucuauggccagcuguaacuagcauuaugaaauaauagguugccugauugguggucaccagcuagaucaucacaucuguucuuccuugcuacucuguacccuuugcccagcuucccuauucucucacaucagcucuagugagugucacuuuacucgggugcgaugaguuacaugguauaacuuucacauguucaugacaucauuuauauuucucuuucuguucgcagucuauuguaauuaaguugcguaauguccuucaccuuuauccauguuguccuagaaugauggaguuacuaucuuguaaaaggcuuugcaauauacuauuuucugcaugcaccuauguacucacaauaccauacagugucuauccauccacugauggagacucugcuugguuuucuguaccuugacaguuuuaauccaauacuuuguuuuacaaauguuuuacuuuauggcaaauucuuguuguaaauaacaaacugaugguauaguugaccuuaaggauacauacauaguucuuuacuaggucagguaaagguaagauugggguuaaagcuggagaaguauugcuuugcuuacuauauuccugucucuuucagugggccacaguuacauuucaucuuccucaucacguauugaagucuauugccagugccauuguaaaugaacuuaagaaaauaaaucaaaauguugcugccuuaccuguggcguccucagugauggacagauugucuuaccucuugcccagugcacguccagaacuuggaguugggccaggccguucuguagacagguaggauccuuguuccugggguauugcugagauugaacuucuaguuuuaagauuucaguaaaaacuacugcagauauucuuaugauuagaauguucagaaaaguagauuuuuuacuuauauguaaauguuaugagcugauggcugcuauuggacauaucuuuucuucucuaaaagaauuauaaggguuuuucuuuuuucuuuucuuuucuuuucuuuuuuuuuuuuuuugagacaggguuucccuguauagcccuggcuguccuggagcucacuuuguagaccaggcuggccucgaacucagaaauccgccugccucugccucucgagugcugggauuaaaggcgugcgccaccaggcccgacuauuugaggaaauuuuaagccauuuauugguuggguguguaguauuucaccauuaaugaaauuuauugaccuuugcccugaauucugacaaauacuguguagaacugugaggguaaguaaagugcacacuguuaccgauagccuuggagugguuggauaugaucaaauagauacauuguaacuaucugggaaguucucaagauaaacauggugggggaguaggugugauuaaaauacauuguauucgcaaugaauacaaugaaggucucaaauagcuaugaaguucucaaagcaaaaggacugcucccgccuuaguucauuggaguaguugccuuaaauuuuuaugcuguuugcccuagauuuaaacaguacuaugaaaaucauaccgcuaccaucaguucuuuucagauuuauugaguaccuguuuuauguaaaucuaaaacuuauaauguuucauguaugacauuuucaucgggugagugagucgcugucuuugcauuuuccugaaauacauuuauaaauaguguauggugaagcuagcaaaugcaauucugaauggaugaacuuguaacuuaaguauggcucuuauguucauaguauguagcaguuuauccuccauauuauucauuuuccuuauuuguauuaaguaauuuauuacagacacaauuccuauuaauuguauuagcaaguggugaggguuuuccuuugcuagaguaaugcuguucucugugucuuuuggucagauuaccugaguaggccacaugaaaucugaguaucuggugcuaaguguuauggcuaucaugaaaauguucuuggaaccuguuuggaagggaucagagaaaaagaagugugugauaagagcaggcgaugucugaguagcucagaccuugagcucuuuugcaguuacagcgcugucucugaagaugcgauaacacugugaugaguguuguauuguagggaaugagaucaggagauaggauuuuguuuuguuuaguuacuuuugacaagaagcaacuugaggaaggaaggcguuauuuuagcuuauaauuugaggcuacagcucauaggggacaggaaccagagaauagugaaugcuugugcucaacuuaguuuccccuucucauucaugcuugaaucucagguacaggcuaguagcucccaaauuaaggguuuguuuauuuauuuauuuauuuauuuaauucccucuucagucacauuucucuaacagaugugccugagggauaugucguuuaggugauucuaaaucuagucauauguuccuucuguguaugcuaaaauauccucaaauaccaauuugauguaguuucccaguuauuacauuaguaaaugaaucuacagaaacacggguggacauagugaguugaggcucgccuggccuauaggagacaaugucucacccucccuucuagcaaagacauaaccuauacauggaaccuuucuagcccucaaaauuuguauuuuucaaaaagggaaaugucuauuuacuguauuucaaagggucuguguccugggcuaacagaauugcuaccagguguacuuagccgagccgagccccggguccugugcuucccgugcauugcuggggacuggauccaagggcuuccugcaggccaggcagcugcugcaaguucuggugcuguagugcuccucccuucccgcgugcgugugcgcgcucucagcagucacccagagcagugguguggacuaguacaauacugcugaauggauucguuuuggacagcuauauagaaauguauuuuucuggucaguuuugucgugauuuuucucuguuacuuuccucucaguuacuguguauagagcuauaaaagcaagaggacgcuuugcucaguagugugcucuuaucugaaggcuuuuggacuuuaguuuguuauuguccuuaacaaauucacugaugcccugaguuauaguuugacaugucuuugaaguaaagcauuuaacuaugagcaugugaagauuuuuucauuuuauuuuccagguagucucauaaggcugucuuucagcucaugauauuuuugccucagucuccugagugccaugguuauaggcugcaaaacacuuuucaaaauuuacuagaguuucugaccuuagugguauacgccuuuaaucccagcagggagagugaggcuuugaguuuuaagccagccuauucuacauagugagucccaggucaguaaguuccaggacagucagggcugcacaguugaaacagugucuccaccuaaccuaugcuaaaguaaaguaaaccaaacuaaaguuuguuagagccacagcuucccuagagagagaguacccucccucgcccccgauuucuaguuaauaaaacaaccagaaaaaaagaaaagaaaagaaauaaaaaugaaggacugccuaaauguuuggacaguaaaucggagacagacgcccgcuuagccagcuugcggccuaaagaaagggugcagggcucuaugucaagucagccucuucauuuccugcucucugauuauuaguuaauugaaucuaccuguggaauuaacuugauuucuguagucacuagucagauuuccuguuaauuuacaguuggggaauuuaaaccuacuaaaacaauuauuuuuaguugaaaauaaaaauuugaacauaaucauucccauguuuuacuguuucuuuccuauuagggcauugauguauagugaagcuaacagaagggagaccuucacuucguggccucauguuggcuauaggugggcacagccagaucccauggcucaagcuggauuuuaucaccagguaaaaaauaucauuaguagauuuuuuuuuucugcaaccuagcuauguacuuuauuaugauguuaguccuauguccuacauugugaauguaacggacauauaauuacuggguuauuugauacuuaaucuuucagauuaagacauuugcucuuuuugcuaucaaauugauauguucuuuaaaugucauuuuugggaaauguguuuggauauguguuauuuucacauauauaacuuguauaaucugguaguugguucuugaguagcagucauucugcaaggcagaaaguggugaugcgccugaaacacuagcacuugggcgugacggggguccaugaggugcagcccagccagaaacauggagugagacacugcaucuauuuauucauguguuuguuugguuuucuauuuucuauucaggcucucacuauguugcucugguuugccugaaauuuuauugaauacuuacuuugauaugaauggaguaauacuguacauuuuuuccccccuuggaaaauuguucuuggaauugggaacuuuuugaaaagaguuuuucuugaaaagacauuuuaaugauugaauuuucuuuuucucuuuucuucccuuaucucucuccucugggcauuugccuucuuucuuuucuucccccuuucucuuuuuuucuucuuuucuuuuuauccccuuuucuucccuccuuucuccucuauuuuaacauaauuuauuuguuaaaauaaauaucuccucuauuuauuuuugcagccugcuucaucuggagaugauagagccauguguuuuacuuguaguguuugccucguuuguugggagccuacggaugaaccuuggugagucuugaguuuccuagguguaauuggcuaaaaguuaguaucauaguacuucuauauuuugcuuuuuugauuuugauguaaucuuuucuuuuuuuuuccuauguguuauuguugcugucuuaagaaaaugagguaguucuuucuauauucugucacaguacuccaaaaucugcauagggaaaaugcuaagauagaaguaggcucuuaucagaccagaggccauguuacaccaaccagagcacugcuguagcaguguaguucugggccauugaggaaagcuaacagagaauucaugcauggaaguauuuacaguacaguuuuaauuuuaaguaaccuuuuaccgggaaucuugagccugugauuuauaguguacaacauuuuauuacuugauuaacacuagauaugcaauaauacccaagaucuacuaugaagccuuaauuuagaagaaaaaaaaguuuagcaagggugcuuguccaguaagcaguagaagcaguuuuuaguuuucagagaugucgcauaguuuguacuaaaauggauugaagcuucauguuuauuaguugacaugagugcaguggguaaacaaaaaccaaaaaaaaaaaaaaucauuauuuauucuacacuugaaaaauugcacuuuguagaauguauuauguauucacaauuuuuaucuuagguuuuaguguacauguauguuuguauauguaugcacacguguacuaggguaccuucagaaaccaggaucccuggggcugccugcugugacugcaggagacacucagauccucugugagagcagccagcacuguuagcuacuguuagcuauacuucugaucccagugcacacaucucuauguauuugcuacagggucucauguagccugggcuugucuggaacucacuauccagcugaaguuggguucaaauccuccucucucuuuuuuuuuuuuuuuuuucaaauuuaggaucucucuguguagcuauggcugaccuuagaccaagcuuguuuagauuucuaaaauaucuaccugccucucucuguuucucugccucucuaguccugggauuaaaguugugugccuucaugcccuuccgggcaucaaguuccugaugcuccucgcaccguauuuuggguucagaggagggucccaccacaccuuuucuuucucuccuuaagauggagucaaggcuuaaagugagccuaggcugcaaaccaacucaggcugcccucaaacuuaugucagcuaugccucagcuuccuuagugcugggauuauggguauaaaucacaauggacagcuuugauggaaccuguauucuuaauuuacuuguguuggggaggcagauucagaauuucaguuugggcagauaaguacccaucuuuucuugacaugcugaggguuugggcauguaccagaauaugggauucaaaacucaagaauuugagagucugauguucugaguauacuguucuaagugcuaggagagaaacuggguugcugagcaugggugcuuuccagaucuuuauaauaaagaggcaguuuaaaggggaaaaggagaccuugcucuuuugcuuaugggaauugaaagaguuaguagcgagauugacuucuucaagaaauaaaaaugaauauucuugcuaaauauagugacccacaccuuuaaucccagcccguaggauacagaggcaggugggucucugaguucaaggucagccuggucaacaaagagagucuaguacagcuaauauagcuauaguuuguuacauagagaaacccugucucaaaaaacaagcaagcaaccaaacaaacaaaguggguauucucuaucuucugucaguucuguauuuaccucucuacucuuaggagcuaauucuuuuuguaugcuuggcuuugugacaagauuggccaucacggugaaaaacuggaaagauuuuaaauguccaccaagagugcaguggcuucugggaggcagaggcagguggaucuuuugugaguuugaugccauucaaagcuacauacugaugcuguguuguuuuucuuuuaaaaaaauugcuauggccaauguaguuugauaaauucaugagaauuaguagagaauuagaagaacuuuuuauauacuuuaaaauuuauccauuuauuuauguauaugagcacacuguugcuguuuucagacacaccagaagagggcauuggaucccauuacagauggcucugagccaccaugugggugcuggaaauugaacuuuggacuucuggaagaguagucagucagugcucuuaacugcugagccuccucuccagccccaaguuuauauuuuuuagugauuauugucaguaacauucuguauguucuuguuuuacaaaaacuguugcagaguggcucagugcuacuggugauuuaaaauucuuugaaguaauuaacaaaauaauaauaaaauaauaauuuuuucccauaaacuacuaaaaguauuuuagaguuaagaugcuaagacucuuauuugaaaggugauaagagauuauuaggguuagcuauaaaugaaguugacuuuuaauuuuauuuuacacagacacauguagcuucaaauaucugauuaaaaaguuaaaacucaguuaagagaagguagaaaggggaaaauacacuagaacuuggcugggagacaguguagcucaaauacugugcuuugugguguagugcagagcgauuuaugaaggaugccugugcauuacaguuugcccaggaugucauaauaguaaacugcagguguggugugaaaaaaaaugucuguucugaagaauagcauguuuuaugaguaaaauuuucuuuuucucucuaugcugugaguaaggaaacaaagauuaugucuuugguagcaggauccuguucuaaaguaucgcuuugaaauuauaugccgggugugguggcacaugccuuuaaucccagcacuugagaggcagaggcagaggcaggcagauuucugaguucgaggcuggccuggucuacaaagugaguuccaggacagccagggcuauauagagaaacccuguuuugaaaaaccaaaaaaaaaaaauaauuuuuuugggggggcuggcaagauggcucagugguuaagagcgcugacuauucuuccaaagguccugaguucaaaucccagcaaccacaugggggcucacaaccauccauaaugaaugaaaucugaugcccucuucuggagugucugaagacagcuccaguguacuuacauauaguaaauaaauuaaaaaaaaauuauaugaaggaaaauaaacaaggaaacaaacaacagaaaaccaaauggaaaucuuaggaaauugggcaauuuuaucaugauuugcauuguagugcugauuccacgcuguauucaguuaaagugaguacagcugcuagcaauaaaugcccauaauauggacagugcgagcaccguggguacuuuaaagagauugaguaagcagguaaagcuaagcuuagguaaggguuggaaaugcagcugaguagugaaguacuuguuauacaugcucaaagccaggauucuaguacuugccugccucugccacacuccacagcccacuauauaaaaauggaaaaguaagacuuuaaauguaucuacaaagcaggcaaucuucuaguuucugcuuugcucuucauuaaacuuccccuuuucccccucuaaagguccgaacaugagagacacucucccaacugucccuuugugaagggugagcacacccagaaugugcccuugucagucacccuggcaacgaguccugcgcagcucccuucugcagauggagcugacagaauagcuugcuuugggucugggagcuguccucaguuucuagcugcugcaaccaaacgugggaagaucugcauaugggacgucuccaaacucaugaaggugcacuugaaguuugaaauuaaugccuaugacccagcaaucgugcaacagcugauccuaucaggagacccaaguucaggaguugauucaaggagacccacuuuggcauggcuggaagacucuucuaguugcucagacauaccgaaacuggaaggagacagguacguguauuuuuuuuuuaauguaguauuuauagugguacauguuuucauuuucuaaguuucauuuucuuaacucaaugagaacaaaaaagugguucaaguuagagaguagaaaauagauguugagcugaaauccugaagguuauaugaaauucagaaguuuucauucagauuaccacacacuaguuggaucugauaguuggaacagucuggaacauaaauuaaguauuuggucucaaaagaccaagaaauaaaacagacaaaaggaaaugccacuguguguuaaauacaccuuuucuccacaagauauuuuccuuuguuauauagcuaagacaaacaggaauugguagaaauacugacaagugucuaaggauaaauauaugauaaugaaaaacacagugccaaacagguagcaaacacuaguggucccagucagauagaacaggcuaaaauacauuugucaaauuaucuguuacguaguucuaaagcuacucugucaauccauuucugugcaaaaaaaugucaaacuuuauaauucuugaaaaaguaaacuccagucuuuagaaagccauugccauauuaaacccaacauuuaggcauuguagcucacagagugcauguguagcauuugugagguccuuaguucugucuuuaguaucuaaacaaaggcauaacaaaaauaaaacaagaaaaggaaguugaaacauuaauauuaaagcaguggacuaaauuuguaauuuuaccuuuaccuccuaguuccacagaauaguuguucugaaaugagucugguuucucuuaguucugaaagugagugucccugagcagcaaauaacuuuagacgaggcaguaguaaacuaguaguauugaggagacaugccuggugguuuuuguuuuguuuagacaccugccuuggcuugagauauggauaucacuacuccucagaacugcaggaugcagcuugcauauagcuugagacccuuagcugcuuugguagauucuuggcucuuguggcucuaucagaucuauaggagaugggaguacagaguccaggaaacccucuuguuuccuaagaaucuccacuuuugacuuuaaauugggccaguuucacauggcucagauuuagucacauaaacagaauuaagaauuuaaugauagccccugagcgugugaugaauaauagcagcuaucccugugaagacucuacuggggauaacguguacugaagcauauuuaacugugacuugguugagaguuucugcuuuuuaccugcuggauguucaguguuacugaugccauaguugcuauacuccagucacgucucccccagggugcccuuuugagacaagauuuugauaugcagcccugacuugucuggugcuuauuacauagaucagccugcccucaauccacagagauucuccugcuucuuucgcaggcgugcugggauuacaggugugcuacuaugcucagcgacaugcauuuuuauuuaaguaauacagaauuuuguuaaaugaaaauuaagacauuuaauugauaauucaaaacauauaaauugggaaguuuguauaguuugucaugguacuaacuuguggaaauugacuggcagauaaaggaauuguaccugagaucugguacaaaugaaaugaaaacuugauggcuauuuucuguuauuuauuguacaucugcgugaacguuugaggggcaagcaguuuagcuauuuuugucucaguuuauuagcacauuugcugauaacacuagaaccaagaaugcuugauuuuuaugauuuaauuaaaggauuuaguggauaauuauggaagauaaugaaauuggccugucauuuuaaacauugauuuuaauuagaacuuuguuuuaaaauuugaauuuguagauuaaaaguugcauaaaaauaggcuucuaggauugccacauugauacauuccucuuuggggaaguguaucacauguauacguguauacacauacacacacacacacacacacacacacacacacacacacacacacacgguuuauuauacucuuguguuguuuccagcagaaauuuauuacaguauuauauaguuaaugaccaauugguugagguaguacacagaagugaaacacacgguaagaagaaggggcaaagcgggacuccagguugaggauguacucgcuuguagacuacuugaccagcaggagcaaaggaaaauccuggguuuaauucccagacucauucuccucccagaaaggugggaagggccugaggggcaaagaagcagccagcauuauggugacuacaugaaccuagcacgggggagcuuaaucaggagaauggguugauacgcucuuuuaaagcaaaagaaaacccagaacaaaguccagccuuggugcucugccccuuuugcuugacuucugguuacucuccuuccagaggcaaugggaguccuguggauuaccaguaaauagaaacacuucugacuuuguguggcacaagaugcaauauguuuaaucuucacauaucaaauguggguuucauuaacuuuaggaacaacauaauuugagauuaaaagcuggguuuaaaguuauuacaguauaacuuguuuaggaauuacuuuugacucauuuugacucaaccaggaauagccacuacaauccaccccuugucaacuugacacaaauaauaucucauguucacaugaaacaauaacaagguugugaauaugccuaacaugauauaacuaucccucguacaaucgcaaacgcauuuguaaauuuacaaugggcauucauauuacuuagaauccucguuucugcaacugguuacguggccuuaauugguauuuauaacuaccuuccucuacuacccauucuguacuuccuucaccuucagccagcaccucagcaggucuuggcucuuuuccuggaggauugacccauaccuuuauuccugaugugucugcguccuuugucauccugcuuggauuaggcuguuguaguuucccauuuugacucaaagcauugacacaauucucaauguacucagugaguauuugauagcauacuuaauuuaaauaaaguaacauguuucucuagaugcuauacuuguuauauauauuucuuuuuugagacaggcucucgaguaucuauccuacauugacuuugaacucuugaucuuaccucugaccucaagugcugagauaagacauuuacuacacugccuggcuuuguguauuuugcugaguugacaaagauguucugaauuucauuuuugaggacacuauggcauugauaaaauuaaugauauuuuauuagcuuuaaaacaaagguaguauuaacuaaguuuuguaacuugccuguaauuuaucuuguaugauuuguaacuugccuauaauuuaucuuguaugauuguuacuuuuuaaaauauuuuugucaccuaaaagcugaauaguaugggcauaaauauguuuauuguagaagaauuggcaaaggcaggaaugagaaugaaagagaacauagagaacccguugaagcaguuauuuggcuaaauugcuuugacuccuggugcucuccuguaccgcucagaagcucucuggguuugcgaaugaaagacagacagacagacagacagacaugcacacgcacacgcacaugcaacaguuaauuuuaguaugccuugaccuggcuagcauacauuucccuccaguacccuggcuccaacaccuucuaaaucuauguuucaucucugcugcccuguuaccuucugggcagccccucccauaggacuauugcccuuaccaccuacauuuuggaugaauuuucuucuguagcucuaaaucugaucuggcuccccuacccccaccccgcucccccuuccuucugcccuccgacauggcaauccccccuuucucucucccagucuccaacgcgcacgaaucuaaagguccugucucagucuaccugcccugcuauuggccuuuggcucuuuauugauugaucaaaauccaauuguggacaaggaccuucagcauuuggacacacagauucccaauuuugggggccgauuaauucaaagccuuagaaccaauccccaacaaccuguauucaugcuaucuaguuaugggaguguucuuuuuuuaaagcaaauguuggaucaauuuauaugcauuauaauuuuuaucauaaaguauuuuagaaauagaucauuauguuuuuguagaccaauuagaucuguaaugucaagaccauugaauucuuuccuuauaaaaacuguauuuuauguuuuaucucaguaugccugggugguaauugguuaauacuaaaguucuucuguaguugaaaccuaauguguucuguuccuguuuugaauuugcuuauccuagcucccaagugcaguauuuuuuuuuuuuuuggaagaguuuuuuuuuuuuuuuuuuaaacuucugauucggauuugaauacuugaagcucuuagcaggugaucuuaugcuuguuuuacauccuuuuuauuauuuuaaauuguagugaguugggguugguuucuggugauacugcucagugggagagcaauugcccaauauucaggaagcucaguacugagcaauaauaauaagcuaaucugugacucagagcugacugcaucugucuguuaauaccauuuacaaaaaacuuaaggcacagaaccuuugucagcauugucuuaguaaacaguuguagacauugccuuggaaugcuguauuaugcuccuccuccucuucuccaucuccaucuccaucuccuucuccuucuccuucuccaucuccaucuccuucuccaucuccuccuccuccuccuccuccuccugcuccuccuccuccuccugcuccuccuccuccuucuccuccuccuccuccuccuccuucuccuccuccuucuccuccuccuccuccuccuucuccuccuccuccuccugcuccuccuccuccuccuccuucuccuccuccuccuccugcuccuccuccuccuccuccugcuccuccuccuccuccugcuccuccugcuccugcuccuccuccuucuccuccuccugcuccuccugcuucuccuucuccuccuccuccugcuccuccuccucuuccuucuccuccuccuccuucuccuccuccuccuucuccuccuccuccuccuucuccuccuccuucuccuucucauccugcuucuucuccuccuccuucuccuccuccuucuccuccuccugcuccuucuccuucuucuccuucuccuucuccuccuccugcuccuucuccuucuccuccuccuccugcuccugcuccuccuccuccuucuccuccuccugcuccuucuccuucuccuccuccugcuccuccuccuccuccuccuccugcuccuccuccuccuccuccugcuccuccuccuccugcuccuccuccuccugcuccugcuccuccuccuccuucuccuccuccuccuccuucuccuccuccuucuccuucuccuccugcuucuccuccuccuccuccuccuccuccuucuccuccuccuccuccuucuccuccugcuucuccuucuccuccuccuccuccuccuccuccuucuccuccugcuucuccuucuucuccuccuccuucuccuccuccugcuccuccuccugcuccuucuccuucuccuucuccuccugcuccuccuccugcuccuccuccuucuucuccuucuccuccuccuucuccuccugcuccuucuccuucuccuccugcuccuccuccuucuccuccuccuccuccuucuccuucuccuccuccuccuccuccugcuccuccuucuucuccuccugcuccuccuccucuuccucuuucuucuuucuucuacuuucuucuucuuuuucuuuuuuccaagaaagguugguguaguuuagagacaaggccccccagaugcccuggaaguuugagcaaauguccuuuugccucagccuuucuaguagcaggaaagauaggugcaggcuugauagucuggccgaagucuuaaguagagauugccauuuauauguaaaacagcauuaguauauaagcauugugacuuuuaguacaguauauuauucuggaaaaugagacuugccuuuuuuuuuguuuguuuguuuucaagacaggguuucuuucucugcauagccuuggcuguccuggaacuaacucuguggaucgggguggccccgaacucagaaaucugccugucucugccucccaagugcugggauuaauggcaugcaucaccacugccugggagaauugcuuuucuuucuuucuuucuuucuuuuuuuuuuuuuaauaaaauacaucuuuuaguuuuguaacgagaguaucaaaauuuuaaaauacuggugaucuguuggugaguaaagugcagagcuugacuguuacaucugcgagaauggguaaagguugaugcaaagaugggagcuggcaguuucuuggccaccugaaugaagggcaaaggauagaucauugucuuuacuccugucuucugaacugugacucuuaacccucaaugucucccugaaugaacacccauaaacacaauaaaagugaauguugguguaaauacguuuauaauacauuacauacacacauaauguucauaaaacuguuuuuugauuuuagaguaauggucuugaauuuguugacaauagcuguuaguauuuuacuacaacaaguucaaguuugauuugacuagcugacauucucuuuuacucuagugcuugcuauaaauuuucucuaauuuucuauaucuauaaauacuagaauuuuagaggguuccuuccacacaaacuuucauguaaacauucauuuacugcuuuauaauuguauagcaguuauauaucaaaaugauuuauaucacauuucuuuuagcgguuuguauauugcuauuguuuuagcuguguaauagugguuuaaacacugcauaucagggcuggaguuauagcucgguuuuguuuugauuuuuaaauauuuuuaacauuuauuuauuuagguguguuaaguauuuugucugcauguauauauguguaccaugucugugucugguucugauggagguuucagaagagagauucagagcccucagaauugaaccaucauguauaugggugcugggaacugaaccuggcuucucuuuaagagcagcaacuguuucuaaccaaugagccaucucuccagcccugaccucaguuugauccuuagcucugccccuuuuaaagccuaggagacaagccacacccagcugugcugugucuucuuugcuuucuuaugugauguguguucuuuuuuucccugcuggggauuaaacccaagaucugacacaugcagauuccuacauugcagcugaugccauuguucuuacuuugucuuuuaagugaugauuugcuggaggauucagacagugaagagcauuccagaucggauucugugacagguauguaaaagaccuuagauaauauaucuuauaucucuuuauauuuauacuguucaaaguaaaucuuaauaccaauuaguucauacuuucuuggugaaacuggaagucuuuacugauacacacuauuuaaguguccuaugucugucagaucuuggauuucaguauuagaacauuguggguuuuuuuuuuuuuuuuuuuuuuuuuuuuuuugguauuuucgagacaggguuucucuguguaacccuggcuguccuggaacucacucuguauagaccaggcuggccuugaacucagaaauccaccugccucugccucccaagugcugggauuaaaggcgugcgccaccaccacccggcagaacauuguguuucauaauuaaaauuuaaaugacaaccauuucauuuacagggaauaaaguauucccugucacauauuccagagaauggaaauuaugcuuauuuuauuuguaugcuaugcucuuuaaaucagaauaauauuuaaauaaaaguucuuuauacucaaagcaguugaaacuguaaacucauauaggcauugugacaucaaguagauguugccuuguuuacucaugaaaugcuaagguaaaagcagcauggcugucagguagccaggcucucuuggagcuugcucuucucuuagugagcuuuacauucuucuugcauugauauacucaauguuggauuauaggcauaugucagcaucuggcucacaugaguuaaauauuuuucagugucauucauaggauagguuagucaucucuaauggccuuauuacauauuuuucuuuauggguccaugcauguguuugauaaugcucauaugugcaugugcuggagguugauguguuaaaggucuguuauuucucuaccuuaguuaugaaaacccuuccuuacuuuugagacaggguuuuuuaccucaguauuucaugagcaaacaaggcaagaucucccugaugccacaaugcuaaugauuuuacaguuuuaacuucuuugaguauaaagaaccuguauaaaaccaguagcccugguuauccugggucucuguagacaaagguggcuuugagcucagagaucagccugcccuuacuucccaaguguugggaugaaagcaugugcuagugccuagcgcaacagucccuuacuaaauugggagcuuguuuauuugacgugguuagcuggucaagucaaauagcugcaggguuccaccagucucuguuucccucagugcuggaguuacuaauagaugccaugcuuggccuuuaccugggugcugggaaucugaacuuaagcuucaggauuguguagcaagccuuauuucaagcuuauaguuaguugagccaucugccuuugccauagcacguuagaguauaaaucccaaucuaauuauuauuguauaguuauauuuuguaaaauaaugauauuuagcaugcauuaaagaauuguucacaguaccugggaaaugcucauuguuuauaaagugaugguuauugugacuagaaugucauaccaugaacaugucaaggauaugaaacauauuuuaugucuuuagaagaaguguggguuuguguaguguagcaguuaaaaacucauuauuauaaaauagcaaauguuuucuaaauucugauuugucaugaauuauuuuuaaugcugcucaggagaaggcuggacugauuuuuguuuaacacucaguuuugaaguucuuagcucuggaaaaaacaaaaagacaugaaaaugcccgagagauacagagauuuauaauuuuagaaaagaaaaagaacugauuccauuuagaaaguucagacgaggcgaccagcgugguucaguagguaguugaugcuuacugccaacgcugaugcccuaaguucaucucugagaccuguguuggugaaaagagccagcagauuccacaguacuuccacacaugcuccauggucuguggacacacacaaacacagugcacacagguuagccuuuuccuccuuugcuguccuuuacaaacacagaauuggcaugcuguuacauuuucuuacucguucauagagaaauagggugggugcuggagacuuucuggaacccugaacuuuuuuacaggaaugacuccugguuuuuauuagguuauuuaacuguguggacuuuagguuuauuucuuaugaguguuuauaguaaguguuuucaaugcccucucaucuuuuuuaaaguuuuuugguuuuaacuuaauugucuaccacaauuguauccuuuucuuuuggucuaaagaacuuguauguauuuuggagaugaauaguacuuauauuuuggggggcaugcuggcagucccauagucugucgugauggcuguaaucagaaggauugcuacgaguuugagccuagucuggacuauauagcaagaugcugucucacuucccaaaauaauacuugcauuuggucuauauucuuuacuuucuuuuaucauuguguuuuucaucugugcuuguuugauuuucuacacugccuuaggauguacuucaguuucuaauauguagacauuuaucauauauuuucuuuugagacagcaucucauuauguagcucuggcuaguuuggaauuuguauagaucauacuagccuugaacucacagaguuuugugcuucuguccccugaguuuugggauuaaagguauguaguguuauccagggccuuaauucuuguugguacauaugauacauuuuuaaagaaguauugucuuugaauagaauuaaaagaucauagcaguaaggaguaaaauccuuucacuuuaaaaauuuaaauaucccuuaauaucccuuaauauaucccuuuauuuguauuuaguauauguauguacauaaaugugaguuuacguguguggaggcaccuccagugugugugugugugcauguguguguuuaugugcauguguuucuuucuuuugggcagaaucuuucauuaacuuagaguuaauuaguacuagacuaaacucuuuggccagugagccccagggaccugcucgucuuggccucccuagugcugguuacaaguaugcuugucugaccuguuguacauagguucuggggacugcauugaggucccucaugcuuuccuuucaaggcaugcauuuuacugacaaugccauccucuuagcccuaguugauuugaugguuuguaaguaggcuguuugcucauaggaaaauauuuucguuuaagacuaauuucaaaaauauagguucuaacuuauacuuuuauuccaguaaucuuuuggaggauuauggaguaaacaucuaaaccugauaguaaugagggauguagucucauccugaauugucuuacaaauuuuagaugccuuuuuagaacuccucuaaguggaguucuaaaauuaauuugagccuagucuuaauuugaaugacguaguuaaauuguaggcaauauuaaccucagaauuaagagugcacaauaagaggcaucuguuuuugguuaagauuauaaguuuugaaaguucuuaguugauuucaaagagaaaaguuuguuucugaauaauauaucugagucaaggaaacaugacuucucaugaaggcugaaaacaagggcuggcuggagaaucgaguacagauugaacguugauggcuuuagaagacagccaagacaaaaucaggacauguggcuguuagaaacuggcuuuggugcuacguaagaaagccagggacagaaggcuuucccagagucguugucuagcagacuuugagugaagggccaggcuguggcagagugguuaccugauaugcaggaagcccuguguuccuuccagagcaccauaaacacacacugaagaggaggggcagaguuaagagaugucagagucucauaguggauuaucccucgucccagaugugcaugcauucagugcuuauaagaggaaguacaauacuagagcuacuugcuauguuuuucuuuguuuauuuauuuuucuaguuguuugcuucuuuugagcagggucucaguguaucucagcacucacuguagugcagagcggccucauacucagaguaacccuccccacucagucuuuccuguugggauugcagcagugagccacccagcguagcugauuguuucuuuuuaaacagcuucauugugcauacuauuuaccuuaaauauuguccuaauuuuaugugcuuuguguauuuauuuucaguuaauauauacauagauuaaaacuauucuauguggauaauuuuuuuggcauaacuuuaaaagguuagcuuuuuaaauuuaguacauccaauagguaagcauuucaaggaaauagauuuuaauuaauuaaacuuacacaaauacuuuccuuuuuuuuccaaucgggaaaguauguguagacagugccauucagugagauggcuauuuguuauuauaaccacagaguucaggggaaugagcugaucacucuucagcuucaguuagaaaauguuucagcuguagagguuaguaauaauaguaaguuaguaagauaauccagauugucuuaaaauucuggguaacccuguaagugaaucuugaagagacuggauaguauaguaucaggacgccuaagugcuguucuacggaucccuugcucauuacuuacuuguuucaguuuuuauauagccacaucauuuaauauuuucaugccucuuauugucauaccuaguuauaaaagcaguuuuaucuuuucuuuauuuuugccuaucauuggaauguuuuucucuccccccacuguuuuuacugacugauucauacuguugggaaaguuaaaaaauaaucaaaauugguugagagaauuuucaguucaguguuugaguggagaauugguugcugucucuggugggguuuugucucugugaccgccagcauuguggagcaauggaagaaauggugcuugaauuuuaaaguauuaaaaagaaaggaacugagauuaugauauuuuucuuagguauuugagagaaucaauuaauuauaauacacaaagaauauuggguguauuuuugguuuagaaaugaaguccagaaauucuauucuuuuagcaucaauuuaaagcaauaacuaaauaauauaguaauaauuugccaugacuuaagaaucaauuucuucucuacaaaauguauuugaguugaaaauaauuuugaauuucuugaguagucuuuuuuuaaguuuucauauguaaggucaucugacauuugauuaaauuucuuuuaaaauauuggauauaaaaauauuuaauuuuuguguuuccauguauguauuggcacaugugaaggucagcgggauagcaugcaggaaguaguuucauuuuucucccucgugggucccagugaucaucaagcugagucuggcuucagggcaagagccuuuuccugcugaucuauccuguggccauggaguccuuuaguaacacauaggucagaugaaucaggaaaaccucacugaaguacugauagugauuuacaugaccacagcugcugcaucuaaugugauauauuuuucuuuucaaagggcauacaucacagaaggaagccauggaaguaagccuugauauaacagcucucagcauucuccagcagccagaaaaacugcagugggagauuguggcuaaugugcuugaagauacuguuaaggaucuugaagaacuuggggcaaaccccucccuaacgaacucuaagagugaaaagacaaaggaaaagcaccaggaacaacacaacauucccuuccccuguuuauuggcuggagguuuauuaacauauaagucuccugcuaccucacccauuaguaguaauucucacaggucacuggaugguuuaagcagaacucagggcgaaaguauaucagaacaagggucaacugacaaugaauccugcacaaauucagagcugaauucuccucuggucaggaggacuuuaccuguguuacuucuuuauaguaucaaagaaucugaugagaaagcaggaaaaaucuuuucacagaugaacaauaucaugaguaaaaguuugcacgaugacgguuuuacaguuccucagauuauugaaauggagcuggacaaccaggagcagcuguuguuacaggauccgccugugacuuacauccagcaguuugcagaugcagccgccagccucacuucuccagauuccgagaaguggaacucuguguuccccaagccuggggcuuuggugcagugcuugaggcuaccaaaguuugcagaggaggagacucuuuguauagacucuauaacuccuugugcugauggaauucauuuguugguaggacugcggacaugcucuguggaaucauugagugcaauaaaucaagucgaggccuugaauaauuuaaauaaauuaaacucugcacuauguaauagacguaaaggugaucuggaauccaaucuugcuguagugaauggugcaaauaucagugugauccaacaugagucaccagcagaugugccggagcaucugcucauccggccggagcagaggaaugucgucagugguggauauuuaguucuuuacaagaugaacuauaccacucgaauagugacuuuagaagaggagcccgugaaaauccaacauaucaaagauccccaggacacaauuaccucgcucauuuugcuuccaccagauauacuggauaaucgagaggaugacugugaggaaccugcugaggaaaugcaguuagccucaaagaaugggauugaaagagaaaaaaagucugacauuucuacgcuuggacaccugguaguaaccacucagggaggauacgugaaaguauuagaccuuucaaacuucgaaauuuuggccaaaguggagccucccaaaaaggagggcacugaagaacaggauacauuuguuucugucauuuacugcucaggcacagacaggcugugugcgugcaccaaaggugagcugcuugcuugauucuucugagaaaccuuugguggcauuugucuauguacauuaucuagugugaauuuuagauccauguaagagguuaguuuuucuuucuaggaaauauuguuuuuaaugccuuuaaacuuauuuuuuaaacuuuccuaggcaagaaaucuauuguaauuagcuuaguaaguccucagaaaguaucuucucagcugaguguaaacguuuacuuaggauggugaaacucuagggucaugaguuugaggccagccuggauuguguagcaagauagagcuuugcucaauuucaaguaucauggaacuuugugaauacugacuaccuacauuuguggaccuaguuuccuuagcaacuuggauaagagggcccuuguguaugagagcacacaagcugcugagggaggaaggacuuauugggcacaugguuucagagauguuaguuugucacagcugggcacauaugaauaguuagggaagcuccugucauggcagcuacaaagcaaggguguguguguguguguugucaccuauagucagggagcccccccacugcugcaccugugugcaaaggccuccauaguucacuuauagauguguuuuuucuacucuggcuccuauagucuguugcuuaggcuuuuuauaaucaaauaauuuauauacaguuucuggcacagauuacuucuagaaaaaacaacuuagcaaauagucuuuaguuuuguaagaugauaagauacuuggucuuuuuuucuuuucuuuucuuguggggguggggaggguucgagacaggguuucucuguguagcccuggcuguccuggaacucagucuguagaccaggcuagccucgaacucagaaaucugccugccucugccucccaaaugcugggauuaaagguguguaccaccacucccugcuggucuucuuuucuuauaagcuuuggcugauaaaaauuaguuuugaaacauuugagacccccuuuuggauauugugcaccauuccccccauauauauauuguguguguguguguguguaaaucaaauaacugcacuauagauuuucacaaauacuacuggcauuuugaaucauaacaaauacucuuugcugucgauagguuaguuggaauuaaagggccacacaguucuugaagccuagaugaguauaaugaagaguugguggauuuaagaaaagcuaccucuaucugugcuuuuggaguuauuaaguuauuaaguuauuaagcugaguauuuuuuuaaguacauuucuagggcuuugccaaagaggguaguagcuuauacauuaauugauucagauuacaaauuugagcuacaucuaguuuaauacccagaaagggggaaaaaucuucaaaguacauuaaaauaauaguaaauagauauaaaguaggaacauucagcauaauuucagaaagauaaaacuuugaaggucacgugagacuugagaguagcucuucuaaguacuagaaaguuccagggaauuuuaacuuaggaucaugugcacuaguuuguuacucuuagugaucacaccuacuuuucagugcauaugcuuuuuguagagcccauuuugcagaucaguaaacuuaagugaaggagaguucaguaacuaaucacagggcuaaugaauggcagagaggcauucugcucaguguguuguuaauaacgucuuuuaaacuguguauacugcguugucagaguauaacaaaagcugaagaaccuuaaaauggauucucugcucggggugguggcgcacggauuucugaguucgaggccggccuggucuacaaagugaguuccaggacagccagggcuauacagagauacccugucucgaaaaacaaaacaaaacaaaaaauaaaauaauauaaaaugaauuccuguaguauucaguauggaggaucugagaaguugccaucuugccauaauuugcccaaaauggugcuucaguaauuuggcccaggacacauacuuguaggaaccuaauauguauagaaugcaauaaggguuuaauuauuuaaauuuuuuugaugagagauacaauuuaguaagaauuugaaaguagauuuauauauucuuagaguuaggacaguagcagaagcagucucuugugauaguugauuuuccuggcuguccuugaacucucuucaaugcugggauuucagguuugucaugaagaccaaguucuggagagcuaaaacaaauaauuuccccuauguguaagcuugugcaugcaguuccagggcugacauugagagccuuucucaaacucuccaguuccauugaggcagggucucucaguuguguccagguuuugaucagcuguucuaguagccagcuuguuccucguguccccucucaggcuuuugagcacugaaguuucaaguggccaucauaccuuuugauguuuacuggggauccaaacucuacucuuuauggacuuugccauuucuuuagcuauaaaaauuauuauuaaaaauaauuguaacaugaacaaaagcuagaagcauuauucauuguuacucauauuuaauacaucuguauauugaguaauauagaucuauauauuaaguaauacuuuugcauaauguuuacaucaugucaagugcauuuaucuccucacucaucaugucuuuguggaaaaaacuuugaaguccuuucuacuggccuuuugacauguuaauauauguuguuauguguaguguauaguaguuaccccagagcuacuugcugcuguauugguaguguccauugauaaaccauuccacauuucccucuuccuugacccuggucucuguaacugucauucugcucuaaacuuauaugaaauuagcuuuuuuacauuucauaggagucacuucauugagguacuuuucugauuuauuuugcuuaacauaaugaucucuaguucugcucauguaauuguaaaugacaggguuucauugguuuuuauggcuaaguauauuacauuauauacuugugucaacuuuuucuuuucauucauuaguuuaagggcacuuaaugcuguccguugugaauucagcccuucugugaacuuggaugugcaaauguuucuuugacacagugcugcccuuugaaaguuugcccaguaguagaauugcuggaauauaugguucaucugcagugaaaguuucuugagaaacuuucauccuacuuuuuuguuuguuagauguauguauguauguauguauguauguauguauguacuuaucuauuuaacacuccagauuucaucaaccccaaccccuacucccccacccaaccagauuucuaaacucccuggggccuccagucucuugaggguuaggggugcauauucucugacugaacccagaucuggcaguccucugcuguauguguguugggggccucauaucagcugguguaugcugccugguuggugguccaguguuugagacauauugggggucagauuaauugagacugcugguccuccuacagggucacccuccucagcuucuuccagccuuucuuaauucaaccacaggggucagcagcuucuguccauugguugggugcaaauaucugcaugugacucuuugagcuguguggucaugauaggucucuuuuugugaguguuccauugguuuaguaguagugucaggccuugggaccuccccuuuagcuggaucccacuuugggccagucgcuggaccuucuuuuccucaggcuccucuccauuuccaucccugaauuucuuucagaaaggaacaauuaugggucgggguuuugacugugggguggcaacccccuccguccugaguuuaaauaggaugacuuuguuucuguaaagggcuuggaggaaggcuuguuucuuacuguuucagugucagcauaccuuaccguucauucagauuuugugucugacaacuuuaugcaguaugguccugucuguuucucucugccuucauuuucuaauggaauuccucaagucacuuuugcuuugauauggaggcuuaauagccugggcugacuaggggccucucuggcuguugcugaccuugugugaaacaucugaggguuauguggguagagauuguccagcccuugguacuugucuugcuacuugcaauucugauagaugcuuggucuuuagcgcuuugcuuguucuacacaggacuguaaccuuaaguagaagggcuuguugguaucucacuugaaacuaacauuuuuuaacuuucaaaguucuguaggucacauuuccuuaggaaguggccggggguuaccugguucucauuauuuaccucacuuugguugucuguaaguuuuauagcuuuauaguuauauauauauaugacuacauauauauauauauauaaauaaauaagaaaagcucugugucauacucuauaagcuaugugacuauuaaaguuuauauauacauaauauauauuuugcauacacgcacauauauguucucuuuuggaaguguaacuacauaaacuuguuacaauggaacauuauuuguaaucauggaguuuugguuuuagucucacauacuugcugaguuugcuguaaguuuuuaugugauagguaugaaaauuagaaauuugauuugcuuuguaaacaauuccauugugagcacaucaaaaguuaaaaauaucuguuuauuuuucuuacuccuggaauuaagagauuggccuauggauguuaauauauauagcuacuguguuaguguccucauccguaaggugaucacaguaacagauaaauuaguuaaagguacaaaacuaauguauuauaugauguaaagaggaugagaauaaauaccuuuuaacagaguguuuugcuuucauguguuguuuguacaugugcuugugcccuuggagggcacacaaagcuguaagauccccuggaauuggaguuacaaauggugugagccaucauguaggugguagaaauugaagccagguucuuugcauguaguuguuuguuuguuuguuuauggguuuuguuuuuguuuuuuuuugagacaggguuucuccguauagcccuggcuguucuggaacucacucuguagccaggcuggccccaaacucagaaaucugccugccucugccucccaagugcugggauuaauggcgugcgccaacacugcccacccauuuuaguagucuuaagauaaaucucuguauucuauuuuuguuacuuaauugguuguagcucauugggacuaaaucuccaauuuuuuugacacagguaauugcuguagugguuuuuaucuggguguuaaguacuauuuuaacaaauuaugaauuuuaacuaauacuccauuuaauuaaaaacuauuuuauaugcauuuguugaugaaauuuuacuauacuauagguggugagcuucauuuucuccaaauuggaggaaccugugaugauauugaugaagcugauauucugguagauggaucccuuucuaaaggaauagaaccagcucuagaagguuccagaccuuuaucaaauccuucaaguccugguauuucagguaagauacuacuuuuuaaaauauccuuguaauauuuguuugugucuuauaaugaauucuucauuguuacguuuagaaagacauucuuuaaccagguuuauuauuauacuauuauaauuaaccuuucugguagcugaaaaauguuaugcaaacuuaguauagaaagaaauuauuuucauagacuacacaauauuuaugagaucugccuaagaagcaaaacuaucauuucucuuauguuuuuauaaauuacauuuuauucauguauuuaugucuuuauuuauguguguguguguguguguguguguguguguguguguguguguguuuguaugcuugccacagcacuucuguggaagucagagaacaacuuguaggaacugguucucucuacgacaugaguccuggacugaauccaaguuguuugaugugguaguaggcccuuuuaugcuuagccaucuugccugccuuuuucucucaauacauagcuuuuaguuuaauuaaggaauacaacgugaaagaaagggacacuggggcuggagaaaaggcuuagcgguuaagagcacugucugcucucccagagagccauuguucauugauuggccuucgacagucuguaauucuagcuccgaggagaucugaugccucuggucccugagggugcugcacucagaugcacauacucacauacggcauguacauacauacacauaauauagagcagaggaagaguaaauaagugcagaaucaauggaguggaguaauagucugaauaguacauguaauugaauagcuaagagacauucuuaccgcagagauuuauuuacauuguccuugccccauuucuuaaccucuggauaacauuguguguguuuaucguuuuuuuuuguuggucacacuguccauggcaaaacuccaguuacaggucuaucaguauuaccugggcugaauucucacuucuccuagcucuccugacagagggcaggcugguguucccuaguguccagcuugcuacuuuuacuuuuuguucccaucuauacucuccuguuuuaaggauuuuacaaaaaaacauagcaauagcauauaauuccggcuuaaaagcucuucuuugcuuuguugacauuuaugaaguaauuauaggcugcuucucaaaaaauacagauuuuuuucauaaaaaucuuaaaaauaaaaaagauuucauuauguagcacuggcuagcaugagacuuacuguguagaccaggcuagccuccaauucagauauucaccuagccuugcccacugagcacugggauaacagguauaugcuaccaugcucaggaaaacuucaggauuucuuuuaaaauauguuuagauauucauuuuauguguaugauauauuaccugcauaugugucugugcaccagcaccacaugcauaucugaugcugcacauuagauuccuugucacuggaguuacagacaguugugagcuccuuauguggguccugggaaucuaaccugggugcucugcuugaaaagaagagccagugcucuuaaccacugaaccauucuuuccagccccaacuuaugauuuaugaaguauauaauucaguuuuauguucuugacauuucauguucucuuucccuuugucugccacacuucauccaguccauugcauguuccacccccccccucagugcugugguucaaagccagugcuuuauggauaggagagaaguucucucucugaccugcaccccauccuuguaccuccccucugcauagccaguuccuccuucugugguucuguaacucuuaacacaguccacaguuuaucuucuuaaccuaauguuuaaaagaaauuuaagcaaggcuugguggcauaaauuuaaccccaguauucuggaggcagaggcauagauugguugauuucuguggauuccaggcuacccaaggggacauaaugagaucuugucucaugaacaaaacaaacagaaaacagaaaaggacuggagauguagcucaguggaauacucauugcucuuguagauaaccuggguuugauuuccaguaaccauacagugacucauaguccccuguaacuccagguccagaucugaacccccucuucuaaccucugcugcucccaggcacagaccugguguauauacauacaugcaggcagagauucauaaacauaaauauuuaaugaaguaaauuuuaacagaauacuuaauaaauguuuuaaaaaguaguaaauaggucaguaaaagacgcuugagacuuuuucagugaaaaauguguuguaagagugagcuguagugcugcaggucucuaauauuugcacuugagagacucagacucuggaguauucugaguuuguugccaguuuugucuacacagugaaacuccaauuucuccccauaaaaaauguuaaagcacaugcuaaguaggagcaauaucuaaacuugucacuuauucuuuaugguaucuuguaguucagcauuuugauguuuuucucuuacacaagaaguaaucuuuuggugaucacuaguuaauaauauaguucauuuucggaauuaguaacguagaauauggucauuuucaauguuuauuuacuacuggcaugugucuagaggaugucuuuaucacagaagagaaagaauaguucauucuugguguuuauugccuuuggcuguuuuacaugauuauaaaagggcauuucuuuuuuaaaaaauuuuuaaaaagauuuauuuuuauuuauaugaguauacuauagcugucuucagauacaccagaagagggcauuggaucccauuacagaugguugugagccaccaugugguugcugggauuugaacucaggaccucuggaagagcagucagugcucuuaacugcugagccaucucuccagcuccaaaagggcauuucuuauguaauugcugcuaccuugcauuugcuuuguaaauaacauguuaucaaaauuaaccacuuaucugagugugguaauuaguaguuuaguacuauugacuuuauugcccucaguuauuuccccuuuuuguuuuuuguuuguuuuaacuuuaaagauuuauuuauuuauuuauuuauuuauuuauuugaguacacuguagcuaucuucagacacaccaaaaggggacaucaggucuuguuacagaugguugugagccaccaugugggugcugggauuugaacucaggaucuucagaagagcaguaagugcucuuaaccauugagcccuuucucccacccuauuugccuuuuucuaacagacuggauuugggaguacugaauaugaucugucccuuagccaaguacuacuuaguauagaauaaagauuccuuaguuuaguuuauucuuuuuuuucauguauuuggcaguguuguauuuugaauagacaaauaaaaaaaaaaaagaacugaaauaagaacuaaaauaaugucuuuuuuuuccccuuuuuaaaucuguuucaacuacugcacuuacuacuguuaggaguugaguuauugguggaccagccuuucacacuugaaaucuugacgucuuuaguagaacuaacucgauuugaaacacugacuccacgauuuucagcaacuguuccuccauguuggguagaaguucagcaagaacagcagcaaagaaggcacccgcagcaucugcaccagcagcaccacggcgaugcugcucagcacacccggaccuggaaacugcagaccgacagguaugcggcuucuccacggagauuggacucucauuagaaguaacauggaguucucagccgucuuacuguuucucuuaauauuggaguauuaauaacuuucucuuuguauuugucauuugauuuuggauauuccuguauugcuuugacuuguagaauaauaugagaugacucacuauuguuauuugagagccaaaauuuaaacucuuguguguaaaaccagccacuguuucagacacuaguguuucgaaagucauauuuuagugagcaucaaacagugaacagguauauccuauuguauauagucauagugcccagauggcugugguuagauuaaccuagagcuuggggaggagagagcaaugguagagagcucuguauagagauucugauucaugggcagugcaaguaugaagccucugacaucuuacgguuucuagaguaggaaaaccacuauugucggaggguugugaacauaguagagggcaggaaguaaggucccgccucuguuuaggagcugagggcuagaggccuuugagcacagucaagcuuugacaacaaugcacagcacaggaucccuccugagucugcuguuaggggugguaacaggugcguacgguuauggauucuggugaugguggguacuggugcaugcaaagacuucgcuuugguugucgaauuguugaugguaccuuagaagauaguaauaaugauggagaaaguuaaaagaguagugagaaucuggauauaauuuaaagauaaagggcauggaauuuucugauauauuuaaccucugaugugagagaggacauuuuguagcaauagaagagaucaaguaagaaguucuuauuuuacaaugaaaauucuaggaucucauuuauagaucuugguuggggcccaggaaucuucagguaauugauacaugauagaaacccucuuugaaugucaaaggcuuuguuuugguuugguuugguuuuucuggagacaggguuucucuguauagcccuggcuguccuggaacucacuuuguagaccaggguggccuugaacucaaaucugccugccucugacucccaagugcuucgauuaaaggugugugcugccacgcccugcuguuauuuuacuuuuauuuaaaaauauucuaucuuauuuauuugugugggggcuuuguuauaacaaaucucaaggcagguacagauugcuaagguaagauuaaugcccuaaguuucacuuuuaacaaacaaaaacaaaaugggcuuauuuuaauuuuuucauauguauauguauaucuguuuaaauguuugccucauguaugugugugaccauugaggccaaaagaggauaucagcugcgcugguacuggguuuaguggcuuguaaaugaacuuccauccuguggaaaugggcucuuuuuaaacccugagcaaucugugcagccucuacccuccuuuccuuucauuuccccuuuccucauuccaauuuuccuuuuccccuuucccccuuucuccuuucccccuuuucccucuucccucuuucccuuucuguuuuuuccuuucuuuuuuugucaucucuucuuucccccucuuucucuccuucccucccuuccuauuuuuuucugagacaggguuucucuguguauucuuggcuguccuagaacucaguucuguagauuaggcuggacucaaacucaauuccucaugccucugcuuaccaacagcugggauuaaagaugugugccaucacugcccauuuccuccucuccucuccucuccucuccucuccucuccucuccucuccucuccucuccucuccucuccucuccucuccucuccucuccuccccuccccuccccuccccuccccuccccuccccuccccuccccuccccuccccuccccuccccuccccuccccuccccuccccuccccuccccuccccuccccuccccuccccuccccuccccuccccucuccguucuucucuucuccccuccccucuccccucuccccuccucuccccuccucucuccuccucuccccuccucuccccuccucuccccuccccuccccuccccucccuuucucuuuucuuguuaauuuuuuucuuuuuaaaaaaaguuuauuuguccuacucacugccuuccucccuaucauguuuccccucuuuccccuuauuccuucuucgcuuuucugagcaaauagggaccucccuggguauccccauguccugguacaucaaguccaucugaggcuaggagcaucgucuuucacugaggcagccaagcuagaagagcauaucccagguacagacaacagcuuuugggauagccccuguuucaguuguucaacacccgcaugaagaccaagcuguacaucaacuacauuaugugcaggcaggcuuagguccaacucccgauguucuuuaguuggugguucagacucugagagccccaggcguccagguuaguugacuguuggucuucuuauagaguuucuauccccuuagagacuacaauccuuccucccauucuuccauaccaguccccaggcugugggugucuguucuguaucugucugaguaagcugcuggauagaguggggagggguguucaggaucaggugugaggagggacaggagagaugauggauagaugcuaugauaaugaauggaaaucugcaacugaugggugugaggagguggggggcaucuuuaggacaagacugagaccuuggaucagggaggugcccaagaaucaguaagggugaccuuaguugugucucacuacauuggggauauggaaccugaagaggcuaccuccuauagucuggugggaacuccauuggagugauagggacaccaacccacccacaaaauuuuugacccaaaauucauugugucuacaagaaaugcggucacgggggauggagcagaaacugagggaaugggcaacaaacaaccagcacaacuugagacccaucccaugggcaagcaccacucuaugacacuguuauguuugcagacaggagucuagcaaggauguccccucuucuauuuuuugaagcaguguccuuguauuuuaguuuuguuuagaacucugcauuccaggguggccucuuucuuguuucuucaucaugaguucuguguuugcgguuacuaaccaccacacccugguugagaaaacaaggaguagaaaagguaaugugaugcuaaugauauuuugguguaugaaggaaguguuuuucuucauuuaacauuuuuuaccuuaucugacagcaacagcugggaugaacauguguuugaauugguucuaccuaaagccuguaugguuggacauguggacuucaaauucguucugaacuccaacaucaccagugucccccagauacaagugacacugcugaagaacaaagcuccaggccuagggaaagccaaugguaagagggaucagagcuacuacuggaaggucuuguccugggcuuguugucucuccacgagcuugacuguuguucucgugacucuugugcucuccagcgcuggcgaccuucuaguuuuauuuucuaaaaccacucaagagagucaucuaaaguacauuucagauuuuuccaguaacuuaguaauuuucaggauuuaugaugguaaauaguuuaaucaugucuuuugugaagugacaccaguuccccuucugugacugccagcuuuauucuuugucuuuuuuuuaaggaagaauugaugguaagagaaacuguuuugaaaauuauuauuuuaaaguagucagucaagcuagacuuuuauguaaugccagaaauaauagcaauuuuucauggauuuaccaugauaggaacuagauauuaggucucauuacuugucucuccccuccccuccccuccccuccccuccccuccccuccccuccccucccuuccccuccucccccuccccuuccccccuucccucccguccccuuccuucuuuuuuucuuccccuuuucuuugaaaauucauucuuaaaauugaauauaaaaucaguguaaaaugaggacgaaaggguacaaacauuuugcucugaaaauguuccuuugccagaacgucuuuguguguuugcauacugaagagagggagggagggguguguguguguguguguguguguguguguguguguguguguguauucauguguguauucucaugacauuuucauuuaaugaauuuaggacuuaggcaguugguaucuuuagaacuuuguagguauuuguauugugcagcuuagggaggaacuuuuaauuuaguugccaacaaguuauaucuucaagcaaauauuuuauuacuguuuguagagaagacaaaauauaaaaucauugaauuuaauuuucucuucuugacaaguauuuuauagcaucuauggugaaaucuuaguagcucccuguuuagcaaaagauuugagaguuuuaggcacaaaaauuauugauauugagcaaaauuaaguuuacuaauauuuuuauccucuagaaacagcaguagauaggcagaucaccuuuccuuugucuccagcucuuaacauugaaguggaacauaaugggaacccgucccugguugauuugaaugaagaaaugcaccacauggauguagaggagucacagugugaguucaaccacagagcuguugucccuggcaguaaaggaguagugauuguaaugcauccuguggggaaagacuuccuuguggcaaauaacuuauaauucugcuuuugcaaugugcuguaacuuccaucucaccuuugugaauauagcugcacuaauacuugugauuuaguccuuaaugccuugcaauuugaaaucaauucaugauucuauagcuccucuuuucaaagucaaggugaaauauaaaaugagaguggaaaaaaacacguaacagauaacugauuauacuaaugaguuguuggaacacauuuuaugaauuguauuuuaugcggugguaucauauggaaaugggauggauauaucuuuauuggauuucugauaauacucugaaagaaaaauacauauuuuucuuuuuaggucuuagguuauguccauucuuagaggaucauaaagaagacauucuguguggcccaguauggcuugcuaguggucuggaccuaucaggucaugcugggauguugacguugacaagccccaaacuuguuaaagguaaagugagauguuuuguaaaaguagaguaaauaaugccagcauaauacagaagacacuuuugaaaacugaucccaaaaugcuguuuuguuuggaacuuugacuaggacuuccagcgucuuccuaugugugaggguaucgccuaucaugagugugugugugugugaacugacucuagguuuucaggucuucguacgucuuagaguuaggguguggcgucaucacaguuggguguuugaggaaagugcaugcuuuauauaggcuucagcauucauuggguggcuuugaaacauacaccccguagauaaagguaaguucuguauauacaaguuucauuguauuucuugacuguaugguauuuguuaaagauuugagauaugaugauguauuuggguucauucugggaaguagugguaugaaaaaccaaaucucuuacauuauuuagacuauaacauaagcuuguaagugggaaaauguuuagauaaaacauggggaugugccacacagcaggacuaggaaacucuuaguguuuugcagcauuuuuuuaaaucaaauuucccucaugagcucacaauuauuuuugagacaggaucucuccauaacccugacuauccugcuauugauuauguaaaucaaacuggccuggaacucagagaaucaucugccucuaucuccuuagagauaggaucagaguugugugccaccacaccugguucucacgaucucuaagugauggaagcaaugauugcggaaucuaauggaagagugaaaguaugaauugugucaaacagcagauugagauggggaguccuaucaaguccuaguagucuagguguauuaguaagaagaguguagcagcccugggacuacuugggucagagaaaaacaagugacguguagucaaacccuaggggcaggcagggaagugggaagcugccgguggguuugcagcuauuaaaauauguagcccacugcagcaguagucugaugguuuguucguuaggucuauuuauuugaggauauuuuugcaacauuuuacauuauagaugggaucugugaucucaguuuagugacuguugauugcuuucaucuugagagauacaauuacaggaguuuuaguuaacaccaagguguaggcacuacuauauaugagaagaaaccaaaccggaagaaggaauuuuguugcaugccuaaaagcagcauauuaauuacccaaauccuggguauaugaguauguguguauaucucaaaccauuuucucuucacuucaaaguuuuucuuaacugagguaaaaauaugucuuugauuuuuuuuuuuuuuuuaacuauaaccauuaaaaugcuuuauguacguauucacacacuucuauaaaugggcagacaggaauguuagauaaggcauagugaggcaaagagaccuguguucagagcacacauacauaaggacaugcucacacucacacauaaacauaauuaacagauaaaauaaucauuucaaaaagguuagaucauggucaugcuaccauaaucaguuguugacaguaauccuuuacaaucuacuuuugcuuguguuguuuuuuaauaguuuacaaaacuuuugccaucuaaauaaacgucacuggaacagauaugucuaaugaugucuguaguuacaguuuucuaaauuugcugagacuuuuuuuaagcuuuuuuuuuuuuuuuuuuuuuuggcuaucauaucaaaauuguucuguuauauuaaucagaugauauauauuguuauuucuggccuauauuuuucuuuuauggaguuaguacuuacucuugcuccaugaugaugaaguaauaaauuauuuucucacucuucccuuguccagguauggcaggagggaaguaccguucauuuuuaauucaugucaaagcagugagugaccgaggagcagcagaugagaugugcagcaguggccugcguccuguugugaggcuuccaucucuuaaacagcagggucacaagggauacucacuggcuucucucuuggccaaaguugcagcaggcaagguaagacccugguuuugaacgggagcaaugcuguuguugagauuuguuggaaggggcgcuucucuugguuaaucguuuguuugcuccuuggucuauuacugauuuuuccuuaugaugauuucagaaugcauauaauuacgaaaauguuuucugcuaacuuuggauuaggaauuagcuuuuauggacuauugaaaagggagcagcuuuagaagguccuuuccuuuaaauucacagcuuuuuuguuccaaugauacuugagaaugcuguugcugaauaacuuuagagauagccuugauuaauuuucuauagguaugcaagguuuucauacuugucugagugaagauuuuccugaacuuggguuuuuucuuuccuuuauuauuuuuauuuuuuaaaauuuauauauauauauauauauauauauauauauauauauauauauauauauauauauuuuuuuuuuuuuuuuugagacaguguuuuucuguguagcccugacuguccuggaacucacucuguagaccaggcuggccucaaacacagaaauccgccugccucugccucccaagugcugggauuaaaggcgugcaccgccaccaccacccggcuaucauuauuauuuuuauuacgaaaucuuagcaucaguaucagcaccccucacuuuguauauacauagcucuuccaguuuuucaaggucuuuaucagaguuaauucucaaauuaacugaguuagguugagcaguauacgguaggccaagcaguagaugguaggccgaacaggugcuauuucuguguauguuagcguucuguagcuugggauugcauucaguauuuugguucuuuauuuuuaauuauugagcuucagaaaucuugacuauauuuuuucuguuaaaauaauguggaaagcuaggcauuuaucauuuuagucugaauuuuuuauuggagucuuauuuuuauauuuuuaguuugauuuguuugucucauacuuauuguuauuaaauuaggaaaaaucaucuaauguuaaaaaugaaaaugcaggaggcacccgaaagucugaaaaccugcgggguugugauuuacuucaggaggugucugucaccauucggagguuuaagaaaaccuccaucuguaaggaaagguaaccacauuucuucagucugccauucuuuugucuuguuuugguuuugaaacagucucagguacucuucacugauccugaauugauccucuucucuccaaguccuacuuaauaaguauuuaaggugccucaucauauauggcgguucugcuguuaacaauaaaaguauaaauacacaagugauugaacuuuuccaccggaaguacuugcuugcuuucucauucucuaaguaaauggcauuugcugaggacguuacucauugccuucauugcuuuaucucugguuguauauauaguacuuaaugauguguaccaugaaaggugagaaauguaaggagcuugauuuaaggacacagccacauucucucaggucacauuauuguaaacuucuuuuucuuuaaaacagaguucaaguucuguacagcacauaagacuauucaaaaagcauucuuuuuuuuuuuuuuccugauuuuucgaggcaggguuuuucuguguagcccuggcuguccuggaacucacucuguagaccaggcuggccucgaacucagaaauccaccugccuuugccucccgagugcugggauuaaaggcgugcgacaucaugcuugacucaaaaagcauucuuauccuuuuuuuauugaccucuuuugcauuguuagagucuuaaacauggcugguuuaaguucucuaauacugaacuacguggccagcccugaaaacuuuauuuguuauauucauuauuagcacuagucugauugucguguuuuuacugguguaaacaccuauaauguauuuauacuuucucuccuuaggguucagcguugcgccauguuacaguuuucagaauuucaugagaagcuucuuaacacgcuuuguagacgaucagaugaugggcaggucacagagcacgcccagagucuuguguuggaugcucucugcugguuagcaggaguccauucaaauggaucuggcagguuaauaauuaggauuuuguuugcuuuaaugauuauccuuuagcuguuaugauucagaguccaaagugaaucuguuugcucuuguuuugcagcucaaaggaaggaaaugagugccuacuuucaaaaacacggaaaugucuuuccgauauuguccguguaugcuucuuugaggcaggacgaaguauagcccauaaaugugcucgguuucuagccuugugcauuagguugguguguguauuuuuuuuuaaacuauauuugcgcuuugguguucauauuuugucuauaaugggauuugauucucaucaaauguaugaguaacuuucaacaguugauaacuguuauguccuaaagaaaaauuugggauuucuuagggugaaaugcauuguuaaguuacgucagcugggcuuaauuaauucaugagaauuugaugaguggagcccugacuccuagugguugauugaccacugccuuauccuuguuacuuaacagucuugcucaaucuucagcuguaaacccugaaacuuuacugucuagaaauuauuugagagggaugaaucuauguauuagcuuuucuuaguaaugguaauggucuaaccugggagaaaauucuuggugauauggcuuuuuuucauauauauauauaaauaaagcacuaugccaaguuuagaguuuaagucaguauaauaaauaaugucuuuaaauucucuuacugaacaauuuuccaguaauggcaaaugcgagcccugucagccuggauuuggaucgguucuauugaaggcuuuacuugauaauaugugcuuuuuaccagcagcagcaacuggugguauguaaaguuacuuuaauacauauuuauagugaauaauuuaaguuauuuuguucuuauuguagcuucucuggaugauuaauucaguuuuuguuauuggguauguuuauguuuguguguaggugcaccuguuuguguagguacauuugcaguggacucagagagucucagguauaauuucucaaaaauguuguucaaugccugauggugguggcaugugccuuuauucucagcacuugggaggcagaugcaggcagaucuaggccagccagccuugaacagagugaguuccaggauagccagggcuacacagagaaacccuguccaccuuacuuguuguugacuuuuuaauugguucuuugugaauaucacaacauauauuucaaucccacucgucucuucuuaccugccaugugcucuugcaaccuucccccaaaaacagaaaaaaaaucuuguaucgaaagcuguagugugucacaguguguuccauaguauacccuuuguccacacuucuuuccuugcaauuguucaucacagugagucauuggucugcuucaaggcccuggcuucuacuacacuaucaauauuggaaccacacugggacuucugucuuuguuguuauccugucucauagagacccuguaguuuuggaucuguaggacuggcccuuccacgggcucaugcaguucuuagaugggguaaauguuggguuggccaacucaaagauguuggauaugggcuuaagagggauuuaagcuaauuaaccugccagcuuuccugcaccacaugggcuggguuggggaugguggaaguucugcagcacugcccuuagcuaucaguuauccagugcccuagucaguaagggguagaggcagcgcuucagucucaggccaucagggcugacucaugccauuagcucugcugugcugcccaggugaugguauauauuauauuauauuauauuauauuauauuauauuaagagugaccauggcaaacugagugcuccaaaaggguccugugaacauuccauagaaaugauuuucaggaauaaaugaaguuauaaaagcuaucuccacuaauaguacauguauaagguaauagaaacuuuuauauaagcucuuuugcuguuacugugaaggaauucuggcuuagcuuuuuaaucucucuguguaucuguuuguuuucuuucguauaagcauuugccaacauguaaguauaugugugugcagugcccuggguggcuaggauggggcagcagauccucuggcccuagagucgucugauugugggcugucauaaggacucuguaagagaagccaguguucuuaacuacugagcuguggcuacauacaggcuaggguuuuuauaggcauuucucacagugcuuuguaaugcucugguuucuuuauucauuuauuugcuuaccuaguuaugagcucaggcucauuuaacuuugaggcugaccuuucacuucuagucucccugcucucacuuccuaggugcagagauuacacaaauugguuucuguuuuacaaguagucaacucauucauauauuucacaggaauuugaucuuuguaauaaaucagagaaaucuuucuuaaaauuguuugguaaauaauguggauuuucauuaccuuagacugcuuauauuugccuugaacauaauuugacuguuaugcuacaacuguuaaguauguacacagugauucccaacuuccuaauucugugaccuuuuaauacaguuccuuguuugcauggcagcccuaaucaugaauuuauuuuuugcuacuuuauaacuaauuuuuuacaugauuacaaaucauaauguaaguaucugacaugcaagauauccacuaugugacccccuuccccaucccccaaaucugcauuucacagauugagaaccaccuacauagaguauggcauuuuacauucuuuuguucacuguaguaacguucugacuuucaguuucuuacggauugcuuuuagugguauguugcuuacauucugggcauguacuuaguacuaaaauuucuuuaguaaggcaucaaucuaaugugcugaggucuucuuagucaugccauauggguucuaucugacugccagucuagaguagugcuccauucaguugcuaauguguacuaguugaagcuuacugccaugcaguguuuagaacaauuuuguaucgagaagcaguauuuuaggaauauugauuugacacuuccagucucugcuuuugugacuauucacaaaugcuguucuucacauuaauauacucuuauuuugagauagcaucucuauguagccacagcuauucuagaacuugcuuuguagaccaggcuggcccugagaucugacugucuuugcuuccugagugcuagaauuaaaggcauguuucaucaugcuggcacauuauugugcucuucuuuguuguuguuuuguguuuugguuuugagacagggucucucuauguaguccugucuauccuggugcuugcucuguagaucaggcuggcccugaacugaagagaucugucugccuuugacucccaagugcugagauuaaaggaugugugcaccacaaugcuugguuugauauacuuucaaguucgauuaauauaccucuugaauguuauaaauuccuuuggaaaacauuacugcaugcuacagugaauauguggaggucaagauaauauacaguguugguucugggacuugaacuuaaacuuuguugggcuauuggacaagugcccauuccuauuguguuauuuuaccagcccugcuauucuuaaauuaagacucuuucuuagaaugauucuuauauuauuaguguucuagaacucuuuguccauucucccuauguuguuaaagauuaucuuuccagaacaagcaagugucuuucuagcaaagguagcuguauguuuaaaugugggaccugaaguucuguaugcuagaggugaagaagaaauaggcaugguuucauuguuuuuccagguucugucuacugguauuuuguacugcugaauuauguuaaggacgaagaccuggcuggaugcagcacagcgugugcagcccuacuuacggcuguguccagacagcugcaggacaggcuaacgccgcuggaggcucugcuucaaacaagguaugcuugccaucaccgggcauggagcucuucauuacuagguucacuuaaaacauucuuuuaccuuagaaaguauuuauuuugugguaugcauucuaaacaugaauagugugagguccuccuuccuguguuucugugggaacuauuuucuucagcuguuagugacagucuuuaauguuuacacagagaacuaauuuuaguuuuuaaguuuauuuuaugugguuuuuuuguuuuuguuuuuuucugcauguuuugucuccacuguaugcacacaaugcuuguaaggcuaaaaaaaugaguuggauccccugggacugaaguucaagaugguuaugagcugccauuucgggcuugcccaucagucucaagucuucuggaaguauagccagauccuaacuguugagucauuacucuuacccuaauuguauugaacauuuagggauacuuugcuuuguuaauacaagggguauucaauauuauuuuuuaaugguaugaauuuauagguauaauuaguaaaucucuuguuacuuuuacaugaaauucuuuugucugccaguuggaguuuuaaauuuuuaauuagcauauugaauaacaaaauguugacuuuaaauuuuuucuuuuuucuguugucagcugucucucaucuuugagcuaugguuucuuuguuguagccuaggcagcccuggaaacucagaacucugccucaugagcacuggggucaaaggccgccccgucauuucccagcuggucuccagccuuuaagaaauuuuuauuuuauuuuguuuuauuuuauuuuauuuuauuuuuuauuuuauuuuauauguaugacugguuuucauacaugugcauauaugugcuacaugcauaacuggugcuuuuggaugcccaagaggauugcagauaaugugacccuggaguuaugacauuuuaagaaccgccacguggguguugggaaucagcaacuauugcucuuaaccaucaagcuaucuuugcagcuucuggucuucagguuuugaaguuggacauuuuauuuuuucucauuuacuugaaguugcauuuuauuuuugaaguuggacauuucuuauuugacacacugcuuuuaugauaacuuuauaaauccugauuuugaugugguuuuuuuuuuuuuuucuuuuuuuuuuuucucuuuuuuugguuuuucaagacaggguuucucuguguagcccuggcuguucuggaacucacucuguagaccaggcuggccucgaauucagaaaucugccugccucugccucugccucccaagugcugggauuaaaggcgugcaccaccaugcccggcucaguaauuuuucaauaaaugccuagaggguaaaauauugaauacauuucucauuucucagauauggacuguacagcuccccguuugauccaguucucuuugacuuggagaugagcggcucuucuuggaaaacuguguacaguagcagcacugcuguccagucagaugaaaucgacuuaucagacguucuuucagguacugaccucuuuuacuaaguaaggagcgaagaguucuguuguucauagucaguucaguuuucucuuugucaaguacugaguuuaaguucucauugucagguacugagauuaaguucacagugucauguacagaguuuaaguuuucaaugucagguaaugaguuuaaguucucaucucucuuuauuauaucuacucacauuuuugucuucagaacacuaaaguuuuuugguuuuuuuuuuuuagaccuuaaccauauaaugccugugaacuguagugcuauguaauauguaaaguguagcuuuugugucuggcuuugagugaaauauuacagcucuugccauguuuugaguuaaucagugcaggcugagaaauuguuuugagauuguuugaaccuugaagaaauagcucugcacuuggugcuacuuuagauuuuguaccugcccaaacauuagucuuaagacacuccucgcgaacuuggaguucuuaguuuugauuauggcuagccauggucaaaacagacugacauuugugugggcugucugcuuucuccggcagcaagggcaagacaacuuuuguaguuggaaccuuucccagccccaaucaauuuuguguuaugauugaauagaaguaacuggagugagcuagucugggucagucuuuuccaagaaagcuaaaccccucugcucuuucagaaagugagggcuuagcaucuuggugagcuucucucucuacuggggcaccuaugaccaacaucuacaaguaaugauugguuaaagccauuuuacuucauaucucaguuucuuugccuguucucaaaaaguaaacacacacacacacacacacacacacacacacacacaaacacacacacacacacacacacacacacucucacaauucagaaauccaaaaucugaaacauuuguccaccauguuaguggccaaaaguuucauaguguauuucagaaguguggaucaagaauccuuuauagugacauaugcaaacauuaaaacaauaaaagcaguuuucaauauuuaaaacaaguuaugauucaguuuaauuuuguuuuuuauuguaaucauuccaguguaauuuuacuguucaaaagauuuuguucguauauacuguaaguuucauauuacugugaauuccuaccaaauugcuuucauuccuauagacauuuguaugaaggaagcuaguuucucuguuuauagguuuucuuaauaugcccuuuguugauguagugugaguuuugugcauuuuaugcuaauuaagguuggcuaaauaaucaugauuauugcuucuuccugccuuuuacaagucaccuucaugcauugugagguuuucuuugugucuagggaauggaagagucagcaguugcacggcugcggagggaagcuucacaucucucacggggcuucuagagguugaaccucuucacuuuacuugcgugucaaccagugaugggaccagaauagaaagggaugaugcaaguacguuuacugguauauauuuucuuuuauuacauucuuuaugcaguaauaaugcaaaaaugauaugagcuauuuaaaauuauaucuuuguuugcaugguaagagaagaccuaugggagcaagggauguuuggagggacuaccaugaguaauuuuauauuugagaucaguugagguuuuuuuuuuccuuuacccaauaaaacauucccuuaaauccuuuuauuuuuauguuuauuuucuauguguguuuauguguauuuuuauuaugggaaauaucagccagaaagaaaauagaaggaagaguaagguagagcccguguuuccauagccauuucaaccuuuagaugauaccuaguguaguguaugacuuugauauccugaugugacuuguugcacuuaaaguucauaguaguuugguuagguuuugaccugacuauaaucccuagaauacugaauacagccuggguuuuauaaccagagccagucuuagugagagcgugcacuuguugaaacgaugaaauaggggacauauugauuagauaaacugcuucauuuaaccauuaggucuauaaaucauggaaauacuuaucauuuucuuuuaaaaaauuuuuucugugcccccuuauguuauaugauauauauauaauguauauuaugauguauauaauguauguuuauaauucuauuuuggcacaaagaauuuaaauuuuauuguaaagaauauucguauuuugaccuagucuguuuuuccuugauagaagguauugaauaguaucuuaaguugauuuuauugggaaacuaauuuaagcagguucuauuucaaccucuucauuaaguuacuauuaauaguccaaggcacagcucugugugagagaguacuugccaagugcauucaagaauuuggaugaagucccuaguucugccaaagaaacaaauuaaaaaacaccaacaaaaacaguuuugaagagaagucacagaaguuuauaauccuggauuuuggcucuagaagagauacaguuucaaaagaauuuauaaguucauuuaguguauuugcuuucuaccuauuuauuguagaaguagccucuaaguuucauuuauguagugucuuagucaggguuucuauuccugcaccaacaucaugagcaaaaagcaguuggggaggaaaggguuuauucagcuuacacuuccauguugcuguucaucaccaaaggaagucaggacuggaacucaagcaggucaggaagcaggagcugaugcaggagucauggagggauguucuuuacuggcuugcuuccccuggcuugcucagccugcucucuuauagaaccaagacuaccagcccagagauggucccacccacaaggggcccucccacccuugaucacuaauugagaaaaugccuuauggaggcauuucccccacugaaacuccuuucucugugauaacuccaguugugucaaguugacacaaaaccagccaguacaauugaccccuugucaacuugacacacaaacacaucacuaguaagccucaacacuuaguucuuauucauccccaagaucuuaaauaacuuuaaaagucccacagucuuuacauauuaaaaguucaauccuuuuaaauuauccaguaucuuuuaaaauucaaaguacuuuaaaauucaaagucuuuuaauugugggcuucacuaaaaaacuuccuucaagagggaaaaauauugggaauugcuccaauaccucacuguaaaauugguguagcagugguaguaucacugcauugcagugcucauaugaacauauccguggugagacuggucauugaggcaagugccuugucacugagugacaacccaaccuuuuuuuuuuuucuuuaaacugcauauaauuuuaaugauacauuguguauuuuggccauguaacucuguguaccuuuucuucauccuggugucuuguuuugucuuucccuugucucaugccagugaguuccuucgggguuccuccugcaguagguggccuaucaucuggcacaguuggggaagccucgacagcccugaguucagcagcccagguagcuuugcagucucucucucaugcaauggcuucagccgagcaacagcugcaggugcugcaagagaaacagcagcagcuuuugaagcuucagcaacagguuggagacucuuuggcucuuuguucaugcugucucuaaacuucaaaagcugaaaaguaaaaauguaaaaaugaccauuguuuucagaaaggaaaaguagcuuguccaaucugagcuagucgguuucaacagaaaauugagguaaugccuuugugauauguuuaaauguauuacucuaugauauguuuaaauggauuauucuaugacugcauuuuauuuaggaugugauugagaaaaaaaugauacuuuuugaguagccuugaagucucuuguacuuuuauguuuaaaaacuuuuggagaaacauuauauuguuaucaguuacuguuuucaugacacagagacuguuggacauuauaaauuggaggacauuaguuugauucuaaguacagcaauuaugacaacaugguuuauggauuuaauugcugacuaaaugcaaccugugcaaacucugcuugagaaauuguauccugucaguuaacaaugaauucauuugcuucauuuuauucugugcagagcugguuucauuauuuauauuuaaugguucugcuggcuuuucauuuuuugagcacuuucuaguucccuuaauauauaagaaaauuuugcauaauaacuaagaaauguuccuaacaaggcagugcuucauguguuacguccaguuuugucucauguaagcagaaucuuacuaaucucacuuaaguuuuuuauauaugaucaucaaguguccucacaacuucgucaggacucuucuacaggcauugcuuuuacuuuuacagaaagcaaagcuggaagccaagcugcaucagacaacagcggcagcagcagcagcugcaucagcagcggcagcagcagcagcagguccuguucacaaugcagugccuuccaacccaguggcugcuccuggauucuucauccauccaucugauguuauuccccccacuccaaaaacaacaccacucuuuaugacuccaccgcugacuccgcccaacgaagcuguuucuguugugauuaaugcugagcuugcccagcuuuucccaggcucagucauugauccucccgcagugaaucuugcugcacagaacaaaaacuccagcaaaucuagaaugguaaaugauguuuuaaguaaauguuaacuuagacagauucuuauauuuuuaaagaaauucuaacuuugaaagucaaauguuuaaauugucaugaaaguauaucaggucauuuugauuuuauaaaacauuucaaaauguguaucaguaaaugagacuuguuaauuuaacguuaugguuuuuuagagugaggguauuaguacaaaguuauauuguuuuggguguuuuuuggcuuuugucuuuuugucuagaauccacuugguucuggccuggcccuugcaauuucucaugccucacauuuucuucagccgccaccucaccaguccauuauuauagagcgaaugcauucagguaaucuuugcauuucuaaaauaauuuuucuugcuuagucucuugguccccuuuaaugacuuacugcaaauaaauuacauuugcugucaaguaaguacauucuacugagaguaaaaacuagagaagguguaaauucuuuggguugguuaauucuauugaaacaaugagauuucucuguaucuaaguuuuaccuauugaaauauaagugauacaaauggcauacuuaaauuuuuguugcgaucauacuagaauuagccuguguggcaguauccuaaaauuagcauuaaaucugcaugugugucauguaguguuccagaauugggauggguuugugcauauuuacagauaaacuuugucuacuuuuaaccuucuaacucuacuagcuuguaguuugauacuauaggaacaggaacaugccauacugcaucugugguuuuauaugaacaguugagucauguuugcucauauaugagggagcuuuaaaacauacaaaguucucuugcuguuuucugcccauuuaauuauaaauuuuuuuagcuggauuagugcuuauaacauguagaggaaaguuuuguuccucugcuugugaacaguuguuuauacuguaguuugguuuuaaccugugcacauauuugaaucuuaugaggcccaugaggagcgaacauggcuucuggaagugcagcagaaugugcuugcucuuaacugcugagucauacuuuuuaaugguagcauuacuauguaauuuucuauacauacuaaaccaaauauauuacacccccgucuuagaagguaacaagacuuucacaaguaaaguuacauaauacauuuugguauguguaaucucucuagugaugaaacgaaggcaagaaauauucagauuggaacuuuagagguuuaccuuuucaugccccacuguuuuuaguuguugaacugaaauacguacgaggcucugcgcuguaugaggcuccaugcuauacuugccugcuuuuguauuaauaaucuuaaaaucuuugacuucagcuuuucaaaacuauaguauaguuuuuguuuuaaguuuggcaucaaaucuuaaggcuugacauacuaagcaauuauagaauuuaugaauaaauauugauaaaguacuuagcuacuuuucuuaaaguuuaauaacuugauacuuuuuuauuuuaagaagaaugcguuaguguguucugaguauagacuuuggucacuugauccuguuuugauggcccacauguuucucuuuccuuuacaggagccaggagauuugucacccuggauuuuggaagaccuauacugcugacagauguacugauuccuacuuguggagacuuggcgucuuuaucaauugacauauggacauuaggggaagaaguagauggaaggcguuugguuguggcaacugauaucaguacucauucacuaauucuucaugacuuaauaccuccaccuguaugcagauucaugaagguaaagagcuucaagaaagguugcuauguuucuguguuucuuaguacugcauugacaugauacuaaagaguauaccuauaucuuucaaaaugcauaacuuagauuuuuaaauauuaucacacgugucuuuccuuucagauaacugucauuggacgcuauggaagcacaaaugccagagcaaagauccccuugggauuuuacuacgggcacagcuauaucuuaccuugggaaagugagcugaaguugaugcacgacccucucagaggcgaaggagaaucugccagccagccagaaauugaccagcauuuagcaaugaugguugcucuacaagaagauauacagugcagguuaguggaaauuugcucauauauuuugugaaauuauuccugccaaugaauguuuucucuaucuacauagaaaagagcaaaaggaggacaaacguaauacagcaggagugaaaacauuagaaugcuguuuucuaauugguaguagcauuuauuaguauucgugaacaguaguuuuuuuuuuuuuugcuuauuuguuuguuuuaagauagggucuguauuauagcucugaguggccuagaagugacuguggcuguuauccaaccacacauggcugcccagauuugccucuggaguaaugggauuaaagguguucaauacaguaccuggcccaagaauaauucuucauaguaguugugcuuuaauauauuuuaaagagauguguuuaguguguagauauaaaagaagacugaagcaaugccuguccauuuauuuuuacccauagauauaaccuagccugucaucgucuggaagcucuuuugcagaguauugaucuuccuccgcucaauagugcuaacaaugcacaguacuuuuugagaaaaccagacaaagcagucgaggaagacaguagaguuuuuucugcuuaucaagauugcauucagcuacagcuucaauuaaaucuggcucauaaugcagugcagaggcucaaaguagccauaggugcaagucggaaguuguugaaugaaacaucagguccagaagaccugauucagacgucauccacagagcaguuacgcaccauugugagauacuuacuggauacacugcucagccuccugcacucuuccaaugguuuguauuuggcucaaugacuuugggaaugaguuaauauuuuucugcugccuguuuuggguauauagaauuauuuucuggggaaucuuuuuuuuuuuuuuuuuaaaugaauguguagugcuggggauugaauuguuacuugaugcaugcuaguuaagugcucuucaccacucuaucuagacgugaugcaugcuaguuaagugcucuucacuggucuaucuagacgugaugcaugcuaguuaggugcucuucacuggucugucuggacaguuuuaguuugguaucuuguuuaauguauuuaagaaauuucuguagauucacucauuuauuuucuucuuaaagguuuuuuauuauuguugccauguuauauauugaaucuaaggcuuggcacgugguaaaugggugcuuuccuuacugacuacauccacaugccuuuuaucccaauucuuucuuucuaaguuuuuguuacauuuuuuguuuuuuagagauaaggcuucucccagcaucccuggcuuuccuagaacucaacucuguagaccaggguggccucauacuucuuauucuaauguuucuuaaaugaaucuugauuucuuagguuuguugaauuacuacuaugcaucugcauuugagugagaaaauauuaaacauugcauaaaaguagaagaguuauucugaccuaauacaguaguaguguuuuguagucaugcacuacuuuggauugcucauuuauguuuauagucccccuaagauaucugauaauuuuuuuccauuuauacuuauucccuuauuuacuuguaauugaauuugauacaccugaccacagaaacaagaaacacaauguaugugcuaucucuuauuacugcuaaauauuuuacaacuaauuucuauauaaaagcaguaaauaagucacaaaauacauagauuauaauuguuuacugauugcuggggggaaauguguauguggguguacugguguugcucuuaacaccauacagacacuuagauaagucauuuguuucuuuuucuaacagggcauucuguuccugcaguuuuacagaguaccuuucacgcucaggccugugaagaacuguuuaaacacuugugcaucagugggaccccaaagauacgguugcauacuggccugcuccuuguucagcuaugugguggugagagaugguggggccaguuucuuucuaacguucuucaggaacuguauaauucagagcagcuucucaucuucccacaagauagguagguuggagagguuaaugguuuuguuguaaauuaccuucacuuguagaaucauugucagagugugaaguuuuguuuacauggauaguaaguuuggagaugauguaaaauaaaauaggucucaugguugacaaguacuaaaugaaggacaugagcucuaauauguuuacccucggauauuuucugaaucaaucuauggaacuuaauaggccuugguauguauuuucuauaagaucuacuaaaugcgauucuuuaggcucuuggggaguuuguucucugccugauuucuaagggguugcauaagaaaaaauaaccgggcuggugagauggcucagcagguaagagcacccgacuauucuuccgaaguucaaaucccagcaaccacaugguggcucacaaccauccguagugagaucugacucccucuucuggaguaucugaagacagcuacaguguacuuacauauaauaaauaauaaaaaaaaaaaaaacuuaaaaaaaaaaagaaaaaaauaaccaacaacuagaguagaaacucauuuuacaucauuucuucugauagaaaucuuucuuucuaaccuaccaaagaaugguuuuaacaggcaaacaugcuuuauaacaguuccuaugugaauacauuucuuuaaaaguggaauaauuuaaauugauucuaacuggucauuuucuuuguaucuguuugcagggucuuuauguuacucuccugcauuggacagcgaucacuuaguaacaguggaguauuggaaaguuuacuaaaccucuuggacaauuuauugucaccucuucagccagaguuaagcaugcacagaaggacagaagguauuauagaaggaacugagagguuguucuucugccuuguuagggcugggguucaagcugugcaccaucaugcucagcuuuuuguugguuacuauguggauucugcuggucuggaagcucauuauguagaccaggcugcuuugaccacacagacauccaccugccccugucuucuaaauggugaacuugaacacuuuuguaaucuuucugucuccucaaauguuuaagcauuaaaggcucauuuccuuuuuggccagugauagguuucauuugagcauuaaauaagcuauagaauauaauuguuaguaugaauuauaaggugugguacagguuuuauuuugguuuccuguguguccuuuaucuucuuuuguauucuguucuuuuuuuauuuuugguuaaauauuuauuuuauguauaugaguacacuguagcugucuucagacacaccagaugucugaaucccauuggcgucagaucccauuacagaugguugugagccaccaugugguugcugggaauugaacucgggaccucuggaagagcagucaaugcucuuaacugcugagccaucuuuccagccccuuguauccuguuuuauauuagauuucauuuuuauacucacuuuguguccauauuguaucuuauguauuauauaucauauauuacauuauauauuauaauauuuugguguuggucaugaugcaggguguuuucauuuguaagauggugucacaguuguccuuagaacucaaauuuacuugagucuucuguucuuguuucucucuaggaguccuggacauucccaugaucaguuggguuguuaugcugguguccagguuacuggauuauguggccacuguugaagaugaagcagcugcugcaaagaaaccuuugaaugguaaagacagggaaagguuucugacagguaucagaaguuuauaauaacguguugguggggauuuucagugacgccacacuuguuccugaucuggcuauugacuuggagauaaccauauguauguaauuuauggaaaacaugacuucauuuuuuguuuuuguuuuuuuguuguuguuguuuuuuuucggaaucugcugagaaauagaauuuguaugugauggacaaacuucuuugucuugauaggaauuuuauuuagucagucaguaugucuguaguuuucaucccugcacccauacuucaauacuuucagaagugagauuauggcaagggaauuuguggagguuuuacauuuuuuuauuuguuuauuuuuugaguuuauauuuuaauuauauuaguucacuuguuuucuuuagcaacaauugucuuuuauuuuuugaauuggaaauucuuaacauuauuacuuaacuuuuaguaggcugggagcgcaaaaguuuacaaauuaagggaaaucagacaucaaaccaaguguauuucugcaaucauuauaauuaccaaugauuuuaauacaagauuugaggcaacugaaucuaaugcaucaauacagcaaauagaauccauacaauuauguacuuugauauauuaauaauuuugggaugguggacgaauacucucaaauguggggaauuuauuuuauguugguguaaaaaaagugugucuaucaauccauuucuucaguuacaggaugaagggcuaagcauuagcagugaguuaauuguaauuaaaaauuuaaguuguauagaauaaauugcauugaaguuuuaacuuuuauuuuuauuguuugauauuaucaaggaggagugauggaagacaucuucaggguuugaugauuuugaucuaagaugauugaguguuaggaauaggaaaacauuugaaaauuaugaauaaaacaaucagaagagggggauuuguauggaggguguauguuuaauuccagcuaucggcaacagaagcauuacauucucugaaaauguccgcuagagcuauacacauagugagacccuauuucaaaauaacagcaaagaagaucagagaagagugguuuuaggccaacuaagagaaagaaccaugcacaacaguguugaucuauuccaaaacaccaauguaaauguaguuaugcagccugccuuuugaacuaucaaacccauuuugucagucauuaaucugaauagccuguuuuggugcuuguacaaaaccuuuuuaauguuguuacugucuuuguuguacaaagcacuuuuauuaguauuguuguuguugcuauuauuauuucuuguguacaacacaucaaaguuauguuguucaaaaugaauuauuuugugguuuuucguuguuuugacuuuguuuuuaauuaauuaauuaauuaauuaauuaauuuacaaucuagcagaugcccuccaccaggugcccccucccagaguuccucgucccccuuaccuccaagaggguacucccuacccuggcauccuccuucucuggggccucaagucucuugaggauuaggcacaucuucucucacugaggccagaccaggcagucaucuucuaaaugugugcugggggguccuuggacaagcccaugaauccugccugguuguuggcucagucucccagagcucccaggggucugucuggguuaguugagacuucugguuuuccuaugagauugcccuccucuucagcuccuucaguccuuucccuaauuucuccauaggggucccugacuucaguccaaugguugcaucuuucucagucagcugcuagguggaccucucagaggacagccaugcuagacuacugucuauaagcacauuguagcaucaguaauagugucaggccuuggugucugugacaccccccacccccaccagcccccaugagacagaucccaaguugggcaggucacugaaacaccuuuccuucagucuucuucuacaguuuuuuuccuauaguuccuuuagacaggaacaauucugguucagaaaauuuugacuagguuggugaccuugucucucacucgaugccuugacuaucgucacuaucgucgaaggacucuuagaguuccuuagccccacuuugguuaagauuagccccauugaguccugggagccucucagaucucugguacuuucuagagggucguccccccccaccucccaucccccaagguuacauauuugccuucauucuccuggcccguuggacuucugcaccccccccccccccccgccccauccuuuuccccuuuuccucucccuuccucuucauugaaccgugcuugccuaacuggcugucuguauguagaagaaugaaaauagauucauauuuaucaccuuuugcaaaauucaagucuuauguggaucacggaccuccacguaagccagauacaguaaaucuaauagaagagaaagugggaaagagccucaaacucauuggcacagggggaaauuuucacaacagaacaccaaucaauagcucaggcucuaauaucaagaauugacaaaugggacuucaugaaacugaaaaucaaaggcaaaagacaccguuaacaggacaaaucaguaaucuacagauuggaaaauaauuucaaugacuauauucaacagagggcuaauauccagaauacauaaagaacuuaaaaaguuaaccuuugaagaacuaaauaacccaauuauuuuugguuuuuuggguuguuuguuuguuuguuuuauuuuguuugagcuagaacaggcccggcuguccugaaacucuuuguacaucaggcuggcuuggaacucagaaaucuuccugccucugccucccaagaccugggacuaaaggugugagucacugcggcucaguucagaaugaaucuuaagccuugugacagagugucuggaaugcuccagaagagauuggcuacaggacucuguugucuguaauuugcuuaacccucagagagcugucuuucaaauucuuugucuuaguugacauauuguuguggguuuuguuguagugaaauuacuccaaagucauaguuaaaagaauuauuaauaaaaacguuucuuuccagguaaccaauggaguuuuauuaacaauaaucugcauacucagaacuuaaauagauccuccaagggaggcaguagccucgauagauuauauuccagaaaaaucagaaagcagcuuguccaucauaagcagguaauggucuguaacuuuguuucaguuuugaaucugucaugucaucuguugacuuuagacauuuaggcauuuagcaagcggucuagguuguugguuugcuacuuuggugacuguguuuguaaaaugguaagaucgauacuucacuuaguuuugauacucuuuaaacuucuuggucuucuguuccuauuguugaagaauuuuucugcuaguuuaaaagguguugcuuuuguuugccucguucuggcuuuccuuccauguugccguucauguggguuuuuugcuuuguuuuauuuuuuuaaaaacccaauaacacuuacucuuaaauuccucguggccuugaguugaccuuuacauacaguuacuugucaucugccccucuaacuuuuagauuuuaauuucuuggauauuagauaguauuaaauuuaaguuuguggaauaacgugugcccauuuucucauccaggauauuuggaugugcuaaguaaacucucuuuuuuuuucuauucuuuuuuuuuaaaauuucuaaguacauauuuuuagucguuugcuuggauaaauggacauauuuuucugacguuaguauauuaucauuuucucaaagagguuccuaaguuggaauagcaugucuaugcaaggguucccggaguguucagauucuuuguuucagauaguauugucuuuugcugccuuuagguuugcguaguuuauuguguguaguaguuaaguaaaauauugucagggagguauacacuguguuucauuaugucuagcuucgucagacuuguauucuuggggcuaacugugucagguacaucaguccuuugcuguguagauuuuauuuauuuucacuuuugauguauauguguguuuugccugaauaaugagcagcugguaauugaggcagccagaagaggguaucaggaauuacaugugguugcuaacugcugugugggugcugggaaccgaacccagauccuaugcaacaucaccaaacugcugagcaauuuuucuagccauaguauuuuaauuuuuuauucagauuuuucuuuauuuaaaguaugaauucugagagaaauauaauaauuuacguuuugguucuuaacauugguauuuuaaagauuaaguuguuuauuuguauuuuaagcaacuuaaccuacuaaaggcaaaacagaaggcuuugguggaacagauggaaaaagaaaaaauacagaguaacaaaggcucaucauauaaacugcuaguagagcaagcaaaacugaagcaggcgaccuccaagguaagcucuaccccuugcaaugcaaucagguuuuuaauaaugauugggaaacuaaauaacauguugcucuuaucaacguucagaaucagagcauacagcuucauuggaggaggugucuuguggacucccugccucguaaacaaccuucagaguggguucugagccaggaaacuagggaucaagcaguuacugugcagucuuagagagcgcucacuugacauugauguuucgggcuguuauguucaugguauaauauaaagccuuauaaauaugaucuccuuauccuuuuaaacaaaaguaguaaguaaauacuugucauuucuuuuuucuccagauauauaaugcaaagauuuagauuuggcguuaauacuucuuuguaucgaguugugcauaugagucaaaaacugccuugccacaugaauucaguuccagugaauuuuuuuuuuuaaauauaguuaauuuuuuuccaucauggugguguuugugcauaaucucaauauugaagguugaggcagguagauuacaagaaggaagacucuuaccucaaaauagagaaaacagugaacacccauuaaaucugucgucauuguuccauauuuaccaccaccuaaguaacuuugaauuccaacuucaaaaguuuguaguucuuuucuuuuuuuuaaagauauuuucuucauuuacauuucaaugcuaucccaaaagugcccuauacccucccccugcccugcuccccuacccacccacucccacuucuuggcccuggcguuccccuguacuggggcauauaaaguuugaaagaccaaugggccucucuucccagugauggcugaguaggccaucuucugcuacauaugcagcuagagacacgagcucugggggguacugguuaguucauauuguuguuccaccuauaggguugcagaccccuuuagcuccuugaguacuuuucucuagcuccuccauuaggggcccugggauccauccaauagaugacugugagcauccacuuccauauuugccaggccuagccucacaagagacagcuauaucaggguccuuuccgcaaauucuugcuggcauaugcaauagugucuggguuugguggcugauuaugggauggaucccuugguggggcagucucuggaugguccauccuuucguauaagcuccaaucuuugucucuguaacuccuuccauggguauccacauguuggucuuccuucuucuugauuuucuuguguuuuggaaguuguaucuugguauucuaauuuucugggcuaauauccacuuaucagugagugcauaucuaaugacuucuuuugugauuggguuaccucacaaaggaugauauccuccaaauacguccuuuguuuuuaauagcugaguaguacuccacuguguaaauguaccacauuuucuguauccauuccucuguugaggggcaucuggguucuuuccagcuucuggcuauuauaaauaaggcugcuaugaacauaguggagcauguguccuucuuaccaguugggacaucuucuggguauaugcccaggagagguauuucuggaucuucugguaguaaaaguuuguauuucuauaaaguauaccuuucuagauuuuaaaauaauuugaaucaauguuaaaauuuguuuuaaauauuagauuuuaucuauuuauggccuauaugcaauucuguuguauaucauguacuuuaaagaggagauaauuuaugcuaaccaauggaggcagcuucuuaucguuacccaggugugaagacuuaugccuauaaggucagcaucugcaagauaagacaggaggaucagagguucaggcuggucaaaagaaacaguugggguuuuugugguuugguuugguuugguuuuuccagacaggauuucucuguauagcccuggcuguccuggaacucacucuguagaccaaacuggucucaaacucagaaauccaccugccucugucucccaggggcugggauuaaaggcaugcgccaccacugcccaucgagacaguuguguuuuaaagaaaacacacuccccuauuuuuuucuuggacacuuucgguacauaugaaaauuuuguccauuagaaguugaauguugaauauuuucaucuuacaaacguguauacugaaaaguuuccauuaaauaaacauuucucuaaaucuuguauguuucuguaugcagcauuuuaaggauuugauucgcuugcgccggacagcagaauggucucguucuaauuuagacacugaaguuacaacaacaaaagagagcccugagauugagccucuuccauuuacucuggcccaugaccguuguaucucaguagugcaaaagcucguccuguuucuucuuuccauggauuucaccugccaugcagaccucuuacuguuugucugcaagguaaguaggcugcaguacagcguuggacugauaugacuaaugaaaggaaucaauuuuucucuuuuguguucaauucccuggucuuacucugugccuuggaagguuuuaaaaagauaguuuucccuuaguuccuggugaaucagaugcaguuuguuuguuugguaaaacuugaggguugggaauguagauaaugugagugugccuaccuucauucuucucucagcucacacaggaaguguuucaacauggaugagguuacugaaugacuuugaaugccaugauuguuuuccugcagcacagucauugcuuauguguaaauauucacccaaauuuaaaaucagucacaaaaucuggaccuggugucucacuucuuuaaucucaacagucaacauggcaggcagaggcaggcuaccuugucuacacagagaauuccgggacagcuagaguuacacagagaaagucagucuugaaaauaaauaaauuuaaauacaauauuuaaagugcaaguuugcaauguuucuauuuuguuuaaaguaauuuauagaaaaauuaaacaucugccuugaaaacuguugugucaguguucuauuauuauuacuauuauuaacuuuuaauauaacugguguuuuaagcacaugauuucacaauguguuucagguucuugcacgcauugcaaaugcgaccaggccaacuauucaucugugugaaauugugaaugagccgcaguuagaaagacuguuauugcuucugguuggaacugacuucaacagaggagacaucucuugggguggugccugggcucaguauucuuuaaccuguaugcugcaggacauucuagcagguuugucaagauuaauuuuucucaugguaugucagaauuagcucaagugaugucuaaaggaaaaugucagaggauuccuaaaugcauaaacauugcaauaggagccgucuaacuuuaucuucuucaacacuuggaagaaugguuuuagaaaguuguuacguggugcuggcaagguggaucagcagguaagagcacugacugcucuuucugaguucaaaucccagcaaccccaugguggcucacaaccacuuguaaugagaucugaugcccucuucuggugaauaagaagucagcuaaacuguacuuauauauaauaauaaaugagucuuugggccugagagagcaggguugacuuuagcgagcagagguccuaaaaaauucaguucccaacaacaacauaaaggcucacaaccaucuguacagcuauaguguacucauauacauaaaauaaauaaauauuuaaauaaaaagaaaguugcuaggugacucaaguacacggugcagguagggaagacuuguuugauuagugagaagcauucugcucacuaguucuucugugacguuagaaaaccacucuguuagccucuucaucuguuacauauggguaauaaaaacauauaaauuauuaaaaugguuaggaccaucuccuccaacacaggagaauuguuggcuccgguggcugcagaagcgauggaagaaugcacugugagugaggauguuggugcaacagcuggcgacucugaugacucccugcagcagucccccgcucagcugcuggaaaccauagaugaaccauugacacaugagauagcaggugacuuagaucagauucaagacagcccucacuucugucuuuugcaugaauguuaaugacauauaaauugaguuuuguguuuuucuguuuggucuuuuaaaucaggaccuuuuuccuuuuauaucuuuugcuaucauuuccuaguauauuaagcauuuuauuuuaguguaacuuauauauugcuuucauuuuauagcacuguaaguauuuucacauauuaucuuaauuucuuaucuguuguugcagaagaaacaauacccagagcuuagcaccuuaggaagcauuaggaacagaagagucagcucauguaguggcuuccaaccaugagcugcagggauuugcacucucuucucauuuauguaggcaccacacacacacacacacacacacaacauccuacaaucacuuucaguuguuuguuuuagucauagguucccccauaaucccguucuuucaacugauugcuucuucauuugggaagccuuuguuugcagacagcuuccaagaagcucgucgugagaaagccuuugccaucagugcacucucuuagcuccucauguuaucauuuguuuaacugacgugcaucucuacccuagcccuuucuuaacuggcuuuucuuaacugguauacugguuuuuauauauguacagaaacuaguaaagguuuguguuaucugggcauccuauaaauguguauucgugaaaagaaaggaugaaaaaguaaccacuucaaguuauaggaaacuacuuaaaaaauuggacacaucugggagcaagauaguuucuuauauaguaaauauuuuucaaguaaauagucguacaacuuaacucucuuuggccucagcuugaguuuuuucaugacacuacuguaauuaugguucacauacuuuaaagagaaguguacuuaccacgaaguguaacaaaauauuaauccauuuuagauaagcuaaugauuauuuugagcaauaagauuuaucucacuaauaacuaauaacucacuauccaauauugcauugacuuuuuuauagugcugucaagugauaaguuugcaugcugauuaaucauuaaauauaaaucuuuagauauuuucaaaguguguuauaugcaaaugaagugcuuaguucuauaacauaaagcaguguuucauuuaaauuucauguaauauauucuaccaaugaagucuuuuuuacucaucugaagguacgccuccucucucuuccuuggaaaaagauaaggaaauugaccuugagcuacuucaagaccucauggaaguugacauugauccuuuagauauugaucuagaaaaggauccucuugcagccaaaguuuuuaagguauuuuguguuaggauaauuucaucauacauuuuuguaauaauuauagcaccuagaugcacuguguaagaacucgacuuaagagaccgguauccacauuaucccauccaauagauaggcagugcacagguauuguuuuaggaucucaugaaacguccuacugaaugcuccaucauaggauccaacugaaguuuuaagaaucacacacagacaaauugagaucauuucuuauguuuuauuagacgauaaugcguuaauacuugaagucaauaauaagagaaacuaaaggaaccacaaaaaacaagaaaccauaauagaaacugaaaaaaaucauagagacaaaugauaguaaaaauauguccuauaagaaccucuauuauacaagaaaguuuauugcaacaaguaugcauaauaaaaaaauauuguauauaucaaauaaauaaccuaaucaugaggcuuucaaaaauuacauagccaauugugaacaccgauggccagaaauuaaugaaauagcuauccagagaacaguguauaguauauaguaucaacaaaagagucguucuaggaaaaaguuacuaagcuagcaaauccuuuucuaaucuagcagcaggaguaauaaguaaaaccgugcacauuugcuaccaaauguaucccacuaugccgcauauggcaugcucuuuugugccucuuaaaaaaccaagaaacaaaggcaagguggcuggaaguuugacuuagcaguuaauagcauuggcuguucauacugaggaccuggucuugauacccuguaccaauaugguggugcauaaccaucuguuacucaaauuccauaggaccugauacccucuucugaccucugcagguacuaggcauguguggcacacagaacuaugcauauacauaauaaauauuuuuuauaauauauuuuuaauauaauuuaacauaauaaaaaaauuaaaaguacuaaugacaaggguguuuugaucuccagcauccacaugguagaaagaguaacacguuaaagaauacaaucucuuaacagugucucacacuaaauaaaugaacuucuaaaaauugaaguaaagauaaaaugacaauuucauauauaguacauauuuuuuucucuuaaacucauagccaugaacaguuauguaauacgaauuccuugaagccaggagauguaaguuauggauuaccugacuuucagguagccacugggagucuuaaauacgaucagauucuugcagucaucauuucuguuucucuucauccauuuuuuaauggagaugcauuuguaaugcuuauauaauuauugcucuuuggcauaucaauuuauuuauaauucuaguuaccuuucagguuguaaucuuuuuuuguuuguuuuuuuuuuugguuuuucgagacaagguuucucuguauagcccuggcuguccuggaaaucacuugguagaccaggcuggccuugaacucagaaaucugccugccucugccucccaagugcugggauuaaaggggugcucucaguuucagauuguaaucuuacaaguuauucugugucaccaaauaaacagaauacuacuguaacauuuuauaaauuaauaacauuccaacaacuuuggggaauuuagaaggaggaaauguuuauuuuguaggcuuacuugucauaauauuguaaguuuuuauaacucaguaaagacauuaacuccuuucuuuuuguuuuuaaagccuauaagcaguacaugguaugacuacuggggugcugauuaugguaccuauaauuauaauccuuacauuggaggccuggggaugccuguagcaaaaccaccaucaaacacagagaagaauggaucccagacugucaguguuucggugucucaggguaagugcaucagaacaguuucaggaauauacuaauaaaguuauguaagcugaauuuuguguucaccauuucugaauugugcugucuuugccauucauaucuguuacugucagcagguugaauguugguccauguuuucucucuaagucacucuaagcuauuugaugaauguuugacguuugaagugacaauacauuacuuuauuguaauuucuuuuuucuaugagauuacacucuaguuagauuauuucucuccucucuuuccucucucaaaccuucccccauaccacuccuugcucuuucaaauugauggccucuauuuuuauuccuuguauuaauuuugagcauaguauaacuauguucucuuccugaacucauaaaucacacaccccgucuguugcuugucacuuggaugcgugcuucaggcaguuugggcagucacuugcugacacuguaugauccuaugauccuauuauuugacacuacugggucuccaccacccaacucccuauccucugccucuuaacaguugcucugcccacucuucuacaguguccugagcccuagguacaagagugguuucuagguguauccacuggaauuggguuuauagcucugcauuuugauugauuauuguuuucuauaauggucucauguugcaaagagguuucuuugauguggugaagacuacacuuaccugugagauuuaggaauaauauccaauuguuguuaauggauuaugcuaguuuagaaaaauggugguuguagguucuucuccaagacccaugacuucacgaccacauagcuggcuacguuucuaguaccugacaugguuucucuccuguugagcgggucuuaaguucaaguagagagcugcucagucuuagggaggaaacauucaguucaguuguagcucauggccucugacacgcaugguauauucagcaauagggacucacuuuccacuuacaaaggcaauagcaauaguuuuuauguuuuagcagucucugggacagccuugacuaacagcucaaagaaggcuuccagugucugauaaugggguuuuguuagguggccuuuuagagaguguagucucagcccagaucaaaauauacauuuaaauagcauauacauauuuauccacaguauugcauuuaacuuuuuuauuaagguuuuuuaaccuuaauuguguguguguguguguguguguguguguguguguguauguguguguguguguauacaagagaccaaaaccuaauauguuucuagagagguuuucauuaaauuuuaaccugguccuugauuuucucuuuuaaucagguacuuauaguuuauuauugucauucauuuuuuacuguaagcaauagguauauuauuuauaauuuugaucauuuucauguauguuauuaaacauagucacuaaaauacuuugauuuaauuggauauguuaguuuucucagacaugacugauaggacucuauaaauggccucuggcuuuaugagaaguuauuguuccucuuagagagagcuuuuucuuuuucuuucuuuuuuuuuuuuuuuuuuuuuuuuuuuuggugguuuuucgagacagaguuucucuguagcccugguuguccuggaacucacuuuguagaccaggcuggccucgaacucagaaauccaccucaccuguccuugccucccaagugcugggacuaaaggcgcgcacugccacgcccggcuuagagcauuuucuaguucuugggcaaaugguaugauguugccucaacuucauccuuuucuacuuuugcuuguauuugaaaguuagucucuucuauaauuacuauauuuuaaauuuuguuuaaagaaaucaagauuugaauuauaauuauuagugucuuaaugguauuaugugagugucugucuacacauuuaucuguaccuaguaugauaagcuaacauuuauuuccuuaucugauaaucuucuguugauggugguuuguuguuguuuguuuguuuuuuguuuccaucuucccucugggauggggaagccaucuucccuucuuucguguauuuccuuccacucucaucaugucaccgauuuauuccagucucagugcauucauuucccaucagagcaaguuguuuuguugcucagaugcucuccuugguuuuaguccuugguagcacacgccagcauuucuuuuugugaaguagaagccucuucugggaucagauguuuacacauuucuauaguauggagcccaugaguauuaacuuuucagauaucuccuccucccuuuuguagcuuuagaugcucgucuagaaguuggucuugaacagcaagcagaacuuauguugaaaaugaugucuacucuggaagcagacuccaucuuacaagcauuaacaaauacaucuccuaccuguaaguuugauuacaauucacaugcuuucaaggggucauugcuuuucugaauaucaucaaggacaaguuuaaaauucucugugguaaauuugaaggugcuuugaguguaugacuuaacaacauguaacuugguguccugguaugaaaugacugucucaugaagugaccacuucaguccagagaccuaaagcggauuccuguuuaugugcugcugugacguuaaggagacucuagggaaugcuauauauuuuauuauauugauucuacauccaugacacaacacgacuuuuuaaguauuagcuucuuuauuuugaaauacuaggcugauaauauaagugaagugucauucaaaggucuccuaaccaaauccagaauugagaggcaucacauuccaauuacagcaaaagaaaggcaaucuuuuuccuaauggucuggacagagacaggugaucugccagaguugugccuuccugguguugaugucuaccccgcuuaucaaagacaacauuaaguagugguguugaguaggaggagcuaacagugacauugucuccuuaggcauacaugccauuucauuguuuccuaggcugaaugaaggaagacauguagauaguuggaagaagagaacccacaacauauggucuuccuuuuguaaauagaaaguucacaauaugcauuuuuuuucuugcucacagaagaugaaggaauagaaggggacagauccuauuaguacauaaaaaacauugugcaauagcucucauuuaauguaggaaccacauuuauugagcucaauccccucagaacaugaaacaguguaggauaccuucaagaucccauuucauuauugauugggagccuuuuaagaauccuuucuguuuucagugaaucuuuugcccuugcucacuguccuucacccagguguguuccuuuuuaguuuaauaauacucugaauauaacauacauuucuccacaguguucuuacauuuucuauuucccauaaguagauuuucauuuuauuaauucuugaaaagcuaugcggucaguucuaagaugcagucaaaguuaagaacggaugaacugcagguugcaugucuggguuggugccagagcacuuuucuagaaugcuacgcccuaaauuuaacagcacaguaaaacacaaaggcaugcacuuuauauauugcagcguucuagaacgguuuucuuuauaauuaguaaagguuuuccuuucacuaacuuuggaaaagugagagagauuaguguucuaaauuugcgaguuucguuuucuugucuuuaguuucuaauaauuccuaaauuacuauuauagaaccauuguauacaauuuaauuuuaacaaaacguuauaaccuauucuugucuguuuguuaauucacauguauuccgaaccuugcucauaaagugguacuuuuguuugauuuucaguuucacaaucuccaacuggaacagaugacucacuucuggggaauuuacagccagcaaaccagaacagccagcucaugauacagcucucaucugucccaauguuaaauguuuguuucaauaaacucuucuccaugcuucaaguccaucauguucagguaggacuuuaaaggaaaguaauguauuuugacauaguuugacauaaugguuuuuauuggaugcaauugaaugcaaguucauaugugaccugaccaugaugguaucuuuauuauaguugguugagaaaaaucuuaggaauauuuacugauuccccccaccuuaguugccagccauuuuuuauuuucaugaguuuaaguauugguacuuuuucugcuuuauauuguuuauaacccugugguuuaaaagaguuaauucccauuuuucauugaggaaaacaugggguuuaaagggaauuauauauuuuaauucaguuaaaguauaauuuaucaagaauuuuaagauauguuugcuugcugaccuaguuaaaauagcuaggagauaaugagaaacaaguuauuuacucauaagguuauaagcauaaauauuuuuguuugaaugguccuucauacauuuuccucgucuuaguuuucuuuccuuuauuuguauuuuuuuaaguuggagucacuucuucaguuguggcucacauugagccuuaauucuaguucaucagggaacaaagagaauggagcagauauuuuuuuauauaaugcuaaucggauaccugucaucucauuaaaucaagguaagguuuuuuguuuuuugcuggaaauccauacuguaauuaaaauagcaaauuguuaaaugaacauaauuagguuaaaauguacauuaucuuuauuguuaggauuguguuauuuuggugaaagaaguucuuuggcuugggugugauggcauucgccuuuaaucucagcauugagagacagaggcaaguggaguaaugacuugaggccagccuggucugcauaguguguuguuggccaguuggaacuauagugagccccuacuuuaaauuauuuuuaaaauaaugaauuguuuguuuuuguuuauuugaaagcucaguauugagaccuggcuaauguuuuagucagguugucuggcauggguuuuaggccagucugggucuacauacucuauagugagaaccugucuccaaaccaaaacagaacaaaacaaaaaaccuccucaucccccgcgccucccacuucccaccucccucgcucgcuucucucucuuuuccuucucuuuauucucccauucuccuccccuccuuccauccauagucgcgcacacacacguguguguguguguguguguguguguguguguguuuccugugugugcagagaaaggauuaagguauccuaugcugucacugccuuccuuauucccuugagucauuuuguuacuucacuugaaucuagguaaguaagccagcaagccucagcaauucugcugugccugcucugaucccagggcuauaggugcaccugcaccuucagcuuguuacgugacuucugggcccuugagcuccgacacuuagauuuguacagcagauacuuuuacaugcugcccucucucugcggccuguuugcauuaauguaucuuuuuuccacacagaguguuuaguuccugugacucuguucugucuuucuacuucuguuguggauuuuuuuuucccuuucaguaagaguuuucccuccuagcaccagaagcucauguuugggugacuucccagaggucuguaggucugggaaugcaccuugcuuauuuguuuaccuggauacauucagaauccggacggacacgccacaccuuaauuccuuaguucagcauuauuuuugucuuaauuuuucuuuuuuuuaugcauuuaaguaaaacuuaucucuuucuggggcacucacccugugucccuuggguucagcaaaauaccaacuccagcauuguaagggcaggugauauacauugcuucuucagagcugcaucuuguugauguguggauacuauucuaagugcucuuaaacaggaaaauuugaaacuuuuucaugauuuugugagagaauagccaaccauuuucauauuaccacagaaugcuacuaaaaguggacuuucgggcccugaagagauaggucagcaguuaagggcauuuauuguugcuaaggacccagguuugguuccuagucaccuucauggugucuuauaaccaucuauaguucauccaguucuaggggauccaccacaccucuuugaacaccaggugcacauaugaugugcaggcaaagaaucauacacauaaccuaaacaaaucauaaacacagagaauaaaagcugagcuguuggguuuugcguuucuuccuugcuuuugcuccucuuccucuccucugucuuccuucccucccucccuuucuccuuuguccuugacgagcuuuguagccuaaaaguagaagcacaugucacuucucaucucugugguggguuuuuuuuuuuguuguuguuuuguuuuuuguuuuuuuguaaaacuauuguguagauacuuaggcuuaucaacauuuaauuagaugugacaagaugaauauuccccaugguucuguuuguugaacuuggaaauuuuuucauuugugucaauuaaaugguuuugguuuuggauuucaaaguccaucuuguuguuuuaagcuuuuggcauuccagcucuuccaaacuuccuuccuuaacagcugucaacagcaucucuacagcauguuuuaaaggaaggguugggcucugguucuccagucugcuguauuugaugggcacugugcacucggaguaacuucuuacacuucuccagcugcuaucacuucucuuugucugugucucuuaaguuuuuucaguaguuugaguuugcucuuuucuucugaagucacguuuuugauuggucuacaauaucccagauuuuuuggucauuuguuuuuauuuuuuucuguaaaacuacaauuuuaauuuaaaaucuacaucauuuuaacaauaaacaauauucucucucucucaaaagaaaacaggcaucauugucuuuaauuaacauaggaauuagaauaagucuuggaaauaccacuagaaguaugucaggacccacagacuuguuggggagugaugcaugaaaagucagugggugucugugcaacagguuaaaaugcugacguauaaauaugaauacagaugcagauaucaucugcacaauuguuuuaguuagauauuuucuuuauuuuuuauuuacaucucaaauuuuaccccuuuccugguuuccccucugaaaauccccuauucucucccccgucccccugcucaccaacucacccacucucgcuuucuggcccugauaucccagauuuuuucaggugccuuuuuauaagauuuuuguucugaagaauguugacaaaucacauuggauaaaaaguccaucagauuuguaaugauaacauuucauugugugucacaugcugagcuuuaaacuugucuuguuacugaguuccuacacuaugucugugcuccugagugucugcgugugagugcauugggacccacagaggucagaagagccaucagcuuuccuggagcuacaguuaaugcacuggugaucuugugggaaucccacugagccucucuccaguccccuuguugucagcccuuugaguuuuauuuuagguagugggaauauuugaagauaugaguuaauugugaagaaauaauuuauauuuuguuuuuagucuuuaauaaguauucauuuaucccaacuaaauauauuuuuccuuucuuuuucuauguagcaucaauagcuagcuuucucacagugcuagcuugguauccaaauacuuugcuccggacguggugccuugugcuucauagcuuaacacucaugacgaauaugcagcuuaauuguaaguucaaaauguguuuauauggaucucugucauauacuuuaagucauuucagaaaaugaaauauucaccuaaggauuuauugcuuuuuuuuuuaucucauucuuuuuuagucucuauuuuaucaauauuuggaugauuuuauauuuauuuaaacauaaguuuauuuaauagaauaccuuacacuaauauuuaaagaauuguucuacucucugacuuguauuguauuucccaucugacucugugcugcugaagauuaaguuaguggguuucagaggaugcguuacuuaccacaguugacagaauggaaccugugcaugacaaccgcauaggucuugccucaauuuaucuuagagagcugaguuaaaaagugaguguaucuuuuucuguuucuggaaauggaucguugugacucugccagaggccauuugagauuuagguccuucccacuggucuguguaccaaauaaagauguacugguaugcuuucacaaucugaagggaggugagaggaggagacaugugguagaugagaagcagaaugcucuccaguccgucuucugaguagagauuagggaaccugggcuucuuucaugugaaacauacucgacuguauucacgaugcucuuuuuuccuuuugcugugcacggcuuugaacucuguagcgcuagcaguuucucuugccccuagcauccucaguaucugggauuauuugucugcaccaccagcccaagagauugaaucuguuuuaaaaaggaauguggcauuauucuuugcaaugaaaacuuacauauaaauacauuuccuuauugcuaggaguuauucaucccuuuccuuuuuuuuuuuuuuuuuaauagcugguuccagcaguucuauuggaauucaggagacuacggcucaucuguugguuucagauccaaaccuuauucauguguuagugaaauuucuuucugguaccaguccucaugggacgaaucagcauagcccacagguaauaaaguguuuaaauauugauguauauguucauaccucucaguaaacagauaauuaaaguagccuuuaugacaaacagauuguaagcauuucucuacacagauuuuguuuuguuuguuuuuugagacugggucuuaccauguaguucuggcuguucaggaacucaaucuguagacuaugcuguccuugaacacacagugaucugccugccucugccuccugagugcugggauuaaaggugugaaccacugugccaagcuguuaacuacguuuugaauaguuuaauaagcauuaaauuuugcaggggcucuaaaguuuuccuguaauuucucauuuagugauuuuagugagugcuguuauuaagaaugauaauuaauuuuagucguuauauuaauaauuuucccuaaccaaauaaacaaaaacccaaaaguauugcucuggaaugagcuuuaugcaucucacuuuagauuucuuucauaucaguuuuauuuauuguagugugcugcugcuguuuaaauaauccuacuuaauuauuguuucuugaugaaauaauuuuaguagucaaaucguuuuuuuaguguaaagacaguaaaagauuuuaaauuaaauuaaucuuucuauauaucuugguuuuauaucagaaauaugauuaagagugcaaugauuuuuuuuuuuuggaauuagcaauuacuguuacauaauucuaaaauaccuuaguaggaaggaauuuucuaucaaaggaaauuagcuuaauacaaaagaccacuauguaggaauucugcaaagguguccuuaacaugaaauguggucugcuuauugagugcugguuaccaucacucauuuuuuuuccuccauuaauuuguucacucuacauuccugaucacagccacaccucuccuuuuggugcccucccucuuaccccucuccccuccucucuccucuaagaaaggggagguaccucuccccccacuaucaaccuacccugcacaucaguuuacugcagggccuggcacaccccucccacugagguuaacccaggcagcccaguugggggaacaggaucuacaggcagggauaaguccugccuguuucaguuguugagggaccuguaugaagaccaagcuacauauuugcuacauauuuacagaaggccgggccagauccagcuaaagguuugugguucagucucugaaaguccccaaggguccagguuaaaugacuguuggucucucuguggaguuuguaucuccucugggucccucgguccuuccccuaacccuuccacaacauuccugagcucuguacaguguuuggcgguucagcugcuggguggagcuucugagaggacgguuaugcuaggcuccucucugaaagcauaacagaguaucgguaauagcaucaggaaucggcccccauacacgggcugugucucagguugggccagucaucgguuggcuauucauucagucucuguuccaucuuuguccccgcaauuccuguauguaggacauauuuuggguugcauguuuguguugguauucucaucccuccauugggagcccugccuggccacaggaggugccacuucagucuccauaucuccuccuacugggagucucagcuagugucaccccauaaacucccugggaccucccccaucccuggucuuuggcauguccuagagaugcaaccugcccccagcugcugauuucauuuccuauucuggcccucucucccaacucuccccacaccugaucucuagcacuuccuuauugaugagaaagaaguuugggaaagaaggguuuuagaacuugguguagguauauuuuaguuuuaggguuuauuguuuuugucauuguuguuagguacuuauggcucuuggcuuuacugggcuuugacauuggugagucaguucaccuggauccaguucugcuuuuuguuuuuuauuaaaauguuaugugcagagaugguuuaucugcauguaugucuuugcaucagaggcaugccuggggccuacggaggucagcagaggccucugcuccccugggacuagacagauagcaaccaccauagguccuguggaagagcaccuagggcucuuaaucacugagcccuaucucuagccccaaauuacuuucuuuagggaucacauuuuuuauaaggauauucauaaaauuuaaugcagaauguuguuguaauuugggaaguguuacaaagacauuuggucauugaagcaagacaaagaaauaggauuaauuauagaauugucauuuuuaauauguaaacagugaaauuuaaauuuauuuacuuucuccugucgcuguuaagauuuuguuuuucaucaugcagccuucugacacuagagcuccuagcuuugcucuugacauuugagcaugccaugugucucacucagucgcuuucagugggugugcauuucuccucagguugguccaacagcuacacaagccaugcaggaauuucucacccgacuacaagugcauuugucuucaacauguccccagauauucagugaacuuuugcucaaguuaauucacauacuguccacagaaagguaagugauagcauguacuccuguacauggccugauguaaaagugaaugugggauccaagaaagucaaccucccucaacgguauuagggcuuuaguaggccagaggacagugaguugaggggcuguggaggaaggguucacuggguggcuuugguaauuuucauuucauuuuauuguagauuuuuuuuccaagucuuccagguucuguuacuguaacaaugugguaccucaaaacuccacugauauuuuaauaaucuuguaacuuaguuauacuuuuaaguugaaaguuguuugaaauuacuuaaauucagcaagguggugguggugcauaccuuuaauccuaguuccagcacugcagagacagaggcagggggaucucugugaauuaaaggcugaccuggucuauagagugaguuucaggacacccagggcuacacagagaaacccugucucaaaacauaaguaaacaacaacaaaaaaaauuacuuaaauucuuaugaaauacguagaaaaauaaggacaaauuuuaaaaauguauaauacuaauaugccaaagaaagauagcucaaaaaugaaaguaacgguuccauccccuauagaaaucauuaguaaaaacaaaaguaugcaacaggcuagaagagcaaauugcugccaugcuguguuaauucuuaaaaugaucgaauguuguaguaccacagguugucaggugacacugguguauaauccuauggaaccugccuuacauauggaaggcaagcacucaaccucugagccaaagaacuacuuagauuccuuagagagaaagaagggugauuuuuaaaaauauguaauacuaauaugccaaagaugccuguaugucagaagagggcaccagaucucauuacggauacuugugaucgcugggaauuguauuuaagaccucugaaaaaacaaccucuaagccaucuuuuuugggcuuuaaaaaaaaaaacaccuuugaaugcaugauaaacaguuugucaauuauguagaggucaaaaaaaaaucuaccuggguagccaguguucucauaauacauaagugaccauuauagaaaucagcuugucacauaaaaauccuuuagucuguuacuuuaagcuaauuugguauaccuguauuuuucucuucuuucaguuuagaagggaagcuauuuucugguuagguauauuaaaauagagacgagcagaaacuuguauaagguuggacaacugcuaauugaagaaacaugguaguuagucaaaguuaccuaagugauuuaauuuuuaauccuuguuuuucgcugucucuacaggggggccuuccagacagggcaaggaccucuugaugcccaagugaagcuguuagaguuuacucuggagcagaacuuugaaguugucucaguuaguacgauuucugcugugauagagucugucaccuucuuggugcaucauuacaucacuugcuccgacaaagucaugucuagaagugggucagacagcucugccggugcucgggcuugcuuugggggacucuuugcuaaccucauucguccaggugaugcaaaagcuguuuguggugaaaugacaagagaucaacucauguuugauuuguuaaaacuuguuaacauuuuaguacagcugccucuuucaagcaauagggaauacagcgcaagaguguccgugaccaccaauacaacagauaguguuucagaugaagaaaaagucucaggaggcaaagaugucaauggaagcagugccagcacuccaggaucuccugcauguguugcugacuuagucuuagccaaccagcaaauuaugagccagauucugucugcccuaggccuguguaauagcagugccauggcaaugauaauugguagguauuuagaauauuaaucuaaucucuucuuaguauuauaccuauuuuuauaugauuuuuuuuuaacaacuuaggcuauuaaugaauacuuucauagaguggcuuuacaggaacuacacuaucaaaaauucugagccgggcgugguggugcacgccuuuaaucccagcacucgggaggcagaggcaggcggauuucugaguucgaggccagccuggucuacaaagugaguuccaggacagucccggcuauacagagaaacucugucucaaaaauccaaaaaaaaaaaaaaaaaaaaucugagaaaaucuuaacaaaguaacuugauuaagaaauuaagauuaacuaggcauuguggcccaaugccuuugauuccagcacuuaggaggaaaaagaaaaggguucuccaucaguuuaaacucagcaugauguaagcagugaggguaauguuaacuagggagacccugucucaaaaaagagaagaaaaagcaggauuaagucauccauuuuaagucacuguaauggcuucagaguaugagaaaacagcaaaauguaccccauuccugcaugcuuuuaugauacaugugccauuacacuuuuacaugucaguguuuaacuuuucuaccauuggaaaauaaaaauuuuaaagggcuuuaacauaauguaaggcacuuuaugucugaaacauuuucugcccacuaauacucuuccccuucucccaccuccaauuuuauuucaugaguauauaguuuacuuggcucuauguuuacaucaccugcaugcugugcucccaggggacuagaagaaggcuccaaaucccccugggacugcaguuauagacagugagguacuuacccugaaagugcuguuaaucaaaaguggguccucuggaagaggagacagugcucuuaaucccuuuauuuucuucuugauucagugaugucauuuaaaguuauguccuuagucauauaauaggaccauuuuuauauuagcccgcagugggaggucucauguaagacaguacacccaguacuuuauuggauaccucuacaaauacuuaaaucuuuauaggagucugucugucugucugucuguguguguuuguguguaugcauaugcaugaacguguaugugagcacaugugucuauguuucuguuugugagaaagugaagagacuuauguaccuauccuuuaauguuuuuugaaaaauugguuuuuuuuaauuguuauaauuuuauuuguuuuuauguauguauuuuacaaaauguauaaucuucuauuaaacuaggugcaaguggcuuacaucucaccaaacaugagaacuuccaugguggguuagaugccauaucaguuggagauggauuauuuaccauauugacaacacuuaguaagaaagccucuacaguccacaugauguugcagccaaucuugaccuacauggccuguggauacaugggcagacaaguacguucaguccagcagcugcugcaguaauuuaacaguuugaugguaaugcaagcagagaauuacaucagacagaugaacaguauccauguucaugggcaaaguaacucuuagauuuuacuuuuaauagaaauugaagaauaaaauuucaugauauggucuuuugaaaaaugacuacagagauaaagucaauauuuauauucuggaaaggcucacuacuccuuucccugagauagcaucuuuaacuagcagguuguuuccugagauaugacacagaacuacuaaacauggacaacaaaauucuaaagggugugaggguaaauuuucauucuaauacaauguuuucauuaauuccuuggucauuccuauagugucauuucgaucauauuaagaaaucgaguuguccagauucacagggacuuagaaaaucauguuguguguuuacuuuuuagggcucucuugcuacuugccaguuaucugagccauuguugugguuuaucuugagaguguuggauacuagugaugcauugaaagcuuuccaugauauggguaagaaaaaaaaucuccuaugcugucauucuagcaugguccuuucagcuaacauuguggcauggucauuuuuguacucugaaucuucacuuguuucuaggauucuuuucauuuaguauucuuugugaauuuagguggaguucagcucauaugcaauaauaugguuaccaguacaagggcuauugugaacacugcaagaaguaugguaucaacuauuaugaaauuucuugauucuggaccaaauaaagcuguugacagcacuuugaaaacaaggauccuggccucugagccugacaaugcagaaggaauccauaacuuugcaccacuugguaagauagugguuaugccucuuacuaugacucagcucuguguucugaugaggugaagcaaaauuaguuguggacacaaguugaaacuagauuaguacaauuuuaaauaaaaaaauuccuuuuauaggcuguuggguccaaaacauucuacuaaguacaacauuuuuaggucaguucucucuucaaauguuaaucaccuuaaaaggacuuaaacauugauauguuuuacauuuuuaauuuagguguuuauuccuucauacugcauuucuuucaugcuuuucuuauuguuguuucaugaacaucugagaaauaaagaccauuauuuucaugguuaaagaaauuauaguccucaagaguuuucuacuuaauuuaaaaauuacccuagacaugugcucacuaauggucacuuguccucugacuaauaguugacuggcuauuuugggacuacuguugaucaucaugcuuggugacugacaguguagcuauuccagcagauguuuauuuucugcugguuguuauagcuucauaugguaucaucugaguauuucucguguucuccugcauccuuuucacacguuugcaugcuguuucccacuguuuccuuguagguaccaucacuucuaguaguccuacugcccagccagcugaggugcuccugcaagccacaccgccccaucgaagagcucguucugcugcuugguccuacaucuuucugccugaggaagccuggugugaccuuaccauccaccuuccgucagcagugcugcugaaggagauacacauucaaccucaccucgcaucucucgcaagugcguacugugaggagugcugcgagugacaggcagggaagaccggaagugcucucagcaagcccuccugugcucaccuuugguguuaggucauggguacauguguuuaaucgcugugggcucccucccucccuccccuccuccaccccccccuucuguauaauucacuugguucuuaauugaauauauuuuaucagaacauuuuaagguaaauuccuuaaaauacuuggaaaaucaguuccagauuaaguagagacagauuuuuuuuguagaauauucaguaacaaugcuugauaauauuuuuccauuuaaagucacuuagcuucuuucagcauacucacaguuuauauugagauggucacauucauuuguguucaauguuauucaauugaaaaccuugggagauuucauagauuuuuaguauguuuggaagaauauuuuuauuuuuaagguagacuauaaucuaguuauauucaaacuauuaccuaaucucauccaaauaauauaaggugaacgucagacauaaugucaugucccuguaauuucaugucaugggaacaugagggaggacaguuuugaacuugaggccagccuguguuuccagaugaaauaaaacaaaaauaguaacauacccagaugucccucaacagaggaauagauacagaaaaugugguacauuuacacaauggaguacuacacagcaauuaaaaacaaugaauuaugaaauucuuagacaaauggaugaaucugguggauaucauccugagugagguaaccaaucacaaaagaacacacaugauaugcacucacugauaaguggauauuagcucagaauccuuccuagaagggggaacacaauacccauggaaggaguuacagugacaaaguuuggagcagagacugaaggaacgaccauccagagacugccccacuuggggauccaucccauaaacaaccacuaaacccagacacuauggcagauaccaacaggagcuugcugacagaagccugauauagcugucuccugagaggcucugccagugccugacaaauacagaaguggaugcuuacagccauccauuggacagaguaccggguccccaauggaggagcuagagaacauaccaaaggagcugaagggguuugcagcccuauaggaggaaauuuaauaugaacuaaccaauaucuccagagcuccuugggacuaaaccaccaaucaaagaaaacacauggugagacuuguggcucuagcuguauauguagcagaggauggccuagucggucaucaaugggagaagaggcccuugguccugugaagguucuaugccccaguauaggggacugcuaggaccaggaaugagaguggguggguuggggagcagggagaguggggaggggauaggggauuuucggaggggaaacuaggaaaggggauaacauuugaaauguaaauaaagaaaauaucuaauuaaaaaaaaaagaauaacgggcuggugagauggcucaguggguaagagcacccgacugcucuuccgaagguccgaaguucaaaucccagcaaccauccauaaugagaucugacucccucuucuggaguaucugaggauagcuacaguguacuuacauguaauaaauaaauaaauaaaucuuuaaaaaaaaaaaaaaaagaauaacauauacuaaaaccuuacuuuagcaggccauaaacuauuuuaaaagacaaaguacugcuugacaggguagcauaggccuaccuuccuaucuacuuagucuucagcaggaggauuuacaguugaguaucugcauggguaucuugugaguagacagcuagagaaaccuagugugcagauagaaaccgagacgugaucuaguggcauggaguccuuuccuaguaagcuuugcaucaagcucuaagcugcaguucaaguauugcgaucugaaaugagaaagcuuuuguuugggaggaaaacaguuuguuugaaaguggauagauuuugccugugagaauuuggaacucaaguacaguguggguagagaaagcugguauuuaugcauucuuaacuaacagauaacuuucuggugguuuagggcagggacucaauauauguuccagugaaaauugaauagauuuauuauuaaauggugguagaaauuucaguuguuugauuccuuaaaguguauugcucauguaaaauacagccguuauuaguuucuugaaaauguuuuugaaguuacaguuuacaaacuuuaaaaaaauuucucuaacccuuaauguaagccugccauuuaauugacaauuaauaaaauuauacuuaguauagaaauaaaccaauuuuuaagauuuuucuuugauagcuauguuugccccauaggccucugugcuaugcagggagcagaaugucccauuaggaguuuccauuuguuaccucacuggcacuccuauguaacaaaaacuguuuuacucuuaaaauuugaaaccguuugguuaagauuuaaaauguaaauaaaaggcgaaacuaguugugauguuaacaguguugcaaaucuuacaguauugaaccgauugguaauuacuauucuggucuucucaaguuauucuaaacaaccaaucuuaaaacuaugcuauguucaugacaguuuugguagaagaggaauaggaaguaauugcccucuaaguugcuuuauuuuacuuuuugcaaguauguaauacauacacaacugauauaaguuacuuuuuccuuaggugaauauuuccauauuuaugauuauuuuaauugugggaggucauauuuuuuaaaaacaugcaaaguggugaugaaugcuagugacugguacuucuuguuauaguuagugcuuucuguaagcucauagugcaugcaucucaaaguugccagauuagugcccuucaucuagaguacuagaauauagcaucuaguucccuuuuuuuuacuguucaguuuucucuuccugcagccugcccaucgucagugucuguugaaguaagugcagaugguguuaauaugcucccuuugucuacuccuguugucacaagcggucucaccuacauaaaaauucagcuugucaaagccgaaguagcuucugcugucugccucagacuccaucguccucgggacgccagcacacuaggccucucacagauuaaauuauuaggccuuacugcuuuugguaccaccucaucagccacaguuaauaaucccuuucuuccaucugaagaucaaguuucuaaaacaagguauauauauuuuuuacuucuuacucuuuuuuucucuuauucuuaaaaaaugcuuucugggguuguuuucaaauuauucauccuagccagaggugauggugcacaucucuaaugccaguacuugggaggcaaaggcaggugguuuucugugaguuccaggcaagccuggucuacauagcuacauaaggagaccccaccaccaccaccaccaccaccaccaccaccaccaccaccaccaccaccaccaccaccccacccccaccccugcgcuccaccucccccaaaucaccuuaguaaguuguucuguaggugcuuauauaguaccuauuucuguuaggucuaauacaauaauuuugaugaguauaaccaugaauuaguaaaguugagauuuacggaaagcaucugcaauaauuugagcuacuuauauuaccauacuuguccuuuguauguuucagcauuggaugguuacgguuauuacaucauugccuuacacauauaagugaucuagaagggaugauggccagugcagcugccccuacugccaaccugcugcagacuugugcugccuuacugaugucuccauacugugggaugcauucccccaacauugagguugugcugguaaagauuggguugcaguccacuagaauuggccugaagcuuauugacauucuccugaggaauugcgcagcaucaggcagcgauccuacaggugacucuugacuuugcuccuguaauuuuuacacaccuacacaguaaacauacgugaacaacaugauguugguaauucuuucugaaaugaauuucucuuaaagcuuuguuauuuuuaaaccuuuucauauuuuacaggugacauaauuuaaauauucagugaauauaacuuuuauauucagcgaauaacuuaaaaaauauaucuuuccauguaaacuggcuaauuuaacaauguuuuucuuuuuuccuuggcuaagauuuaaauagcccuuuacuuuuuggaaggcugaauggacuguccucugauucuacaauagauauucuuuaccagcuugguacaacucaggauccuggaacuaaagacagguauacuuugguacuguuuuuuuaauuuaaucacaaacaugauuuugugaauuggaauuaauacuuuuucuucagaaagucuuacaaauguuuaaacgaauauaucuaucaacaucuauucauauacuuuauauaauaaacaaaauaauauauguauagacauauuuuuaaugcuuuugagcuaaaacguauuuguaguccguauuacauugguaggaauacuucacauguaaagauauuauuuauaucaaauuucaguuguggcauuacuggucuuucuuaacuuuuuaagaauucaggccuugcuaaagugggucagugacucugcaaaaauggcugcuuugaagagaaguggcagaaugaacuauaugugcccgagcucaucagcugucgaguauggucuucucaugccaucccccucucauuugcacuguguagcagcgauucuuuggcacaguuaugaacugcugguggaguaugauuugccagcacugcuagaccgagagcucuuugagugaguacgagugaaauccuacucuuguguaugcuauauugacuguauauuuccauuuguuagguauaguauugugucuguuucuguaguuuacugcuuuagaguugaugagaucuaagagaauggagccuaaaaaccaagugggcuaaagucccaugccguagugugcuuuauucagagcacaggacagcaggaagaaaacacugaaagaacaauccuggguuucgaagaaacuagggauacaaggcucuuguuucuuggaguuucuccacuagcacucagaauucucacacaccuucauuuguggaauguguucaaaaaauauugauaauuauuuuugauaugaggguaauuugaaaauaauaaauacagaaguaguuguuuuggaguaacguuuuacauuuacugcauuuccuccauccuagggauugauguguucuuuuccuggagcugcacucucagccuuucuuguuuuaagauugaucagugauauugcuaguuuuucucuaaaugagaaauguuuguguagguguuguaaagugcguuaugcaguucuaacuugcacggucagcuccauuucucuuuaguauacaaguguaaaggaaaguaucaguaaaagugugagaguggcagggaugcucgccccucuauugcuagcacugggagcaggaggaagucggugaauguagugaauuccaggacagugaaggauagaacacugagaccgcccuacucaaaaacagugggaguagaaggagaauauacagauguggauguacacagucaaacagcaggcugagcauggggucagggcaaggagugaaggagcugaagggguuuguagccacguaggaagaauaacaauaucaaccacccagauuccccaaagcucccagagauuaaaacaccaaccaaagaguacaccuggggggacccauggcuccagccaccuauguagcagauaauggccuuaucuggcaucacugggaggggauccccuugguucugugaaggcuugaugcccuagggugggggaaugcucuggcgcugaggcgggagugggugggcaggugguggaacacccucauagaagcagggggaggggaaggggauaggggcuuuguggaagagaaacugggaagggggauaacauuugauacgaaaguaaauaaaauaacgaauuaaaaaaaagaagugucaaguaaacucuugguguuuuggucauuaaauauaaauauuuaaucuccagugggaguauuucaagcaaucuuuucuuucucuagguuacuuuuuaauugguccaugucacuuccaugcaacgugguuuugaagaaagcuguugacagucugcuuugcuccaugugccauauacauccaaauuauuuuuccuugcucaugggcuggaugggaauuaucccuccuccggugcagugucaucauagacuauccaugacagaugauagcaagaagcaagaucuuaguucaucauugacagaugacuccaaaaaugcacaagcaccucugucucuaacugaaucccacuuggcaacucuugcuucuucuucucaguccccagaagcuaucaaacaguugcuagacucgggguugccuucccuucucgugaggagucuggcuagcuuuuguuuuagucacauuucuuacucagaaagcauugcccagucaguagauaauucccaggacaaacucaggcggcaucacguuccacagcacuguaauaagaugcccaucacagcagaccuaguggcucccauccuuagguuuuugacagaaguuggcaauagucauaucaugaaagauuggcuuggugguucugaagucaacccacuguggacagcacuucuguuuuuguugugucacucugggucuaccgcuggaggacauaauuuaggggcacagcagagcagcacaaggucagcuucucauucuucagcuacuacaacaguccugaccacccagcaacggacagccauugagaacgcaacuguugccuucuuucugcaguguauuucaugucaccccaauaaccaaaagcugauggcacagguaagacagcaaggcccuucuuagacuuuauacaggagaaagugcugcaauuuuggauuagcuaagcaagcgccaugugacaacaaagcuugggguuaggucuggaugagcaucagaaucuaggccacaauugaaguauuuucucucuccuugcaauacaugcugucaaaauacauuauuuuuuaggauucgacuaaauucauacuaacauucaugacuggaaauccaugaacauucuagcuucaaucugacacgauuccaaacuccccucgcuaaagagcaaggcuaagagaaugugucucugcugcugggccuggacuggcugucacgugccaccagaacgcugggacuguugcugugccugucacauagacaugaagagucggcuucaggagagaggcucugaacacuauaggcuguuuauuauaguaugucugcauggccaaaauuuugccagcuaggauuguuuagaggauauuugcaagugcuuuauuuuguuuuguugcuaaguuuugcagcuuuguggcccuugugaguuuuggguuacuuuuuuuuacuauauacaucagggcuaguaacacagaacaccuuaggauacaggaaaaaagguucuuuuucucccugucaauggggagugcuuauuccugucauucuauuaauacaggugaacaauuuuaauuuuuauaaauauaguuuguugacuggaaaaacaagguacauuagugcucauaguaguaguuauuagacaaaugucucucugcuuaauauaacuaguuaaaagcaagugcuugaguuauaagcuugaaccagaagcauaauuacaauucuugaaaguuugaauugugcguuuuaaacugaguugcuauauuccuuugacuucugaucucauucucauguuucuuauuaauacuuuguuuuuaaugcaaaaccaauuccccaccccccacacccacccucucaguucucuuugugucagcccgacugaccucaaacucacaaagaccugccucguagugcugagauuaaggcaugggccaacacaccuggcaaagugcuuuucaaaaaguaaauuuuauuauaacuggauugauauuuacugacgacaguucuggcuaguccuucucuuuaugugaaagaucaauaguaggcauuccuuuccucuauugaaauguuaguuuguuuuuuuugugaguuagggucuuacucuguaggcuccuugaacuugcuguguagacugggcuggccuugaguuuaagagaccuaccuuccuucuccugagugccgagauuaaaguugugugacaucacaccuggcuguuucuuacacuuuuaauuguuuaucugcuucuguauucccauauuuugagauuugaguucuuauuugcagacuggaugcaauaaaacacauuuauucguuaauccauauucuuaauuucuuguuuuguuuuuuuuuuuuaaaaccugaauaucuccacuuaacuuuugaaauuucuucccuucccaagguucucugugaacuguuucagacagccccucaaagggguagccuuccaacaucugggaauauuuccggguuugugcgaagacuguuucuacaguugaugcuggaggaugagaaggugacaauguuucuucagucaccuugcccagugaguaaucuuggugaucacuuuguuguccuuauaacucuuagaccuuacagacaccuugugugugugugugucuugcucaaaugucugucugugugccugacccaaagagaugagaggagggcuuugaacucuggaacuggaguuacauguauugugagcugccauguugguucuagaaacaaacccagguccucuguaagaacaagugcucuucacugcagagccgugucuccagccccauuuucucuuuaguaauguagcaguuuauauugacaauaagugucauuuaggauaacuugccacagccccuuuauuagaacaacaacuacuauauugugaauaguagguuuuguuuugcggacacacagaauauuugauaccauugguacuuccaaucuaaaaagcugaucaacaauuccuagguaaagaaagcaugccagaaauauguaaaacauacaaauuaugcuuuauugagcuuuuuauucgucuuuaucuuugaaauugauuccugauaguauguauccuaaaacauuuacuucuaaauugauuaauuuuuucuuagcuauauaaaggaagaauuaaugcaacuagccaugucauccaacacccaauguuuggagcaggccauaaguuucguacucugcauuugccagucucaacaacguugucagaugugcuugauagaguuucagguaagcaagacuuaaguuuuaaguuuucuuuaaccccaguuuuaugcauuugaacuuagaaaaagauuuauuuuuaauuuauguguaugauugucuugcuugcauauguaugucuguguaugccaugcaugcagcacccacagaguugaaaagagggugugucagagucucugcaacuggagguagcagcaguucuaagacaccaugugguuccugaggacugaaccccugcguaggagcagcaaguacucuuaggcaccgcaucaucucuuuagucccuuauaccuuuguuuucuuguuucuguccucucagaaaccauuucauaaccaaaagcuucuaaaugucuucauagcuugaggacagaaacaguucuaauaaaguuagcaauaauaacuauuaccuucaggcaauaauauucuuaguuaugaucucagcucugucuugugaugguggggcaggagcuagaaauggaaacaggugacguuuggaggauuuuccccauacauagucaugaggucacgcuauuguugcacuaguguaucuguggcagguuucaaauuaauaaguguuuucugaaucuagagguaaaaugaacaaauguucacacgugaauguaaagaauguaaaggaguaggaucaccugguccccuccuggcacccuccccagggugcuuuuuuguuguucuguuuuucgauauuggguuucucuguguaacaaagacuaucuuuagauguuacauuguugaccaggcuggcugugaauuucgagaucugccugccugagccaccugagugcugggauuaaaggcaugugccaccaugcccagcuagaaaaagcugcuuuuauggcauugugaucaucagagaaguuauaguuauugaguaaauuuuuucauaagaacugcagauuucucuagagauggacuuaugagaagaacacauucugccccugaaaacaacuauguauacauuagauuuaaaaguaagcugguaauauguauguuauaagauuaaaaaauaguauauaucuauauuuguaaguggaagaccaauguuuuccugggaauuagugaaggaaaaguggacgcuguccuuguaucgcaugaaauccaaagcucacaauucaagucagccagaaaaguguggagagguccucgccuuggcagcaggcguccuuagaauccgauacgggguuagcagcaacccugcaccaggacagagagugcauaaaguguuccauguugagagagaaagaagacaguggggacuugucagcauuuguaaguaguaagucaaacugaugugugugaaacuacucaccuacuguagagugucuggaguccgagcaggaccacaggagccugggaauuaggucucagcaucagcguaaggcugaguaucacagcaagaaaagacugaugacacaauugucuuauaaaauugcaguucuucccugcagcuauaacaaagacuacaauagaauuuuaauguuaugauaacugcauguuaaaacaaguuugguuuuguucuuuauuuuuuauuuggauauggcaguuuaucuauuagaacaaaacuaaugcuguugcuuuccuucuggaugauguagaaaaacacuguauuuuagacaguauugucuugcagauacaccaaguaucacagcuaaacuuauuagugagcaaaaagaugauaaagaaaagaagaaccaugaagagaaagaaaaaguuaaggcggaaaauggauuucaggauaacuacagcguuguuguugccucugguaaguuuuguccuuucugccaccauuaaucugacaucuaugauugucaguagaauuacuuaaaucuguuuauuguuccaccaggaacugaaaaugugugaaagaauggcauacauaguguacuugaucagaaagacuuccugguuuucauuuauaguguuuucauuacauaaaacauuuaaaacauuuaaauuucuaguauuagauuuggaagaagaaaaauauuaucaagggugacuauuaucaaggcuguacauuuaaaaacuacgugguaaaaaguauguaagaaagaauguaaacuucagcuuucuccgugaucagcauauugguauauuuguccuccuuaucauaaaucaacauggggucucucacaccuauuuuccauaacuacuauuuuuugcuugaauagccauauguaucuaauaauugauggcaacuugcaguauucucauuuucuuggcaauuauaaauggaaagccaaaauuauuuauggcaugccuaaaagaucagggagaguuggaaguauagauacuagauuaaugauuugguguuaggaaugccuaguuuauuaaaacuuuuuagaaauauuuacuugauaucuuagcuagaaaaaguuaaaaaaaaaaaacuuaaccaauuauuauguuuuagggcugaaaucacagucuaagcgugccauggcauccacaccaccucgcccaccauccaggagaggaagaaccauucccgauaagaucggaagugcauccucaagcgcagacgcggccagcaaaaucaucaccgugcccguguuucaucuguuccacagacuccuggcagguaacgcucaugcaacagcgcagccgucacgugcuugaucucuugcuuugcgugagauaaaugaggucuuccuuuuucuacacaguuccuuuuaggaagaaauaacaugcucaaaggauaaccuuuuaaaugucagugacauggaguuauguuuuuuucacuuuuauaucuucuuuacccuugcuuugagcacagaugguaaaguagagaaguagcauagguaaguuuuguagguagaauucuagccaaggauuucaagagagaacaaugguaauuaacauauucucuccagauaaaauuuuuugaccaauguuuuucauuuguuaaugugauauucauuauugcugugccauacucuuauugccaaguaaugcuugaaugauguccuuuuuacuucacauccaagguuuguggaugugaucucuacuauaguagaggucaagaaacuaggacugguggguuauuuacuacaucucuuuguaaauaaaguuuuguggguuuuuuuuuuuaagauuuauuuauuuauuauauguaaguacacuguagcugucuucagacacuccagaagagggugucagaucucauuacggaugguugugaaccaccaugugguugcugggauuugaacucuggaccuucggaagagcagucgggugcucuuacccacugagccaucucaccagccccuuguggggguuuuaucauaauuuuaauaacuuuaacaauuaaaaauaugaauaugcuuuuguuuauuaaguugacaauauuaagaaggauuuguuacuuuaaugugcagaaggguuuuaaaauauacaauguaaauucccugaaaucuauuuguacaaguaaccagaaagcgauuauuucaagaggaaacauuaucaaaagaaaaaaauauucuacuaaugcuucauacaagaaauagauacaugugcaguuugcaagauggcugagcagauuaaggugucuguuuccaagccucgguuugauccaugggacccacaugacagaaugagagaacugacucuagaaaguguucuucaacugccacauguauguguaccauggcguguacagcuacacacgcacacacaggaauaauaauaguagaaaaggaauauagacauuuguugaacaaagagacaguuaaagcaauuucuaacccugguaacuuagccuccaugcaugcauugauaaagcugccuaggugagaacuagugcacucuuuggcuacagcggcucucaggugugcagccucgcagcucuacuugaccuccugacucaaucuucaaaauccuggauugcaggccugugccaccaugccuggguugugcaguauccagcuggagauugagcucagaggucuguauaugcuaagugagcgcucugccaacugaguuacauccccagcccaguaugcauacauuacuuugacuuaauuacaaaugagccauuugauaaaaauaguuuaaaauauauuuauauuuuauuuguguguguguguguauguauguguguacacacacacacacacacacacacacacacauauauauauaaauaaaaaaccaggaccuuaaaaauaauaguggaaaacaauuaagagaucauaugacuuugagcaaacuauuuauauuauacuguguuuuacaucaauuguuucuauaaaauuaacacaauuuuccauuauaauuacuuuaaaauuacuauuuguugacauuaaauucauucacagugugugacugccaccaccaucucucuggcaguucuuuucuguaucacacacucuaaaucucuuucauauuaauagagaaucuaugguacauuauaaagaacagacugagaaacagucugacuuugauuccaaucuguguccugaaucuaccacuuauuuaucuacacuaacuaauaauagacacuuauuacuauuucccugucauuuuaaagacucaaaauagucaguuuacugaaguaguguaaaaguugagguuuuuuuuauuggauauuuucuuuauauacauuucaaaugcuauccccaaaguucccuauacccucccucugcccuccuacccuacccacccacuccugcuucuuggcccugguauuccccuguacugggucauauaaaguuugcaagaccaaggggccucucuucccagugauggccgaguaggccaucuucugcuacauaugcagcuagagacacgagcucagggcuacugguuaguucauauuguuguuccaccuauagguuacagaccccuucagcuccuugggugcuuucucuagcuucuccauugggggcccugugauccauccaauagaugacuguaagcauccacuucuguguuugccaggcacugccauagccucacaagagacagcuauaacagggucccuucagcaaaaucuuucuggcauaugcaauagugucuggguuguaaauaaaguuuuauuauaauauguuugcccauguuuaauguauuauucuuagguagagggguaguaauugcagucaugugggccccauugcuuaaaauauuuguuaccuaagccccuaugaaaauauuugcaaauguuagcuuguagaauaucuccucugucauuuguuugaccuugguguucuguagauauuuuucuggguauuaaucuauagguauguuggaaacaguuugacuuuuguagacuuaccaauggguaccuuuaaacuguuuugaaauagguguauuuuccagacucuugacccugauuaauaaaaauaaugguuaguuaacacugucaaaccaaguaaaaaugucucccucuuagauuuuauuuuaacucauguaauuuuuguaggucagccacuaccagcagaaaugacacuugcccagcuuuuaacucuccucuaugaccgaaaacuuccucaagguuaccguucaauagaucuuacuguuaaauugggaucaaaagucauuacagauccaaguuugucaaaaacagauucuuucaaaagacugcacccugaaaaagguauguagaugacacuccuuuauaucuugcaauucauuggugacaagaggucccaguuaggaaaguacuugaugugcaagcauaagcaucaaguuugagguccagcauccaagucacaaagcugagugggauggcuccugcuuuuaaucccagugcugggagauggagacaggaccagcuauaacacuccccagccagcccaucuccauggaguuacacagcgaguacuccuuuaaguuaaacagcugcugagcaucuuugccacucuuuuuuuuuuuuuuaauauuuauuuauuuauuuauuauauguaaguacacuguagcugucuucagacacuccagaagagagcaucggauuuuguugcacagcugcugagcaucuucgccacucuuuuuuuuuuaauauuuauuuauuuauuuauuuauuuauuuauuuauuuauuuauuuauuuauuauauguaaguacacuguagcugucuucagacacuccagaagagagcaucagaucuuguuacggaugguugugagccaccaugugguugcugggauuugaacucaggaccuuuggaagagcagucagcgcucuuaaccgcugagccaucucuccagcccuccgaacuuucucuuugccacuguugcucuuucuuuuuguacaguguauguuuuuuauaaaugaaagcauauugugugugugugugugucuguguguguguauauauauacacacacacagacacacacacacacacacacacacacacacacauagguuguuucuuacauacugaguuuuuguguauuguauagaucauggagacuuaguuggcagcuguccagaggaugaggcucuuaccccgagugaugagugcauggauggaguauuggaugaaucuuugcuggaaaccuguccuauucagucaccauuacaaguuuuugcaggaauggguggacuggcucuuauugcagagagacugcccaugcucuauccagaagugauucagcagguaagcuaagccuucuaccacggugcacaugguauagugauguuuucuguucuuuaaguuacuugcaauaaccuuuuaggaauauucuuggccuuauaauuuuugaucaauggauaagucacagauuggcuucuauagaauauaugagcaucagcugggaauauggaagcucguuucuuaugacuuucccaugauguuguuaugaucaucacacuaacauucucuuuucuguauguagcuuggaugugguuuugauugugguuauuacuguaaaugagagaguaaaauaauagugaaucacucauauuuaugccuuauuuaacuucugcucuuuuugauaccauuuccaauguagauaguuuuaaaucauuauuuuagcucacaucaguuuuaucuucuuccugucauuugauguuuguguacuuuucauguucuuucauguuaaugcaaaguuuuuccaguugucucuggaauguuuuacggacaaauggaaaaaucuguuggguauccuggcauauaccuguaauuuuagcacuugaagagcuauggacagaaugccagcuugaguucauuuuuuuugggcuacagauagcaauaccuuuucucaaaaacaaaaaacaaaacaaaacaaaacaaaacaaaacaaaaaggaaaaagaagaaagaaaacccacuauauguuucuuuugcaugauuuggauuacaaucuacaccagugguucucaaccuaugguuucuuauaauuuuuggaaguuacagaucagauaauccuggcuauauuuauauuacaguucauaaaagaaaaaugagugaauuagguuagugaacuacagguuguuugucuguuuuaaaguucgucuguaguuauucacugacuaugaauaggaagaugcuguucugacauggaugcacuugguagauacuggcauacuugugaugccauacucuucuugguauuuguuaccauguuuuuaaaacacgaagaguucauccgaagcccaguacugaacugucucuuuuucuuuaggugagugcuccagugaucgcuuccaccacucaggaaaagccaaaggauagugaucaguuugaaugggugaccauagaacaaucaggugaacugguuuaugaagcuccagaaaccauugcagcugagccuccaccuguuaagucagcggugcaagccacgucucccauaccugcccauucucuggcugcuuuuggauuauuucuucgucuuccgggcuaugcugaagugcuccugaaagagaggaagcaugcccagugccuucuucgauugguguugggaguuacagaugauggagaaggcaguaaguguuuccaguuacugcuuacauuuaucaacacuacacaaacaggguggauacauuugucuagauuauuuucucuucuuaacuguuuguuuuauaguaaagcuauuuacaugguuuguaauuuuuauugaguuuuucgguauuaaauaugguaauccuaagaaauuucauauuaaguuuauaguaagugacauuggaaucgugugaccaggaaguaggacuaguggcuguguaguagguaugagaacauacugacucugacagcuuagaggaggacuggcgcugaguauucugggagccucagaugugugaggcaguuucuuacagauguguaagugugaagcuggguagcaguuuuggguggugcucugaaggauaagcaaaauuuaauuuagggagaguauuuugaacagaagaguuguaagcuuuguuugaguauuugggcggggaggagcuagcacauucaaaucuguaugaaaggcacuucuaaacuguuguggugggcacguguucgcaaucccagcccucaagagcucaguagcacaaggaucagguuuccaaacugccguugacgauguacugaguuuagugacagccuggauacaugagggucugcauggagaagcaaugaaagagaaguuguuauaggauuaugaauaccuaauauugauuaaacuauuaugaggaaugggggcauuaaaaaaaaaaaauccacccccaaaagaaaaucuagagcacugacuguuuuuccagagguccugaguucaauucccaguacccacauggugacucacaaccaucuguaaugggaucugaugcucucuucuggugugucugaagucagcuacaguguacucauauacaauaaauaaguacauuuaaaaaaaaaaaaaaaaagaaagaaaaucuguugaaguguuugaaacacuaaacuuggauuaguguuugcaacaaggccaaaguccaaucuccuguacuauagaaacaaaacaaggaaauggagaaaagcaaaaagcauaaaucuguagcauuauuuugaacaaagagaagagagcuaagauuauuauauuauacuguauuauauauaguauauguaauacauauaaaguuuauuauauuuaauaaauauauauaauaaauauaaugauuguucuuauuucaugcuguuauuuaaugcaauaagagauugacugaucgcaguugagguaguuaggaaaauucacuuucauuuggaucccucuuaauuguucacucaauaacauuuuacugccgaucgaucauaagcagcaaaggggaaagaguggacuuagauugcacacagaaguccaaggaauggcuucugugaugcauaauuucauuuuuucagcacucauucugcucauauggugcuuuauugcuuguguuuaucacuuucuuauuaaagcaacacaaaacuauuguacaaaagaaaauaguuuuacuuguuauuguucauaggaaaaccauuugaaaggacaccagucacuuucugauugaugguuguaggaaauuucuucuuccuuggcacacuuuuuaucccaguagugaggaggugcagucagagacaagcagccuuuuauaaauuggaggccauccuaggcuacauggagaaccuugucuuuuaaaauaaaaaaaaaauuacauuucauuucacauuuaguucauauuaucuuuguugucauugauggcuguuacauaucuguaaaauuucagaguguguguguguuguguucuagagacuuucuugauacuuuaauaaagauaacagucucacagucagccugcuuuuuaauaaguuuaaugauaaaaccuugcuuuguuguuauuacuugugacccuauguguaagugcuuauuauuuucaagugucuuuaauuuuucccucuucucuuucaaaggucacauucugcagucuccaucagccaaugugcuuccaacccuuccuuuccacguucuucgcagcuuguuuagugcuacucccuugacaacugaugauggugugcuucugcggcggauggcacuggagaucggagcuuugcaccuaauucuugucugucucucagcucugagucaucacgcaccgcgaguuccaaacucuagccuuagccaaacugagguagauuucauuccaauucucuaagucacugcuucucagccuuccuaaugcugggacccuuuaauauaguuccucauguugucacaaccccagccagaaagucauugucacugcuacuucuuguuauuuugcuacuguuauaaauuguaaguuguguuuuccuaccuuuggucuuaggugaucccugugaaaguaaggcuucuuaaacccucaaagagagcuagagguugaggaccacugcuuuauguuacgaaaaucuaaacuuaauugaugagaauauaaaguauaaagugagaguauaaacuccaaauuucagaguuuagauuuuauaauuacuaugggaugucugaaagagaaacuaucacuuguuuucucugcuacccuccuaaggaaaaaaaucagauuuacucaucaguuuaagaagcagauaguggggcuacagagcuggcuuagugguaaagagcaccuguugcucuugcagaggacacagguuccauccccagcucccacauagugagugguucacaguuauccauaacucuauuuccuggggauccaaugcccucuucagaccucuggagccauugagcauagccaugaaacucauaaauggaggcaaaaugcucacauggaaaacagaaacaaauaggagaaaacaagaaauggauaguuagaaccuccccacuuguuaggauauguugacauccuuuagagaaucauauuauugaaugguuuguuauauaauauaguagacacccucaccccacccccaaaacacacacacaugugcauacacaagcuggcaaagggggaaauaguccuuauuuaaaguccauuugauuuguguguauauaaagauuugaaauauaugagauuuguauacaaauacuguuuccaguguugagagaugccuaccaguaaagucuuugugagcuuaaaaaacccaaauuugcaucuucagaacccaaguuaaguuaagaagcuggaugagccgggcgugguggugcacgccuuuaaucccagcacucgggaggcagaggcaggcggaucucugaguuccaggccagccuggucugcagagugaguuccaggacagccagggcuacacagagaaacccugccucagaaaaacaaacaaacaaacaaacaaaaaacccaaaaccaaaaaacagaaaaagcuggaugaguuggcauuuuccuuuaaucccaguguccagaaaaccagacauucuagccaaauuaagucccaggcucagugagagaucuugucucuaaaauaagauggagagcaauugagaaugucucauuuucacuuggauguccuugugcagaaguguuuguauuaugggauacaguguaauguuucaauccauaaaugccauuuguuauaaucagaucacagugaguagcauuuuuaucaccuuaaacaguuacucaaaacucucagguuuuacaaauguaccucauuugcuaacuuagucuuucaguccuacuguaaaaucacacucaucuguguucccucccaguuaagauauauuuuguuuuuaaaccuuaggaggcuagccuggggguuaugcauguuauaaagagguuggcaggguaaggcagaaggcuguugugugcucauggccagccuuggcuacacugaccaaagcaaaaaacaacccauaagcaaauuuuaaaaaacaagaacaaacaagaacccaacaaagggaaugaccugguaagauggcuaggagaggaguagcucuccaucggggugugaguuugguccccagggcucacauagcagaaggagagaaagcacucccuaaaaguuaucgucugaccucugccagcgugcugugcugugugcauccauguuuauuacugaaaccaagugaauaaaagagugagugaguaaaugcaaaaauuaaaacaagacuauaggaaaucccaaagaaacaguuuuagaguggaaacucaaguuagaacuugcuauguggaccaaguuggccucaaacuuguagaucagguuuagcuguaguggaauucaguugguaucuuuucuguaaucuacuccucccccccuuccuuccuccucccuucuugcaugcaucuauucauucauucauucaaggguuucucuguguagcccuggcuguacuagaacuugcucugaggaccagguuggccucaaacuuguagauagaucugcacugcugaguguaaaagaaugugcuaccauguccggcuuaugaucucauucuugauuuguaugguuaguguuuacauuguaguuugucuaauuucuugguuuugugguuuuuuucuguaugccuauucacauuaaggauuuauuuauuuauuuugguuuaugagauggguucuuacucuuuguccaucccaguccacaccuccuagguucaaguaauauuccagcuggagucucccaagugcuaggccugcagacauguguuacaauuuaugcuuggacaucuggagagagagagagagagagagagagagagagagagagagagagagagagagagagugaguguguguguguguguguguguguguguguguaugaguauaaguguuuuauccuacaugaauguguuugugugccauuuguauaccuggcgcccaugaaauuuagaagacaacacuggauccccuggaacuguuguuauggauggagccaccaugugugugguaggguuugaaccugagucuucuguaggaaugaauaguacagucuucuaacuacugagccaucucucuauuuugcuucuuaguauuaaguaucuagugauuauucuaguaauuauuuauacagcaaggagguuuuuuguuuuuaagacaaggucucacuauguuacuuuggcuggccuggaauuuacuauguaugaugaugguacagguagaccaggcugguuucagacucacagagaucugccugcucuaccuguaccaucauaccuugcucuagcaaugaaguauuaauagccuguuuaauugccuaccuuauaagaagugaaugucuuaguuauauaucuacagugauauagcuaacaauuuauagaaacuauuucuaccuaauauuuucucuuagaacauacuuccagugaaagcaacaaaaaauauaccuaguuuuaaaugcuuucagggugcauacucuguuuaauuuaaacaaagauuuuacuucccacauaaauaaagaauuaaccuuuaugguuaagguuauauuucuaaauuuuuuuugguuuuauccaauuuucauaauacuugagguauuuguuuuuguauuauuuaauuuaaaaaauuauguguguguguauguauguguuuggggcagguaacagcuugaggucaaacucugguagucaggcuugucaacaagugucuuuagccacugaacugucucauucuuucuuuauucauauuuuuuuuaaauauaaaaaucaguuuauuguaaugaacucacaaauaaaaaaauuacacaacuagauuaauucagacaaauacuccaccagugcgaacucuguacaucucagugaaccuguauucuauuagaaucgccauucugaagcccaagagcuuugcuuaguguuuuaaacuugugcccucaauuaauauuuauguacuuacccacuauaaaaaaaggaaaaaagaaaaaacuccaugacaggaauaaaacuagcacagcauuaacuuuguaucuuccuuccugacuucuguaucuguuucgauuuucuauucuuccuuaucaccaauaugaccuuuucuuggucucuuuaucaggguuacacuguagucgccacugaucuauaugcuuacagaaauaaauaccugguccacucacauuugaacaacaacaaaaaauugagauaugugaccucuagaaauagaaguagugugccucuuuugacuaagaaugccauuuuaguuuuuuaaaauuuauugauucacuucauuaucaauccaauaucagcccuuucucuccucacaguauccccucauguaaguucuccccccauucuaccuuccccuuuucuuuuuuccauuuugggucucaguccugcccccagcuuuucuguaagauucccgagcuccaucuuauguuuguuuaugagucucugcaucucguuccuuuggcugcugggacagaagucaguuaugcuagguuccugucugcaagcuuaauagaguaucauuaauagugucagggauugguucucacccaugggaugggucucaauuuggggcagucauugguuggccauucccucagacucugcucuaucucugucccugcacaucuuguaggcaggguacauuuugggucgaaggcuuucugguggguugcuguccuuauccuucuacugggaguccugccuggcuacaagaagcagccacuucaggaucuauaugccccacuacuaggagucuuagcuagauucaccucuauagaccuuguggaccucuucccaucucaggucuuuggcacauccuaaagauugcccucccacugucuacuucccuuuccucuacccuguucuuccuacauaugaucucucccuacccucuccguccccucuuuccaucgucugggauaucuauccucccuugggccauccuuguuugggucuguugauuacggcaugauuauccuguacuuuaugguuaauaugcacuuaaaagugaggacauaccauguauguccuuuggggucuuggauacuucacucuggauauuuucuaguuccauccauuugccugugaaauccauaauguccuuguuuuuguuuguuuguuugcuuuuuugguuuuucgagacaggguuucucuguguagcccuggcuguucuggaacucacucuguagaccaggguggccuugaacucagaaaucugccugccucugccucccaagugauguccuugguuuuuaauggcugaguagucuacuauuguauagauaaaccacauuuucuguauccauucuucaguggagaggcauuuagguuauuuccaguuucuggcuauuacuuauuauaaaacugcuuugaacauguugagcaaguguccuuguggggugguggaacaucuuuuggguauaugcccaggaguggcauacugggucuugagguagaacuauuccuaauccgaacagugaggaguguuccccuugcuucacccccaugugcuguccuuuuaguucuugaucuuagccauucugauauguuccuucuaaaaauagaaguugucuuucuccuuugauugagaaaucuccugagauaguuuuuuacuggagcccuaaaauggucuggcuuaaacuuuucuguguuucuguuucuauuugguuuugagucauugauucuuugagccuuaaguaguuuucacuuucauuuauuuucucccucugccuccuccucugcccuccccuucuccuccuccucucccuacuucuucuuuacuccuucccucccucccccacccgugugugugugugugugugugugugugugugugugugugugugugugugucugugucugugucugugucugugucugucugucugucugucugugucucucugguguucuuuccaaauuuucuuuauacaacaugcauuagucuacuuucuugcagcuggauaguguucccuugauuaguucaauauauucauucauuggcaagcauuugggaucuuuuuauccuuggauuguaguguauaauacugcugugugcggguguauacaaauguuuauuuuagcaccaguuuucauuguguuugguguaugccuaggagugucacaguaaguaguuuucaacuuuuugaugaauggccaaauugauuuuuauauuguuaaucuuuuggauaguccuaaugauaauuuaaaaaaaaaaacaaauaauaccaaauacuaguaauuuuccucuucuuaaaagccgcaggugucaaauucccauaaccccacaucagcagaagaacagcagcuguacugggccaaagggacuggcuuuggcacagguuccacggcaucaggaugggacguggaacaagccuuaacuaaacagaggcuagaagaggagcaugugaccugccuuuugcagguacgcuugugagucgguuguuaucaguacugaugauuuacucaguucauuaaguauuuugucuuuuuucuuuuugcugagauguuucauguuuucuaggcugcccuugaacucugaucuuccuuucuucaccuccaaguguaaucaugacagaugugcuccagcauucuuaggcuugcuuuugcuuucuucuccaaauacaguauaaaugccaugguuuaaagaauggucuuuuaugcuuguaauucuaaauauauuccccucaauuagcuucucaccucagauacaauuauccuuugauuucaagauguucucuagaaacauaacaucugcuagcuagccuuuguuuuaauguaaagccucugaccugugcuuacaacccaguauucguacuccauucugcacugggaccucucaccgcuaaacuguaccuguagcucacucucaguucaaauuguucuauagugauuccacaaucaagcaaguugaaaauaggaggggacaucuuuauaucauagaaauaaaugaaauugccgccauuuugaaguguuacuuugcaguuuuaagauggcaugcucguuguaguauaaauucugaggucccagcacucucagacugaaucagugcagugaggacuuggagugcagcguaguagcgugugugccuagcauucaugggcccucuggauucaguccucggcaccgcauuaaagugacacugcgagcgagcaucugaaucucaggucacggugacccacauggccaaguggaggccacgggagccuccugaguuccccagaaagagaaauccaaaggcgacaguggugaugcucccgugucugucagucacuguccagucacugcucuguuagucacggcuuacugcgcucgugugcugcucuguccucagggcgcuccucuuucaguuacauagagagcuauuguccuguguaagcaacccucagcaaacagucccuucccuucugaaaaguuaaguggaaauguccuuuuuuagccguguuugauaucucaggccuauaaucccagcacacaaaguugagggauaaaaauccaaggccacccucucagucgagaaacccaaccuugagguuugucagggccuuauguggaaaagcuaucuccaaaaugaaaaguacacaaucagaaagagugucaacauuggcuaaguaaaaaccagaugcucuugagugugcugagaucaagugucuaguuaugaaacacaucacugaaguguauaaagcugaacuccaauuucuugucugcaaugcagguccuugcgaguuacauaaaccccaugaguggugcugucaauggggaagcccaggcgucucccgagagccgcgcccagaacagcagugcucugcccucggugcuucuggagcuccucagucaguccugccucaucccagccauguccuccuaccugcgcaacgacuccggugagucaggggugcaggcgcugcacggcugcguaaccucagacacgacucuaacuugaaaguccauuauugaaaaaguaaggccgugauacugccuaagaaggguauaaaguuuuugaaauuaaaguuaccauagacagccuuaucaacgugcaacugauguaggguuauuuuguaauguacaugaauauaauguggcauaagugaauauaaugggcuuuuauauuagucacaccuuccuugucucaucccugucucucucacauugcucucaguucuucccaaguaguuacuuaucugccuccuuguccuuuuuccucuacuuuaaaaauguguguguguguguguacacaaauggacaugcuugccaagacacacccguggaagucaggucacgguucaguucuuuucaccguggaagcuccacuacagcucaggucuucagugcuguauccaugacgccuucucccuuuggggccuuuugaaucuauuucaggguaguuuggguuuguacuuccuugauagcuaaucauuaugaaaauuguguuauguuggcuauuuaggccuccuguuuuaaagucuauauaguucaguucguuugucuuuuuugacuuuuuugguguuuaucaguucuuuauauauucuuaguauuaauuaaccuuuuaucaggagagcugagauccucuuguuagagguagccacuguuaaauuugguguuguauucucucucuugguucuuuucacuugugguauaaugaugaauaugcuauucuuuugugugugugugugcaugcguguauaauuauaaauauaugcauguauguucuuuuauguaugcuauaguuagcuauaguaguauuaguuuuagauucuaacuuuuauuuaggaaauuuaagauuaguaaaugcuuuuagaaacauggagauuuaugcagauucaguuuuguucacauaaauucugaacaauucaccuucuuuaucuagacuguuuaaugaauugcucuccuacuagaucucuccaauaauuugguccuuuuuauagaccugaaaggaaaauguauuucuuuuauauauaaguggaaacauguuuguuucuggacauuccaacagauuccaaacacaagacaccauauuucgcugaucccgcugaggugagauuggagcucauuuccuuagugaucggcagucccgaaguuaguuauuccuguugagaauaugguuuguuuugauacugaguuuuaaauauacuuacuggcccuuuucuaucuuuuaagaaacuuguguucagaucuuuuguucuuggauuacauggauuauguuaguuauugaguuuaaguauuguaagacucaaaggguuuacaaaagucucuuuguaaccuaccccuuggcuauuugguaguuucuuuugcuaugcauagacucuuaauuugauguagagucguucuguaggcuucuuauauaugaaggggauggaaagaugguucugcaguuaaaagcaguuuuguugcucuuaaagcacucacauucaguucccagcacccauguagugacucucagccaccuguaacuuuaauucuaggauaucugacacuuucuuuggucuuccauagguacgagggauguaugugguacccauauguacaaacauacaaaacauucauacacacaaaauaaaucuaaauuuuaaaaaaauuuauaaggagcuggguaugguggcgcacaccuuuaaucccagcauuugggaggcagaggcagguggauuucugaguuccaggccagccuggucuacagagugaguuccaggacagcaagggcuauacagagaaacccugucucaaaaaaaaaaaauuauaaagaauuaguacaugaucuagaaauuucacuauuggguguguguaugcacaucuaauggaaguaaaaggauaagaugugugugugucugugugugugugcgggcgcgagugugcgagugcaugcacuauuuauaauagccaagauacagcuuuaucaucuaagauuuuuuuaaaguggcauuugcuucaaccauaaaguguaaaaauccuuuuauuugcauauggggaaaacugcaggucacuuucaacuuaaauaagcuaggaacaugaaaacaaacacagcauguucuccuucauuuguucaaaguguugagugcucugcguguagaagcacuauuugcguuuucaggagaccccaguuugcucuccagcacccuuacagcuacucaaagcuguugauugcuccauacccaggaguaaucaacaccuucuggccuccgaugaugccuggcacccauauuuggucugggagaguugcaauguuucauaacacuaagccagccuaguuugcagcaauuaaauuuugaauuucaaacuaaacagaaaaauuggaaggaucucaucauguauacgugauacauuugugaggauagcaaaugcuaauuacucagccccugagcugguucauugguaaagacacaugcuaccgcaccggaagaaggccagaguggaagaagaagcugacugcucucuaaccuccaagugugcucuuuccccgauacaugcauucguuugaaagagaaagacuggcuaauuaucuuuuuuuuuucuuuuguuuugguuuggggauuuuuguuuguuuguuuguuuugcuuuuucuagacagugugugugugugugugugugugcacgcucauuccugccugccuggcuguccuagaaguagcucuguagcccaggcuggcacugaacucacugagauuuaccugaaucaucugguuucauuaccacauguuguauguccuuguugaauuacaauacugagcauaguaaauaguaacauauccuaauaaaaaggaaugauagaaauuccacuggagagaaaaagugguuauuuaugcuagaaauguucuagguagauagaagaaucuuguguggagaauguguucauguuauccuacacauuguacaaugucaaaaaaucuuuauuggucagaaucaucauuuuaaccaucagguaacauuuaauaagccuguaguuaccacauuugccaccagguggagguacugugucaccuucaggaauguuuaagaacuuuacuuagguuuacucacauuuacaaaacaauucuuuguuguaucccccuccuccaacaaauaauauaguaaguuguauggcacauuauacuacucaguauucacauaguggccaugcuaacaacccuuaaaguguuagaaagccuuuaccuuuuagugcuaguuucaaagucuuuuagagucaaaagagaaauugagguuauacuaaguuauuuguguuugugcucaggaaacugcaaaggaggucucccccaggaaacacagaguauagacuaaaaggaugugaaaaucugucuugaaaugaacggcauccauuugugaggcugcucuucuguuaagauuuuaaaauauuuuuuacuaggcucgcacucuguaggccauuuacucugacacucauguuccuucugccuuagcguccuucauucugggacagcagaauguguaaccauccuuucuaacccuguuacacaugcauaucagaggcaaugaaguauaguaggacauuuggggaauuaaguugugauaagagcuagauuuuccuguaaugggguuuguugucuuuaacuuuacagcaagguuagauuccuagaauaguugugagcucuugcaggccguucaguauugccgaccaucuucccaggagugcugcaucugucauugcuaugcccagugagcaacaggaacaacuuagcguuagcucacuggauacauccucguuuuauuucaugucugauuuuuaucuugguauccaaucuaggauagucuguuguauauaguuaucacauuucuucauuguuuugucaugucuuaguaugcuuuuguuuguuaugauuauuacguuugccaagagaacugguuaguuucuuucaagacuuuuuccacuuugggggauuccuuuauccugacaagaguagaguuaugagcuuggauagaaaauauaagaaaaauagaauuuacacacccaaagaaaaaugaauuccucuccccagcaggcaguaaauugccaguaucucuucagcaggggugaggucucaucagcuccucccacguaagugcuggaauguugagugacugucuugugcagguaacuguaacugugugacuacauuaucucaagagaguagcuccuauagcucuucuccaucucugcugcuuaccuuccuucuucugucucuuucaugauguucucugaagcucaggcgagucaaugaagaugucccauuuagaacaguccuuauucucagcacucugaccaagauuugagaguggcgcucacuaaucuauggauauaaacaaaguucuuuuaaagauaguuugauaauauauuuaguuagcaaaauaacaguagcagguccccuucaucccccaguccuagauuugaccaacuuuacagcuccuaccacaaauuuuccccuguggagcaguccuccaguccaguuaaaaacucguugguugggcuggcgagauggcucagcggguaagagcacugacugcucuuccgaagguccugaguucaaaucccagcaaccacaugguggcucacaaccauccguaaugagaucugauguccucuucuggugcguuugaagacagcuacaguguacuuacauauaauaaauaaauaaaucuuaaaaacaaaacaaaacaaaacaaaacaaaaaaaaacucguugguuaaaucauuauucuacuauuguacccauaggcauaucuugucuggaaggucagggacuacugcuuuucucuccaauaaacuucauagugccuuuuggcacucugaaagcuagccaucugggaaaccuuuuucagaccaguuucauauugauuuuaauuaugucauaccuacaacuaaauuuuguugugucuucagcacuagcuaugauggucaaccaagaaaauagccuuuguuguuuugggggcuuugggggcucucuaaccagcaacuuguaaagauguauuauaaaccuggcacuggguuuucauuuaauaauuuuuaucuucugggggugaagcauuguucaucuauguaggguacuauguucaaacucccccuuuuaaacucgauguuguuguuguuguaguuguuguuguauuuuuaaaacuagcuuacaaaguaguguguuuccauaaggccuuuuuuauccaucguuaguauuuauuaauccauuauauauuccuuucucuucccauucucccacgcccauuucugcauaagccuuuuguccccagcauucacauccacauccacuguuaauucuguuuuccaaauacaggcucagauuucaaaaacaagggggcauugaacacauuugggauagaggacaaauuuucagauaagcaaagagugacaauccaacuuuuuuacuucucaucacuggaggguguaaaaugauggcccuuuucccuccugaaagcagcgguguccccuguaaccuagcugaccuggagcucaccauguagcuugaggaugacugugaacauccaggccuccugccuucaucugcagggcuggucuauaccauuacaccucacuguccauucauuuuauuuauguucguguguguguuuuuuuuuuucucucucucugucugucucucugucugucccacucucucucucucucucccucccucccucucccucucccgguguacagucguaccauaauauguguguggcagucagaggauaaauagcuuuauggaguagauucugccacauuuguaucaguuuugugaucagacucaggucaucaagcuuguguuaucagcaaacaccuuuauccacugaguccucuccagucgcccaggcuucccugaugcagaaauuaacuuuccaucagaacuaaguaucauccugucagacugacacgguccagcccuuuuucccuguagucauugcuguagaaaggccaggauucuagaugaugauaccucauccucccauguccaugcccuguguaggcauggaacaguuccccaucuaauuucuauuccuucaguuucauguuguguuugacuuuucuguauaaaaguuagaaugcuugccagugucucaaaguauugugaaugauuugucuucauguagaaucgugagguuaggaacauuguguuuuuauaacugcuguucuuaggucaacuagcaccacuucuugggauggcuauucaguaauugguguuagaaagguuaccucacgugaggcaaagaagugaauuccagcuggaaugggccacuaaauuuaacaacuaauagaagucuauuuuuuaguacuuugcauuuuaagaaaaaaaaaucauguggcuuguagauauuaauuaaaaauauaguauguuuucaugcuaacuagaauauucauuuauugaaagacuuuuaauaaguuguagucuugugauuguuauauacauacuaugagauuacuucauuguuucaacuuaaacgaugcaauuguccgcaugcuguacccauaguguguacuuuaucguuuguauauaauauaaggagauaguaauuaguacacaucugucccccuacucuguaucuuucuaauuuuccugcaauggugugucauaagugugcuggucuggucaccagcgaucaggucaguacaguauugguguugaugcuguuuauauggcauguguucuuacuuaugcuuucucccuuuuucucguguaguucuggacauggcaagacaugugccacucuaucgugcucugcuagaguugcuccgcgccauugcuucuugcacaucuauggugccgcuguuguugccucuuucuacagagaauggugaagaagaggaagaugaacagucagaaugucaaacuucuguugguacauuauuagcuaaaaugaagaccugugucgauaccuacaccaaccgccuaagguacagcaccguguuuguuccucuucaccuugccuuuaagcauuuuaaaaaucguucugcugauaguuuuuagcuuuucuucuucauugacacacaagcauacuaguacacacaggcaauauaucagcauaaaggaaauguauuguuuguaucuuauaccuaugcaccuuuaucacaaagcuuauuagacauccccuagacugauauuauagguauagguaacacggauuacuaagugcaccacgguauagccauuauccaaagaauguucaucucccucagcaugaugucagagacaccuuuaagugccaguaaacacagucuaaugacacugcucuuguuccuaauuccauauuaaagaugcuggguuuuacuuugccaauacaguugugaauguuauagaaaccuauucggguaaaauccuaguguccaguauguaugcauauauuauguuugucauuuagauacaugguuauaauuuaugccaaaaccuuucuuagaagucagaagaucaaucaugauuuguuagaguuacaguagagcuaauugcuuauggggcagaguuacuucuaauuuacuuuuggaguaaauuaaacuuggaguuccguuuugaaaaacuuuauaaucuagaaaaucuuucuuucccuuuuguggugucaauuuuccuuacagauggccagguugugguuuuaaaacacuuacaauauugaugcaaguacuauauuuccuuuguacucaagaguguuaugcaagagucuacgauuuacauguuaccaguuuaaauaaugccacugaguuguugccaaaugaauaguuuaagcucaaugugcuugacucucugcuagggcagauacaaacagcuauagguucaaucaggagugauugcuacucgugaguccaaaguacaacggugacuugaagcaaaccagucaccuagggcaacccggagggacuuucugucucugguuuguuguuguuauuaaagaugaccgugugugcugcucuugucacuggggaaggaagcuguaaaggccccgccucugcugaugacuuucuguuguauacgagaaaauaacguugaguuggguccguucuguucucccccauguucccagucguugacugggaucuaggaagacaauguuaaaauaguguguugccaccauugaaccaaaacauuaaauuguccaguugaaguagugacuuuaauugugcaucuuguccccuggucuguacuuagugucucuuauuccuguagucuaaacauguaguucuugacuauaucucuguuacauuccaaaauagggaucugccuugcauuucuauaccuuauuuuauauuugggauaacuauauuugcuuauaacuaaagaguaaaaauucgagccagguguggugguacuauauuauuuauaugcuuuuauuccgaacacucuagaagucagagacauuucaaucucuuuggguucaaaaugcuauugaaaaguaucuuuccuuuaaacuguguuuauccuuauuuuguaauaacccuggggaauccuguaaaagaccuauaauaagggauucuaagauauuuaugcauaagcuuuuugcagugaauggugguuagguauuuauuuugcuuuucuuaauuuucauacaacaaguguuauguaauuauuugaauggaucuuuuaguuuuuuguaaaauguauuauuucauuaggaaacauuaauuucagauauauaauaacugcuuuucuuuucaguugauuaucuggaaaagugacucaacuagagaacguuuccuacuucagauuuaagacucauauaauaacaaagcauacaugugaaaccacagugaccauucacagagcuuguuucauuuguuauuuuaucuccacaaagaucuaugcugugacugguuuuaguaacuccuuuacugggcuguuuguguuaagaugugcgaaugaugcuugauaucccagugguuucugcuguggggaaggguaccuggcuagaacaggcagucaaggcuaagugugcuuccaucccuacuucccauucaagauugaacucaaaguucaguuucaauuucacauaaagaguaaaaucuauucuucuuuagucugucaaggguuaagacuuaaaaaacugccugccuuucuuuuuucaaaauuuguauuuuguuuuuucuuuguaccaagcauauuuauacaaaagaaauugucugcauucugaagaccucugcucugaaaguaguuguugcacguaaugauuuucauugaagugguauauuuuguaugugauacuuggaauuuuuauuuuucaguuggggaauaagaaaagcugaaauaagcugccucuuggcugguugggauaaggagcuaauugagauccuguuugaaccccagugguuaagcuucaauauguuagucagagaaugagggcggcucuuggguuuagcaugcuccuuauccuaaaccuuuuauaaagaagacauggauaauuauuacuaaaaaucugaaaggcaagucugacuaauugacaucugacuaguucaugcauuaggacaucacagugauugcuguaagagaggugacaucuguccugcuuggaaagacaauucugcucucaucuagagauuuuacugaagauucgugacugccuaacaauaaauuugggaccuuuccuaaggggcugauauauaaguggaggaaauaguagcuagaccuuuagaauaaauuuguacacaguguacuagacauauaggacacugcaagaggacuagccuaaacucaugcggaaagaggauuuggagcugaggccacagcucaggaccacaggcucaccuaauauguaccauauuagcaucacaaccccucacucucucaagaaaaguagggcuuggcuaaguacaggauuccaggguauguguauuucagacuggaaaaaaugugcaugcugaaauauauuauucuauaugcagggaacuuagggacuuuugaugugcccuuggauguauauggaagauagaacuagagggaagucaagggaggcuauaugcugaagggucacagaccacucaccuuuaaaaguggugaugagagagagcuggcaaggucauuccagcaaguauuuauuucuagaaauguguuaacuuauauuuucaaagaaaacuucaucauuuuuugaacagauuuauuuauuuuuauuuuauguguuuugaguguuugucucauguguauaguaucugcaagaugucagaagauggugcuagauccccugaaacugcaguuaguauauggcuuuuaacugccauaugggugcugggaaccaaguccagucccucugcaagagcugaaguuuucuuaacuacugagccaucucucuagccacacauucucguuuuuuacaaauagaaaacgggaagaguaagacucauauccacccgcagagguuuauuuaaauaaaaguguucaugcauguaaaacagugggaacuaauaaaguggaucuguuuauucuuagauauaaagaacucugaaacaucaguugguuccauauaguaaauaaagugugcuauaguuguuuauuuuaaucaguucacaguuguugaugaguuuucaucuuuuuucuuuugguguguaguuuuguaaacucuagcacagguguuaacauucuuuuaaccccagucauaaacaaaucaugaugguuugaauacuaaaaauugccauaauuagcaguuaagccuuucuccuaucuguaauuacugauguccccuggcguauuuuucauuacuauguuuugacucuucugaagauguucacuaaaaagugaaaaaacacaaauggccaauaugucuuuacaaguguuccucuuccuuagcuaacaugaaaaugcaaacaacuuuugagaugccgucguauugcuguuaaaauaguauccuuaagaaaacaaacggcuagccaggcggagguagcacacaccuuuaaucccagcacuuguaggcagaggcagguggaucuccuguguucaaggccagccuggucuacagagugaguuucaggacuucuaagccuacauagagaaacccuaucuguaaaaaaagaaaaagaaagacaacaaauucuagugaagauguggggacagagaaacccucauucacucuugguaaagugaaaguugaugacauuauuuugggacuccauacggagguucuuaaauagauaggagcaaaacuaccguaugacccagcuuugcuaucccagaguguagaccucagggacucuauccuccuacagaguguagaccucagggacucucuauccuccuacagaggugcuugcacauacauaaagguauguugcugcauuauuuauaauuagcuggaaaauugaaccagcuaaauuaauagauaaugaaaauguagugugugugugugugugugugugugcacauguacauacauacauacauacauacaugcauacauacuuacauacauauauacaaugcaauucaguucagcucuaaaguaaaggaaagccgugaaguuugcaggaagauagauggauagcagacuaugaaagacaaaaccuuugugauuuccuucauguggauuaucguguuuaguguuucuauguauauaaagugggucuaagcugugaaaugagacccgucuguuaugugacaauacuuucccacacauccacucaccccagguagagagcccacagcagaccaaaccauagaugcuaauuaccagagucccacuugguaaaccaugaguuuaaugauuauuuuuuguuguuguuuuugguuuugguuuugguuuguuuguuuuuuuuuuuuuuuuuuuuuuuuuuuuuuuuuuuuuuuuuuuuugagacaggguuucuuuguguagcccuggcuguccuggaacuuagucuguagaccaggcuggccuugaacucagaaaucggccugccucugccucccaagcacugggauuaaaggcgugcgccaccacugcccggcaauuuuuuuuuuuuuuuuuuuuuuuuuuuuuuuuuuuuuuuuuuugaugcacauugguguucugccugugugagagugccagauccucuggaauuggaauuaccgacaguugggagcugccaucuggaugcuaggaauuaaacccagguccuuuggaggagcagcuguucucucaaccuucgagccaucucuccaucccugaacuauaaguuuuauugggguuacuuacagggauaugggugaaggguuacuuacaggagcaaaaauaacucaaagacugugcaucaccaaagccuaccccagcaugggugacaacucauaaaagcuagaaaaccuggcacacacugccugcaggcagcucaguguauucaagauuguccuuuccuggugccucaguuguccuaagucuuuuccaguuagcuggccuagccucagagucuuccaguuugguugucugagucuuugcaacucaguuucucucaagaggccuagaaaaucuggucaguuucagggacucccugaaacuauuguuuuucaccuuccugcuuaaggggcuuuuuugugggagggaauguuuuaguugcagagaaaauuguacaagacuaagagaagggaaagagaugcugagaaaaggaagggaguguggaaacaaaaugaaaagugggaaaagugaaaacaagaaauagccucugauacuauugcuuagaauuuuaaauggggaaaauuaguaaacuaaagaauuacuucaggcuuuaccaagaacuuuccuuuaguagagcguguucucuccgugauuaauacaucuuaccaccacucauagucuuucuuuguuuuguuaagacagggucuugaacucacuugguguagacccaaugcaggagguacccuugccucuuucucuucagugcaaagauucaagaugugccaccacacccagcaaauuucaauagcucuaguuguaucauaauuaguagaauaccaaaccguauuuuuuaaagacuuaaaaaaauuuugaggcuagagagcuagcccagugguuaagaacauuuauugcacuggguggugguggcucacaccuuuagucccagcacucagaaggcaguggcauguggaucucucaguuugaggccauacuugucuauacaguaaguucuaggacagacagaguuacacagaaaaaccuuuuucaaaaaaaggaggggggcauuuauugcucagaggagggaaggcacuuauugccugcugaaagagucaggcuagcuaacgugugcgcgcgccuaccucccagccaucuguaacacacacacacacacauuaccucccagccaucuguaaccccaagucuugucaguuugacaccuugcucuggccucugugggcaccaggcauaaguaugcuccauguacauguauacaaauacucauaagauaaaugaagauggagaaaagaagagcugcgcaauaagaugcauuucuccuagguacuugggacacuaaaucaggagguuugcagguucaaagucagcaugaacagcauaguaaugcacucuaccuaccaccuuaucauuaccccucaaaaaagaagaugcucugaugcauuaugcuuuuguguucacauuauuuccacgugaaugagaacauuauugucuaguguaaagguucauucuguuaccuacacaaugucuguacuaugaugauaucucggauccguuuguuuagaauaagaaccuuucaucacuuguucagaggcaagagaaaauggguuguuuuaucucugcagauaugaacuauuauauucugauaaccaaacaguagccauauucuacagcagucaggauuucauggcuucaccaaaauuugagagacagacuuacugcuauucaaaauuagguuuaauugcuguaagaacagaacacuugugacauucaguauaagauguucuggauuuaaaacuuuucuuuggcaauccucaaauaagaauucuuaauuuccacguuucuuagcaaucucacaggaucuuccuagugaaaagaaacccaucacacuugaacaaaauguuguuagaaggaccccauuacuuuacaaauagauaaauaaauaaauaaaugguuugaccuacucucugaaaaagaaaaucugauucucuuauuuuaagcucccucaaccuuguauucaaaucuuuuccauccccuaccuucuacugaauuagguuucuauugagaaaaccaaaaccauccuaguuuuucuucuugugccucugccucucauucauacaacaugaaaguccugaucccuuaaucaaaaagcauuugacagagucacaucuuuagacaguccuuuuaaaaugacuuuaaacagguucaguugucuucuuugucacuauguagcgcucccuggccuggaacucccagagaucuaccuggcucugacagcuguuucaguuggugauguaaacaauaaagcugguguguuugacucccacccucccuaccccagcugaggacuaaacccagaucccaaaaccuaaauccccaaagcuagugucucguuugcuuaaguuggguuguccccugguagacuggugagguguuauuugugaccucuccauuuggcagucacacagaguaccgcuauuguaucuguugauuuuuaggaccugauugauauucugacacuaagcguuacugugaccuagcuccuugugcuguguuuaggugccucccaguccugcucacucauucuucccacagaguggaaguuggccccuccccacauucauuuaaaccauuaaaaauuaagcuggcacuuuaaacuagagagcguuuaaguaaaacuaaaaaguuuuguuaauuuaaaaccuggauuuuaaguuaaucaugggacauaccucacauuggucuguccuugccuuacuuguggccauguuuuaccaauuacuuugaugcuuucuggagacauuggaagccaacaguucuaaaguaaauuaaaaaaaaaaaaucuuaucuacaaaaaaaaacccuuauuuacuuuuaaucuuaguuugcuuuaaucuguaauuguuggccuagggcuuuacacuuaaggaaagaaguacaguguagugcuuguuucauggauaaauguaggucacuaguuucccagaguuguacaccuuucaggcaacuucuucacauggcugugcuuaucaagaaaauggcucugugaaguuggcuuccauuucugaauuacaaagccacauaauucagauaguauauucagagugcuaucugacuuacuuuugguaguaguguaaaugguaaaggccaauaauagaacaauguugaggucgggacuuuuaaagaauacuuauaacauuuuuguuuacuuuguguuuguuugugggugugaaugugucaggguaaacauggcagucagagggugaucugccgaagagaguacauucuuucuuuccacagugugaguccccacugugcagcuuagacuagcaggcacaaaccaguuccuuuaccaaccaagcagucuuacuggccccagaaguuuuguuuuguuguauuucuguuuuuuuuguuuuuuuuuuuuuuuuaaaucugcccauuuugcucacauccuaguucagacuuucuccauggagucaaaccuuacuuuauuagcuauuuagauggaauucacaguguagaggcaaauguauacagauaauuuuuuauaauaguagaaacuucaguugcuuccucauauuucuucagggcagugaucacaaccagauucaacguaugcacaaagcagcggaugccaugguagcggccgucgcugauugcucuuaccauguuggauccauugucagucucagagaccuccuuccagcuaggugccuugaacucaaauagcuuuucacacagacuucaggaugugagcuaagguauggccuuuuuucaugagcugggccuacauauggguugacaguaaucugcaacuuguauagaacaagaagggacuucugucagacagugaguggcagcgaucacugauaggcagguagggcuuauccuuucucuacuugaaaauccuaucaucauuuggagguuuuuuuuuuuuauguaaguuuuugacaguaagaagucuuugauaaccuguguaaaagucuaaaauacaccuuugugaugauucuaccaucaucuucaaugugaaguaauuguuuuuaugaacuugguguaaguuuucuuaaauuucuagauucuugaacugcuuuuaaaguugguuuaaaaaaaacauaaacauaaaacuuacuauccugcuaauacucuuauaauagccuaucaguaaucuuccucuaaaaauugcaauuaagaaaucagucuauccaggaguaggaauuaaaaauuagugguuuccccaauauaaccuucaugucagacugguaaauacaauaaagcacuuaauucauugauguaguucaggcuccacauugaaggauguuuuuucaaaaagaauauacauuucugggggaaaaaaagagcuuuucguaucuuccuucuuaucuuggugaaauacauuagacugaaaucuuuuuuaaauaccguagaucagcugcuuaagacuuaaguaucaucuaaauuuuuuuuuuuagcuaaaaacaaauguuuucccaaauaacuucccacuuccuuauuauccagugucuuaguagcucacuauuuaagcuuaaugagaauuaguuauaauugggaagggaaagucguuguaaaucaagggaaguuauuguacagaaccuucccacguucuugacccuuagcauuugagucgauuauuacaacuuuacauagcuacaguugacagccuauuugaguuuuuccacaggaaucguuucuucguuaagaaauggccaguauugggcuggagagauggcucagcgguuaagagcacugacugcucuuccagagguccugaguucaaaucccagcacccacaugguggcucacagccaucuguaaugggauccgaugccauuuucuggugugucuguagacagcuacaguguacucauauaaauagaauaaaaaaucuuuagaaaaaagaaagaggaaggaaggaaggaaggaaggaaggaaggaaggaaggaaggaaggaagggccuguauuccuguugagcuguaggcuaaaguguacuucagaauuacgagacaccgugucuuugguuuacucgagaaguagaaguaucugguauuucagcuuuaaacccuugccuguucucugcuuacugguaagcaugggugugcucauguguagguacauagguacaugcauugagauugacacugcggugcuguacagucucaacagaugcuaaguuaguuucugggugacaaaagaaaguagccauuuguuuuccuugacuucuuaugugugaggaaagacaaggacaguguuucagugacacauuuuacuuuauuaguuaggucaccuuuccaggugagagauaguagacacguuuacaugugcagcuuugacacauuggaaccaaauugagagcacgugccugugugcuguauuuauuugcuucugcucacugugagagcggcuucuuaguuugcuacuuccugucucccugcaguuacgaaaggaauggcuuuugagaagguuugccuuggugacaagguucauuuuugucuguacauggcauauuauuuuguuacauucugcaacauucuaaauuuaaaaguuuauucucagccaggcaaacuaguacaucccuuuuauccccgcacuggggaggcagaggcaggugauucuuuugaguuugaggccagccuggucuacagagugaguucccggacacccagugcuacacagagaaaccugacucaaaacaacaaagauucucuguggcuucaugccuacuauggguaaaauauuuuaauauaaugguaaaaccuuuguguugguagguauuuauguaaaaaaugccauauaguuuagauuuuuccuucaaaaucuauguuuuuauuuaucuauguuguuuguuuugaaacugaguuaacaagaauaaguuauuuugaagaucuaaacuauaguuaauuauuaagugucaagaguugcaauagaagaaaaagaaauacuuaacuuuuauuuuuagugaaucuuacauugaccugacacugcgucuuguucgcugaagccuuggcugucacgcugugcuguugugauacaguguuugauacaguguuugauacaguuugauacaguguugggucauuuuacauccugaaaagaaguaacagagugauccucuguacaaccacuugguguuaaagauguauagcagcugcacuuguugucuuguaagagacucacuugggguccuacugugugcucugaaauacugaguucuuuuguucucagaaaucagcauacucagugaauacaaguaguauuuuagauugcuauguccuuuugauucuaaggcuuuuaaaagacaauagguucuuaguuuaccacaggcgugguaacuaaguugguuccuuuaccucuggguacuuagaguuaaggguuucuaagugugggucuaagggcauagcaaacauuugguuguuuagccuaauauuuauguaauauuucuuuuuuuaucuuuuaacuagauaggaacuaucuaccuauacuuuuguuaucuuaagcauuaggcuuccaaagcaguaaugacugugacuagccucccugcucaucacaugggacaaauguagcgcauagucugucaguuuucauuucuguuguugaauuguauuuuuauuuucaguuuuaaaacuuaauuuuuucuugcauuuuucccauguuuaaaaucaaauucagaucuaaaagggaaaaugugaaagccggagucaagccggacgcgccugaucaagagcccgaaggacuugcgcuucugguccccgacauccagaggacugcugagaucguccacgccgccaccgccaaucugcggcaagccaaucaaggccaguaguguucuacaugauugguuuuuucauugcaugaaauuauauauuuuuuucuauugcacaacaaacguaauugagaacugucuguuuuuuuuuuuucucauuuuucagguaaguucuuguacuuacgaauucauugucugguagguuuuguucuuugucagguuuuaguuaagaguauuucuugggacugcagagauggcucaccgauuaagagcccuggcugcucuuccaaaggucaugaguucaguucccagcaacccacaugguggcccacaaccaucugcauuggaucugauguucucuucuggugugucaacgacaggaugucauauaaaauaaauaaaucuuaauuuuaaaaaacccuaauagauuuaaaaaaaaauuucuugcuguagaaugugcaucuuggcuagguguaguggcacaugucuuuaauugcagcacucggaaggugaaagcagaugaucucugugacuuucaggccagccaguagcaaguugugggcuagccagagccacauaaugagacccucucucaaagaaaagaaccuaaaauaagaauugauuucuucuauauaugcugagacuaacuguaguagcucaagaacauacuuuuuuucuuuucauugaaagucuugggauuggaaagccuuguguuugggagcaguaaauugaggcagcugcaugugguggugcacacggcuguggugauaaaauaggacucagguagaaaucuggaaugugaaaccuauacauagaagaggauugucuuucagcuuacugacgcagggagagaguacagggggcuggcugagaagaagggauucaucugagugggaagaggacagagggcaguggaaugugaucagaaucuauauuacuguacaugaugaaacacauauugcuauauacacugaaacagcauucacauaugcugaugaaaacauugaaaaaugcauacuuauguuauuuaucuuguaauauuacagaaaaaaaacuaggugaauacucaaagaaggugguuaugaaacccaaaccucugucaguauuaaaaucacuugaagaaaaauauguggcugucaugaaaaaacugcaguuugguaaguagaaguuucucuuugccacaaugccauuggccucuuccagcaaugcugcuaaggcaauucggggaauucuagacuugagcuaggguggugaugcuucccuaggauuccacuacccuagugccugaggcagaagaauugugacugugagacuaaccugugugccauuaagaugcugccucaacaauugcucuguuccacucucaccuaccuauacgcacaugaaagcuucugccaugucuguuuugagaccguuguguuuagugucaccauucucauccugauuccagcacauggcuugcuuucaccaagaaagcacaagaagaggucugcagagcgugcagacagugauuuucuuuugucauucugcagugcugggauugaacccaggagcccgugcaggcuagggaucugcucuggcagcaccccgcacccugagacauuccuuuccucuaggggacagagagacuagacuuugguaucauaacaacuguuugccuucuccacuuuggucuucuaucuccuuuuagauacauuugaaaugguuucugaagaugacgaugggaaauuggguuuuaaaguaaauuaccacuacaugucucaggugaaaaaugccaacgaugccaacagugcugccagagcccgccgccuggcucaagaagcggugacacugucaaccucacugccucugucaucgucuuccagugucuuuguacgcugugaugaggagcgacuugacaucaugaagguagaaaccaauuuuuccccacccuuccuagauuuuaaauuucaacauaaauucugguggccacuuggggcagccauaaaggagcugugauguaauguuaguucagggugugcagaugagacaacaugucaagacgguaccagaggagacgcugcgcauguuugcucccucacagcuugaagccugcuagcaaaggacuuaaugcugugcaggcggaggggaaaguuacagaauaaagucaucccaggcgccacacucguaccagaaaugucuuucucucaauuuaucagcagucugugguuuuaauuaucuaaguuuuaugaauaaaguauuagcaauauaacauaacuuguacuuuucuguuuuaacauugugaucugucauaucuuaaagucuaagaaaacucuaucaagaaaaacuaauuugauauguacugaaaaaaugucuuuaccuuuaugauuuaauuaauauguuaacuaguccacauuccucagacagcuaaaaguauugaucuguugacuucugagcacuguccuaugcauguaagaucuucagcuuagaacccccagaauaaaucaguuauaguaaguggugcccacgugcagcucuccagguggugguguauguuaauugacucagaagaaaauuucacacaaaaaaaaguucuuuauauuuuaaagaaguucaaaauucagguaaacuuucuugauacaaauaagaauucauuuuagagcaggcuuuccucuuaacucagagcgcugccugccucugccaccugagugcugguauuaaagauguauaccaccacugccuggcagccacgcuacuccuaauucuaagaagaaaccuuuuucuaguccucuguguguguuugacuucugauuccacucuugcaacucuugcaguguucucuaagaugcuccugcggaugauucucacagaucucuguuuauaugcccaccagguucugauaaccgggccagcggacacccccuaugcaaauggcugcuuugaguuugauguauauuuuccucaagauuauccuagcucaccuccucuagugaaccuagaaacaacugggggucauagugugcgcuucaaucccaaccuuuacaaugauggcaagguaagguggcugcggucuuuguuucaaggucacacacugaucugaagguuguuugugauucaaauaaaaguuggugugguuagauauuuuuuucuucauuauuaguuuccucuauaugcauagacagaucacuuugaaaauaggagagaagaaacugaaaagggcgaaacaagagcuuccacaaaucaguaaugcucagaauacagcauacccagugucuggcguggauauuaaagcaggaauacucagcagggaauuuacuacuagaaugcuauuaaacuagccaaaauuacauugaaaugaugauuuuucuuuuaaauuuucaauguaauuuuggauaguuuaauugaauucuaguaguaaauuccaugcuaaguauuacugcuuuaaaauucaugagaaggcaucuguagagacuggagagauggcucaguagucaggagcacugucugcuuuccagaaaaccugccucccuccucuggccuccauaggcaccaggcacacacauaaacaaccugaguugagucccugaccccucauaaugauagagaccagacucuucaaacuguccccugacaccaugcaugccuacacacaccgacaaagaaauacauuucacugaaagcuuguggguuuuuaaaaaguaugauguuucauuaaaauauguuauguaggacuagugacauaguuuauugauagcgugcuuacuuacacaaagccuugguuuuaaucucuucuaaugcauugacuggggauggugcugccucccuuuuaucaccacuauagcaauggaggcaggaggguuagaaacucagggucaucuuccacuacauggcuaguugagggccagccugaguuacauaagcaaccuuguaucaaccaacaacaaaaaaagauauauguuaucuaugcagauauggauguaaucuguguggaguuuuccuuaugaagaaacuauaaucccacaaggguuuggaucauaucugaagaugcagugggcuuuuacagacuuagauacacuuugacaugagagcauaauguuuuguuuccagcugagacaguuugcuuuaaauucuguucaauugugucuuuucuucuuaagguuuguuuaagcauccugaauacauggcauggaagaccagaagagaaguggaacccucagacaucaagcuuuuugcaaguaaacaaaguuucucugacagauuuacuuacacccuaagagcuguguauguugggggagggaaucagugacuaaaauaaacauagaaaacuguuuuaaaggcaggaaauaauaguuuaaagucucaaguuuugagguaagauaaacagccuugucaaguucaagucuuuucuuagguucuuaaagugcaguaugcugcaggaagguaauugggucugucuccuguuuugugaguagaauuuaauacacuguugguaccacccacuucuucauguaugaugugguccuaguuacaguuuuuacuuaacugaugccuaaaauuaaugcccuggaauucauaaaauuuaagaguuguaguuuacuaucaggguauuugauauauaagauuuaaaaaucuugaaagcuugcauuucuguaagugagugcauaaaaucuauuguauaaagccaguggcgcaugccuuuaaucccagcacucgggaggcagaggcaggcggauuucugaguucgaggccagccuggucuacaaagugaguuucaggacagccaggacuacacagagaaacccugucucgaaaaaccaaaaaaaaaaaaagaaaaaucuuuuguauaauaucucauuucugcucauguuuuuacuuuauaauaaauaacucagagccucagcuaaagguagaguguacguguaucgagguauguguuuacuagaguacuuguuuguuuaggaagcacagacacaguacuuaguugugguuguuauauaauaccuugaauucacauguacaauuuagugcuucaaaaauuaucaccagguaauccuacuaaaaguggaccuauccuaaaagguuauuuucuuuaaugcuaguuuguguuagauaagagaugugaaaauaaauucucuuuagaggacuuaacugguuuaacuugaguaaaguaggaagcuuuuuuaaaaaaagauuauugguuauuuuauuuauuuacauaaaucugcaacccccaccccaucccccuagccucuaugagggugcuuccccacccacccuccccacccuggcauuccccuacucuggggcaucgagcuuccacaggaccaagggccuccccucccauugaugucagauaaggccauucucugcuacuuaugcaauuggagcccugggaacucugggugcuccaguuaauugauauuauuguucuuccuauuauugaagguugcaaacuccuucagcuccuucauuccuuccccuagcacuuccacugggguccccaugcucagugcaaugguuggcugcgagcauccacaucugucuuggucagacacuggcagagccucucagggcacagcuauaccaggcuccuagcagcaagcgcuucuugacaucagcaauagugucuggguuuggugucugcagauagguuggaucccuagauggggcaguuucuggguguccuuuucuccagucucugcucucuacucuuugucccugcauuuccuuuagacaggaacaauucuggguuaaaauuuuaaguuuuuuuuuuuuuuccuuuuuuucucuuuuuucuuuuuuaaauguuguuuugguuuuggugucaguuuuuuguuuauuuguuuugagacuaggucacauuauguuacacuggcuggccugaaauuuagauguccuccuuccccuccucuuggguauuggggcuaaaggcauguaccacaccuggcugaaaguaauuugggacuacaacaucucaucuaaaagcgauuuuucaaaauaaguuggguuuuaaauuguagguuuguguuaagaauuugacuuaauucuuuucucugcuuuuguagaaauugaauuguauacccuauucauguaaguaaaagaggaaaaaauauuuuaaaacagcaaaugagccgggcagugguggcacaugccuuuaaucccaguaguuuggaggcagaggcaggcagauuucugaguucgaggccagccuggucuacagagugaguuccaggacagccagggcuacacagagaaacccugucuccaacaaacaaacaaagcaaaugauagaacuaaccaauguuuuaaaagcucucuggggagucucagauuugaaauagaagaaaacucuccuuuauugacaaguggaucaaggaccgcaacauaaaaccuuaugcacuaaauaucauagaagagaaaguaugaaauauucuugaaagcuuuguuauacaaaacaacaacagaacaccaaugguauacauugcuccuuccaggccagcuagaacaacacagugagacucugccuauagguagacagacagacagacugacugacugauugauuuauaaaacaugauauuuugguguagcuaacuuuguagagcuuuuuguuuguuugucuaucauuuuuuaggguagggucuuggacuuuaacacacaucauuuuggaguucacugugcagccucgguuggccuugagcuuacccuaauagccaugacucagcugagagaguguguauggauauuuugccuccauguuuguaugaccaccauauacauaugcugagaaucagacauaggcagguuuuauuaguuuuguuuuguuuuauaccagaaacuguggaaacaugcuuauagagacuccuuggaggugaagcaggauagcaguuuauuugcaguaaaccugucugucucuuaauaacuuggacuuucuucuauuccucagguguugguuucuguccagucccuuauauuaguagcugagccuuacuucaaugaaccaggauaugaacggucuagaggcacucccagugguacacagagcucucgagaauacgaugggaacauccgacaagcaacgguuaaaugggcuaugcuagaacaaaucagaaauccuucaccgugcuuuaaagaaguauguuggauggaguuaaguacuuguagacauuugaggagagguuguuaguauuauauacuguaaacuuacagaaucugcuauacuaagcuuugcuucuuauaacuagcaauuaauccugaagucauuaauaacaaagugcaguuaguaagguuuaaacccacauauccugaaagacaccagacuuucccguggaaccuuuuuauuuaaacuuuacuuuggcaugauugcuugcagguacacauuuggugaguagauaauuuaguacuggcucaguggguaaaggcgcucuccuucaagccuaaccaccagaguuggauuccugaaaccaccuacaugauaggagaaaacuaaugccuuugcccucuauaugugcuaugguauacaugcguaccuacaauaaaaaauaaauguaauuuguaaauauuuuuuaaaaaguauuuagauuucugugcagucucuuuuagaguuuuuuuuuuuuuuuuuuuaauuuuguuugggguuggaugugugugcacgugaguucaaaugccuagagaagccugacuuaacaggugggugggagccuccugacauggugaugagaacuaagcagaucuuuuguagagcuauauacucugagccaucucuucagucccugaguucuauuuaaaaggcaaaauguuuucugcugccaguauguugaaaaccuuuuuuuuccuugcugauuuauucccauuuauuuuaugugaugggaagacauuagaaucugaaguuagguauccuuaccauaguagaauugaguguuucagugugugccgucugauguccugaaccggauuugaaaugauggagaacacaggaaaccagauuuucuggacagauaaacauugcaguaucuaaaauuuuuguuuuaguaaugccauaaacuuugacuuuuugauguguagacaugcucuguuguuguuuuuauuuucaagguuauacacaaacauuuuuacuugaagagaauugagcucauggcccagugugaggaguggauugcagacauccagcaguacagcagugacaagcgggugggcaggaccaugucucaccaugcagcugcucucaaggugagcuugguuaugaagucaucgacucgggaauucccaaagaagagcaguguuacagaaaguguauagauggcugcaauagcuuucacagaacuucuucaauuaaaagugacuacaggaccugagcccaaaagugugacaggguucagggguuggcgagguauuggguccaugaaguuuguuuaguuuuguucuaauuuauuuauuuacaacucaauagcagcccuuccucuccucccccacccccuuuagaaggagaaggucccucuggguaucagccccacacaucaaguugcugcagacuagguacauccucucuagcagacaagacugucguuuagauaugggauccacagacaagcaggcaggcagcaggcucauagacaacccgugcuccaguuguuugggguaccugcaugaagaccaagcugcucaucugcuacauguauguaggaggucuagguccagccugugcucugucuuuggugggugauucagucucugggagcccccaagguccagguuaguugacucuguaagucuuccuguggaguuccuguccucuucagaucccuccaucuuucucccaacuuuucucuaagacucccgagcuccaucuuauguuuguuuaugagucucugcaucucguuccuuuggcugccgggacagaggucaguuaugcuagguuccugucugcaagcauagcagaauaucauuaauagugucagggauugguucucacccaugagaugggucucaauuuggggcagucauugguuagccauucccucagacucugcucuaucucugucccugcacaucuuguaggcaggguacauuuugcauugaaggcuuuguggaugguuugcuguccuuauccuucuacagggaguccugccuggcuacaagaagcagccacuucaagauccauauccccucugcuagaaaucucagcuagaguuacccuauuagacucucugagacccucucuucaucccaggucucuggcacauccuagagauuguccacaugaguuuugucuuuaauccuuuagccuuaccuuaugccucuugccuuacauaauuuuauuucuugcuauugguaugaagaagaagguacaagauggagggccucuaauagcugguugggaauaaccaaugugagagcagucagauuuguggaagguaggcaguugguuuuacuugagcauucccugagggaaaugaagaugcaguggcuuugcagaauuuuucccauacaugggacucauucuuuguacagccacccauuuugcugcuuccauauaauccuuucauucucugccaugcauuguuuuccgucccuccugccuucugugcgugugguggucuccuucccuccugguuccuuuccucuuuguuuuucaguccuugaaaagauggagguggucagcugugguggcauacaccuuuaaucccuguaccuggcuaggguggguucccagauagccagugcugaguacuaaaacaaguaaauagcugauaauaagaaugcuaguuuuucagguguguuuccuuauuuuuccaguucagaaauauuuaugagugacacauuguaugauaucugggaggauuugcuuccaaauaaggaaaaugaauggaugagcucagaccgccagggauuggugguuacugaagccaccaagguucugggucaugugcauugacuuuucugcucugccacuuuuuuauccaguugaagguuuuacauuauggagacuuuagagccacaacuguccgugcguguccguuccagcacugugcaucucuguacaggaggguaggaacucaagaccacccuuggcuagugaggcagcugucugaggagagaacacuuugcugaucuaugcuaguucuguuauguccaauacuggaaaccaguuuguguucugcaccaagcaggagcaaggacuugugcauguauaaacuuguaggucucuucucucuccuuacaccaugccugccgucuccucuccauuuauguuucacuccacguucacugcuggaggccuuccucaaccugacgcacacugagguuacucaugaacacacccacccacugcuuacuagcgcuucccuccuuuagucaucauaaacuguucucuuucucccuguuccuuguuuaauuuccuuucacuuuuuucugagauccaauuuauagcugccucacuuucucuuguggucguugggcuugaaauguuaggcauuuauucauaagacaaaccuaaacgucauggaucugaaaaagggaugguagggaugaggcaguuugauagggacaggagggaggguggagagaacaucgggacucauacaugcaugaaguugacaggaaaacaaaaucaaucaguuaaaaugugauccuucaaacaaagucuccuucguccccugacuuguguuccuaguggucucucauaggcgcccucauuaaacauggagagcaggacugugccucccuucagauagauucucucagcuuccuacacuuaauuuccagacugcccuuuucucgaagauauguagacauugcuuaacucccuucaccuaguucaagugcucaaugggagacccuucagucuuaucucuucuuccuggugcucgcuggauugauccucccuggauaaguguucagcugcaacuuugcucacauacacccucaccaccugccgucuagcuguggcugcugcucuguuauugcagcguuggcuuuuaccugaaauuauuuuauuguauuauuucgaaggauguuuuuuauuuuuguuuguuuguuuccuuuguacucauggcuggccuggaucuuaacuauguacaccaagaugcccucaaacucagaucugccuuccucugucuccccagugccacucugacuuacaaguccuuuauuuccaaacuggugaagguuuuuauuacauuuuuuauuacauuuuugcugaagaaggcuagucaaggaaggacguaugacagcuugaguuccuaauaagacuuacaguaucccacucccaaguucucauaauaguaauagugggauguuucuacuccuuccuuagucaggauuauuaucacagugggaagaaaucagugcuggagaguuuuaaaguuucaaguaugacaauaugcuuuaaacccaugcaaguggcugauaauguaugauggccucaaccuuucucuaucugucccaccuucaucuaguccucaggcuucacacaagaguaucugcaucaugcuccuugcccuuguuuaguuagugauuaccagagcaucuuuuacauguaaagauuguucuguggaaacugcguaguggggcuuccagaugguucggugacuaaaggcuuugccaccaugccugaugaccugaguuugaucugagacccacguggggcaaaggaaaagacugacuacuucaaguuguccuaaaucuucucacgugcagugccuauacaaauacacucccaaaaccagcuaguuuccucuucuagucaucauaaacuguccuuugaaagacuucaaugugcuauaagcguccaaucacucuuauauucuaaggcaagaugugauaacacaauuauuuagucucuagauauuauuuuuuguguuuaaaauuuuaaaaucugaaugauaaaaguauuucuccuguuucuccugaguuagagugaaacaguguagaaacuuuugcagaguuugcagagggcccugcuauugaagcccgcucauuuccacuugcaaaaauagcaguguauaugugggcuguauuuuguaguuuagguuuuuguuuggugguuguauauuaugugguguguaguaucuuccccccacccacccuccgaguacuaaaggucaaauccaaagccuugcucgugccagagaagugcugcacuauucaaucaacacccaaucuggguauauuuuaguuuguucaguuguccuuuucagaguuggcaucugugacagcacaaggaauuacugucuuuaauuuaaaagaauauguauaucaaacuauugauguuuguaagucauuguugaugcugauccuguggaacuguacuguguucuugaggagguggaguuuagucuuuuguagcuggauagaauguaacucugagcuuuucuuuucuuuuuuuuuuuucuuuuuucuuuuuuuugguuuuuugagacaggguuucucuguguagcccuggcuguccuggaacucacuuuguagaccaggcuggccacgaacucagaaaucugccugccucugccucccaagugcugggauuaaaggcgccaccacacccagcuuacucugagcuuuucaacaucuggaauuaauuucuauguuuaggaauuuugccugcauguauaugcauauggggguggugugagcccuggaacuugaguuacagacaggugugaauuaccaugugggugcugggaauugaaccaggguccucaugaaaaauagcuagugcucuuaaccucugaaccaucucucuagccccuaguuuggggauccuugagaguuuuguuuacuguguuuuaaauggcugccauaagaagacaguaaagauuuguacucgauacugaaguauguuaaaaccaaguugucucagugauaggcaagaaucacacuguucacacuucugauauuagcgauuuucucuaccuagcgccacacugcucagcuccgagaagagcuacugaaacuucccugcccugaaggcuuagauccggacauugaggaugccuccccggugugcagggccacagcaggugcugaagacacucuaacccacgaccaugucaaucccagcagcagcaaagaccuccccagugacuuccaauuaugagcugcauugauguggauuucguagacacaaaggcuucgaagcacaagccaaauaugucaauauuuguauguaagaaacuaauuauguaauagguaaugaaacugaaacuauacuaugcccuuaaggagauccaguuuaauucaaggugaucuuugauuuaccuguacaagaguguaaacuuuuuugugcuuuuauuuuucaauugugagaaccacugauugguauguucaacaaauuuguguauacaaaaaaauggauaaaucacugaucuauaagggaaacuaccuuaggaaagaaugguuacugaauguuuaucuuuuuuuuuuuuuuuuuuuuuuuuuuacuguagagugagagguuguuaacaaagaauauauauuggucauucuuacaacuacuauuuaaagucagcaacuuuucacugaauuugauagauuuuguuuggccauaucuucaugcucauauuugauuucugaagacuuccuacauacacuuuaauaaaaguuaaacagacauagccccucuuuuuugauuuacugguacauuuuuaaguaauaaaucugccauaaaaugcacuauagcuggagacuugcacuuguauggaugaauuuauuacauucaacauauuuaauuuuaugccuucuaagaugcagaaaaaaauaaaugaacaugauuuuauucuaugccaaacauuugggccucugaauguauccauuauuugaauuuacuauaugaaaagguauggucaauuggaaaagucgcuuuaaacuguuuuccucaagggcuccucuuauuccuggacuguguggguuuguuccugaagucacauguauguaucaacauggaggcucuguagaggagagaggcugggccucucuggugcuguuacaguacguucuguaccugccauacaggcucguuuucaugcaaauucuuccuagagccaauaaauaaaaauguagguaaauuaguaugucuuguuucuaaaauaguugccauggugugcaaugguauuucuacaggaaaacuuuuugaaacuugagcgugggggaaaagaggauguuuuuguaagaccaguuauuguaaagaaagcugaaagcugcacgcaguggcacucaguuauaaucccauaugggacagucuuuucuucacauuucacguuccagcacgaccagggcuauuuagaaagacccugucugaagaaaguagaaaaaggaagagcugacgugacuauuaauauuuauauagagguggcagccuggcaucguuccuuauacaucccugccugggaagauugagguauagaguuugcucagaaaauacagucugagacccugccucaaaaauugggguaaggagaaagaaucacaauucuaagaauugaggaugua

SEQ ID NO: 8737 - RNA, 727 nt, Mus musculus
agaaacucuauuuuugccauccuuauugcuaucccugcugccgccagucaccugacaggcucagccuugccucugccccugaggccaucaagcuguuuccgugccuugauggcuggcuguugugcugcugcucuguucaugagggcagcucagauugucccacugacagcagugauccuacaggaagccuuuuguugagugacccugcugcaucugcaucgggagaaggggcacaggaucgugucugcuuagcuuaguaagcugaguaccuuuuucuuuuucuuuuuuuuuuuuuuugucuuuuuuuuuuuuccauuuuuuauuagguauuuagcucauuuacauuuccaaugcuauaccaaaagucccccauacccacccacccccaugaguaccuuuuucacagggcaacuuaaagaguguuuguacccaucccagcaaacucucauaaauaaaaguuuguguuuguacuauucauggcaugguugccugugcccuagucacaggcuaccaggaagcuggcccccaugaaggugguugcagggccauccaaggugugugauaggaaaaagccugguacgaacuauuugaaacauuucaucaccuucagaagcugcagaaagcugcuguaauugcccuguaguuuccucaaagcauugugcaguauucaaagcagcaggcucugacaaaggauggguugacuaguuguuuaagugaccauuauuuu

SEQ ID NO: 8738 - RNA, 772 nt, Mus musculus
ccuuccuccgcagcccggcaccgagucggcccugcugccgaucauccgggcucggggcccggccccgcgagcgcgcugcggccggggaucugagacagucguagcgacgcgagcccccgccggcaccgggccacgagggcuagcuuuggagcaccgggggcgggacggcugcaccuccgggugguaguuuugaguucagagaguggcggggauccuagccggagcuguugcugcagccuaggcugggcacuggccggaucgaaccccaggaaagggaagcgaacgcguggaauuuccgcaaacuggacgagaauccaucuuccacucgagcugggaauagacuuuguaaaagauauuauguaauggagucuuggaaaccuggagacaucuccagggaaacugcuggugggguugaaugcuuuaaauggucuagguaaauauucugagcugggacaauguuggggagggcugcagcuugaauuuuaaugauccaccuucuguaugucuguguggaggugcuguaucaugggaggggugacuggaaaguaacagagcuuaauccucucuggaguaaggcucaacacuagauuacaagucuugacaugacgcuaggcuggaagagccuaggcauccuuacaugccaccugacugugccguuuuguuuuguuuuuucaggcucgcgagcuaaagaggcguguuucccuuuucuuccucccauuuuucuuuccuaaaagauuuaucacgaauguauuaauaaagaagauggguggua

SEQ ID NO: 8739 - RNA, 2219 nt, Mus musculus
ugcuuccacagccugaguuuauuuccugguuguucugacaagcuucaggucuaagguuaagggugugucccucccaaggcccccaccccaccccccaccccuggccugugagugcccauccuuucuccagccuuccuuccuuccguacauaccagugacccacgcuucuucgucuuccuguaagacacaggucacguuggaucgaggaccagccuugugccuccuuuuuacuuagucaucucuguaaauauuccaaaugcugggauauccugcaggacuguggguuaagacuucagcaugcguuuuugggggagagaaaguuuauuuagcucauaaaaagcaagauaguaauguguuuacugaaaagaauuccuaaguuuacaaacaguugucuuugauguagcuuugaagaaauuugggaagugagauuuucuuagacuuggaucuguguuuguauaugacagcacuggacuguaacuaccaugugguuggcugucacgaagagguucugaauagccauacccagcacgggguggcucugagccuggcagcugaugcauugugauuauugccaggccugccucccugcugggugggaucccguuaugaucugggauuguacugugguuugaccagaggucugaggcugggcugucuuaauuccuuuguguuuuguggcuucuuuguaaccuuuggaagguucucugacacgcuacauuuuuuuccucugaugugauuuggccacagcucuguagauaagcccuuagcauugcuggaguacuaaauccaaaauccaguccugauauaggauaagauaggagaaauaugugucaguuaccuagcauuccuaaaacguuccucagacgagauggcuuagacaguggaauucaacuucucagagcuuuguaggccaguguuaaaauccaacuccuuggcuuguacauggggacagcuguguuuccccuggguucuuggcagggggggggggucaccuuuguccucuuucuucauucuggaaagcuagcaguuacguuggauuaaaguccaugcaguaaacucauuugcacuguaugaccuaaguccuucccugcagcucauccagucucauugcgaggugcaggcauuagggcuucagcaauggccuccuggcucucccgugcuuuggagugcugaggaagaacugaagugacuuccguggacugucccuccucucauccuccugaucugcagccagauucaugcgaggaggcauggaggaucgaacaagcauuucguuugaugcuuucagaccagcucuuuccccagaacccugcaaugguugcuugucugucugugucccuucccugguucuggguuuguucuuuuccucaggccagcuucauuucagucuuggcauaguaguacucgugggaugcucgauuuauacacauaaaaaaaggauacauuuuucuucucagcugagugacuuuaucuacucaccccuacuuguaugcacccaccagagcuucuuaguucccaagaucccaaacggucaguguaauugcuuagacucugauuugcccuuugguuuaaagcacccauuaugcugccuugaaacggccgugucucaguguucgccguccguguuucuggccacaggagugaaaaggcugucggugucugagcuaaacgaacugcuggaagagaucgaggcagccauuaagcaguacucugaggagcuggugcagcagcuggcccugcgagaugaacucgaguucgagaaggaaguggaaaacagcuucauuuccgcucugauugaggugcagaacaagcagaaagaacacaaagagacagccaagaagaagaagaagcucaaaaguggcagcucucagaacgggaggagugagagaagucacaugccgggcacaguaagugaugugugcagcaaacaccugaugccguccacaggucgcuccagcagcacagcuggccagcggggggucuggcaggucgaaccugugcagaguguggagccucuagccagagcaccacgaggacaaugucuucaagcaaagaggacuggccagugggcacuccuuaccacaucacagugauaguagagaucaguuugucugguuugcuuaugagugguucuguuuucuugugugugcuuagcucuggggguuguauuauaagcagugaagagaguccucuuagagguagcugagaacugugcucaa

SEQ ID NO: 8740 - RNA, 2026 nt, Mus musculus
auuuucuuuucuuuuuuuuuuuuauagaaaugagcuguuuuauuacaaagaguuucacaaaaugaaaauaucucaaaaaggaagcuaggcuaucaaccuccaccuacagaauugggggaagacagggcaauauaaguuuuuuuguuugcccaagaugggugggaagguauaaacagaaccaaucuaaaaauggcugcuauuacccaagccugaaaagggguccuaggagacccagaccccuccuaaauguuuaacaggggcaucuuagcagagcuccuaagcaggcacuuggcaguucaggauuuuucucuucugguuguuuucuuuccacgcaaauggggugaggggggcggcaggauggacaaggucgcucugggaagagcccuccuagcaccacugcccugugcucuggucccuggggacguuauaguuaauauauuuuauauaaauacacagaggaauagaaaauauaaaaucugagaaguugagggaaagugaggaacuuggggagaagauggggcugcagaccuugcucaggccaacuugaccucuucuuugaccccuuuggcuucuggcuucuccuccuugguuuucucuucuucugugacuucuuuuuucucuucaggaucuuucucuuucucauccucuguuuuaacucuuuuggcuuuuuugaaguuagaagaguucuugcgaccaccuucucccuccucaucugaguccgagaacucuuccucacaggcaaugcguuugucagaggagcagauggagaugcguuugucaggguccuccucaucuucauccccacucucuucugggauggcauccucagggauggccugcaucuggaccccaggggcauggggcagcauccucaaguucucaaagagacgcugcuugaucuucuccagguacucguuaguguucugguuggucauguuggaagggcugaugugaagcuugaaauccgguccaaaguauucaaaguagucguuguagggcagcucauuagggaucucuguguccagggccaccgcuguuucguaaguccagcagcgagcaacauuccggaugguguagccaccuccucccagcaucagcaugggcaaguugaaacucuucacgaacuccacacacuuggcguguccuuugauggucagauugaagcaaccuaaccgguccccagacagggaaucugagccacacuguaagaccacugcacuaggcuggaacaucuccauuacuuuggacaugacuggcuuaaagguggcuucauaggauucgucgucaaugccgucucgcaguggguaguucacagcauaguacuugccuuugccagccccaaugucccguagguccccaguuccugggaaguacucuccguauuuaugaaaggacacagucaugacccggucuguaguauagaaggccucuuccacgccaucgccauggugaauaucaaugucaauauagagcacccucuggugguacuuuagcaguuccgggauggccaagacgauaucaucgacguaacagaagccagaugcuucagacuucuuugcauggugcaggcccccagcccaguucacagcgauguccgucugcugcuuauuaagcuucacagcacuugcgacagagccuccuguggacaacugacagaacucaaacaagccaucaaacaccggacaguccucaccaacauugaaucucugcaucugcuugcuguauucagacauauuaucugggcgaauagaacgcaggaauuuaauguagucaucacugugguacuuggucaucuccucagcauuggcuuugugaggacgguagaucuccauuuuucgguagagaccauaguugagcagcaaauugugagucaugcggauucggugaggcuucauggggugcccuuguccauaauaguaguuuccaacauccccgucguaguaguaacagacuuuccucuuggugcccugagucugcgccaucuugcucgccgcccggcccucccgucagucuguccgcccgcccc

SEQ ID NO: 8741 - RNA, 1786 nt, Mus musculus
ugaaggccugagacagggauggcaagugcucucaucuauauuuauauuucauguaguuagugauaaccccugcaccauuccagacuauggaucauuuuauuuguauauuggaauuauaaugcuuugaaguugauacaccucuuacugauuuuuaaaaaucaugugguuacuacuaggcauauacccagaagaugcuccaacauguaagaaggacacaugcuccccuauguucauagcagccuuauuuauaauagccagaagcuggaaaggacccagaugccccucaacagaggaauggauacagaaaaugugguacauuuacacaacggaguacuacucagcuauuaaaaacacugaauuuaugaaauucuuaggcaaauggauggaacuagaaaauaucauccugagugaaguaacccaaucacaaaagaacacaaauaguaugcacucacuaauaaguggauauuagcccagaagcucagaauacccaagauacaauucacagaccacaugaagcucaagaagaaggaagaccaaaguguggaugcuuugguccuucuuagaagggggaacaaaauacccuugggaggaguuaacagagacaaaucauagaacagagacugaagaaaaggccaucuagagacugccccaccugaggauccaucccuuauauggucaccaaacccagacacuauugcagaugccaacaagugcuugcuaacaggcgucugauauagcucucuccugucuaccagugccugacaaauacagagguggaugcuuucagccaaccauuggacugaacacaggguccccacuggaagaacuagagaaaggacacaaggagcugaagggguuugcagccccauaagaggaacaacaguaugaacuaaccaguacccccagagcucccagggacuaaaccaccaaccaaaggguacacauggugggacuaaugucucuagcugcauauguagcagaggauggccuaguuggucaucaacgggaggugaggcccuugguccugugaagguuccaugccccaguauaggggaaugccagggccaggaagcaggagugagugggcuggugagcagggggaggugggaagggauaggggauuuucagaggagaaaccaggaaaggggauaacauuugaaaaguaaauaaaauaucuaauaaaacaacaaaaaaucaugugguaaauauauuuucauuuuuaucccaaugauacuucucauuuguugacuuauuuuguuguuccuguugggggugguggcguuguuucuggguuuugguacagguaacuggacccagagccuugcuuauuguaagcaugcaccguacugauguaugccacuggacccuaauuaacuuacuguuuuuauauaugaguacacuguaacugucuucagacacuccagaagagggugucagaucucauuacagauggcugugagccaccauguuguugcugagauuugaacucagggccuuuggaagagcagucagggcucuuaacacugaaccaucucuccagcccccuuacuguuuuuaacucuaagccacagucuuuuaaauuucuuagaauauaauuuuaucauguaguugaguggccauugguuaguaucaggaaaagaaaaugggucaaauuuuagcauuugucaugaaaauuaauugaaaagcaaacagauuguaaaauuugaagugacucaaauaacagaaaaaccuuuguuuuauggcaaauauccugugaauaaaagcacauuuucuaaccauuccauca

SEQ ID NO: 8742 - RNA, 10461 nt, Mus musculus
ucucucaaucuauuuauuaaaaugauguuuaacauggacacuguguuuugcuacacauacacaugugaaaugacuacugaagucaagccaucaugucacacagcugcuuuguuguguauagagaaagaguaguauauguuugcuggucccuuagcaaacacuacuucauuaugcaacacuggauucauaacucuaauccuuaggcuguacauuagcuuacuagacuuauucacaacucagcgcuccaaaguuacaucagaguuguaauugccuuccuucgcaucccuggcaccauccugcuuucuguguuacucaaccuuuaaaaagauccaacauguagaugagaccaauauuuugcuuucugccauauauuugccuacaugaugccucccaauucauuuaugccauggaugccagcaucacuauuugaauauuccauguucuaucuauauaccacaaucugugaaggccagucuaaaggguauuugauauagcaaaucccacagcauuccgaguacauggacacuacauacgguaccagcucccuggaaaagauaaauauuggaucgagucauagcagcaaggaaagcucacaaggagaugcauuacuguacagcaccagucagccugcuucuguugucuagaaacacuuuguagagucaggcagggcaaaucuguaacgccgcuccauacauauguggcaccgcuccauacauaugugacaccgcuccauacauaugugacaccgcuccauacauaugugacaccauuccauacauaugugacaccacuccauacauaugugacaccgcuccauacauaugugacaccauuccauacauaugugacaccauuccauacauauauaacacugcuccauacauauguaacacugcuccauacauauguaacacugcuccauacauaugugacaccacuccauacauaugugacaccacuccauacauauacaauaccucaagggaacauucagugaugauuuuugugacuugugggacaacaugaagaauccucuccauccucugcguucauucuuucugcucaguugauaagcaacaagaugugacagucauaacuuggacaggauuuuuuuccuugcaaaauuccgaaauccaacacacagaggcaaacgaagacauuagggacaccacgauuggccgaccaagcuccugccaugaugacuuccccacaaggguggacgugaucuugaauugcaaagugaagcaaacucucugcugaaguugcuugcgucagaauauucuaucacaacaacagaaaggaagcucaggccuguucccucuuucugaguuauugcguuaucucugaggaaucuuagagcuugcucaguuguaucacuaauggcaaauguucgaggaaguaagacacggguggguauggacagugaggcagguguauuccaccuccuggagacagacuuguaauacacacaaccucucuugaucauuuacccauaugugugauaucuguuuuccucaguuaugaacagugucuuacuuuuuuuuucuccugugcuuuuuaguuucuuggggaaguuacuuugauuuugcaauuaauuggaacaaacauauugaugaugaaaauguuaaguucauauuauaugaagaccugaaagaggugagauuauggucauugauauucaagggcaguauuuacuagagauuacagcacacagcacauacuuagaaugucuaauuuugugaacuaacaguguguucauuuuuaaaaaaaaaaaaguacuagauauaaaauacaaaacuagaaaaagcucacuauacauaagauuuuaguuuguuuacuuagcgaauaaaauaaugcuugcagcuuaauaauagcaguuuucuuuuccauuugugauggacagcuccuguuagugguggaagaaauaauauguaggucucagcuaauuuaaucaaauauucauuugguuaugaaauuuccaauugagugcuuuuucuuaaaaagauuguuuauucacuuaacuuugagucagagaugucucagcacaguuuuaggcacacguucuacaucaguggagaaucccaauacaguucacugcacuggagaaguuucuagaauaagggugggaaggcugaaugguaaggaacacaaaggagauugacgugugugcagaaugugagaagaacaaagcgcacaguuggggaaggagaccagagaguggaaggucggaacacuggaucaauccgagaacauaacaguugaugaguugccaguaagaagcuaugauugaucgaaggacugaaugaaaugagggugugagccaaguaaguagcugugggagagcauuccaagcugaggaagggagcuggagcacuaacacacagacacacacaccauauauauaaacacaucauagauacacauaccacacacagacacacacacauacacacagauacacauacacauauauauucacacauacaacacacagacacacauacacauagagacauauacagagacagauacacacacacauagauacacauacccaccacacauagacacacaugcacacacacauagacacauauagauacacagacacacacaccacacacacagauacacucacacagacaugcacaccauauacauagacacaacucauagauacacauaccacacacagagacacauacaaacacaccacacacagagacacagacagacauacgcauagguaccauaugcauagagacauaugcagagacagauacagacacagacacacacagauacacauacccacauacagauacacauauacauaaauacacacaccacacacaaagacacacaugcacuauaccacaaacacacacauauacagacauguaccacauacauaaacacacacacacacacaccacagagagagagacagacacacauacacagagacacagacacacacacauacauacacacagauacagacacacauagauauacacauaccagauagcagugcacagaggaggcagguggagugaguggggccaagugcgugugacauggcugagugaccaagugaggaacaguagagcaggcccccuagagugacucuggcuuucacccagagggaacagaaggcaucugagcagaggagugaggagggucuuuuuggcuggugagugagaauggacuggggccaggcgagugcaggaagagagacaucccuccagggcaggagggguaaaaggaacaggaguucagagacgaucugugguaccuaacaggcuuucucagaaauuaaauaaauaaaagaacggugcugauuuaagaaaaucucggccucugugaaucccacugagagauguuuaucauucaaauauuucuuuuccccagaauuugguuguuggaauaaaacagaucucugaauuccuugguuucucuuuaacugacgaacaaauagaaaccaucuccacucagagcaccuuccuggccaugagagcaaauucucaagagacacauggugccauugggcccuuccucuuccgcaaagguaaccuugcuuucauuugggggucaugugucagcuugggagugacuuugugcuuaacacacaagccaaaucacuuugucugaagcaaaauaagacuuagguuuuuuucucccuugauaagaaaaaucaggacccagggagcccagagcugccccuggcagcugucccuguccuugacugcacugagcgcucagugauggcaaaguggcagcuugagcuccaacauucugguucuggguaggaaaggaagccacaaaggaaggaauccuguacacuagcuaaccagaccccuuccagagcuucccaccaagcccugcucggaggcuguuugcguucauucuccaucucuccucccuacagcaguagcugaaaauguagcuuucguuuuugagcuaagugcauuguaacucacuuaaaaaucagaguuuuguuaauauaggaaaagaagaaaacggucauuggguaagaaauuagguacuuggcagacgguuuacuuaaauuucauuaaaguauucuaaguucuuaccccaaguuuagaauucuguaaguuaggacuuuccacuuucauucuauugcuuauuugaugaaaauauaacaauauuuaacauuuuuauugcauguuguguguaugugugugugugugcaugccaugaaaugcaugaugagguuagaggacaauuuauggaacucaguucaauccuuccaucauauggaacuuggggcuagaauucaagcuuugggguaagcaccuguguccacugagccaucucaucagcccauggaacagcaagggugaccacaacuaacaugggaacugguuagguacugccuggaaugcuggguugggguuaaauuuuauagcaaaaggauacaagagacuuaguuuugcaauguagaagaagacugaagcccccagggucuggcuuuuacacugucacauuucaggauuugagcugggucuacuuucuuccguuacuuuuucaccugacccauuugaaauaaugggucuguaugaauagaagaucaaauaggaaccugggugcagcuggauuccuguauaacccugauucuuauaccugauuuuauuagcuuuaggaaggggaaaauaggaccuuucuauacaucuaucucauuaaguguuauucagagaggaaaacuccuacaauaaaugaaguaaaucugaugugcguuguagaaaguccagagggcaggaaaauauggaagagcaugaaaauaaaacacaaaucauuuacaggugacaucaaaaauguaaacuucuucccccugagucagguucuuuuugguguguuuccucccagcccccccccuuuuuuuugucauuggguacaguugauggcaucuggggacagcuuuguguccuguuucauuuccuuaaugcaucauaacuauuuucucaugucauuaagcccacgucaucagcacacauuucaauggcugugcaacgguuugcaauuucaacgagaaaauccgaggauuccacagaaagaaauaacuuacucuuuacgugcauuuauuuaucuucuguguguauguaugucuguguguauauguauauauguauuauguaugcauguguguauguauguaugugggcucacaugugcaugccauggcacacaugugaaggucagacggccacugguagaagucaaucuacuccuucuauuccagggucccaguggucaaacucaggucuccgggcuugaucagguucauugacccacccagccgucucacccgccaaagaaauaacuuauuguaugucagaaaaaaaaaaaagcguuuuaaaucucuguugagucagaguuucaccauguagcucaggcugaccuggaacuugcuauguggcccugggugacuuaaaagcaagaucuuccugccuuggccuccgggcaacuggccaaaguauuaaauuccucaaaaaaaaaaaaaaaaaaaaaaaaagaaagaaagaaaagaaaaaaguucagugucugacauguuaaccaaaccaauuuaaaauguuaacuuuagaaauguauuuggguuccauccuauagcugacugugagcauccacuucuguauuugcuaggcacuggcauagccucauacgagacagcuauaacagggucccuucagcaaaaucuuucuggcauugugcaauagugucuggguuauggagaagcuagagaaaguacccaaggagcugaaggggucugcaacccuauagguggaacaacauuaugaacuaaccaguaccccggagcucuugucucuagcugcauauguaucagaagauggccuagucggccaucacuggaaagagaggcccacugguauugcaaacuuuauaugccccaguacagggggacgccagggccaagaagugggaguggguggguaggggagcagggcggagggaggguauagggaacuuucgggauagcauuugaaauguauauaaagaaaauaucuaauaaaaaauaaauaacaauaaaaaaaagaaauguauuugaguagcugagaaacuuucguaaggaagaacgacauucugaaauuauaagauuuuagaccccagaugcugggaaaaggauaggguugaccacugggguggagucuucuucacccagauuuguaagguaggcaugccaucugcuauccaccaauggagaagcccccaugggcccuggugaucuuacaagaaaauuguggguuguggguucauuuuuaaagguggaaguguaccucagcuaguuuccaaauaaaugagacugagacucuaagauuuauuuaauuacgccuuauggugcagugacugggaaguuaauaaucuauucuaauccuuugggcuaaucugguuaccucccagagaaaauucccaagauacuugcauuuuaguauuggucuggcucucugcacuuccgguguuuucccacaaugucucucaggacuccucacucacuuccccucucucucuccauuucccucuccuggcugguggaagcccagcucuauucucucuuuccucagccauuggcuggucagcuuauauugacaagucagagaauaaauggggagcaguguuuacacaaacuugaaaugggagaugcuuagaauaaucauuacaauggcaugucugaggacaauaagaugggggggcaaagaaaucagcaucuguauauguuggccuugaacucacagagaucuauuacccaagugcucgaauuaaaggcaugugucaccauuccuggcuuguggcaacucauaaaauaaagcuugcuuacaguuucagaggguucguauauuaucaggauagcaggaagcaugaccucucacaggcagauauggcaguugagaauuuuacauccagaucuaaggcagcaggaagagacugugagccacugggcuuggcuuggccuucugaaacgucaaagcagcuacucagugacacauuuccuccaauaaugccacacccacuuccacaaggccacaccuucuaaucuucucaaauagugccacucccuaagcacucaaauauaugagccuauugcagccauucuuauucaagccaccacaacuacauuguugccguuuuagaccuuucaaaggaaaacacugcauuaaacaaaaagguaaauuugggcagaacagaggauaaaauuaagaaauacccuaacauuauaucuaagucuuuugugcuuucuguguuguaggugagguuggugauuggaaacguuuguucaacgaaacccagaaccaggaaauggaugagagauucaaagaguguuuggcaggcacgucccucggagacaagcugaaguaugaagcauauugccuggcuuaacucuggccaagcuggcuggcuuacagagcuucuguucccucagaauaacuggauuuauaaaauuagauaguagugcagucaaacagucgcgugacaauaaucauguaacaugauuaugaauaguguggaucuaggaauggugguaagagcugacauauuugagcucaaauuaaaguuugucuuucuuuugaagaauuggaacauugcugucaguguguuguucuagagucaaacacagaccaaaaugggcuuccaaaugcuguauuugcauuuucucaagcuuuucucaguaggaaacuucucacuaucgguccaaguauuuguaguaguuuucucagacuuccuggugggugaaauucaagccugacucugcacugauuuaagguugacaaacugcaaguugcuucaggauaaaucccucuucgucuacucuggguacuccaugcaugcaggccucuagaggugcuucccucaagagacaugacauuauacuucuacuuaacaccaucguugaggcaaagcuaagcugucuguuuuuguaccauacagauuuuucuguugcagggucauaagcagucacgugaaacuaacaggaggauguagagaacauucuagaaagauugaccuaucuguagcgucucagucauccuaccacuuaggaggaagaggcaggaggcuugcuacaagugugaagucagccgagcuuuaaaaguucuagaucacuuagggcuucaaucagaccuugacuccaaccaucaagcaaagcaacaggaacacaccugcuggcuugcucagcugguagugucugcuucccauggucucuuccccaacacuacagugacuaggcauugugguauggaucuuggaggugaacacaggaaaacuggaaguucacggucacuuuuagcuucacgacaaauuugaagccagucuauacuacaugccaaucucaaaacaaaacacucaccaacucguggagaauauugggaguugauaagauuggguguacaucacuugcacacuugcucccuaaccauucgccuccagaaagauccagaggcaccccuuucaguggcuaacacuucagcuagauguuccaagaccccgaagaaauuauggugaucaugggucuuuggaaaugccaagaguaaaccaccuagaauggaauagguagagugagcagaauggcauccauugugaauguucaguagagaaaugucugcagagaucucgcugucagcuucucccuagguagucggguguucauuuaaggugcuauaguagggagcgggaguuuaucgaggcugaucuggucacgggcuuuucacauuagagaccucaaauuacacccaggauccacgcuacaagaaaaguuaggcuguuguucuccuaccuuacaggaaaggaagaagaaaggagugggcacagcaauguugacugugaaauugggggcucugucuugggacuuuuccaucucucaccaguugccauguugggaguacaauuucccgguucuaauucuagcuccugaguucuccucauagggauggugcucagcucagagugcaggcaugaagaugugucacugggcagugugccacaagcuaaacccucaaguccugggccagcaaguuccauuaugggaguguguuacagucuuacaggaagguaggauugcuuuucuuuucuuuuuuuuuuuuuaauuuuguuuuaacccguauacgaguucacuauagcugucuucagacacaccagaagagggcaucggaucccauuacagaugguugugagccaccaugugguugcugggaauugaacucaggaccucuggaagagcagucagugcuuuuaccugcugagccaucucuccagcucaggcaagguuccuuauuaagcagggacugcugguguuggccuugugauaaaacauuccuuguggccuuucugggagcagguggaucuuaacaggggccuggccuggugagugauaugcaacaaggggcuagcagguaacugcugagggcuggacaaauagauuuaagagagaauucuucaacccucuggccaauguugucaagauggcuauguccuccuuggcauggcagugugaaaggggaaggagacuaacguuuacaaaccuggacuucaauugucacagacauagcuuggcuggacccucugagaggcgaguuacucaguaucucccacugcacaucggaauucgguagcauccaugugcccaguugcuuccucaaaguuuguuuugaaaaguagauugugaucauugauccaggagcaggaggcuuggguuucuccuucuucuuccugcagagcuuucccagaauggaagccaggaaguguccgaaaccuggagaagcuggcaguuacugcaguugcacaggagaggggaggcgggcccggaccuuggcucccgcgcugggguacagaggcgacacgccuaccugacuucucgcgggugcgagccggugcgggaggggcccagagcagugugggaaggcggaguccgccgggaaaacgaaacagaagagaaccggccaggcccggacuuccaugggcagcagcagcggcagggaacggagggcgaauagauuucagagccugcaccugaaguacaauucgaauccugcuccagggagcgagccacuguccggauccagaaacuuugguaagaccugagggcuauuuucccacuccuggauagcgguugcaggaaaagggacccagaaggaaaaugacaagcccaaugacuuaaaacucuggagggaacucuagaagccugaaugacccagagacugaauucugcgccaagacuuugugcugcacagucauggcauuccaauuagcuguccuuugugacaagcggguccugcuccauccuccaccagccgcuauggucaggcaacccccccccccgcgccucccccuccccuucccccuucuucucccaacucccccgcccagugcccaccacuuucagacuuacuuggugguucugggccacagccaaauacccuccaacuccug

SEQ ID NO: 8743 - RNA, 21989 nt, Mus musculus
caugugcacucaggaaacuuuccgagcuuuggaugccuuugaagccagaagugaugacguccugcuagcauccuacccgaagugugguaaagcggaccuuucccuacgagugcauuuuggaaggaggugggagagggcgaaggugggaaggaggagguucguuuccacauggaacacacuggaaaucagcagggaggagaccaggacaggagagugcaugcguuacaaagucaacaacugagacagcuugagauauagcuuccuggaggucagggugcagaggucacggcagaugauggaaugaguggugggaggcagcauggcggggucagaauaacaaaaugugacuauuuuugacagauaaugaaggaugucauuucugucauuuauauaaugguuuccauguggugagguuguuuuuuuuaauccaggaucuaacacuaauucucugguuucucaaaucaguuuuagaagguccgucaucaguggcggaaaaagauuggaggauaaagauuaagaaucuaacuuacucuacuguacauuaucuacuuuuucuguuugagucuuugcuuguuuuaauugagguucaggcugaccuagaacuuacgucuucugcuucggccucuagcuuggguuaugggugugagcuauuccacccucuggcagcaucugcuacugauucuuucaacuguuacuuacgaaagcccauuucuuugaacacuuuucuguuacuuaaugcuggacuuuuauaaaaucgaggucauauacuccuguagcuuaauugcggaggaaauauaguauauaaacccaacauuucucuagcauaauauucuucuuuaagaaacauauucuauuuucaaaaugagucaugucaaggagacaucugagguuuauguggugucaaaugucuggaaucucaauacucaugaggcugagacaggggacucaugaauuagaagccaaugugggguacacuguacccugcccucaaaagaaaggaagagugggagggagcggggaagggaaaggaaagaugaauuuuauaaguucacuaaauucccuguuaauacacacaaaugcucuuugcucccaaauuauuuuuucccaguaucuagguucuuucaaccucuaaagaagcaaaugcagacaucaugggagaguugaaaauguaaaauuuccucaucuauaugagaaggugaaaugucuuuguuauaagacuccuugaugagcuucuguuuucuguuuguuuuucuuacagguucaaacuggauucuccauauugucagugaauuaauauuugccguuucuaaaaagaaauacgcauguccagaauuuccaguucuugaauguggugacgccgagaaauaucagguugguacccaaagucuuucaagguacagcacacaaucccagggggauuucuuucacucuggagucuucccuucuggguucagaaaguauuaauagggugcucacaaugaucacugaucaggaguuauugcuuguuuaccauauucucaggccucuuccaguauuaucucauuuuucuuacaaaacaacuuuaucaccaguugacaaaggaugaaauugccaaccuugcccaagaugaagauaauaaauggcaaggccaaaaauggaaucugagcuuucugauucgagcucuugaaagaauuuaauauacagcuauucuuacgaauaguagcaauucuuuuaacuugacgcgcaaguaaucugagaacacccaggacaggaacuaagcccaagaguuacaggcacggguaggaugcuaggcagaggcauuuucaauuuccuugccuucauuacagcugcuguguacgugaccagugaggaauagcgaagggguaguuaggucagacaagccuccgaugaggaugagccuugaaagcgcuuacagagcucucagccuauuagcauugcucucucucucucucucaucagaauuggcugggacacugcauucgggaaucucugcuuacugcccagggaggaagggguaagagguaggcucugcuuugggaucuuaugcuuagacacagcaggaagaugaugaaccgcccucugcuggccucauacagggaggaaggaaggcuggacccaggggaaaccauuccuguaaaaccccggaaguacuaaccaccaaguuucucuauggagaaagucccauggggacuugcggggacagcuucugggaagugaccacacucuacagcuugacgaauacaaacgucaaguucccaaagguuaaagggagcccauuuccauggauuggggaaaguaacagcagaaaaaugaaguuugaauggcagcuguuugagacuugagcaugagugggaggcaagccgcaaaucccggugcgcaggcagccacccacugcaccucaaggugcaaaagagaguucagaggccauuaaggcccagcgucccaaacuuggggaggguuguuaugcucgagggcauccaaugaaggcucagacagcaggggcucaggcuuuagggcuaggagaacgcacggacggacucgugagcuuuugcuaagggaagagaugggacaccuagagaaaagccaaacaacugucauguaaccuugcuccuaaugaggacauuugguauugcuuuagaagugauacuaacgugugcccagcuuucuaaccuuuauuuuaaaaaccuauuauguccugggucaggaucuuuuuuuuuuuuuuuuuuuacuuuauuugccaauguuauuaccuaccuucagcacaaacgggcuugucuuagguuugaaauaggauuuggacugucggcuuguacguuauacaugagauuccucuucuucuccuccuucuccuucuccuccuccuccuccuccuucuucuuccuucugguuuauuuauuuauuuauuuauuuauuuauuuauuuauuuaauguguauggguacacuguagcugucuccagacacaccagaagagggcaucugguuuauuuauuuauuuauuuauuuauuuauuuauuuauuuauuuaauguguauggguacacuguagcugucuccagacacaccagaagagggcaucagauugcauuauagaugguugugugccaccaugugguugcugggaauugaacucaggaccuguggaagagcagucagugcucuuaaccauugagccaucucaccagccugccagucuagguucuugacaugugaggauuugccucugaacuugaguauccuuggagucucucuuccucuccuagaagaugugguauuccugcuccucaugugagauccaaaguuauguuuuaaguuuuaaugacuguguuuaagaguuccaugaaacaaaaugcuucuaaccuuuaagccacuugccccaggacagaaacuuucugagacacuggcggcuauccauuguuuauguaagaugauaggacacauauuuucacuucccuagacagguuuguuugacccaaggauguguuuggccacauguaggcaggaaguacauagauaggaaaugcaucaggauguauacucgcuucugauugggugucugugggcaaccaggaagcaggcaggaagcaggcaggcuguaugcuugccccccuggaccuggugggaaacacauggccuuauggguuugccuuaauaagccucugcauaaugugacuuguuaccauuuucugggaucccuggacuggccuuaccagauccaucaaacuggucaauauuugacuaaagcuugcuucaaauuuggcuuugguuuguggugguagauuuauccucauccagugggggacaguucagugggggacuuucugcuucuucagcuacaccacugugaacguaaagccaaguguugcccuggcuuuuucuagaaccuuccuuauuugaucuuagugccaauugugaaagggaaguuacccuuucuguuaaagaaaagucuagcuguagugaaaagcucuaaaugacuacugcauucaagguguucuggaagaauuuaacuccacuuuaaaauagucacugaagugggccuggagaaauaaauggcuccgagguuaauggcacuugcugcuuuugaaggggagguaaauuugguucccagcacccacaugguagcccacaaccauuccagggaaucugauucccucuucugccucuguuggcaccagacacauggacacuacauacacauacauacuugcaagcaagauagucguacucauaaaaauaaaauuuuuauuuuuaauuaacuaauuuuauaaguguuuugcaugcauacacacacacacacacacacacacauauauacauauacacacuaugugaaugccuagugccuguggaagccuuguaagagggcauccgauccucuagacugaaguuaugguugguuauaauccaccacguaugugcuagaaauggacucuuguuccucugcaagaucaagcaguauucuaaaccacugagccaucucucuggcccauaaaaugaaaucugaaaauaaauucaguaagugaguuuggcauaguauccuagugcaacuagaucugcgcuguccaagaacagccaagaacgaugaaccacaucuuaaaucucugcuuuauucaagagaaccauuagcuugaaaagguaguggauuagcaucccuguagcuuacggauaauacagggagguaaaacaaaugucagucauuucaagguuuauucuugugucccuuccccggacucccggagggucacacuugucucugagguuuaugucauugcuacuucucuccucugugccgcagggggagaguugguguaaaauaaguuauuauauucuaguuauccuauauauaagauacaaaauccaaguauuuuauuuauaagcuauaagccuagacugggcagguuuggagcuguucuaacuuacaucccagccacgugucccuucuuaccgcuucuucuccuggccaugggcucauaguccaucucuucucaugguggcuuuccucacucuccaugugcuuucuuccuucuccucucucuuuaucugagguccccagccagcuagugaaaacccuccuaccucuaucuacuguaaaucauaagcuuuaaccuuguauggaccgauuaacuugggaagcaagguucacacaagagcuggugugccugagaauucauucuggggcagccaggucuugaaauacagagcuauacauuuaaauacaaagcagcaccagaccccuuucugucuaaagaaaaaggcucuuuuucuuacaauaauaaacuguauacaguaagaacaaguaugaaacaauaaggagaucuaugauguaauaauuacauucauaauguccaguccaauuguauuuggcaacuuaggagaaaguauuuuuuaaucuauccuaucuugguggguuuugcauuuaaaucaucuuuuuuuuacugucucaagcauuuaaauccuuuaauguucauaacuugcaauuaccaaccuguuugauuguaaacaucaguuuacaaucuccuacaaccuucauaaaauaccuuacagacucucuagccuucaucugcuaaccuuuaaagaucuugcagcuuaaaccuucaugaccuccaaccuucaaagcuugcauuuaccauccuaaaagcauuuccuuagacucuaaaacacuuuccgagauccuuugcuacgcaaguuuaaaugugaggcuacagcugucuagucuuugaccccaacagagacuugagaaggaaauaaauauuaugugaauaggcaagaaguacagguaggcagcuuccaaaguuauagacaugacagauauaguuggcuguuugaacagcccccuaaaaugucucuauagcauuggaguaucuaucuucagccuucuggccucguguauaugacagauauuugugaaguagucauuauaaaggacuuucuuacucuguguuggcagagcucaacuguagauauugucugcauuuaaguuugcgcauuuuucagagaguguucugucugcaguugaaguuuaaggcauucucucugcucaguggcuagcuugccucuaauuggagguccuuugaugcucaucaucuucuuuggaguggaaugaggugcugcuaggagcugacagauuucaaugucuaaaagaccuuaaauuaauaauaauaauaauauauggcauguucugugagucucugagguuuuggaagaccaucuaucugaacaaacaaacuuuccuuguuucuaguuauuauuaucuguucaacccaggauguauauuucugugauaaucuagacuaguaucugacaugacugugaugcuuuacagucccacuguagcuuuggaaguugguucuugugucuguaggcuccuaggaccaaccgcugucagcugucuauugugacuaauucuuccccuuagcuggagccaagauuuguccucugacuuucauggcuuuggguuucucucgaauggacccaaauuagacugagguugaagaccaccaucugucuggugugagcccaagccacugcacuggagcccaagccacugcacuggagcccaagccacugcacuggagcccgaaagaaggcuugagggaagcuccuugcagcuuuggaauuagcucugagcuaacuuggcugugccagauggggcaaccaggucuugggauacaguagcauuugaagacauagcagcaccagaccaacucuaacaacaucaagguaaacaucuaggauaccgagacuuuccaugcucccugaaccucuguuuggauggcaucuagguugaagguuaaugaagaacuaacaauuaauuguguguguguguguguguguguguguguguguguguguguguguguuccuuccugcagaauaaagcacaauuggguucuaacacaggccauaggugcccacucacuagcuccagaauugccagaaagacauuugaacuaugucaacccuuuugggguuucauaucuaaaguuuaucagaaaugauuauuuuuuuauuaagaugcuuuagaggcaaauuucuauuucaguuauaauuuaguugugucuaauuuuaaaauacagcgugccuuuuaguuucaaccagaaaucagugagaagguaggcuuaaauaaauagugauuugauauacagagaacuuuccucuaagacuugucugaagaauauguauauauucuauguauagucagucuuccuauugauuacgcuuuagauauguuacucauuuguuugaauaaaguguuguauaucuaguucuguggcaaauacuuuccugucugugccucuaauccugcuuugucguccugcaugagucacugugugaccuggggccgugugguguuggaggaacuguaaacuaucauuuaaucugaaaaugagcacuuauuggaugucauucaaagcaucuaaaaccucagagccuaaccuuaaucucuauaauagaggcucuaguaucagccuggugugaauggauguaaccaaguuauuuuaaacaccaaggaagacaguuuacugggacucagccauuaaccauaacaaaucaccacuuggacucacugcguugauuaaauauuuuuuaaucuuucaaagucuugauuuuuuuuucucuucuuugagucaaaaucuucauaaguuuuuauagaauuaacuacaaauuccuaaauauuauuuugucacuggaguuauaacacggcuuaugaagcuuugaaugcucuccuuaaauguggggcuggccaaaccgaagccuugcccucugaauaaaauauauuuauaaggacugauugcaagcuaaagucccuuuaccacuuaacaguguuguguauuugcucuucagacagggucucuguggccuggaauuuauuaugugcccacucuacuuuaaauuuguguucuuccugccucucgaucccuaguccugguuacugacacacccccacccucacacauggccauaaaaccuuguucucuuuaguucucaguagaaauagauaacagaaaaauaaucaauuauucuauaaccuuuaaaugaacaaacauuucauaaauaauuucucagauaguuaggaaaccuggaccuucagagucuuuugggauauuugggugcaagguacuccuuuaaucccaacacucagaaaguaaggacaggcagaucuuugaguucgaggccaaucugguuuacagagcuaguuccaagaaaaccagagcuacacagggaaaccuugucuugaaaaaccauaaaaagaaaaaauaucucuaggggcuagaaagauaaugugaguggguaagagagcucuuacugugcaaucuuaaggccugaguuuagaucucagugcccacauaaaaggccaagugcuccuaucauaccauuguuggaggggauggagacaggagaguuccugggacuuucuggcugucaaccuaccuccacauuuggucagugacugucucaaaggaacacugugugggcagugacacagcaggucgcucaguaucuucucuggccucugagagagcaugcacaagcacacauacauagaaacauuugcauuccacauuuacauauauauauauauauauauguucuugcaugggagugcacacauacacacucagagaaguucaguucugcuuguuuuagguggacuuuuagaaaacauggaagacuugaauauuucuauuaaggccuugauacaggagagauaugacuaaacaaaacagugaaauauagguucugaacuaguugaugugauuguuauaaaggguagaggauaagugacaaugauagaagauggaaagcaggauccaauaaaguaacugaugggauuaaugauuuguuuaugauucuccaugaaaaauguaggagagcagaagauaaaauaauuauagaguucuugaggcuaccacuuagauaccaugcuucuaggugacugaacacacauacacacacacacacacacucauacauacauacauacauacauacguacauacucuaacacucacauacacacucuuagaagcauacacucucacacacucagacauacucucucauacacacauuuucuuaaacauacucucacacacauucacauacacacuuucacagacacacccacuccccacacacucagauauauucucacacauucauugucuuauacaugucuuucacauacacucauacacacucacacacucacccuagugucccuauuuuguagagaaugaaacucuucccaucaccaaggauccugacaacccaccuccacuaugacaagcuaccucaguccaucuucaagaacaaagccaaggugagugaauuugagacauauaaaaagauuuaguucuauuuuguuuaugugugaguguuuugguuguguguauacguguguaucauguaugugcugaauuggaaacuuugauguauacauacaggcuacccuuugauuucucuggaacuuugaccucgaguuuuggcagugcuagaggucaaacccagagccucacacgugcucagcaagaacccuaccauugagcuacaucuucaaccccauaguuauuggauauuggugugaacuugcuaguaauugugggaugugaauaugugaaauguaaaauauaguauuucuuuuaucauuucuuucuuuggauguuuugcuauguuuccauuuaagucaaaugcauuccucauacauaagaggaaauguguaguuuauuaguuuauuauuaguuuauugguuuuacaauugauaggcuuuagaaucuuacuacuucagaagaauuuuuuuucuggugacaucugcaacuguauuauuucagaauuucacauaaaauaggcaccauugcaucaccagacagaauucuuguugccuugacucuucuuuccauuuguuuaaauaucuaacaucaggagugacaaggcaagacucugcuucccccacuccucccucccuucuacccccacuugugugggucccuucugccuuccuaucacacggauuccaucuucccccuucccgugaggucucuucuuccuuuucaugguccccuuucuacuuucaugaucgaucuacacacacacauauacacacacacacacacauacacacacacucacauccacacauacuugcacgcacucauauacauacacaugcucacucacauacucucacacucacacacgcacacacucucacauacauacacacucaguuauagauucugaacauaugugagaaaguaugugcucuuuauauuaaucuggcuugaauuacuuaacgugcuucccaguugcucccaucuuccugcaaacugucagugacuucaguuuccuuuacagcucaauggaguuccacugugaaccacguuugcuacauccauucauucaucuguugauggccgucugggcuggcuucauuucauugcuauuauggacgguucaguuaaugcucaaguaucucuguggcaggcacgucagcagugagaggacagaacugcugcucgacccucacaucuucagcagcaugagugaggcuuuccucucaucuuguagggagccugacucaggccuaaccaggauuugugacuuugaugcaguaaaguaguuuaggauuggucaguacaaugcaaaguuggagauuuuauugaagauauuuuaauaugguggcacccagcacccaggagacgggggcaggugccauggacagagcaaauuccaggccaggcaacaguggaacccugccuuaaacaauaauaauaacaaaaucgagauauuuuuaguagaacgcaaaaccuucaagaagagaagaaaaaccuaagaguaugcguguaggauucucaaugaacagacacagaaaguaagcugcucccaagcucgguacugggugucuuagaauuagccauauuuaccaguuuaguagauacuuccuaaagaugcuuuaaaaaaaaaaaaacguuuauuuucuccucccuuugauuggagaguucauagagcaggucuggcaaugcuuugcauagaacuguaaucugaugaaagaaaagcuaggagcucuucucuucccagccucucgguuguuagcuaugacccuucucccaccccaguuugaaagucccgagguccguuuccacgagucaguuaggcccuuugcauuugaggacggagcugcuauugcuuucugcuuguugccuuccaguuuucacagaaaaucuuaaguccggaaaagcucuggaaaucggccaaaaccacuugaggagcagccuccucagugacucugcagagggcugguguugcccccugcuggguucagcugcuucuuacaagggccucaaauauauuuagucaagaaauuuccaggguugggggugugggggugggagggucgucuuccccuuuucagaaaguuacaugacaucuguucugccuuauccugcuucugcuauauagucucuguguucaacccgaugcucaguugucauagguuugaaacaggaugccaggaugcaucugauuuccuccaggcacgcggagcagccauguacucuucccacaauuccugaguucucuccacaaucccuggguucucucccacuaccccugggaccuugcccacaaucccuggguuguggguugucucccacaaucccuggguccucucccacaaucccuagguccucucccacaaucccuggguccucucccacaaucccuggguucucucccacaaucccuggguccccuuaagacucaguuugcucuuuacuguucuccuuucacacuuuucauccaaagggcaucggaggucacuggagaaaacagacgcgggaaugagagguccaaccccaucugcauuccacagacacacaccgccucggcaccucaugucuauaaccuuaaagauuaguuugcaaucuuuugcuuuauuugggauuuuaccuuucaaaucuauccuucuugauucuguuaggggaauuguucuguuuuuccuuuuagugucuucuacgucugccuuuuuguggucauuauuagcaaagguccucucaguaccacucuucuguccuuccucuuccuucccccaucugugauuuaccaugguuccucuugcucucuguaucaauacaguuaugaugcuguucacccuuucucucuuccaugcugcaauacaaagcuccauaaacuaacuucguucuuguucucuagauauuggugauauuucgaaacccuaaggauacagcgguguccuuuuuucauuuucauaaugauguccccgauauucccagcuaugccucaugggaugaauucuucaggcaauucauaaagggacaagguaugacuguugauaagagaauuucaucuucaacaggugaauccauaaaugugaaaauguaaagaaauaagauuugugaagaucuuggaaugggaaguuuacauuuauaggagguuuugcagcagcugcagcagugguuucaugacccaagcuacugaugcaucucugguuucaaggagacucuagcacagugguccucaaccuuccuaacgcugagacccuuugauacaguuucucauacugugaugacccccaaccauaaaauuauucuugcugcuaccccacaacugcaauuuugcuaguuaugaaucauaauguaaauaucuguuacuuccuagggucuuaugggaccacugugaaagggucuuuugaugcccaccccccaaguggguugaaacccacagguuggagaguucauuuuguugaccaugaauauugaguggucauagaagagauuaagaacaaagauguuuuuuaagaguaauauagaaaaguauuucuaguuuuuucucucaagucacuguaucacagugucaaaaaagacccaagaaaaagaaaaagaaaaauccacagauuuguguagcuaugccuaaaacauuuuuguuagacuauguaaacaucuuaucucuaguuaucaauaacuacuauuuaaauuauugauuuuuuuguuccuugauaauuucacauaugcguauaaugaauuuuagccuucucuucuccccaugaccuucuuuugucucccguccuuuucccauugaaaccuucuucccaacaacccucccuauuauuuccugacuuucugugcaaaugcggcuugcugaguuuaaauacgguugcugugcuagucacuuuucugucacugugauggaacuccuuggccaggacagcuuauugaagaaaguuuaucugagcuuccaguuccagaaggauaagagugcaugauggcaaacagacaugguggcuggagcaggaagcugagaucugacuucucaaacagcaagcacaauaagggagagggacuuggagauggcauggaacuuugaaaucucaaagcccacccccagugacacacuuccuccacaaggccacaccuccuauaccuauccaaacagcaccaccaacuugggaccagguauccaaauaucugagccuauggaggacauuucauucagacuaucacaguaacuugcaugagcauggaugggaaguucuauacuggagcaugcacgguuauaccacagaggaaagcgacgcacccccacccaccauuauuaacugcuaagacucuugaggaguuauggagccuugugagcccuuccucuucucaugaugaaauaguaacuauuaauuucuaacuguuacugcuucuucagauacuaaacuaggugcuguauaggagugcuuucccccaagacucaugaccaacuagaguaaggcccugcuguacagcugagaacacuaacgaaaauguucugccaaucgcuaaucaccccacuuguuuucgugguccaugaauacaguggccagaggucuauauguaucuccuuuuaauagcagcuaaaugaccauagaggagaugauauugucugcucucuuuaagagauggugcaugcugucuaacaguuuucucugagauuaaaauaacaaaaucugagaguccuguucagagagugaaacugagcuguaaagacccugagacagaccagcugccuggaagaagcagaagccagcuaagcugccuggaagaggucuagaccagagucacuuggaauggacacucuccuaccuguugagcuggcugcaggugugcagugugcuccagguucccagcuuuggugagcugucccccauaggccuuggugaugcagcugucuuugagucauuucuggcccugcaugcaaccccaagcgaacuuauugguucaccaaguuggacuuuggugguacccauacuuuggucuguugcgggaugucuaucggggaugaguagacaugugugcuacaccuucccaggaaaaguauuuucacaccacagaaccgcuucucucaaucuauuuauuaaaaugauguuuaacauggacacuguguuuugcuacacauacacaugugaaaugacuacugaagucaagccaucaugucacacagcugcuuuguuguguauagagaaagaguaguauauguuugcuggucccuuagcaaacacuacuucauuaugcaacacuggauucauaacucuaauccuuaggcuguacauuagcuuacuagacuuauucacaacucagcgcuccaaaguuacaucagaguuguaauugccuuccuucgcaucccuggcaccauccugcuuucuguguuacucaaccuuuaaaaagauccaacauguagaugagaccaauauuuugcuuucugccauauauuugccuacaugaugccucccaauucauuuaugccauggaugccagcaucacuauuugaauauuccauguucuaucuauauaccacaaucugugaaggccagucuaaaggguauuugauauagcaaaucccacagcauuccgaguacauggacacuacauacgguaccagcucccuggaaaagauaaauauuggaucgagucauagcagcaaggaaagcucacaaggagaugcauuacuguacagcaccagucagccugcuucuguugucuagaaacacuuuguagagucaggcagggcaaaucuguaacgccgcuccauacauauguggcaccgcuccauacauaugugacaccgcuccauacauaugugacaccgcuccauacauaugugacaccauuccauacauaugugacaccacuccauacauaugugacaccgcuccauacauaugugacaccauuccauacauaugugacaccauuccauacauauauaacacugcuccauacauauguaacacugcuccauacauauguaacacugcuccauacauaugugacaccacuccauacauaugugacaccacuccauacauauacaauaccucaagggaacauucagugaugauuuuugugacuugugggacaacaugaagaauccucuccauccucugcguucauucuuucugcucaguugauaagcaacaagaugugacagucauaacuuggacaggauuuuuuuccuugcaaaauuccgaaauccaacacacagaggcaaacgaagacauuagggacaccacgauuggccgaccaagcuccugccaugaugacuuccccacaaggguggacgugaucuugaauugcaaagugaagcaaacucucugcugaaguugcuugcgucagaauauucuaucacaacaacagaaaggaagcucaggccuguucccucuuucugaguuauugcguuaucucugaggaaucuuagagcuugcucaguuguaucacuaauggcaaauguucgaggaaguaagacacggguggguauggacagugaggcagguguauuccaccuccuggagacagacuuguaauacacacaaccucucuugaucauuuacccauaugugugauaucuguuuuccucaguuaugaacagugucuuacuuuuuuuuucuccugugcuuuuuaguuucuuggggaaguuacuuugauuuugcaauuaauuggaacaaacauauugaugaugaaaauguuaaguucauauuauaugaagaccugaaagaggugagauuauggucauugauauucaagggcaguauuuacuagagauuacagcacacagcacauacuuagaaugucuaauuuugugaacuaacaguguguucauuuuuaaaaaaaaaaaaguacuagauauaaaauacaaaacuagaaaaagcucacuauacauaagauuuuaguuuguuuacuuagcgaauaaaauaaugcuugcagcuuaauaauagcaguuuucuuuuccauuugugauggacagcuccuguuagugguggaagaaauaauauguaggucucagcuaauuuaaucaaauauucauuugguuaugaaauuuccaauugagugcuuuuucuuaaaaagauuguuuauucacuuaacuuugagucagagaugucucagcacaguuuuaggcacacguucuacaucaguggagaaucccaauacaguucacugcacuggagaaguuucuagaauaagggugggaaggcugaaugguaaggaacacaaaggagauugacgugugugcagaaugugagaagaacaaagcgcacaguuggggaaggagaccagagaguggaaggucggaacacuggaucaauccgagaacauaacaguugaugaguugccaguaagaagcuaugauugaucgaaggacugaaugaaaugagggugugagccaaguaaguagcugugggagagcauuccaagcugaggaagggagcuggagcacuaacacacagacacacacaccauauauauaaacacaucauagauacacauaccacacacagacacacacacauacacacagauacacauacacauauauauucacacauacaacacacagacacacauacacauagagacauauacagagacagauacacacacacauagauacacauacccaccacacauagacacacaugcacacacacauagacacauauagauacacagacacacacaccacacacacagauacacucacacagacaugcacaccauauacauagacacaacucauagauacacauaccacacacagagacacauacaaacacaccacacacagagacacagacagacauacgcauagguaccauaugcauagagacauaugcagagacagauacagacacagacacacacagauacacauacccacauacagauacacauauacauaaauacacacaccacacacaaagacacacaugcacuauaccacaaacacacacauauacagacauguaccacauacauaaacacacacacacacacaccacagagagagagacagacacacauacacagagacacagacacacacacauacauacacacagauacagacacacauagauauacacauaccagauagcagugcacagaggaggcagguggagugaguggggccaagugcgugugacauggcugagugaccaagugaggaacaguagagcaggcccccuagagugacucuggcuuucacccagagggaacagaaggcaucugagcagaggagugaggagggucuuuuuggcuggugagugagaauggacuggggccaggcgagugcaggaagagagacaucccuccagggcaggagggguaaaaggaacaggaguucagagacgaucugugguaccuaacaggcuuucucagaaauuaaauaaauaaaagaacggugcugauuuaagaaaaucucggccucugugaaucccacugagagauguuuaucauucaaauauuucuuuuccccagaauuugguuguuggaauaaaacagaucucugaauuccuugguuucucuuuaacugacgaacaaauagaaaccaucuccacucagagcaccuuccuggccaugagagcaaauucucaagagacacauggugccauugggcccuuccucuuccgcaaagguaaccuugcuuucauuugggggucaugugucagcuugggagugacuuugugcuuaacacacaagccaaaucacuuugucugaagcaaaauaagacuuagguuuuuuucucccuugauaagaaaaaucaggacccagggagcccagagcugccccuggcagcugucccuguccuugacugcacugagcgcucagugauggcaaaguggcagcuugagcuccaacauucugguucuggguaggaaaggaagccacaaaggaaggaauccuguacacuagcuaaccagaccccuuccagagcuucccaccaagcccugcucggaggcuguuugcguucauucuccaucucuccucccuacagcaguagcugaaaauguagcuuucguuuuugagcuaagugcauuguaacucacuuaaaaaucagaguuuuguuaauauaggaaaagaagaaaacggucauuggguaagaaauuagguacuuggcagacgguuuacuuaaauuucauuaaaguauucuaaguucuuaccccaaguuuagaauucuguaaguuaggacuuuccacuuucauucuauugcuuauuugaugaaaauauaacaauauuuaacauuuuuauugcauguuguguguaugugugugugugugcaugccaugaaaugcaugaugagguuagaggacaauuuauggaacucaguucaauccuuccaucauauggaacuuggggcuagaauucaagcuuugggguaagcaccuguguccacugagccaucucaucagcccauggaacagcaagggugaccacaacuaacaugggaacugguuagguacugccuggaaugcuggguugggguuaaauuuuauagcaaaaggauacaagagacuuaguuuugcaauguagaagaagacugaagcccccagggucuggcuuuuacacugucacauuucaggauuugagcugggucuacuuucuuccguuacuuuuucaccugacccauuugaaauaaugggucuguaugaauagaagaucaaauaggaaccugggugcagcuggauuccuguauaacccugauucuuauaccugauuuuauuagcuuuaggaaggggaaaauaggaccuuucuauacaucuaucucauuaaguguuauucagagaggaaaacuccuacaauaaaugaaguaaaucugaugugcguuguagaaaguccagagggcaggaaaauauggaagagcaugaaaauaaaacacaaaucauuuacaggugacaucaaaaauguaaacuucuucccccugagucagguucuuuuugguguguuuccucccagcccccccccuuuuuuuugucauuggguacaguugauggcaucuggggacagcuuuguguccuguuucauuuccuuaaugcaucauaacuauuuucucaugucauuaagcccacgucaucagcacacauuucaauggcugugcaacgguuugcaauuucaacgagaaaauccgaggauuccacagaaagaaauaacuuacucuuuacgugcauuuauuuaucuucuguguguauguaugucuguguguauauguauauauguauuauguaugcauguguguauguauguaugugggcucacaugugcaugccauggcacacaugugaaggucagacggccacugguagaagucaaucuacuccuucuauuccagggucccaguggucaaacucaggucuccgggcuugaucagguucauugacccacccagccgucucacccgccaaagaaauaacuuauuguaugucagaaaaaaaaaaaagcguuuuaaaucucuguugagucagaguuucaccauguagcucaggcugaccuggaacuugcuauguggcccugggugacuuaaaagcaagaucuuccugccuuggccuccgggcaacuggccaaaguauuaaauuccucaaaaaaaaaaaaaaaaaaaaaaaaagaaagaaagaaaagaaaaaaguucagugucugacauguuaaccaaaccaauuuaaaauguuaacuuuagaaauguauuuggguuccauccuauagcugacugugagcauccacuucuguauuugcuaggcacuggcauagccucauacgagacagcuauaacagggucccuucagcaaaaucuuucuggcauugugcaauagugucuggguuauggagaagcuagagaaaguacccaaggagcugaaggggucugcaacccuauagguggaacaacauuaugaacuaaccaguaccccggagcucuugucucuagcugcauauguaucagaagauggccuagucggccaucacuggaaagagaggcccacugguauugcaaacuuuauaugccccaguacagggggacgccagggccaagaagugggaguggguggguaggggagcagggcggagggaggguauagggaacuuucgggauagcauuugaaauguauauaaagaaaauaucuaauaaaaaauaaauaacaauaaaaaaaagaaauguauuugaguagcugagaaacuuucguaaggaagaacgacauucugaaauuauaagauuuuagaccccagaugcugggaaaaggauaggguugaccacugggguggagucuucuucacccagauuuguaagguaggcaugccaucugcuauccaccaauggagaagcccccaugggcccuggugaucuuacaagaaaauuguggguuguggguucauuuuuaaagguggaaguguaccucagcuaguuuccaaauaaaugagacugagacucuaagauuuauuuaauuacgccuuauggugcagugacugggaaguuaauaaucuauucuaauccuuugggcuaaucugguuaccucccagagaaaauucccaagauacuugcauuuuaguauuggucuggcucucugcacuuccgguguuuucccacaaugucucucaggacuccucacucacuuccccucucucucuccauuucccucuccuggcugguggaagcccagcucuauucucucuuuccucagccauuggcuggucagcuuauauugacaagucagagaauaaauggggagcaguguuuacacaaacuugaaaugggagaugcuuagaauaaucauuacaauggcaugucugaggacaauaagaugggggggcaaagaaaucagcaucuguauauguuggccuugaacucacagagaucuauuacccaagugcucgaauuaaaggcaugugucaccauuccuggcuuguggcaacucauaaaauaaagcuugcuuacaguuucagaggguucguauauuaucaggauagcaggaagcaugaccucucacaggcagauauggcaguugagaauuuuacauccagaucuaaggcagcaggaagagacugugagccacugggcuuggcuuggccuucugaaacgucaaagcagcuacucagugacacauuuccuccaauaaugccacacccacuuccacaaggccacaccuucuaaucuucucaaauagugccacucccuaagcacucaaauauaugagccuauugcagccauucuuauucaagccaccacaacuacauuguugccguuuuagaccuuucaaaggaaaacacugcauuaaacaaaaagguaaauuugggcagaacagaggauaaaauuaagaaauacccuaacauuauaucuaagucuuuugugcuuucuguguuguaggugagguuggugauuggaaacguuuguucaacgaaacccagaaccaggaaauggaugagagauucaaagaguguuuggcaggcacgucccucggagacaagcugaaguaugaagcauauugccuggcuuaacucuggccaagcuggcuggcuuacagagcuucuguucccucagaauaacuggauuuauaaaauuagauaguagugcagucaaacagucgcgugacaauaaucauguaacaugauuaugaauaguguggaucuaggaauggugguaagagcugacauauuugagcucaaauuaaaguuugucuuucuuuugaagaa

SEQ ID NO: 8744 - RNA, 4549 nt, Mus musculus
cgcagucggguugcggaggccucagguaaggaccgggcaguguuucuuguccucuguuccccaauguguggcgcguggggucugugacauucuuggguguggggaacacucgagcgagcccgccccgcaggcgcaggagcgcgagcguuuccgggucgccgagccgcgacgcaugcugggaccaggaccccggguaaggcugggugcucgcuguuggauccuugcagggcagcagcccccggucgcagcgccgccuuuccucccucgggccuacacuggagcacacgcaggguugcuucuccugcgcugcagccccaggcgcuccugugcaacaaggcuccguggucuuuggucucccugagccaucuugucuggacagugugucucuggugacaaacgugcuuuauuauuaaguagacaagucccgaagcgcagggcuuuggaauguggcacguccaucaguuuuuaagaaauuaaguguuuuauuaauaucauuauuuggacuguuugauaucuuagcaucacucucuuccaaucaaaaaagauuucgcucagaucccguaaguuguggaacaggaugcaggcaggugugcccuguccucgcccugaaaccuuaaaaccgcccuugagaacuuagaacugagcgggaccgucagugauuuagcagaguacugggaaaucgaggaacacagcugucccuucugccuccuccccaguuuuuuauuugcuucguuuuaaaaaugagaauaauacaguuuuuuuuuuuucuggucccugaguaauucccauuacuaaagugaaaaacgaacguuggaggagggacacaugguaacagaguccaaggcgaauccugauaguguuuaauuauuuucaugcuuagauaccaugaaagggacguaaaagcaggggaaaggacuggcugauccugaacauuaaagaacagccugucucagcauugagcagugggaaaauaucagaauauuagaucaaaagcuuaguaguuugggguuauagggaguuaguuauaaagccugagcuaccuuuugcauauuuagcaagacaaaaccuuauuuacuggauaacgguucuucaaagacaccuucuuuugacuguuggaaacugagccuacuacucaugcuaauagcuugcaugcucccguucucgguuugucucugcguacaggggggaagacuucaguuacucgaagcuuugccauggacugggucaccaccagucaacuucucccccaugggccagggcuuuguauaaaaccuggagugacuucacgggggggggggggauuacuggggugccugccacccuagucuugcugaaucaggaucuggggacugggaaguggucugaaggcuuaggaacgcacgcugcuuuggggauggugcauugaaguguuccaacacugagacugccuuagagccaagacugguuugcuaccgucugguuucauauccgucuaggaaaggcaugaacuguggugcaacuuaacaaaaguaccuuccucuugcagggcagucuccaaaagggccuuccaaugcuguuccuauuauuagacuguauuauaauuccuaggucagcuaaaaaguuucucucuaacagacacuaaaaagccuuaguuccuccaguuuugcuuuguaaagagcucuauaccuucucagaauuucugugguuuaucacacuccuuaggcauggagaucggaaacugcauguaggaaugucuaaacgaaacacauacuacccuugagguucauacaagcacugagacuggggguggagguuuuucuuuauagauguggcaacagaaaucuaaacaugcucauccauccauguuguuaauguaggauggcucggaucauggaaccgcuggcgaggaagaucuuuaaaggagugcuagcagcugagcuugugggugucgcuggagcuuacugucuguuuaaaaagaugcacuccagccaagguaaacucagcucagcaauuguuuucuagcaggggaugcacucaauguuggugacauuucugggcaaaaauguuucuugagacugaagguaucggacguuuuuaugggcaggaggggagcgaggcuguuauuguaccugcagacuaggagugucuggguuuuaccugggaaggguagaacagacgucccuauucuggcucagaacugaacggaauggguggaggcagcucagccugcccgucauacuuacuuguagaaaaagcuaacaccgcugugggcagugauggugcacaccucucccagaacucgggaggcagaggcagguggaucuaugugaguucgaggccaaccuggucuacagugauuuccaggacaucuagggcuacugugaaacccugccuugaaaaacaaaaaccaaacaaaacgauaaaggcuauauuuuaagaugaauguaauuuguauacuauccuguaagauuuacuucuuggauuaguagauggaccuuaguacaaaaugcuaauagacacuaauauacuaaauuguuguuuaauauguuaauacagugauuuuuuuuuaauaucagauuucagacaaacaaugagcaagaaauuuccauucauuuuggaagguauguuuuucuucaaguaaaaauucaagugugaaacaaccuauagauucugugauguuuuuacaacuuuagagcaagugaccuuauuuuguuauugguuucaaacacuaguugcuuccugggaccacacaguaaggacucacaccuauuacuuagaugagaacagcuagcucuuguuuuaauccuuauuccccuguuuacugaucaaccugcaggcuuuauaaacaauggacaaaagugcugucacugaguuauauaccccacgugccagcuggaguuuucauucguucagugguuaagauuauagauuccagagcgagaccuaaggguugggacgggcacaaaccauaguuacugcuguaaagacuguuuuccuccgguguacuauguucucagagauacugcuuucucuuggggagagccaacgcugacccugauaguuagaguugaccacagugacaucaugcacuuagccuaagcaugguaccuggucccggacaagcagcccaucacagaggucuggagagugguuacagcucccguguggacauggagccccgcuguccuuucguuugcuauguagcaauauggaagaauucuuucacuauaaguuuaaauuuuguguaauuuuauaaaugacaguacuuuguuuccacaguuuauuacaaauccauugaacagucuggaauguauggaguuagagagaaagaugaggaaaaaugguugacuagcaaaaacuaaggguaaguauaaucuuaauuuauugucacccugaagaugucacuuccucugccguuuggguuucugaggggcuuucaucuucuuccugaaauuuuucuuuuucuugaugauacuuuucacaucucuguugugcagccagucaucucgcucagcuucccacuugagcuguuugaaaccuuugaggggagacgacagaugagucuguacccgggacuccacagacgcucccugaccguaacugcaggccugcggcuucccacccacuguuugcugcucuccucuacuggauaguugaggaauuuacaagugaaaauauaggauuuauacuggaaagauuuuucuuuucuauuuuaugaaagaauagaaacuagugauuauaacaucaggaauaauuacaaagucuucaagcaugugagaguacaccuuuagcuaagucuaaauaaaacagacagacucuugaagaaauaacgugugugggucugcaguuugugugugugguuuaaaugccuugcuaugugacaaacauccugccacuaaggacaucuucagggaaguaccauuuaaaugacacaggugaccugguagugcacuuguaauccuacugcuugggaggaggaggauuuagagcccaaggucagccugggcuacgacccugcuguaaaaacaacacaaacaaacaaacaaacaaacaccaccagcuuacuuacuugcauuaucucuguuagccauggcguucaugccaauaguaucaaacuuggagcccauauucucauccagcagauggccaaacugaaaaaagaaaggaagggugggcaaggcuauuaggaaacuugaaaagaauguaaacagcuacuuucuuaaguuaguacauuagccucaccuccucagcagagacaaacaggcuggagucauugaaacuuuucuucuuuuucuuuuguccuaaagaaaaauuauguguagguuacucaaagcauauacuuauuuuucagauuugguccccgaucaauguuuaucuuuacaagaaaccaaaaguaucacucaggcuuaaaauuccacagcugacuuggauggaguuuguaauaugugaaacaaaauauaaauuguaauucaugucuuauucuuugggcuugaaaagcugauuauguuuauuguuuuaucaguaaaguuuuauuuauaccacugaaaauaaaaugucuauaaaaacucac

SEQ ID NO: 8745 - RNA, 4549 nt, Mus musculus
gugaguuuuuauagacauuuuauuuucagugguauaaauaaaacuuuacugauaaaacaauaaacauaaucagcuuuucaagcccaaagaauaagacaugaauuacaauuuauauuuuguuucacauauuacaaacuccauccaagucagcuguggaauuuuaagccugagugauacuuuugguuucuuguaaagauaaacauugaucggggaccaaaucugaaaaauaaguauaugcuuugaguaaccuacacauaauuuuucuuuaggacaaaagaaaaagaagaaaaguuucaaugacuccagccuguuugucucugcugaggaggugaggcuaauguacuaacuuaagaaaguagcuguuuacauucuuuucaaguuuccuaauagccuugcccacccuuccuuucuuuuuucaguuuggccaucugcuggaugagaauaugggcuccaaguuugauacuauuggcaugaacgccauggcuaacagagauaaugcaaguaaguaagcuggugguguuuguuuguuuguuuguuuguguuguuuuuacagcagggucguagcccaggcugaccuugggcucuaaauccuccuccucccaagcaguaggauuacaagugcacuaccaggucaccugugucauuuaaaugguacuucccugaagauguccuuaguggcaggauguuugucacauagcaaggcauuuaaaccacacacacaaacugcagacccacacacguuauuucuucaagagucugucuguuuuauuuagacuuagcuaaagguguacucucacaugcuugaagacuuuguaauuauuccugauguuauaaucacuaguuucuauucuuucauaaaauagaaaagaaaaaucuuuccaguauaaauccuauauuuucacuuguaaauuccucaacuauccaguagaggagagcagcaaacagugggugggaagccgcaggccugcaguuacggucagggagcgucuguggagucccggguacagacucaucugucgucuccccucaaagguuucaaacagcucaagugggaagcugagcgagaugacuggcugcacaacagagaugugaaaaguaucaucaagaaaaagaaaaauuucaggaagaagaugaaagccccucagaaacccaaacggcagaggaagugacaucuucagggugacaauaaauuaagauuauacuuacccuuaguuuuugcuagucaaccauuuuuccucaucuuucucucuaacuccauacauuccagacuguucaauggauuuguaauaaacuguggaaacaaaguacugucauuuauaaaauuacacaaaauuuaaacuuauagugaaagaauucuuccauauugcuacauagcaaacgaaaggacagcggggcuccauguccacacgggagcuguaaccacucuccagaccucugugaugggcugcuuguccgggaccagguaccaugcuuaggcuaagugcaugaugucacuguggucaacucuaacuaucagggucagcguuggcucuccccaagagaaagcaguaucucugagaacauaguacaccggaggaaaacagucuuuacagcaguaacuaugguuugugcccgucccaacccuuaggucucgcucuggaaucuauaaucuuaaccacugaacgaaugaaaacuccagcuggcacgugggguauauaacucagugacagcacuuuuguccauuguuuauaaagccugcagguugaucaguaaacaggggaauaaggauuaaaacaagagcuagcuguucucaucuaaguaauaggugugaguccuuacuguguggucccaggaagcaacuaguguuugaaaccaauaacaaaauaaggucacuugcucuaaaguuguaaaaacaucacagaaucuauagguuguuucacacuugaauuuuuacuugaagaaaaacauaccuuccaaaaugaauggaaauuucuugcucauuguuugucugaaaucugauauuaaaaaaaaaucacuguauuaacauauuaaacaacaauuuaguauauuagugucuauuagcauuuuguacuaagguccaucuacuaauccaagaaguaaaucuuacaggauaguauacaaauuacauucaucuuaaaauauagccuuuaucguuuuguuugguuuuuguuuuucaaggcaggguuucacaguagcccuagauguccuggaaaucacuguagaccagguuggccucgaacucacauagauccaccugccucugccucccgaguucugggagaggugugcaccaucacugcccacagcgguguuagcuuuuucuacaaguaaguaugacgggcaggcugagcugccuccacccauuccguucaguucugagccagaauagggacgucuguucuacccuucccagguaaaacccagacacuccuagucugcagguacaauaacagccucgcuccccuccugcccauaaaaacguccgauaccuucagucucaagaaacauuuuugcccagaaaugucaccaacauugagugcauccccugcuagaaaacaauugcugagcugaguuuaccuuggcuggagugcaucuuuuuaaacagacaguaagcuccagcgacacccacaagcucagcugcuagcacuccuuuaaagaucuuccucgccagcgguuccaugauccgagccauccuacauuaacaacauggauggaugagcauguuuagauuucuguugccacaucuauaaagaaaaaccuccacccccagucucagugcuuguaugaaccucaaggguaguauguguuucguuuagacauuccuacaugcaguuuccgaucuccaugccuaaggagugugauaaaccacagaaauucugagaagguauagagcucuuuacaaagcaaaacuggaggaacuaaggcuuuuuagugucuguuagagagaaacuuuuuagcugaccuaggaauuauaauacagucuaauaauaggaacagcauuggaaggcccuuuuggagacugcccugcaagaggaagguacuuuuguuaaguugcaccacaguucaugccuuuccuagacggauaugaaaccagacgguagcaaaccagucuuggcucuaaggcagucucaguguuggaacacuucaaugcaccauccccaaagcagcgugcguuccuaagccuucagaccacuucccaguccccagauccugauucagcaagacuaggguggcaggcaccccaguaaucccccccccccccgugaagucacuccagguuuuauacaaagcccuggcccaugggggagaaguugacugguggugacccaguccauggcaaagcuucgaguaacugaagucuuccccccuguacgcagagacaaaccgagaacgggagcaugcaagcuauuagcaugaguaguaggcucaguuuccaacagucaaaagaaggugucuuugaagaaccguuauccaguaaauaagguuuugucuugcuaaauaugcaaaagguagcucaggcuuuauaacuaacucccuauaaccccaaacuacuaagcuuuugaucuaauauucugauauuuucccacugcucaaugcugagacaggcuguucuuuaauguucaggaucagccaguccuuuccccugcuuuuacgucccuuucaugguaucuaagcaugaaaauaauuaaacacuaucaggauucgccuuggacucuguuaccaugugucccuccuccaacguucguuuuucacuuuaguaaugggaauuacucagggaccagaaaaaaaaaaaacuguauuauucucauuuuuaaaacgaagcaaauaaaaaacuggggaggaggcagaagggacagcuguguuccucgauuucccaguacucugcuaaaucacugacggucccgcucaguucuaaguucucaagggcgguuuuaagguuucagggcgaggacagggcacaccugccugcauccuguuccacaacuuacgggaucugagcgaaaucuuuuuugauuggaagagagugaugcuaagauaucaaacaguccaaauaaugauauuaauaaaacacuuaauuucuuaaaaacugauggacgugccacauuccaaagcccugcgcuucgggacuugucuacuuaauaauaaagcacguuugucaccagagacacacuguccagacaagauggcucagggagaccaaagaccacggagccuuguugcacaggagcgccuggggcugcagcgcaggagaagcaacccugcgugugcuccaguguaggcccgagggaggaaaggcggcgcugcgaccgggggcugcugcccugcaaggauccaacagcgagcacccagccuuacccgggguccuggucccagcaugcgucgcggcucggcgacccggaaacgcucgcgcuccugcgccugcggggcgggcucgcucgaguguuccccacacccaagaaugucacagaccccacgcgccacacauuggggaacagaggacaagaaacacugcccgguccuuaccugaggccuccgcaacccgacugcg

SEQ ID NO: 8746 - RNA, 18088 nt, Mus musculus
auauacuaaauuguuguuuaauauguuaauacagugauuuuuuuuuaauaucagauuucagacaaacaaugagcaagaaauuuccauucauuuuggaagguauguuuuucuucaaguaaaaauucaagugugaaacaaccuauagauucugugauguuuuuacaacuuuagagcaagugaccuuauuuuguuauugguuucaaacacuaguugcuuccugggaccacacaguaaggacucacaccuauuacuuagaugagaacagcuagcucuuguuuuaauccuuauuccccuguuuacugaucaaccugcaggcuuuauaaacaauggacaaaagugcugucacugaguuauauaccccacgugccagcuggaguuuucauucguucagugguuaagauuauagauuccagagcgagaccuaaggguugggacgggcacaaaccauaguuacugcuguaaagacuguuuuccuccgguguacuauguucucagagauacugcuuucucuuggggagagccaacgcugacccugauaguuagaguugaccacagugacaucaugcacuuagccuaagcaugguaccuggucccggacaagcagcccaucacagaggucuggagagugguuacagcucccguguggacauggagccccgcuguccuuucguuugcuauguagcaauauggaagaauucuuucacuauaaguuuaaauuuuguguaauuuuauaaaugacaguacuuuguuuccacaguuuauuacaaauccauugaacagucuggaauguauggaguuagagagaaagaugaggaaaaaugguugacuagcaaaaacuaaggguaaguauaaucuuaauuuauugucacccugaagaugucacuuccucugccguuuggguuucugaggggcuuucaucuucuuccugaaauuuuucuuuuucuugaugauacuuuucacaucucuguugugcagccagucaucucgcucagcuucccacuugagcuguuugaaaccuuugaggggagacgacagaugagucuguacccgggacuccacagacgcucccugaccguaacugcaggccugcggcuucccacccacuguuugcugcucuccucuacuggauaguugaggaauuuacaagugaaaauauaggauuuauacuggaaagauuuuucuuuucuauuuuaugaaagaauagaaacuagugauuauaacaucaggaauaauuacaaagucuucaagcaugugagaguacaccuuuagcuaagucuaaauaaaacagacagacucuugaagaaauaacgugugugggucugcaguuugugugugugguuuaaaugccuugcuaugugacaaacauccugccacuaaggacaucuucagggaaguaccauuuaaaugacacaggugaccugguagugcacuuguaauccuacugcuugggaggaggaggauuuagagcccaaggucagccugggcuacgacccugcuguaaaaacaacacaaacaaacaaacaaacaaacaccaccagcuuacuuacuugcauuaucucuguuagccauggcguucaugccaauaguaucaaacuuggagcccauauucucauccagcagauggccaaacugaaaaaagaaaggaagggugggcaaggcuauuaggaaacuugaaaagaauguaaacagcuacuuucuuaaguuaguacauuagccucaccuccucagcagagacaaacaggcuggagucauugaaacuuuucuucuuuuucuuuuguccuaaagaaaaauuauguguagguuacucaaagcauauacuuauuuuucagauuugguccccgaucaauguuuaucuuuacaagaaaccaaaaguaucacucaggcuuaaaauuccacagcugacuuggauggaguuuguaauaugugaaacaaaauauaaauuguaauucaugucuuauucuuugggcuugaaaagcugauuauguuuauuguuuuaucaguaaaguuuuauuuauaccacugaaaauaaaaugucuauaaaaacucaccuacaguuuugaaucuguagacauuucaagaaaguuaaaguaguaagauaguuaggguucauauauaacuggacucuugaaacaugacugaaaagaucaucuagaaauacuuaaaugugagaggguagggcuugggaacaaugaaaacuaagguugcaugcgagaacucucuaccucuccacauuucacaacucuguuguuauaacucuuaaugcaccuuucuuggcagggagaugguuuaacuggaauacucgcaucgcaagagugacaacagaauucagaucugcagcagccauuuaaaaaccugggaguagugguguaaugucagugaggaaagaggaggcagaggcaggugcgugucuagagccuuguggaacaguuggccuugccuaaauggugaaguccuaagccuaagagagacccuugucucagacaaaugggagaaggugccugagggcugaucuuaaacauuuucuaaaugguaucaaagcaauuuaaaacauuuccuccaagauauuuguugguagcaggugcucuucauauagcagcugcuaugguuugaagagagcgcauguauuuucuuaccuugaaaugacccagcaaagucaaaaucaucuucacucuuucucuugcuuuucuuaguauuggcuuugggguuggcgucagcaaauucuguuacccaagaaaguuugcuauuaaaccauuuuauacacaguaagaagccuggaaaauaccaauuccaguaguggcagugcaacaucaaggccugguacaucuguuccauguguguccaguccuccaaucccaacagaaugggccuggaggauacuggacacucuagugucucagagacccaggaccuuacacauuuuaggaaguauucuacuacugagcuacacuacagucccuuauacuaaaugauaaaaagaggcaacaugacagcucaacugcaacuggguagaaaaagcuguugacuuaaaaucaguucaguacugauacguguauucuuuagauauggaagccuagccuaagaaugagcaagaacgcuauauaaucuguaucuuccuuuucauuguguaccuggagcaucuucacuuucaucaucugacacauccaugaacguuccuccaucuucaucaaucucaaagucuucaucguucauacuuccgagagaaacuucaucgucauccaggucuccaaguucgccgucacuacucucugagucuuccaagucagccuuagcuccuuuugcuuuuuucauauugcugggggugggggugggggggaaacacuuguaaaggaggcugugucuucuaaagugugcucaggagacaagcauucuaaagguucaagcccaggugagcauuucccuuagggaucauguaauuucuaggccuccucuucuaaugaacuauaauaaucugggaaagacugggaaaugguaaagacaaggcugcguuuuaccuggcaaaaucaauaucauccuucccaggugggaagcaguugucgucuucaaaugugucugcgcgagaaccauauaaacaguguaagagacagcaaggacaagagugauacacauuacacaccagucagccgugacacagaaccaggauuucacaacagcagaaugucguuauuaggacugcugcugguuuguccuaugcaaaccuaugagcuuagugaccucuuuaaaauggagucuguuacuguaauuccugucuauaguucuuuuguugaaaaauaacuuuaggguuuauuuuuaaucaaguauaggauauaacagcaaguaaacccuuccauuuucauguaguuuuauuugauuacaguuaacuaaaaauccccaagcuguaaggauuauaaagaaaaaaaaaacccagcagacauugcuacucauaaaacuaggagauuaugaaaacuaaacagugucugugucaucagagccuuggcuugagaaaugaaaacacucugccugcaaacagaauugucugacauauuaugcaaaguucaauaacguuauuuuucuagaaugaauaugaguaaggucaccauaggcuauuucuuaaucuuccauuauagucugcagaucaaugauuuguaaauacuaaguucacuuauacuacuaauauuauacagucuauuaacaaauauuaauaauuuuacaaacugagucaacaaaaacaaauuaccaaucauauuuucaaauucuucaucaucaauaucuucuauacuuucuucaucugcacugcguuucuguuugucuuuaacaacagcaacuuuuuuguaauaccuaaaguaaaaugcguauuacauaucuguauaauuuauaacuaaagacuaauuacaacucaaaguguguuauggauacugaaaugggcacaaaugaguagaauuuguauucaauauaaaaggguugaguuaaacgugaggcauaauuuucuuuacucuuccauguagccuuggcuggcucuggacacucaacccugcuuuuccuccugagugcuggguuacaguaugcgccaccaagcacuuuuaagugagguagaagcagcuuucaagacuuuauagugucuuauaagccauuucuucaaacauuuuaacauggcaccauagaggccuuaggguguacacaguguugucuagcaugaacaagacccugaguuuaaucccacacaacaguaaaauaauagcauaguaaaagguugguucaccuuaacacuacuuaucuaaguaucagaauauagugguuuuaaaugaccuaaagucgcuaaucagcccacccaaagucacaguaaaaguuaagacuuuuacuuuuggcaucacacucauaaaauuauucacaauaaauguuuguuuguuuuuuaaagcaauuuaaaucaaaccuaauuaacuaaucaaccagacaacuugacaucauauuaaaggcacuagaagcaucaguagugacauuaaagaucaaucagucucacuucauucaaaggauccuucugccugaaggaucauggugugaacaaauuaccccugaguuacuacuauagccauauaccaacacagauagagacacuaaagaguuaccguuugggagggagaggcaggaggaucacagucaucuuuggcaauauacagaaggaucaggaguuuaguuaacuugaugccccaguguaggggguacuagaguggugaggugggagugggugaguggguggaggagcacucucuuagagacaaaggggaaggaagaugggaugggagguuuacagaggggagaccaggaagggggacaacauuugaaauguaaauaaaguaacaaacaaacaaaaacaauuaaaaacuuaaaaagcaauauaucaaauauaaacauuuaaacagugccuaagaaugcuguucuagguaucuuaccuauagaagaacacuucauccacugggaucuggcuuucuucuuuugcaaggaacuccuugcuguucacugcagaaugaagcaucauauuacacccauucccagcacucacauguucauacuauaucuaacauacuggcaguucugacaucuuuuuuucuugaaaggguuucucugugaagcccuggcugugaugugagucaccacugcugaaugguucugaaaucuugaaacgagacaguguuggcuaagaagcccaccaguacagagcacaccucugaagugugugagccucagcauacuaaacucuuggcuguccugcggagaacagguagaacacagccacaguggagcaacagguucuuuuauuguuuuucaguugcacucacgacacaaguuucaagagaaccaaauuauuugagauuuacuucuuuauauguacaugugugggcaaagaugugauugacugcaggugucggcaguagccacagaugcuguaccuccccagaggugguuacaggugguugugagagacacccuauaugggugacaagaaccaagguugggccuucucccagugaaguauuuuuaaccccugagcuaaccccugaagccccuggaauucucccagugaaguauuuuuaaccccugaagccccuggaagaguucuuaugaaguugcuaacccuaauccuaacucuugauccuucugcuccuaccacccacacgcggguuauagcaacucugguugucucggaagaaaaguauguaaugcuugcaguuuaaaaucaggaagaauccaucaacagaacuuuccauaauuuuacuuagaagugagaaaaauaaagaauucaaggauauuggcuuuuuuccuaaugaaauaaaauuugauuugauuuagcgauuggcuugccuuacagcccuaauuuuagccugcguaacccuguugacauuucuggauuucucggaaguuggcuggaaauaauuaaaacugacucaacugaauuucugagcaagagaugaagguggggccuggugugugaagaaaugcugaacagagaaguagaaccagaucugaagauugguaccaaauacacguucacagggggaccacagggggccacaggggaccacauggggccacaggggaccacagggggaccacacggggaccacagggggacuucaacugcacugccaauggugcugcauggaagagccagcugcucacuuuuguuagaggaguuuaagaugggaugagcuguacaggauauggacuguacauguugggcucugaagcagcuacgagcuguggcagaaugguuuaacugccaaggcuagggaaugguugucagagggccuaucauuuaacguacuuuguuuaucaugauaaaguagggcacagaauauaguuugcauuggacugucguaugcuauccuuuggagucaccugcccuggcucugugcuuaccagcgagaucucugacauucuucauaaagugcuuccuuuuggguugcaucacaacacugucgguauuuucugaaagguaaaucaugauaggcuaaugcaguuauacguucacucacauacuaaaucugagcaacgagaaccaaacagacacuaaauaaugcaggccuaccuuugccuuuauguagcuuuggauuucgguacacaaaucgauccaagaaucucaugagugugaaauccugcaguggguccccugaguauugaauacaauuucccugaaagguggaaagaugguagaggacugaaggauuuaauaauaaauaacccaucuaucuaaauacgaaaaacaggaaaaccauaagcugcugcuaugucccaucugaggcagauaugaacaauauuuguauaccacacuaaaaaacuauacauacaaacauauauuguacgauguacuggagauuuuauaggcaauauaggggagacuauguaaccauuaucagaaccaaacacugaaaaagcacacccaggaagcagaggccauagcacguguccccaggagagccagucuguaauaagcaucugcaugagacacgacaccaacuuuguucucuguauuagacauugguccucaacaacagcagaaaacaucagauucuacauggcagggaaauuugaaccaucaauuacugaugacccaaaacuacaaaacuuagccaggugucaaggugcccugcacucagaggcaggcgguucucugugaguucaagacuaacccagacaaacggaguucuaggacagccagggcucugucucaggaaaacaaaaaacaaacaacccccgcccaaacccaacaaauaaaaaacaaaacaaaacacaacaaaaaaacccaaaaccccuaaccuccccccccccgcaaaacccuauaauauuuacauauuuuagaguauuuuauacuuaccucaaggauagucuuugcaaaaagggccacagaaggauggaaauguucagauagcuauauaagaaaaaauauaaacaucauuauuuuuaagguuuuuuuuuuuguuuuuaaaguaaaauuauagguuagggggcuggagagauggcucagugguuaagagugcugacaguucuuccagagguucugaguucaauucccagcaaccacaugguggcucacaaccaucuguagugggaccugaugcccuuuucuggugugucugaggacagcuacaguguacucauaaaaagucuuuuuaaaaaaauuacagguuauuugagaaaaaucuagagaacuaaaacuuaagcuaauacagaaagaaugauucucaaaugguuugcaaaccauguaugcauuuaaaaaacugaaaauuuaagaacguccaccuaaguggguuauuuuuauauuuauuagaaauuauaacaggaaaaauuuuaaugcuuucaguucauuuaaauuaauaaauccaggggcuggagagacagcucagcagcucagagcacaugauggacuugcagaaguccugaguucaggucccagaacccacacaguggcuccuaacugcuuguaacuccaauuccaggggaucugacagccucuucuggccuugggaaccagguaugcaaguggaugcacucacauacacaugcaagcaaaauacucauacacguaaaaugaaauuaauaauaacauacauaccauuuauuaauguaaacaacauguucaugaaaaauauguguauuucagaacagagauuacaaaauuaggaagcacuauuucugaaaguaauauuuucaaaaucuccuguguguuuaggugacuagaacacaaugcauuuuaauccuucccaguguucuauacuguuugagcaucuaugaagagaaccuagccucaaacagaucugugguuaaaaaaggaguuaguaagucuuucaccgaaguguggauuuucuucuuugaagcuauaccaaaaggaaaaaauuaacugccagguaggaucaaccacaccaaauggcguuaggcauuugcuacuuagcuggcaguuagcugguccacuaugaauguauagaccucaccuacagugaauuaggaacacuguacacugguuauuugagaaacacuggaugggcagggcacuuccuccacacugcacagacuugcacuguuagagugaacacuaacucuaucauccaacuuuguagagaggcaggacugaucuucaggcacuguuugagaaugaacuguugacuacaggaaugacuagugaguuuugucugaggcaaaagaaucaauuacuucauuuacaagcaaauguaucucagacagaguaaacuaugccagucagugucuauuaggauacagcuccauggaucaggaacagcugaccaaguucuacucugagacagcucauccuucauacuuaggugcacagcaagagugggaauaugcacuuuccauucacacagggaacacuggcaugcauuuauuuauuucuuaaucauucccaagugauccuggcuuuucccucccuuauuuacuacaggaacacgcagagaggaauauaaagaaguaauggcuacaaacacaccagcuugacuugcacagggcaucagcaguucccccaucuuuuuuuuaaucucagcagagcugcagcuagcacaaggacagacaaaggacacauggacauuuccaggacaguagcuguggucuuguagacucaauggagugcugugaacaucuggacucacauuucuuuucuuuucuuuucuuuucuuuucuuuucuuuucuuuucuuuucuuuucuuuucuuuucuuuucuuuucuuuucuuuucuuuucuuuucuuuucuuuucuuuucuuuugacacaggguuucucuguguagccuuggcuguccuggaacucacucuguagaccaggcuggccucgaacucagaaauccaccugccucugccucccaagugcugggauuaaaggcgugcgccaccacugccuggcagaagacucacauuucaagagucacagggagaaauucauugccuucugguuacagaaaggcuauuaggagccuaacuccucuucuucauuuacaaaauaacauaggaaaagauuucuauucucacacaaaagcaggacauguuagagagccacaugcauccacauucuuauuuguaaacuagauaugguauuuuuauuuacauguacaucaguuaaaauguuucuguagaaugaacacacacacuauguuuuugccagugugugcuuucacguuagcuucuucaucauuugcaaguaaagauucaauguguuaaaaucuaugaaggaagaauaugugucacaaacuaaucaaaagauaguugaaacuauuuuaccuuuuugagcucccaaagaguuguauuuucagcuccgcagaauaaaggauuucuacugaauggaucauaugucuuuauuugcuugccaccuaagaacacagaauuuuugaaauguuuuauuccuaguucaagaagaugcuucaaacuaauguucucacagaaugaccuaaucuucaaguguuaguaguucacuaauccaauguuagauaaaaauguccagucccuucaagaauuuaucuugaugucugucuacucaaacacuuuuuuuccugaaaaaacuuugcaacaugcuggcuccaucucccaaaugaccgauucuucaguaguuuucaaucagccagagaaagugcuaagaaaacaaguauuaaauaggaaagauggaaauaaccuagaggaauaugucuagaguauuucagagcauuucauuugugguauugcaaauccuugcuauuaaguuacauucaggaaguuuuuuccuggaacagauuuguauguuugcagaaacucuaaaauaaaagagacuuagguuugcuuucuacuuuuucuuauuaagcauguguguguaugugugugugugugugugugugugugugugugugugugcaagugccauaggcugcauguggaggucagaaaacaguauuuaggagccgugucuccaugcaguucacgaucugggacccgagacugaagucaguccaugaggcuuaggggcagugccuccccuucccugggugaguugucucguuggccccgcaagguuuuaacguccacuguaaacucuacagcucuagcacaagcucgucauccuccuaaagcacaacacugugugcuuccaacagaugaaucccuuaacaacuucccucauggggcacugacugcucuucugaaguccuggguucaauucccagcaaccacaugguggcucacaaccaucuguaaugagaucugaugcccucuucugaggugucugaagacagcuucaguguacuuacuuauaauaauaaaucaaucuuuaaaaaaacaaaaaacuuuccuugacuaccagcaugcucuuuaaucuaucuaaguggacacuuaaagcugagcuauuuucaccacagguccuaaaagaaaugagucugguacugccucccucagugcaaagcugguguucuuuuucuuuguggccucagauaaagaccucauuucuaagcuuucuuuugguucuaauauucuauuaacugacuucuuuuccucugauguguguguacauagacaccugagguuucuauuucucagaaagucuaucuuaaaaacuugcuuuaaggggcugaagagacggcucaguaguuaagagcacuggcugcacuuccagaggaccuggguucaaguccuaucaccuacauggugcucacaacugucuggaaaccaguuccauggcauccaaugcucucuucuggccuccugggcauuaggcauucacauggcacacaggcauauguacaggcuaaacacauacacauaaaaaauuaauaaaaaaaaacuuucuguaagaaacugcaaugaauaugacagccacacaaaaaucaagaagggucaagagcugugucaaauacagguccauucaggaaucaaacuucauguggcccacaggugggugccuucaugugcugauuaaaguggcucgaugaggcucaaacucuuauuuagaacagaaauuaaugauucacaguguacaucauuuaucaguguucaccuaauucccacaccucaaaggcaucugcuugaucuccaagguuuauuuaaaacacggaauucuguuaaugaagauuaucugugauucccuaccaacaaaauuucacuucaugauugcagauguaguucacuacuugcucagcacacacaauggcuaugcauugcaccuccagaauugucacacgcaugugcaugcgugugcucacacgcacacauacucauagauauaugaagcuaacagaagaaacuaaucccuucguuuagaaguucaagggaacaagccaaaggacuucaccuuucaaguugucaaagugcacccaggaagcggccuucggcuucucggccucugcgcugcucucaggcucugucuccuuugacucuacuuccuuuacugcaucuguugcuguuucuuugucugcaucgguaaacuuuucaucgucacugucaucucccacgucaacgaaguuuucuucgucagacuccuaacgaaauguagcaaugacucuguuaauuaaugggaauuguaaugaagucuguuaaucaaugggaauuguaaugaagucuguauucauuuauguggugcagaguuucagagacucacugcaauucugguaaagggugaagaaacagcaaucaagugaaacuccaggccugacggccacccaggugagacagaagacagacucucuuccuaaacacgagagccaaguucucagccaagagauuuuacaacugaauccucaaacaucugucauguuauaaaccacgacaaccggugcuauuacuauuuauuucuauuucauaaccgaggaaauggacggaaagggucuacucauucuauaaucaccuauaacucccuuauaugacugcaauuucuaauguaaugcaguuucuuauguaauagauggaaaaguugagcaagcugcccaucuauuuagcuguacacccggcagugaagucuggcuccuuccaacucuagagucacauuccagagaaacuaacuuaccaccgguaaagcaaagaaaaacauacacacaaaagcccccacccagcacaccagcacccacuaaggucaagaagcaguagagaacacaccggaugaucaucuaguuggcuucuuaaaucugguuuugcuuuaaggaucucagacacaagauacaacgcuccacaaaugaauggcggcaucugugugcaggugaccugaagcaaccucuucacaaacgccuucacccggcgcagcaugaugucagcuuucaaagauuuguagaucagguugagaaacaucgcuugcuuggaacaugucgucaggccuggauccaacaucuuucugucaaaugaaaucaaggucaaguguucauuccuaaagucauccucacauccaggagucacaguuuacagacuccacaaccaauuacaacaaccucaucuuagggacaccuuuccugcauauguuacaauaagcaacuacuucugucuuaucagauauugugagaaucaaugacccccgagagaaagaacacacugguacaaaggaaagacaucaucaguuaagagccacuuuuuugugacuuuuuucucauuuuuuuuuuaaauagugauacagaccccucgugaaagguuacacacacgccaauuaacaaaagcugacaccuacucaaucugcuuuuaaccaguucuuggaaggcagaggcagcagcucucaaguucagucagccugauuuccauagcaaauucaaggcuagccagggcuacacagugagcuguuaacaaaauaaagaccgagcccuaggaagcaagaugaaauaaccucuguccuaugcagcacagaugaaaugacccaagugucugccuuucuuuacucuugaggugagcggggcagccuccccacccccaacacggcucuaguguagaccaccuaugaguaguuaaaacggaaauucugaguccuucagaugugacccaauggacuaagcaugcacucccucauacccaccgucccaguccagaauguucucugcauguccacagcuccuaaaauagguucaguucuucugauguucucucuguuuaugcucugcaguucccuaaacucagaguccucaguuucccugccuuuucucccaagggucaaaggaaucagacuguucuauuauaagcuuccuccaugugcuguuuuccuaaaugagggguccaaucaggcacugacgaaagccuucaguaauuaucccaaauaaagcuuuucccuuauacaguuuucuuggaaaauguguguguaugugugugguguguguaugugugugugugguguaugccuauggaaggagauaagcaaguuggagaggacaacucagaguuuguucuuucucuccacuauguaggucuuggggacuaaacacaaguuggcaaucuugucaguaaaccccuuuaugcccugggccgucucacuggcccuaagcacugcucuguaagguuccaguugucugucugucauucacugcuggagcgcagcaggugcuuccuaauguggacuaaagguggaugcacgggccugcauuuuacuaauaaaauacaguaagaaaaaugagcuucgucaaguuuccaguaggguuuuacugauaguuaaauaauuuauccaauuugcacauggcaaacuacugccugggauucagaucaugguaaguguggcuuaagucuaaacuacuuuacauuuuccuucauaaguuagauacagaugugcaacuguaaaaaaaauaaauaaaaaauaaaaacaaauuagugauagaacaggccuuuaauucuagcgcucagacgucagagacgggcgggucucuauggguuucagagcuagagcagucgaggcuaaacggugcgaaccugucucaaaaauaaaaaagcaaaauagaaaauagaaaaguuccucaacacagcauauguaaggcagacccaacgugcuuccacugcagcacuaucugccucggcgagauacaggacagcugugugauucaacaaacaaagcuuaaaggcagaaaaagcauaauacaaccaaaccaaagccugaaaucuggaacuccuaacacgcacucuuuagcauacuuccaguaaggaucugcagggcugggaugucuguugguggugccauaucuuacacgcccaguacaugggcagcagauacaagcacuaaaaaaaaaaaaaaaaaaaaaaaaaaaucacuuguugaaagaauuacucagcagcugugugaagaacuggagggagauuuagacugaguguauuggggaaacggaauuucaauuccaccucugguucuaguuccugacucucuaguaagacuuaaaacaaauguagcaaagugucaaaguguuacgugcucaaaguuggugaauacucaguuacugagggugccuaugugaaauaugaguauguauguauacauauagguacauauauaugcauaccuauauguauguauguguauacacacacacacacacacacaaccuuuuacccuaugcuauauaugcuauaccacagcaaaguuuccaccacauucaugcacuuaccuguauaaagcuguguaauaucggucagauauugucuguugagaauucauuacuuggaaaaguagcauuaaagccugcacacucguauuaaaauuuacaacaugcaacacuuugaauaaaguguccaccugcucccucacuuugucgucaccuaucugggaguaaggguaugcucuguucaccccuguuaaaaucgcacugagcauuuuugauucaaugucuuuuuucuugauacaaguccgaaagaaacaaaaauaaagaguaauuaauuuguuagccaacucacuuucuucaugggagaggaccauuugguuuagaaagcaaauugcauaauacugagcuuuggggcugauauuugagcggaagaguagccuuucuauuucugcacacacaacuccuuucauauugggaugcuuccgaaguaacacuucuaacagaugggaggcuuucguagcaauucuguucugaggaucucccagcuuauuuaucaccugcacaagaagagccuuuuccuccucggguuuaucacagagcagcucaugggcagcuaccagggcccgcguuuuagugguuaccaaggaaucaugacuuaaagucucgaggaccuggacgaauucugcuaccaaguguuucaauugguguucauaauaccacaguaucagucuucuaucucucgaguccuuguugccacuggacaacucuuccaguuuguggaaaggaugcuggcugaaaacccggagcuuccgacugucuggcagaaggucugugaugagcaacuccuugaacguguccaacgccaugaggcacugcugcuugcugcccuucuuuuucacaaggcucaucaggguuucuacaaacugcagaguguggacagcaucauccuggauuagaaggaucauggccgccauccugucagcuagugucccugaugacacgauggccuucauccagguggaagagccucccuuuugauuguuugucuuacucuugaauaagcugacuucgugcucauacagcuucugggccagggcuuuguacuuggacacgacaucuggaggcugcagcuccaaggaauacucaccgcuguacuccaugucguaccacuugccuccaggccugaguaacauuguuugucucucuagaaauucaaacacaucggguuguuuaucuuucuuugcuuuggagacgggacagcucucaggacgcuguucugguacagucuuauuuuucaccuucuuuuccgaugucuuuuuuccuucuguugcuuuuuguuuuuuauucuccaccuucaguaguuuugcuucuuuuuugcugguguuuuccuuuuucucugguucaucuucuucaaucaaagacuuugaguauuuggccaaauucagauucugaauaaaugacuccaguucaccuuguugaaggucgucaaugguucccuuuuugcccccauccaccacuuccucauuuucauccaaaguagccagcauaagguaaucuugcuguagaaacacauuaaaaaaaaaaaaaaaaggccguauuacaaacccagaaauucaguaagaacuucauuuuuaaaaaccaucacauaugaauuauuacacuauuaucuggcaaacucacagauauccaacaggaaaaugugccaaagauagguacacaauagggaaaaggcuuuugaagaaccuucuucaagauaugaaaagauucucaagcugacagucacaaaauccagugaaaaucgcaaugaucuaggcacucguaaugcaucaggugagcaagguuaaagguuuaucugagugggcaggggauggcucagugggucaagucuaugccaaggagccuggugauuuagguccgauccucggaagucacauaaaagagagaaucgauuccaaaguuguccucugacuuccacacgaguguaccaacaaacauacaacacuccuuccaauaauagaaaguacuuuaugagguaguguagggaggaagaggcacuuucauaaaaggcuaauguaaacuggcagguucuuuuagcgacuucaauccaaccuuuuaaccuagcagauguagauuacacauacggucguguucaaaacauuugcccacgugguuagaauccgaucgccuacauuuuaacgaggcauaaacccaggagaaaacaugcaagccgaacuguuuuuuuucccacugaagcgcgguaacaguaaaugcgugggaagcucucagagcaggucggaggcugggcugcgggucccaccuucccggcagccgugagcauccccuuccccagagccugcggcccuuaccuuugugccuccgaggcguaacaccuccuccagggagaagccauucuugcccucaucgccauccuccucgucuuccucauccggaucuucugucaccuguuugggacgccagggcugcuuggcaaggaacgccacagguuccuggucggccgacauggcgggcuggacacgcgagugcagcccggagcuuacuuccgcuuuacggugacgcacuu

SEQ ID NO: 8747 - RNA, 18088 nt, Mus musculus
aagugcgucaccguaaagcggaaguaagcuccgggcugcacucgcguguccagcccgccaugucggccgaccaggaaccuguggcguuccuugccaagcagcccuggcgucccaaacaggugacagaagauccggaugaggaagacgaggaggauggcgaugagggcaagaauggcuucucccuggaggagguguuacgccucggaggcacaaagguaagggccgcaggcucuggggaaggggaugcucacggcugccgggaaggugggacccgcagcccagccuccgaccugcucugagagcuucccacgcauuuacuguuaccgcgcuucagugggaaaaaaaacaguucggcuugcauguuuucuccuggguuuaugccucguuaaaauguaggcgaucggauucuaaccacgugggcaaauguuuugaacacgaccguauguguaaucuacaucugcuagguuaaaagguuggauugaagucgcuaaaagaaccugccaguuuacauuagccuuuuaugaaagugccucuuccucccuacacuaccucauaaaguacuuucuauuauuggaaggaguguuguauguuuguugguacacucguguggaagucagaggacaacuuuggaaucgauucucucuuuuaugugacuuccgaggaucggaccuaaaucaccaggcuccuuggcauagacuugacccacugagccauccccugcccacucagauaaaccuuuaaccuugcucaccugaugcauuacgagugccuagaucauugcgauuuucacuggauuuugugacugucagcuugagaaucuuuucauaucuugaagaagguucuucaaaagccuuuucccuauuguguaccuaucuuuggcacauuuuccuguuggauaucugugaguuugccagauaauaguguaauaauucauaugugaugguuuuuaaaaaugaaguucuuacugaauuucuggguuuguaauacggccuuuuuuuuuuuuuuuuaauguguuucuacagcaagauuaccuuaugcuggcuacuuuggaugaaaaugaggaagugguggaugggggcaaaaagggaaccauugacgaccuucaacaaggugaacuggagucauuuauucagaaucugaauuuggccaaauacucaaagucuuugauugaagaagaugaaccagagaaaaaggaaaacaccagcaaaaaagaagcaaaacuacugaagguggagaauaaaaaacaaaaagcaacagaaggaaaaaagacaucggaaaagaaggugaaaaauaagacuguaccagaacagcguccugagagcugucccgucuccaaagcaaagaaagauaaacaacccgauguguuugaauuucuagagagacaaacaauguuacucaggccuggaggcaagugguacgacauggaguacagcggugaguauuccuuggagcugcagccuccagaugucguguccaaguacaaagcccuggcccagaagcuguaugagcacgaagucagcuuauucaagaguaagacaaacaaucaaaagggaggcucuuccaccuggaugaaggccaucgugucaucagggacacuagcugacaggauggcggccaugauccuucuaauccaggaugaugcuguccacacucugcaguuuguagaaacccugaugagccuugugaaaaagaagggcagcaagcagcagugccucauggcguuggacacguucaaggaguugcucaucacagaccuucugccagacagucggaagcuccggguuuucagccagcauccuuuccacaaacuggaagaguuguccaguggcaacaaggacucgagagauagaagacugauacugugguauuaugaacaccaauugaaacacuugguagcagaauucguccagguccucgagacuuuaagucaugauuccuugguaaccacuaaaacgcgggcccugguagcugcccaugagcugcucugugauaaacccgaggaggaaaaggcucuucuugugcaggugauaaauaagcugggagauccucagaacagaauugcuacgaaagccucccaucuguuagaaguguuacuucggaagcaucccaauaugaaaggaguugugugugcagaaauagaaaggcuacucuuccgcucaaauaucagccccaaagcucaguauuaugcaauuugcuuucuaaaccaaaugguccucucccaugaagaaagugaguuggcuaacaaauuaauuacucuuuauuuuuguuucuuucggacuuguaucaagaaaaaagacauugaaucaaaaaugcucagugcgauuuuaacaggggugaacagagcauacccuuacucccagauaggugacgacaaagugagggagcagguggacacuuuauucaaaguguugcauguuguaaauuuuaauacgagugugcaggcuuuaaugcuacuuuuccaaguaaugaauucucaacagacaauaucugaccgauauuacacagcuuuauacagguaagugcaugaaugugguggaaacuuugcugugguauagcauauauagcauaggguaaaagguuguguguguguguguguguguauacacauacauacauauagguaugcauauauauguaccuauauguauacauacauacucauauuucacauaggcacccucaguaacugaguauucaccaacuuugagcacguaacacuuugacacuuugcuacauuuguuuuaagucuuacuagagagucaggaacuagaaccagagguggaauugaaauuccguuuccccaauacacucagucuaaaucucccuccaguucuucacacagcugcugaguaauucuuucaacaagugauuuuuuuuuuuuuuuuuuuuuuuuuuuagugcuuguaucugcugcccauguacugggcguguaagauauggcaccaccaacagacaucccagcccugcagauccuuacuggaaguaugcuaaagagugcguguuaggaguuccagauuucaggcuuugguuugguuguauuaugcuuuuucugccuuuaagcuuuguuuguugaaucacacagcuguccuguaucucgccgaggcagauagugcugcaguggaagcacguugggucugccuuacauaugcuguguugaggaacuuuucuauuuucuauuuugcuuuuuuauuuuugagacagguucgcaccguuuagccucgacugcucuagcucugaaacccauagagacccgcccgucucugacgucugagcgcuagaauuaaaggccuguucuaucacuaauuuguuuuuauuuuuuauuuauuuuuuuuacaguugcacaucuguaucuaacuuaugaaggaaaauguaaaguaguuuagacuuaagccacacuuaccaugaucugaaucccaggcaguaguuugccaugugcaaauuggauaaauuauuuaacuaucaguaaaacccuacuggaaacuugacgaagcucauuuuucuuacuguauuuuauuaguaaaaugcaggcccgugcauccaccuuuaguccacauuaggaagcaccugcugcgcuccagcagugaaugacagacagacaacuggaaccuuacagagcagugcuuagggccagugagacggcccagggcauaaagggguuuacugacaagauugccaacuuguguuuaguccccaagaccuacauaguggagagaaagaacaaacucugaguuguccucuccaacuugcuuaucuccuuccauaggcauacaccacacacacacauacacacaccacacacauacacacacauuuuccaagaaaacuguauaagggaaaagcuuuauuugggauaauuacugaaggcuuucgucagugccugauuggaccccucauuuaggaaaacagcacauggaggaagcuuauaauagaacagucugauuccuuugacccuugggagaaaaggcagggaaacugaggacucugaguuuagggaacugcagagcauaaacagagagaacaucagaagaacugaaccuauuuuaggagcuguggacaugcagagaacauucuggacugggacgguggguaugagggagugcaugcuuaguccauugggucacaucugaaggacucagaauuuccguuuuaacuacucauagguggucuacacuagagccguguuggggguggggaggcugccccgcucaccucaagaguaaagaaaggcagacacuugggucauuucaucugugcugcauaggacagagguuauuucaucuugcuuccuagggcucggucuuuauuuuguuaacagcucacuguguagcccuggcuagccuugaauuugcuauggaaaucaggcugacugaacuugagagcugcugccucugccuuccaagaacugguuaaaagcagauugaguaggugucagcuuuuguuaauuggcguguguguaaccuuucacgaggggucuguaucacuauuuaaaaaaaaaaugagaaaaaagucacaaaaaaguggcucuuaacugaugaugucuuuccuuuguaccaguguguucuuucucucgggggucauugauucucacaauaucugauaagacagaaguaguugcuuauuguaacauaugcaggaaaggugucccuaagaugagguuguuguaauugguuguggagucuguaaacugugacuccuggaugugaggaugacuuuaggaaugaacacuugaccuugauuucauuugacagaaagauguuggauccaggccugacgacauguuccaagcaagcgauguuucucaaccugaucuacaaaucuuugaaagcugacaucaugcugcgccgggugaaggcguuugugaagagguugcuucaggucaccugcacacagaugccgccauucauuuguggagcguuguaucuugugucugagauccuuaaagcaaaaccagauuuaagaagccaacuagaugaucauccgguguguucucuacugcuucuugaccuuagugggugcuggugugcugggugggggcuuuuguguguauguuuuucuuugcuuuaccggugguaaguuaguuucucuggaaugugacucuagaguuggaaggagccagacuucacugccggguguacagcuaaauagaugggcagcuugcucaacuuuuccaucuauuacauaagaaacugcauuacauuagaaauugcagucauauaagggaguuauaggugauuauagaaugaguagacccuuuccguccauuuccucgguuaugaaauagaaauaaauaguaauagcaccgguugucgugguuuauaacaugacagauguuugaggauucaguuguaaaaucucuuggcugagaacuuggcucucguguuuaggaagagagucugucuucugucucaccuggguggccgucaggccuggaguuucacuugauugcuguuucuucacccuuuaccagaauugcagugagucucugaaacucugcaccacauaaaugaauacagacuucauuacaauucccauugauuaacagacuucauuacaauucccauuaauuaacagagucauugcuacauuucguuaggagucugacgaagaaaacuucguugacgugggagaugacagugacgaugaaaaguuuaccgaugcagacaaagaaacagcaacagaugcaguaaaggaaguagagucaaaggagacagagccugagagcagcgcagaggccgagaagccgaaggccgcuuccugggugcacuuugacaacuugaaaggugaaguccuuuggcuuguucccuugaacuucuaaacgaagggauuaguuucuucuguuagcuucauauaucuaugaguaugugugcgugugagcacacgcaugcacaugcgugugacaauucuggaggugcaaugcauagccauugugugugcugagcaaguagugaacuacaucugcaaucaugaagugaaauuuuguugguagggaaucacagauaaucuucauuaacagaauuccguguuuuaaauaaaccuuggagaucaagcagaugccuuugaggugugggaauuaggugaacacugauaaaugauguacacugugaaucauuaauuucuguucuaaauaagaguuugagccucaucgagccacuuuaaucagcacaugaaggcacccaccugugggccacaugaaguuugauuccugaauggaccuguauuugacacagcucuugacccuucuugauuuuuguguggcugucauauucauugcaguuucuuacagaaaguuuuuuuuuauuaauuuuuuauguguauguguuuagccuguacauaugccugugugccaugugaaugccuaaugcccaggaggccagaagagagcauuggaugccauggaacugguuuccagacaguugugagcaccauguaggugauaggacuugaacccagguccucuggaagugcagccagugcucuuaacuacugagccgucucuucagccccuuaaagcaaguuuuuaagauagacuuucugagaaauagaaaccucaggugucuauguacacacacaucagaggaaaagaagucaguuaauagaauauuagaaccaaaagaaagcuuagaaaugaggucuuuaucugaggccacaaagaaaaagaacaccagcuuugcacugagggaggcaguaccagacucauuucuuuuaggaccuguggugaaaauagcucagcuuuaaguguccacuuagauagauuaaagagcaugcugguagucaaggaaaguuuuuuguuuuuuuaaagauugauuuauuauuauaaguaaguacacugaagcugucuucagacaccucagaagagggcaucagaucucauuacagaugguugugagccaccaugugguugcugggaauugaacccaggacuucagaagagcagucagugccccaugagggaaguuguuaagggauucaucuguuggaagcacacaguguugugcuuuaggaggaugacgagcuugugcuagagcuguagaguuuacaguggacguuaaaaccuugcggggccaacgagacaacucacccagggaaggggaggcacugccccuaagccucauggacugacuucagucucgggucccagaucgugaacugcauggagacacggcuccuaaauacuguuuucugaccuccacaugcagccuauggcacuugcacacacacacacacacacacacacacacacacacacauacacacacaugcuuaauaagaaaaaguagaaagcaaaccuaagucucuuuuauuuuagaguuucugcaaacauacaaaucuguuccaggaaaaaacuuccugaauguaacuuaauagcaaggauuugcaauaccacaaaugaaaugcucugaaauacucuagacauauuccucuagguuauuuccaucuuuccuauuuaauacuuguuuucuuagcacuuucucuggcugauugaaaacuacugaagaaucggucauuugggagauggagccagcauguugcaaaguuuuuucaggaaaaaaaguguuugaguagacagacaucaagauaaauucuugaagggacuggacauuuuuaucuaacauuggauuagugaacuacuaacacuugaagauuaggucauucugugagaacauuaguuugaagcaucuucuugaacuaggaauaaaacauuucaaaaauucuguguucuuagguggcaagcaaauaaagacauaugauccauucaguagaaauccuuuauucugcggagcugaaaauacaacucuuugggagcucaaaaagguaaaauaguuucaacuaucuuuugauuaguuugugacacauauucuuccuucauagauuuuaacacauugaaucuuuacuugcaaaugaugaagaagcuaacgugaaagcacacacuggcaaaaacauaguguguguguucauucuacagaaacauuuuaacugauguacauguaaauaaaaauaccauaucuaguuuacaaauaagaauguggaugcauguggcucucuaacauguccugcuuuugugugagaauagaaaucuuuuccuauguuauuuuguaaaugaagaagaggaguuaggcuccuaauagccuuucuguaaccagaaggcaaugaauuucucccugugacucuugaaaugugagucuucugccaggcagugguggcgcacgccuuuaaucccagcacuugggaggcagaggcagguggauuucugaguucgaggccagccuggucuacagagugaguuccaggacagccaaggcuacacagagaaacccugugucaaaagaaaagaaaagaaaagaaaagaaaagaaaagaaaagaaaagaaaagaaaagaaaagaaaagaaaagaaaagaaaagaaaagaaaagaaaagaaaagaaaagaaaagaaaugugaguccagauguucacagcacuccauugagucuacaagaccacagcuacuguccuggaaauguccauguguccuuugucuguccuugugcuagcugcagcucugcugagauuaaaaaaaagaugggggaacugcugaugcccugugcaagucaagcugguguguuuguagccauuacuucuuuauauuccucucugcguguuccuguaguaaauaagggagggaaaagccaggaucacuugggaaugauuaagaaauaaauaaaugcaugccaguguucccugugugaauggaaagugcauauucccacucuugcugugcaccuaaguaugaaggaugagcugucucagaguagaacuuggucagcuguuccugauccauggagcuguauccuaauagacacugacuggcauaguuuacucugucugagauacauuugcuuguaaaugaaguaauugauucuuuugccucagacaaaacucacuagucauuccuguagucaacaguucauucucaaacagugccugaagaucaguccugccucucuacaaaguuggaugauagaguuaguguucacucuaacagugcaagucugugcaguguggaggaagugcccugcccauccaguguuucucaaauaaccaguguacaguguuccuaauucacuguaggugaggucuauacauucauaguggaccagcuaacugccagcuaaguagcaaaugccuaacgccauuuggugugguugauccuaccuggcaguuaauuuuuuccuuuugguauagcuucaaagaagaaaauccacacuucggugaaagacuuacuaacuccuuuuuuaaccacagaucuguuugaggcuagguucucuucauagaugcucaaacaguauagaacacugggaaggauuaaaaugcauuguguucuagucaccuaaacacacaggagauuuugaaaauauuacuuucagaaauagugcuuccuaauuuuguaaucucuguucugaaauacacauauuuuucaugaacauguuguuuacauuaauaaaugguauguauguuauuauuaauuucauuuuacguguaugaguauuuugcuugcauguguaugugagugcauccacuugcauaccugguucccaaggccagaagaggcugucagauccccuggaauuggaguuacaagcaguuaggagccacuguguggguucugggaccugaacucaggacuucugcaaguccaucaugugcucugagcugcugagcugucucuccagccccuggauuuauuaauuuaaaugaacugaaagcauuaaaauuuuuccuguuauaauuucuaauaaauauaaaaauaacccacuuagguggacguucuuaaauuuucaguuuuuuaaaugcauacaugguuugcaaaccauuugagaaucauucuuucuguauuagcuuaaguuuuaguucucuagauuuuucucaaauaaccuguaauuuuuuuaaaaagacuuuuuaugaguacacuguagcuguccucagacacaccagaaaagggcaucaggucccacuacagaugguugugagccaccaugugguugcugggaauugaacucagaaccucuggaagaacugucagcacucuuaaccacugagccaucucuccagcccccuaaccuauaauuuuacuuuaaaaacaaaaaaaaaaaccuuaaaaauaaugauguuuauauuuuuucuuauauagcuaucugaacauuuccauccuucuguggcccuuuuugcaaagacuauccuugagguaaguauaaaauacucuaaaauauguaaauauuauaggguuuugcggggggggggagguuagggguuuuggguuuuuuuguuguguuuuguuuuguuuuuuauuuguuggguuugggcggggguuguuuguuuuuuguuuuccugagacagagcccuggcuguccuagaacuccguuugucuggguuagucuugaacucacagagaaccgccugccucugagugcagggcaccuugacaccuggcuaaguuuuguaguuuugggucaucaguaauugaugguucaaauuucccugccauguagaaucugauguuuucugcuguuguugaggaccaaugucuaauacagagaacaaaguuggugucgugucucaugcagaugcuuauuacagacuggcucuccuggggacacgugcuauggccucugcuuccugggugugcuuuuucaguguuugguucugauaaugguuacauagucuccccuauauugccuauaaaaucuccaguacaucguacaauauauguuuguauguauaguuuuuuagugugguauacaaauauuguucauaucugccucagaugggacauagcagcagcuuaugguuuuccuguuuuucguauuuagauagauggguuauuuauuauuaaauccuucaguccucuaccaucuuuccaccuuucagggaaauuguauucaauacucaggggacccacugcaggauuucacacucaugagauucuuggaucgauuuguguaccgaaauccaaagcuacauaaaggcaaagguaggccugcauuauuuagugucuguuugguucucguugcucagauuuaguaugugagugaacguauaacugcauuagccuaucaugauuuaccuuucagaaaauaccgacaguguugugaugcaacccaaaaggaagcacuuuaugaagaaugucagagaucucgcugguaagcacagagccagggcaggugacuccaaaggauagcauacgacaguccaaugcaaacuauauucugugcccuacuuuaucaugauaaacaaaguacguuaaaugauaggcccucugacaaccauucccuagccuuggcaguuaaaccauucugccacagcucguagcugcuucagagcccaacauguacaguccauauccuguacagcucaucccaucuuaaacuccucuaacaaaagugagcagcuggcucuuccaugcagcaccauuggcagugcaguugaagucccccugugguccccguguggucccccugugguccccuguggccccaugugguccccuguggcccccuguggucccccugugaacguguauuugguaccaaucuucagaucugguucuacuucucuguucagcauuucuucacacaccaggccccaccuucaucucuugcucagaaauucaguugagucaguuuuaauuauuuccagccaacuuccgagaaauccagaaaugucaacaggguuacgcaggcuaaaauuagggcuguaaggcaagccaaucgcuaaaucaaaucaaauuuuauuucauuaggaaaaaagccaauauccuugaauucuuuauuuuucucacuucuaaguaaaauuauggaaaguucuguugauggauucuuccugauuuuaaacugcaagcauuacauacuuuucuuccgagacaaccagaguugcuauaacccgcgugugggugguaggagcagaaggaucaagaguuaggauuaggguuagcaacuucauaagaacucuuccaggggcuucagggguuaaaaauacuucacugggagaauuccaggggcuucagggguuagcucagggguuaaaaauacuucacugggagaaggcccaaccuugguucuugucacccauauagggugucucucacaaccaccuguaaccaccucuggggagguacagcaucuguggcuacugccgacaccugcagucaaucacaucuuugcccacacauguacauauaaagaaguaaaucucaaauaauuugguucucuugaaacuugugucgugagugcaacugaaaaacaauaaaagaaccuguugcuccacuguggcuguguucuaccuguucuccgcaggacagccaagaguuuaguaugcugaggcucacacacuucagaggugugcucuguacuggugggcuucuuagccaacacugucucguuucaagauuucagaaccauucagcaguggugacucacaucacagccagggcuucacagagaaacccuuucaagaaaaaaagaugucagaacugccaguauguuagauauaguaugaacaugugagugcugggaauggguguaauaugaugcuucauucugcagugaacagcaaggaguuccuugcaaaagaagaaagccagaucccaguggaugaaguguucuucuauagguaagauaccuagaacagcauucuuaggcacuguuuaaauguuuauauuugauauauugcuuuuuaaguuuuuaauuguuuuuguuuguuuguuacuuuauuuacauuucaaauguugucccccuuccuggucuccccucuguaaaccucccaucccaucuuccuuccccuuugucucuaagagagugcuccuccacccacucacccacucccaccucaccacucuaguacccccuacacuggggcaucaaguuaacuaaacuccugauccuucuguauauugccaaagaugacugugauccuccugccucucccucccaaacgguaacucuuuagugucucuaucuguguugguauauggcuauaguaguaacucagggguaauuuguucacaccaugauccuucaggcagaaggauccuuugaaugaagugagacugauugaucuuuaaugucacuacugaugcuucuagugccuuuaauaugaugucaaguugucugguugauuaguuaauuagguuugauuuaaauugcuuuaaaaaacaaacaaacauuuauugugaauaauuuuaugagugugaugccaaaaguaaaagucuuaacuuuuacugugacuuugggugggcugauuagcgacuuuaggucauuuaaaaccacuauauucugauacuuagauaaguaguguuaaggugaaccaaccuuuuacuaugcuauuauuuuacuguugugugggauuaaacucagggucuuguucaugcuagacaacacuguguacacccuaaggccucuauggugccauguuaaaauguuugaagaaauggcuuauaagacacuauaaagucuugaaagcugcuucuaccucacuuaaaagugcuugguggcgcauacuguaacccagcacucaggaggaaaagcaggguugaguguccagagccagccaaggcuacauggaagaguaaagaaaauuaugccucacguuuaacucaacccuuuuauauugaauacaaauucuacucauuugugcccauuucaguauccauaacacacuuugaguuguaauuagucuuuaguuauaaauuauacagauauguaauacgcauuuuacuuuagguauuacaaaaaaguugcuguuguuaaagacaaacagaaacgcagugcagaugaagaaaguauagaagauauugaugaugaagaauuugaaaauaugauugguaauuuguuuuuguugacucaguuuguaaaauuauuaauauuuguuaauagacuguauaauauuaguaguauaagugaacuuaguauuuacaaaucauugaucugcagacuauaauggaagauuaagaaauagccuauggugaccuuacucauauucauucuagaaaaauaacguuauugaacuuugcauaauaugucagacaauucuguuugcaggcagaguguuuucauuucucaagccaaggcucugaugacacagacacuguuuaguuuucauaaucuccuaguuuuaugaguagcaaugucugcuggguuuuuuuuuucuuuauaauccuuacagcuuggggauuuuuaguuaacuguaaucaaauaaaacuacaugaaaauggaaggguuuacuugcuguuauauccuauacuugauuaaaaauaaacccuaaaguuauuuuucaacaaaagaacuauagacaggaauuacaguaacagacuccauuuuaaagaggucacuaagcucauagguuugcauaggacaaaccagcagcaguccuaauaacgacauucugcuguugugaaauccugguucugugucacggcugacugguguguaauguguaucacucuuguccuugcugucucuuacacuguuuauaugguucucgcgcagacacauuugaagacgacaacugcuucccaccugggaaggaugauauugauuuugccagguaaaacgcagccuugucuuuaccauuucccagucuuucccagauuauuauaguucauuagaagaggaggccuagaaauuacaugaucccuaagggaaaugcucaccugggcuugaaccuuuagaaugcuugucuccugagcacacuuuagaagacacagccuccuuuacaaguguuucccccccacccccacccccagcaauaugaaaaaagcaaaaggagcuaaggcugacuuggaagacucagagaguagugacggcgaacuuggagaccuggaugacgaugaaguuucucucggaaguaugaacgaugaagacuuugagauugaugaagauggaggaacguucauggaugugucagaugaugaaagugaagaugcuccagguacacaaugaaaaggaagauacagauuauauagcguucuugcucauucuuaggcuaggcuuccauaucuaaagaauacacguaucaguacugaacugauuuuaagucaacagcuuuuucuacccaguugcaguugagcugucauguugccucuuuuuaucauuuaguauaagggacuguaguguagcucaguaguagaauacuuccuaaaauguguaagguccugggucucugagacacuagaguguccaguauccuccaggcccauucuguugggauuggaggacuggacacacauggaacagauguaccaggccuugauguugcacugccacuacuggaauugguauuuuccaggcuucuuacuguguauaaaaugguuuaauagcaaacuuucuuggguaacagaauuugcugacgccaaccccaaagccaauacuaagaaaagcaagagaaagagugaagaugauuuugacuuugcugggucauuucaagguaagaaaauacaugcgcucucuucaaaccauagcagcugcuauaugaagagcaccugcuaccaacaaauaucuuggaggaaauguuuuaaauugcuuugauaccauuuagaaaauguuuaagaucagcccucaggcaccuucucccauuugucugagacaagggucucucuuaggcuuaggacuucaccauuuaggcaaggccaacuguuccacaaggcucuagacacgcaccugccucugccuccucuuuccucacugacauuacaccacuacucccagguuuuuaaauggcugcugcagaucugaauucuguugucacucuugcgaugcgaguauuccaguuaaaccaucucccugccaagaaaggugcauuaagaguuauaacaacagaguugugaaauguggagagguagagaguucucgcaugcaaccuuaguuuucauuguucccaagcccuacccucucacauuuaaguauuucuagaugaucuuuucagucauguuucaagaguccaguuauauaugaacccuaacuaucuuacuacuuuaacuuucuugaaaugucuacagauucaaaacuguaggugaguuuuuauagacauuuuauuuucagugguauaaauaaaacuuuacugauaaaacaauaaacauaaucagcuuuucaagcccaaagaauaagacaugaauuacaauuuauauuuuguuucacauauuacaaacuccauccaagucagcuguggaauuuuaagccugagugauacuuuugguuucuuguaaagauaaacauugaucggggaccaaaucugaaaaauaaguauaugcuuugaguaaccuacacauaauuuuucuuuaggacaaaagaaaaagaagaaaaguuucaaugacuccagccuguuugucucugcugaggaggugaggcuaauguacuaacuuaagaaaguagcuguuuacauucuuuucaaguuuccuaauagccuugcccacccuuccuuucuuuuuucaguuuggccaucugcuggaugagaauaugggcuccaaguuugauacuauuggcaugaacgccauggcuaacagagauaaugcaaguaaguaagcuggugguguuuguuuguuuguuuguuuguguuguuuuuacagcagggucguagcccaggcugaccuugggcucuaaauccuccuccucccaagcaguaggauuacaagugcacuaccaggucaccugugucauuuaaaugguacuucccugaagauguccuuaguggcaggauguuugucacauagcaaggcauuuaaaccacacacacaaacugcagacccacacacguuauuucuucaagagucugucuguuuuauuuagacuuagcuaaagguguacucucacaugcuugaagacuuuguaauuauuccugauguuauaaucacuaguuucuauucuuucauaaaauagaaaagaaaaaucuuuccaguauaaauccuauauuuucacuuguaaauuccucaacuauccaguagaggagagcagcaaacagugggugggaagccgcaggccugcaguuacggucagggagcgucuguggagucccggguacagacucaucugucgucuccccucaaagguuucaaacagcucaagugggaagcugagcgagaugacuggcugcacaacagagaugugaaaaguaucaucaagaaaaagaaaaauuucaggaagaagaugaaagccccucagaaacccaaacggcagaggaagugacaucuucagggugacaauaaauuaagauuauacuuacccuuaguuuuugcuagucaaccauuuuuccucaucuuucucucuaacuccauacauuccagacuguucaauggauuuguaauaaacuguggaaacaaaguacugucauuuauaaaauuacacaaaauuuaaacuuauagugaaagaauucuuccauauugcuacauagcaaacgaaaggacagcggggcuccauguccacacgggagcuguaaccacucuccagaccucugugaugggcugcuuguccgggaccagguaccaugcuuaggcuaagugcaugaugucacuguggucaacucuaacuaucagggucagcguuggcucuccccaagagaaagcaguaucucugagaacauaguacaccggaggaaaacagucuuuacagcaguaacuaugguuugugcccgucccaacccuuaggucucgcucuggaaucuauaaucuuaaccacugaacgaaugaaaacuccagcuggcacgugggguauauaacucagugacagcacuuuuguccauuguuuauaaagccugcagguugaucaguaaacaggggaauaaggauuaaaacaagagcuagcuguucucaucuaaguaauaggugugaguccuuacuguguggucccaggaagcaacuaguguuugaaaccaauaacaaaauaaggucacuugcucuaaaguuguaaaaacaucacagaaucuauagguuguuucacacuugaauuuuuacuugaagaaaaacauaccuuccaaaaugaauggaaauuucuugcucauuguuugucugaaaucugauauuaaaaaaaaaucacuguauuaacauauuaaacaacaauuuaguauau

SEQ ID NO: 8748 - RNA, 79189 nt, Mus musculus
gagaggucaggugcagccacuggugaagauucaaguagcagcugaagccccgggauugauggggggcaggggggggucacagaaagaagaugaggcuuggcaccaugaagagaacccaaggggaagcaauuagcaaaagugcagcccaguugcugcaggaaaccccaggauuuuggagagagcagccacagacagcagaagccauugaguggaacuggcuugaucugugcuaugguaaguccucugggggaguccagaagauuaugagugagcucuggacauuggacacugaguuacugaugcuguuggagcuuguuuuguucuguucaaacuguaauuguggccugguucuuccuacuuggaauaagaaaaguauuuauuuuuauuuuacaguagaccacaauugagagacuuuuugaacuuuuaaaaagauuucgaaguaagaaaacaaaacaaaacaaaaauuuggguuuucaaggagaccuuggauuuuuaaagguaccaaacuuuuaaaguguuuggguuuuuaauaauuuugcauugugauauuuauuaauaugagaucuugggggaaugaacaaaaagagaaaaauuauuguuaaauagugcugcguugguauuuuguguugaagggucaguuguugaauguggggucacauccugugccacuuaaaguuuggccacucauccucaauaaacaauuaaaagagccaagcugaaaauggaaagaagaagguuuacucaagguggacacagugggaagagggacacgcccuuccccacuccugccccucacccccaaggccuucuucaagggauacauauuuuuaaaagcuuguauuugagaugcagguuaagucuagaaaucuccagugaaacaggaagaaagucucuaaaauugcuuuccagagguccccaaaauagaaugcuaagaaaguaaauagguacuaggagaguaccuagcuguguaacacaugcuuagcauggaacucuggguucaaucccagaacaaaacuaacaaauaaaaaugacacgaauucacagagauagcaacagucuuuaaaaauaauguuuguuuuaccauauauaguagcaacauaauaccauaacucaaauuccaccucuaaaucacacacacacauauguauauauauguauguauauauguguguguauauguauauauacauauauauacauacuaaguucauauauacacuaaguucauauacauauauauguaauuuuuaucuagacuuggguuuaaauuuagacuaauuucaugcuaguuuguuuuauuuaaauaucuauaaacauuagugaaguauuuugaguguuucuguaauccuaaaacagcagauguuguggucauaaaauuauuuuugaagacuaguuuauucauacuacaugauucauuucauaaauuagaugaacuaauccauuuucaguuuaauguuuuuugaaaaagcauuucaacagagcugaucaucaaccagagcauucccaaauuucuacccccuaaagaagaagcuuaaaauuucaggguacaauuauagcaagacuaauccccuucugucacugacaaagcuuugucucagauacauaucacacagaacaugucaguuucaaccuagaaauuuggacaaagcaaaguaauuugcuucuccagcaaucuggaagaagaggcaagcaggucucuguagguuccaggucagccugguuacacagcaaauuucaggacagccagauaaccccaaugcuauggaggguagagaaaggaggaccuggccaccaaugucauuccagguauagugagagauccugugucaauguaacaaaacagaaaaugauguaaaaggguaccugauauauuccucuggccucuacaugcagguauguacauaaacacacacacacacucucucucacacacauucacacacacucacacacacgcucacauacacacacacaugaauaaauacugugauuuuaagaaagaaaauaagacaaugucucagacagaaaaugggugccauuauauauaaaaugaaguaaaaauuauuauucaagguuuuuacaggcugaaaauaugagaggaauaugaaauaauagacaagcagcaugacuacucgcauaucuguaggauuacuuguguuuaccagaucauucaguuaguauacaguaguauuauuuaaauauaugcauaccuucucaauauaaaucuaguugugugacccuuaaagacaagacaauauucuaaaaguauaguguuaugugacuucaucacuccacaaacaucagacuucacaaguguaguugguacuacaaaguacacuuauacguuuguuuuggguuuguuuguuuauuuauuuuuuuaugauugauuuuuaugugcacugguguuucaccugcaugggugccugugugagggugucagauugcccugggacuggaguuauagauaguuugagcugucguguaggugcugggaauugaaucccaguccuccggaagagcagccaguacucuuaacugcugagccaucucuccaguuacccacauguaaguuuauaggucugguaugcuugguaugucauauuucuccuagggcuaugauaaacaaaaccaacaggacacucaguccagcacaagaaaaaccaagagacacuguaacuaugagacacacgagguugccaucagcaaaacacaauguagcgcuuuauaguaagcuuuaaaaaaauacauaaauagaauuauugcacuccaaaauaauaucagugauuggcgcuuagcauuuaugaguucuuagguucagcccucagcaccaauggguuaguaaacaaggaacaagcaaggauggugaaugcagaagccgugacacagagcuuauugcuaucccuuaguuaucacuaaguuucacgcacuguacacgacuccauaugcuuuucuuugcugucgcugacagcacaggccuguuuaucucaucauggucacaugagacgaacuucucuugcaguuucaaccucucucgcuucccuucugcuuauaccuuuuuacacuucucuauacuauaggucagucuauauuucaguuaauaauuucaacaagagcuauuucccccuucagaucaaaugccuugcacaaauguuugagacgcauaagugauucucaaauguuuagggcaucaacaaaucaaaggcugugaagucuugggggggggggggacaaaaccaaacaggcuaaaucaaaaccaaccagacuucagcuaagccugccaucgucauuaaaggaacugggacaguuuaacaucaaguuaaauaaucaaaugugugucugucgauacuugaaaguuuuuaaguuugagguauaaucagaguacaaguuaaaauaaaacauacaagucauuacagucugaauauaguaaaaauaaaacccaaugaauguauuuauuuaucuacucagagauuuuauaguccaccaaaacaccggcagccagcagcauagacagcaacgguucuggccacccgaggguagcaaugggaccuuccuuugaugaaacagaaaggaaguccuucuacauccugggccucuuuagcuuuuuguuguccuuuaaaacugacacccacagaaucaaguucagcaacucguuucuccgacaagauuuuuuuaaaaagaaagagagagagagagagaacaaaugaacaaacuucuuuaauaugacuuauauugguaucuuaagugguaccugcuguguauuuucugcgagcuggcgauuaaaaaaaaaaaugcuuucugagcauuuuuccacuuaauccuugugacaacuuacaggguagagucaacacucacuccagugaagugucacuugguugugugacacauaccaaggcagacuaaucacauguguacugcuuucuucagucaauucucacaagaauccuaugauguauaaaauuauuuccccccucauuuugagcaaaauuaauucuggauaagauuaagguaaaugguagaacguagacuugacuacacucaaagucccaccccaacucccuccacucaggauauucugaguuuuuucacguggugagaaagucuggacuucuaugguuucgucaguccagacgugauaagccuguaauagcuuuguucuuuucaguuuggcucuugggcuguaacuaguugacacuauuucacaacagagcuuuuuauuaaaacccaggacuccauugucuaaggggacuugauguuaauuccacuuuuaagaaacccauaagcaucuacacauuaccugucuguaugggaaagccagaaagacaaacggaaaucccugugaaagacgacaagauaauuaccugucuguaugggaaagccagaaagacaaacggaaaucccugugaaagacgacaagauaauuguguccuuucucccauuaccugaauuuuaacuuguaagaaaaagauagaaaaccuagguguaacauaugacuaucucucccuuuaguaauuaguuuuuccuagucuucuuauuugucaaaugaucauauaugcucuuuuaugauaugcucuuauaaauacguacacuguuaucaauguuauuguauauaaaauuaaaugaaaaauauaaagcuaaugaaaguauuguuaauaaaaauagguaauauagaauaaacagagaaaucuauauaaaaaagaaugacuauauuugacucagggcugguaugcaauuaauggugguauuauuaccagccuuugaauccuauuaauuugguccuuguuagaagaggguagggaacuauugcaggguuuagcauuugauguuuuaggacuauaagcuaaccaauauaaucacgauaaugaagaaaaaguuuucuaguucagcuaaaaauuuacuaaacccuuggaacuaaugaaugucuuuaaucccaacagaggcagguucaucucugaguuugaggccagccugaucuacauagugaguuccaggacagccagggcuacacagggaaaccaugucucaaaaacaaacauuuacuaagccccgugcuaagugaugaaugaauaacaaugaaacguguuuuuccacaaguucaggagaggccagggcagauccauaauaaagacgcaaagaaaugugguaagugacccgagaguugucuaugggacaaucaggagacagagcaauuacagcgugcaaaaucagagaugaagauggauuuaaccagcaugaacguaacaguucgagcuagucuaggacagacuaauaaaacaucuauuggaguaaccuacacugacauuguucuaggauaacuguaauggaaccagguggggugcuaaaagacuguaacuagugugucuaccaauaaagagccuacagcacccccccccaugaucauuuuauuaacucuguguugaugcuugaaugcuauauaaauuuucagcuguguuccagggucauggaaaaaaaaaagacccaaacaaaaugaguuuccaguagccauguacaauaaaucaaacccagcugaaguuuuaaaauaauggcuacuuccucuagcaaguccucagcaaguggugguuuucugcauuuaggauucuaaaucaggaagcucugcucucucaacucauaaccacaccgacccucuuugcuuguauuagguucacacauguaaaugauuaucucauuaaggacaagaggggacauuaaacgugaggacaggaagauuuacaaccaaagccagugaaggagaagauacaaacuccuguuuccauuaaaaacaaaaccaaaccaaaaaaaaaaaaaaaaaaaacaacccgagaagucuugaacauucauugaacauucagacuguaguucucuuagggauaaugaacacuccuuaagaaaaccaauguucaucccuuaggacagaagagaacaugcaggaaaauuguggcuuauguucaggaaaggcaagauuucaggugagaagacaguagccucaaacgaccuguugaaagauuuaacuagagaaaggaauucaaaagcgaaacagugagaauucagcucaaugaaauauuuauguguaaaguauguauuucgcauaaacacuuaaaucucuguagagcagcaguuuaguucuuugagaaaguuacaccuaugaaaaguaacuguuucuuaagggccacagcagaaaauggaagucuagaguugguucaaacugaaugcaaauugcucugaugagauccugcgagucuugcugagagaagauauuccuggcugggccaaaacaucuauugugaagaagagagaaagagagaaagaaagaaagaaagagagaaagagagaaagagagaaagagagaaagagagaaagagagaaagagagaaagaaagaaagaaagaaagaaagaaagaaagaaagaaagaaagaaagaaagaaagaaagaaagaaagaaagaaagaaagaaagaaagaaagaaagaaagaaagaaagaaagaagagagcaguuaggcaagggaacgcuuaagaagaggguacacuggaaugaaucugcuuuuaaucuuaaaguaaaagaaucacaaaauauauuuaaagagucucugucucucucccucuccucccucccucgcucccugcccuccaccaccaccauuuugaucauauucacaacccauacccuacucaauugagccccuucugaacugggcccuuuccuuugacaccuuuuuuguuuaguuaggguugccugcauuagugugaguggugucuggguaagacuuuaagaacaaagauguaaucagauuuagauuuuaguggauguuggcaguuuccgauuccagagaaauguccgaaauguccucccaccccuuaacgcucccuguagaaaaagauuauacacaguuuuguuuuaaaagccucacucccuaggagacgaggcugcagcuaguaguauggucagugcuuuagcucuucagugaccuugugaguggguucggucucccauuucuaucccugggggggcagggagaggucucacuuauuucaaauccaggacuauccauuaauauuacagauucuguacccagauuaauucuccccuauguucucaaaagcugccccccaccccgcuuucugcauccagacgaguggccuuuaugacaauauauuuuacuuugaagauauaaaacgucgacguggaagaacuaucuaguuuuugugucagugacuguaccgcgcagauguuucucuuucaucaacuauuuauaauuuaacacacagggcuucuucucucugagguuccaugacugucgaccgcucuuuugguagagagggcaacgcaccaguguuaaggugcacaagaggaaacacaggcacgugcaagcggcgucuccaaguuuugcuguggcgccggugaaggacugugucuguguagcucuggguguugggugacagcugcccccgggaacgccgaaagggacaacuuuggaaaggaggguccuccacucuggacgcugcguucagguggucaccucuugucaccgacugccagcgcccgccuagggggacagcaaagugagagguucgaguacagcgcguccuuccagucgcgcucaagcccgcgcuccgagcgcccgguggggaccucugcggguuugcagagccuccgcgcgcccccucggagccagacccaccaaccgcgcgcggcggggaacuacagcucccggcaggccccgcgcgggccgcgcgcccccgcccgcgcgccccggccccccgcccuccggccucgagacgggacgggagggagggcaggaggaaggggcgcgggcgggcggguucgugcgaggcgcgugaagccucgcuggcuccugcuccgggacgcggacgcuggcgcgcgccgacuuucuccagaacagccgagcccgccucuguaaguagucgcuggagggagcgcggagcagacaccgaaaaaaguucgcgccgccgccgccgcugccgcuuuguucucccgacccgucgggcugagguggcgcggccccucccccaccgcaugcggcggccgcggcgacggcggcgggacucggacccgcgcggggcugggcggcggccgcggcugggcgggaagucggggcggugcuccgcgggcggccgggggcgccggcgcggccaaguuccgcgguccgcgccgaggccaaguuggagucgcgcggcugcugcuggugacccaccgcgcccuggcccucggggacccgcuuucucccgagccccgccaacuaauccugccgccggcggcacggugcagugagccuucccgguucuuugcugcacuuuuccugguccuggggcuggaaggggcgaguauccgggguuuggaggauagugaccccaguuuccugacugccuuuaggcuugccuguugcagccucgcuccaagucguucucauucccugggggagcuucgcccugaguugaaacauccgcgaguguggagcaauaaaauaguaauaauaauaauaauaauaaugagcacacacgacauuacuugauugcgugucggguauuuuaguucacaucgucgaaaucagaaguauaggccgugcugucagcaagcacgaauauaaaucaggcuacaggcgaccugcagacuuuuccguacacagauugauggcauggauguaacugucccuucaaccacgcccguccccacaggaaauaugacuaucggugucaucuuugauuaaagaggauaaguuucaacaugaaguacuacuuuguaggacagggccuuuaaaaccuguaggcacaaaugaagcaacaguuugagauacuuucauccauguccuagaaaaacguuauuacacuaaaaaguuacuuuuacucuguaccugauguugcaguuuuagcaguuuugauuuuguucagcuggaguuuaaacuuuuaaugccaggcggguagacaagccuacggauuugcuucaagaaagcaucccugaaguugccagacucaguucugaguaacauuugcucuagaagaacauuuccucucccaguuauaaucuggggugggauaaaacagcaguuuagccagaaaguuguuucaaguuuuugcaaauauauuauuuuuaaaacgucucacgggaaccguuacaauagguuuugcuucauaggauagguuuauaaaugucaugggccugagaauauggguuuggaggcaucuuugauaagccagggcaguucacauuucaggacuguuaagacuaaaagaauuuuucuuaaauguguuuggcaguuucauacauucugaugcccuaccccucacucucucuaguacccccuacccccucaccaaucccuuaaagagguuuuauagccaugagccuuuaaucuugcacauuguauaagcuauuuuaucagaugaccuguuuaaaauagacauuucuuucuguuuuuguguuguuugucaucuaaacacugcuauacacaccaaaagccacaguaaguuaaacuuuaaaagucagaggaguugaaaacaccucauacauaaagauagagggaaagagaguuguuaaaguguacuuuccacagaagggacagacaguuuucaacagaauucuaaaguuggcaaaaauacuaaccauagcggaguucacugcuuguuuuuaaagacacucauucaggauuugauguauaauuacuuacauauaauuugauuaggcacauaauuggauuuaauaaucacaucucuugagucucuuggguuauguaauucaaacagaacuugccucuuugaagcagucauuuuaaaaggaaaaacugggaugugguacuuaagaaauguuuuaguuuuaauuucgauguagauaaaacauuuucucugcucguguggugaacuuacaguggcugcacaugagaauugugcuuuggcaauuagccaaucagauuucuuagaaacuacgggugcagggcugaagauauaucaagcuuauccauagcuucguauugcuuugccagacugaugugccgguaccuggauacaccucucagugccugcgcagagaagcugccuggugugcccucucucuguucuccaacacgguggaagggcagagagugaaccgcuacccggagaaguagacuuguagaaggaacaauuuagcagagugcuaagcucuuagaaagacagucuucuauuaaucugagggaauguuucuggaauaugcaauugauggagagacugccacagauuuuuuuuuaaucuacaaauauaccugaguuuuuuguauacuguacaagcauuaagcaaagucagaccuuuuucgagguaaagcguggauauugacuucaguguacuggcaugucacuggaaaagcucccaugcuucuuuacaugcucacacaguacaugccauacacaugugcauauccucacgagggucaggauaaaacuuuauuaccauuccuuguacacaaagugaaauuaaaccuggacaacccuuuaccccugggagucacguaaacaugguauuacaaaggaaaagcauuuuuuuuuuuuuacucuucauguuaacauuugcagaaugcacauagaagguugguuacccuaaauaaugagagccccuccuuguaguauuuaacgugucuuguucucuggaauccucuuacuuguuucuuuauagagaccuucccugagaccccacuggaauuaagucucccuggcauaugcucuguuguaucucauagguuguaauuaccuagcuacuuaugcaaauguuuguuuaaugucugugaguuccagagagagcaguggccaugucucuuucuacugcugcugugaaacuucagugucuuucuuaguccucuggcaaguaucaagguugaaugaaacuccugcugguagagcuucugaagagacuugguugagauuggcgcauaauguauggcaaugaagugacagggcagggagggaaaagguagaucagcuugugacauuaccaugaaauauaacagcccaguuaccccagucaccuggccuccaagguuuuuguuuuacuuuguuugggugcacugagcucaaaauacuuuuugauuccauucaguggugacagaauuuguaaguucauuugaaugagauaugugacaacggucuaaaagaaugguggaaaaaaaugccaacuaaacuuaauaaauucuugacaacuagacaauacuguucuggcuuagagacucucauagcuauuagaaacaacauaucuaauacacaauuuauauaucaacgagauguacuauuuguuaacuuauaaacuguuuucuauuugaagcauaaauacaaagaaauuaaacagcacaccaaaguuuauauaaauuagaauuguuagauuucuuacagaucaaaccaauuccauaaacaaaaccaggagagagaagacagaugggaugagugggugggagcuguuaagacagguucuuacauuucuauucaugcugaagcuuuaaaaaaaacacuuuuauacaaaauuauauauaguuuauaaggaaugugugucucuaguaaauuaaucaaguguguuauuagauuguuacuauuaauuaaccucaagugguauaauaaaaaguagacuuaguagaauggcaccuuuuaucuaauugcuguaaaacuucugaauggucugagugcuacaguaagccagaugcugucauuaguaacuggcaggugccguccuuauaacccgggagucccacaaguguugcugccaguuucuuuguacaucucucaaguaaagcugagcuaaaaacagcucugccuuaauacuucuucagauauuugaggaccacucauucugauuggcauaugcggcguagcacaugcccuuaucuucaugguuaccuggauguuugcaguuguuuucuucccaaaccuaaaaaucuguaacucuaaagauauggauuauagaaugaauagucucucucucucucucucucucucucucucucucuuucucugugugugugugugugugugucucuguauauucuauccaucucuauauauguauguauauuugaauguacagucuauaguagcauaggcuaacaagugugcauauuaaugcuauggcuuuccaauguccagagguuuuaggauugucuuaguucuuugagugagcccuuuauauucacagcacuuaccuuaagccucagauacacagcccacccucaugaauggcuuccagaucagcaucuccccucauucugauguugcacauuuaacuuggaauuuaucucuguugaguuucacuuuaauuuuaccaccucugcucaguuuuguucaaccugaagaugacauaagcagauugucuuugucuuuaccauuucacaucucauggaaagacagagcugagaguggcuugggaacauuuccccaaggacuccacacaugccaguugacauacagcagauuccuuaccacacugaugcccagcucaaacucagcgcgguuacagagacaguagggaaaugcuuugacuaccguuuccgugagauuguagcagccuugagugaguaaccucugaacuuucccuuucucaacucuaaagcggcugguugugcagauucaugaggugcgccuacgugggguugagacucgugucugucagaucccagauaguaagaguucagcgaaggucacuacuuacuuccuccacuugagaagucuagacuuuaugaaguuauacgugugauggacuuagcauuucuuguucugcuugaaauuaggcugauaugaccauuauacuauccucuagcuauucacaaauaauuugaauaacaaucugacuaaagguuuucuuuacuuuuuuuuaaaacaauuuauuuauuuuuauuuuauuuacauugguguuugcuugcauauaugucugugagagugucagaucuccuggaacuggaguuucagacagcugugaacugucaugugggugcugggaauugaaccuggguccuuuggaagaacagcuaaagcucuaaaccucagagucaucucuccagccccuggcaaaggauauuuaguuucuuugguaguuucuagauugugcuuaucugcuuuuuggugcucugcacuugaagcagcccugcccaucccaggccguggucucucacccugagcucuuucugcagguuauugcacaauagucaugguuaaacuugcucccugcuguaugggaugagcugcauccuggcccagagacuugcacucacacaaaguuuuagaaucccagcauugaaaagguggagauagaaagacuguaaauuugagaucauccaaggcuacaugaguuugaagcugaccugggcuacauaguuagauucaaaagaaaagacauuaaaaaauaaagucauuuaauucucuuguauucacaaaguuucaguucucugaguuagcuugaaaacuguugggagacuauuagugcgauacaguuugagcaauucuuucuguguaauuguucacccuccucucuaaacugugauucucaguuccuuguuaucuuuaagaagcaggaguuacugugaaaacaguacugguaagaaagcaugagacuuggguucuaauccccacucuguucauagccaugugauacuaggcacauuguucuagcacuuugugcuuuggucuucucaucugcaaaaaggauauuucccuguuaauugaaaaaaaaguaucaugaggcauauuagugaaacauuaccaucaaaugcuauaaaguaggaguuugaauucuagccauuugcccaaauguuacuaucagugcuuguaucuuuaaguuauuuuagacucauuuuauucugaauuuucgcauuuguauuucuguaucucuguguuuuguucuucauuucauacaucucauucguuuuaauuuaacuccauauacucauuuccacucugcacacacuucgaaugcuuugaguuuucaucauuguaauuauuuaugacuacaaagaauuuagaaggauucaucucuugugagccauuccauucagccaugaaggguuaugccuuuuucuuuuucuuuuuuucccuuuuucuuuuccuuguccuucuucuuuuucuuuuucuuuuucuucuucuuuuccuuuuccuucuucuuuuucuuuuaaaaaaauuucuggacugugucuuccuaaaacuuaggaugcacaguuugcugguguacuuucccaguguuagaaaucccuuaacgaugaugaguucacguucuccugggcuucauaguuuaucagcagucacagucgguccuugcugacuccaguguauccccauuugcuucuuuaggcuuccggaaggcauucgucaacaaagcaguccaagacucguauuuuggcagaauagacucuuuuggaggaaugagagaaguggagaaaaccuagggccuuuacuugcuacuaagucuaguguauucucacuagacucuuaauauauaaaaacauaaaagacuacuuaagcuuuccuguagugggaaguuauucuguauuucuaaagaggcuugugucauauuuuaugucugugauguuuguuuuacuucuccuguuuugucucuucugucuuucucagugucuuaucauaauugaguuguguaguuguggaauaacaguguuugaucuucauaaauuuaaaauacaauaacuuacagcugggugcaaugguauaugucuuagccucaacuacuugggaggcugagacaaaaggaucuugagaaacaggaguucaaggccagucuagaccacauagucuaaucuuaucuccaagaaagaagaacauauuauuuaaccuggcccugcuccccaacgaguuaguggugaggggcgggguauuauuuuaaguggaaaucucucucugaaauuauaacuguaguaaaaaaaauuauugugauagcuaaacuuaaaauaacuaccuauuggauuguauucaugaauuguaaaaauaugacccaaaguuaucacuaaaaauuguagggauucuuacauuuuaaacugauaucaaaugcauauaaaacauuaaaaaacccuuuaauuuuuuucuucuagguugacagcauuucagaaggcaccagcuuuucucucuggauccauucauccaaagaaauauguuuguacuauuuuuacaagcuuuuuauuuuuacuucaucacagggaaguucagucccaagauggaaaugaguuccuaugagaggguaaacuaaggugugaccauuuguggugucccgucaaucccugaaggcauagauuaucugaaacuacuuuuaaucaggaagauuucauaucuugauacagaucaacuauucuguuuguuuuucugaaaugaaaagcaaaagacaagagcagauuuagaagaagugaagaugucuuguaaauauucagcaugaacucuguucuuccgacgaugauggugaugugaagugggggacagaucugggugugguccuaaagacaagauucuugaugggacugauaccgacagcaauaggaucuuuugaguauucaacucggaguaacagaauuugucaucaacggcaugaauggcucagccgaggaaauagagcagcuuucaucuaaauccaagcgugucgucauuuuuucacugcuauuauuuugaaaacuucuucaaaaccauuuaaaaagcauugacaacuaauuuuauagaucaaagaaaggcagaugucugcaaauaauuccccuccaucagcccagaaaucuguguucccugcaacuguuucugcugugcuuccagcuccuucuccguguucaagucccaaaacaggacucucagcucggcucucuaauggcagcuucagugccccgucacucacaaacucuagaggcucagugcacacaguuucauuucuacuucagauuggccucacacgagagaguguuaccaucgaggcccaggaacugucucucucugcugucaaagaccucgugugcuccauuguuuaucagaagguacugugcaagcuguuuauaucagugauguuuuccuaauuaauauuguuucucacaugucucuauaauuuaugcauaaaacaaugagagaacacauuuggacucaucaguaauuuauguucugauuaugagcauucugggcaguauucuaauagacugugagccaaaaagucugaaauuucaguaucuaaagagaaccuauaucccaguuuaaaaauaucacuuaccccaaaauagugucauuuuauauccagggguuaucugacauuucauuuaaucucagagaaaagggccgggaaauaguaggcauaagacauucuuacuagaaaggugggccaccauagcugccgaauccagugaccaacugaagcuugggcuuuccagguguccguccuuugcccucauuuaucccuugacuucgauuuggaugcugauaaucucucauagaggaaguucagaaucuaucuaaacugccauuuauuauagaaguacucucuuccucuuaaacaggcaaaucacuuuggaauauauaacagguuguucaaggugguuguuuauuguauaagcaccucuuaccuuauccugugccauuuuucccaguuauuuauuuauuuauucauucauucauucaaucaaucauuuuacauccuaaucacagcucuccccccucacacagccccucucugucccuccucccuuucuccgcugagaaaggggaggucucccuggguaccaacccauccuguccugugccauuuuuuuaaugaaucuuggcucaguagauaauauaguaugauuucuacuuaagaauuauuuauauggauuauauuaauugacuuuauuuuuauccuuaauggacaaccaccugcuucagacagacuuggcuguuugcagaccuucccucuuggggacugugaaaguggcgcaauucauaauauccuugcuucccaagcaugaggccuaaguucaaauuccuguagcacccacuuaaaaagcuaggcucagcaguaauacaccuuagucccaguacuggggaggugaagggagacaggccagccaggaggugaaaucagugaguuccagguucagugagaaaccccaucuccaccgauaaggugaggaaugaaugaggaagagacacaaagccagccacugaccuguguagacacacaggcacguacauucacagaugugugcguauagagacauguagucucagugacaaugauaacauugaauuucagcucuacaucucuuguuguauuuccuauguuuuauaugguuugucauuagcuucuaacuuaaaaguaguaauccaaaaacauuauaguuugugauaauggccuaugggccuguguuuuagcagugacuugcugguguaaauauggccuaauguaagagugacuuuagaucugcagcauuguugacuuguuuuuacauguuauuacuuacuguaacauuuaauuuugagauagaguuacuacuguuguugcccaggcuggucuuuggacucugggguucuccugccuuagucauuaucccgugcuacagucacagaccaccuugcccagaacuaccuuucagugucuuagguuuuauagcccuuucauuauaucccucauaagcuuuuuacaaguacuuuuguagcuauuuugugacuuuuuaaacugaaaggugauguuuaaacuuaaggauaacuucuuuugagagcauaagaauguguaaucuauguucagugaaaccuacuguuuuuuuuuuucaacauuuagaauuuucagcuuuuguuuuuuaauugauaaaauauguauacauauauuuaucauguauagcauauuaaaauauggacacauuguauaguggcuacaugagcuagcugauuuauuucagaucauuuacuuacuuggaugaauuuauuuacuucacacauuuauauagagacauauugauucuccguaggauuguuauggaaucagaucuauuauuuacaggaugacacugggcaagagauuuuacuuguuugaauaaguuuccagaucuguccagucauugaauuggguaguuucuagucucuaaguauagcugugagguuuaggucuucucuguaggagacagauacacaagagaggagcuugaaugguuggugagaaaucuuaaagcaccagcuuagauucggggauuuuauagauauguucauggauuccuaacucauuugagauuugaaaaagcugucaacauuucuuaccuucucucuuaacuuagagaucaugcuuucuagccaugcauuuaguuucuuguguauguauaguuucagguucugaaauaauuauuugaguggcacuugagugauuauuucgaaccuccaaagaaagauguuauuuaauacucauaauuuauguaccagauuauuuuucaaguuaguagugaugguaauuccucuguaaagaaaugcuuuagauuuuaaaauaagauugcauacauuaauaauaauuauaacuucaauuuguugguuugucaguuucuguucaagcaucuuuauacauauuauauuaauuuucacagcugcacuauguaugggucaccacaauuaucaaaaaggaaauagaagcacggaaaacauaaguuacuuucuaaagccugugauaauaagaguucagagcuuccauuucuaacuguuguguucuagacagaugcuuugauuuuccauuaucuaucauugcucauuugugaaaugccuuccaguaaagagacuguacagucaguaacuguagaauccaguucccuuaaagcuaacuggccuugaagccuucacaacaaacugaaguaaugguuccauaguagcuggcauuuaaaauucuagaaaagugacuggcacuugaugguuuuauuuauaauuuguugggaacuaaaaaagggggccuugggaagugggggcggggggaagacccauacccugccagaguuuuaccuauucucuggucugucaggcaugggagagcugcuauacacuuuccacucaguccugggugggcauucaagcacucuucagggggguggccaagggccagcccuuccugggaaccccagagcuacuuugcuaaagucaccagaguugaggagagagggaugaaggaagagugguucccaacacuugugagaguaagugcagcagaucuugacuggaguaccggaaggccuucuaacgggagguuagaaaccggcucauuaggagaaagccuuuuccauccuccaagugcagugggccuugaugagcagagacagucuaugauuuuagagcuuuauuauagaaaggcaggggaaaagagagaagggagggagagagggagggaggggaggggagagggaagacagaggagaggagaggggaggggaggggaggggaggggaggagaggagaggagaggagaggagaggagaggagaggagaggagaggagaggagaggagaggagaggagaggagaggagaggagaagacagaggaggggagaggagaggagaggagaggacaggggagaugagaggagaagacagaggagaggagagagaggagaagacagaggaggggaggggaggggaggggaggggaggggaggggaggggaggggaggggagaggagaggagaggagaggagaggagaggagaggagaggagaggagagagaagacagaggagagaggugagagaauaaaggagugagagcuaagagagccagguggggcugaacagcccuuuuuauggucuucacugaugcuagguaacuggggaggaguuuagccugaaggucagaagcuugggccauugccuaugugacuacugaccaugcuucucuugugggggcugugggagugguaacuuaggcaggagccagaguuccaggagcaugagggaacgccaaccgugucauguaggugaauuaugacuucaggguucagaccucaccucaacuggagaccagccugcaauuccacacaauaauuauuugguaguuugaucucauggacauuauuuguuguuuuaguuucuauucuugauaaacucucuuauguagaaccuucuaagaaauaggccaguaguuacauuuuagggauuagauggacuagacauugucccugcccuuaaaagcuuauauuauagugagggaaccacauucacuaguaucagauaugagaaguagcaugagauauugaaguaaaaaguguauguuguaggcugaugaagaauguagaaggcugaagccauacagaaaauaauauuaaaccuggaagucuggcaacaaaauaaugagaugaggacaguauuccagacagaaggauugagauaagcagagacgggagaaggaacaugguaaguguuggggcuagagagaugucucaacaguuacaacaguauacuguucuuccagaggaccuaagugugauucccagcauccauaucagguggaugacaaccaccuguaacuccagcucuggggaaucugaugucucuggcuuccaugagcacccccacacaugugacauauaccagacagacacaugacuaaaaauaaaauaaaagaaauagaagugcugacauuuaguaagugccuacuuggugucaggagauucagaugcacuuaauccacacaguagucuggggugcaucugaaacaaugugcaugagauucauuugggaauucuaaggaguauuauuuugauucaguagguuuguguggguacauauuucuauuaaugguaaugguggugguccuuuguuguagauucuaucuaaaguacuuuuuuggggggauggggaaauagggagcugugcuaagacaccaugaccaaaacaaaacuauuaaaauaaagcauuuaauuuguggcucgcucaugauuccagaggguuagguccgaugaccaucaugacagggacauggcaccagguagacagggacaugacacuggggcaucaacugagaucucacaucaggauccacaacacaagguugagagagcuaauugggaauggcaugguuuuuugaaaccucaaaguucaccccuagugacgcaccucuuucaacaaggccacaccuccuaauccuucccagacaguuccaccaacuugggaccaaguguucaaacuugagccuguggaagccauucucauccaaaucaccacagacucauaaauauacugaguuacacagguguagugaucuucauuuaauaacaaaggaaacucagauuucagaaaagaauaauuugcugaaaaucagagaucagacaggccugucuuaacucgaagccuucuaugcuccucucggcaccugcugccucuccucagcaacagaaacuuucauacugaauccuuccuagaguagagauuugccuaagguguuuguauagcaaagugaguagaucauuucugccuugaggagcucacagggggcugauaaagguaaaggucuuugcugccaagcucaaugaccugaguuuguucccuugaacccauaugguggagucagaauugacucucagacguuaucuuccaacuugcaaacauacgcaugcacaaauaaaauaaacauuaaaaaccuuaaagguauuuucaagaugaguuagaugaaguuguggguacauugagucgaacuuagauccuguuacuauaaggacgugcagagugacugccagcuugaggggcuggaagcgugacgucguugguaccugagauucuuuugguagggggauggugucacuuacuuucaucaaacucuaauaaaauaagguuccuguguucuagaaauuucuaggaggacugaagaaguauucuuguacuucaggguugugcagggauguacauuggaacuauucugcucugccugacuguggggaggaguuucuucuaaaaaacuucacaccucuauaguugucuuguuagcaaaccuggcaagguuagaaaagcuugaaaaggucucuuaguuuggagguccugagaagagaccuuuaacagugagauaaacacacaaggccaccacccuacuuuaaauuaggaaagaacuuccugaauuauuuuuacauuuuggacauacuugagauuuugaaaauagauauuuaauauaguacucauaaaauguagaucccaucucuacauucacuuuuccaguugggaauauauuaaccucagaauaaaagauuauaauugaucuuaaauaaaagauuaauuugaaaauuuguaagauuugcaauagugauuacaauaaugauuacaagguaaaacaagauuauuugaaguguaaaagcuaucaaaaaagaaaaggauuuuguuggugagcaguuguauugauguacugcuauaacaaagcauacaagaguacagacugcugucauauauguguacauccaggcacauauucagaaacaauugaauguuuuaaaaacagugauuuuuguauucccuuauuuucuagcaucuuuggucagaaaugugggaugcacauacacucgugccauguauauuauuuauauuuucucuugagcuaucuugcaagauauuguuucuaaagauuuguuuauuuguuuauucucucucucucucucucucucucucucucucucucucucucucucucucucucucucucugugugugugugugugugugugugugugugugugugugugugugugugugugugugugugugugcuuggaauccagaagagggcauagauucccccagaacuggaauuacauguauauuugugcugcccaauguggaugcuggaaacugaacuuggguucucuuggaggagcaacaagugcuucuaaccauagagccaucuauuuaguccccuaaauacuauuuuuuaaaagacagauuugagauaaaaauuuaccuguaauaaauuccaucacuuuuauguucaugagauugaucauuuucaacaguugcauacagcuauauaauucuucuaauucaagcuauaaaucaucccagauauacucuuguauaugugcagucucuuuccccccacuuccagcccuaaccaacaauacucuacauucuuucacuguaacuuaaacuucucuggguguucuuauagauaaaugagaucaucuucuauguaguguuuuggaacuuaauauuauuguauuguaucauauguaaguguuuugaaaauuaauauuauuguauugcuauaguucuuuauguugcugaauuaguguguuauauuggcuaugccuuaauuuuuuuguucauugauguauacucgaacuguuugcagguuuggugguuaugagucaaguuguugucagccuucucauacagucucaauuauaagcuguaaauacauguuggcuuuuguaugucuaccagaaguauaauggccgggugauuuaguaggccuguguuugugauaccucaccagacugauuuauaaagauagcugugcacuuuccccaucgacaagcuccauagccuugcucauacuugauaucagcugccuuuuuaauuuacccagccagguugcuguauguaauguauguaugaauguaaugccuccuccuucugauuuuaauuuguauguccuugcgaauauauuugaaauugauguuuucuuacaugaauuuuaaacagacuguaugcugauuaguuuuuugucaguucacccaaacuagagcuaccugggaagagggcaccucaguugaggaauugucuucuucagauuggcccacaggcaccucuuugaggcauugaugaguaacugauaucugagggccgagccugcuugaacagguaguucugggcuguauaagaaagaagcugagcaggcaugaggaagcaguagcagccucccucccuccguggucccacccugacuucucucaguccacgacgauugucaucuguaagccaaauaaugucuuucuucuccagguuguuuuuucucaggguuacacuagaguauauuguucaucuuauuacugaguguaaaaguucuuccuacaacccugaaacaaauugauuugauuuuuaaagagcagauaacuaaaacaagcuuauaacauaucuuuugccuuaacauuuuccugugcuuugaacauuugaaauuuacccaacaguuuugaauuacaaaguacuguuguuaaauauguucacacacacucagcacauuguucacuagaucucagacggaaaagaauuuacacuuauuuuccugucuaaccgaggcuuugugcuuguugacugucaucuuucucaucuucuccccuagccucugguagucuguucucucccucugagggauuuuuuuuuuuuuagauauuuucuuuauuuacauuucaaauguuauccccuuucuucauuuccccucugaaaaccucccuaucccaucccccacccccuugcucacuaacccacccacuccugcuucccuguccugccauucccccaguguuugaguuucuauauguaagcaagaagaugguuagcauucaucucugcacuugccuuauuucaguuccuguauaauguucucugaucucaucaguguuggaggggcacagugaugcugccuccgaauucacacugauaaccucauccuaacauggucacuuguaaagauccagugucugaggugauguguguggcuguuggggugggaaugcuaacauggggagugugacuuucaaguuaacucuguagauggugugacauuaagguuagaauucaucuguauguguguuacguguacaucauuuuucuaggacuguauuagaaauucuauccucucuacaacgaauuacucaauacccuuuguuguaaaucaguugacuauacagauuuugggcauuccuaaacauugaauacuuaccaguuucauauugucuugaauucuuuuguuuacaaacaaaacaaauaaaaaucccaugaagucuaaugcugaaguccucaacuuugucuauuuuuucaagaaucuuuuguccaucugauccuuugccuuuccauauaaauuuuaaaaccaguuuuuacaugauggaaagggcuuuuugaaaccuuguagauauuauuuucagucagagcuuuauguuuuauuguugguacaaccuuuucuuuauaaguuuucauguguuacauggaaauacaggcuuuuaugauacguccuuaucuuuccuaaacacauguaacuuuguuuugaagauucuuuaggguuuucuguuggauuauuuugucuuuagggaaucuugcuguuuuuccacguaguguuucauucuucuucuggcuuuugcuuuuguauuucuuugcuuuggcagugaggauuuccagcauaaucuugaauagaagugcauuugcauccugugugcauuugaaaaagggaaaucuuucugucuuugaccaaucaguauggugugcguuugugaagguguccuucaucaggcuaaggaggcgcgcccucuuccagguggugcagacugugucuaggaaagucuguagugcuucgcugcucccugacagccuugcguuuuucucuuagucucuuaccauggcacauuaccuuagcugaaucuuugaauuccuggagcaaaccacauagucaccauacauuaucuuuuccacaguucuucuaauuuauuaauauuuucuuuacuuuuucugccucuguucaugagagauacuggccuguaguuuaaauucuucccgugucuuugauuugggugucagcagaauguggcuugaggaagggugcuacggguugaacagggucucgagauacugauauucguggacuuuaccauugaggugcugucccuuccucaggcuaauguuggcuucucaagaugaaaauguuacucuucaucuacuugcuaaauacauuuaaauaaaaauuuuaaaugaaauuaauauuguuaguguuaaugcacuugacuagugaaaccauucuagaccaggauuuccuuugugcuguuuuuaacuaaaucuuuguaccuaauagacaugaacuauuuaaauuacuauuucuuuggugaagcuugguguccugguuagguuuuugugaacuugucacaagcuagacuuacauguaaagaggagccucaguugggaaaauugccuucaucagauugccuauagguaagucugggacauuuucuugauuaaugauugaugugggaggauccaguccacugugagcagugcugccccugggugcauuucuggguuguauaagaaaaaaacugaagcugggcguggugguucacgccuuuaaucccagcacuugggaggcagaggcagguggauuccugaguuugaggacagccagggcuacacagagaaacccugucuuggaaaaaaaaaaaaaaaaaaaagaaaagaaaaagaaaacaaacugaacaggcugugaggaacaagccaauaauaagcaucauuucuccgugcgcucagcuucagcuccugccuccaucccuccaugauggacugacuguaagcuuuacagugaaauaaacccuuucuuccucaaguugcuucucaucaugaugcucauuacagcgauagaaaacagucgauacauuagugccuugaguauaaaaagaaauuaauuuuaguuuucagagucauuaguaaaaguuacacauuguauuuugcuaaugucucucuaagucuguaguaucuccagugagccacucauuccugguacugaucagggcugguucuuguuaauuuuuuauuucucuugauuuguuuggcucauaguuuaccaauuuugcuuucagugaacuagccucuauuaaauugauuuuucuguauuauggccugcagcaccagugcaggauggguagaaacagacgggucccagggacucacuggccagucauguuccauguucauguagagaugcacacacacacauacacacacacacacacacacacacacacacacacacacacacacacacacagagagacagcacauaauuucaguuuguuuauuuuauaauauauaauucuccauagacuacuuuguaaauguuacauguugucuuaguucuuauugaaauaucacaaucaagacagcuuacaggaggagggguguauuugggucuuggaguuccaaagggauaggaguccaucaucucuguggcaggagcauggccacuguggcccuggagcagcagcugagagcucauauccagauccacaaacaggaaggagcagggagugcaguggggguagcaggaggaauuugaagcaucaaagccacccugugauacaccuucuccaauaagaccauacuuccaaauccuucccaacaguuccagcaagcagaugggccucuggguggagaggaagauggggagaaucugggagggggaaaaacaugaucgaaaugcauuguaugaaagaaauguuauaacauuacuuuuguacauacaucucugauuuuuuauuuguugguuuauuuuuauauaugaguaccuaucucugugaguguaugcgacagugcguguguagguaccgucaggucaggagaggacaguggcauugcuggagcuggagugguugagagaugccugacauagguucuggcaaucacacucagguccucugaaagaguagcaaguacucauuacugcugagccaucaaucuaacucacauuuuagaauuuuaagcaaaagcuuuugguauauuuacucaguuuucaauauauuuuucuuuauuugagguaauuauaucuuguucugaaguuuugguauuaaaacaacuuuuuauuaguguuuucauugugaugucuuuucucaugacguguguguguguguguguguguguguauauauauauauauauauauacacacauucauuguauacuucuaucuucauuuauaauuucauguagguuucauaguugauuguauguuucaaguuuauucagucaacuacuuguguuaagaucacucauguuuaauacaauuuucaauauagauucauuaaauauauagauuucuccuacuuacaaagauuuugcuuaggacuucucuacuucauaaaaaaagggcagugcguauacaguagaaauuauacuucaaauuuugaaaguucaugguacaguauaacacuuucacaagacugagugccgacagcuacuagccagccuaaaggccuguacugguaacaacuaguuuccuagaguguacucaguuguuaaacuauguguuugcugggcuaggugaauuaaauacauucucaauuuauuauucccaggcuacuagaagugugcucugaugugccuuaucagucaagaagcauccguaugacagaaguggcuguucuuuuaauauguguuccuucuguucucggggccucuucugccuucuuuuaguuauuuccauuuucucuccuccccuguuuugguggugguuguuuuaucugguuugguuuaguaguuucuaaaaguuccuuuuagcauuugcccuagugcaagggucagccaucuacauccuuugaccaaaucuggcuaucuuaguuucauuuccuguuguuuugaugaaacaccuugacuuguggaggaaggguguauugccucacaauccaggugacaguccaucauugugggagagucaaggcaguagaaacuugcagcgucuggcuacguuaccaccgcagucaagacagaaagcagugaguuaacacugccugcagugcccagcucauuuucuccaccauuacucaacccaggaugcccugcccagggaaugcuuccacacacugugugugcucuggccuugccaccucaguuuaaucaagauaaccccccauaaccagcuaaucuagauagucccuuauugagacuccuuucccgggugaauguagauuuuaucuaguuaacaauuaaaaucuaaccaucacacuggcccgccaccuacuucucuaguucuguugaaacacagcauuacauucauuuacauaaggucuguagcagagguuaguacagcagauaccauauggcccucuagaccugaaauauuaucugguauuuuacagacaucugaauuuuuuuuuaaauuuuaguugagauacuacaaacauuuuuaaguuagccuagaauaucuuguguauaaugcaguguguacgucagaacuuuguauuucuauccuuuuuaucugugcuauuauugucgcauauuuuguuucuacauacuuucaguucucauuauucacauaguaaggcugcacaaaguuacuacaaacaacgaauuagcagaugcaguccugaugugcuaggggaaguguaggguagguuucuauaugcuuuucuucacaaugcuuuugucagccaggaaauaacauuauuuuauguauguuucugccuaaaguuacuuuauuuaacaucuacugugaauuguuaauucuucucaaagccuagaaugccuaccugaauaauacagauuuaacucagccagucuucagaaccucuagucuaaugcaaaucaauacacucagacagguaaaugauaauaggaaaugcuuugaaauacuuaaauuguguauuuuuauaugagguugacaucucauuuccuauuccccagagaagggaugcuuuuuauauuuguguaauucaaaacuucaacaacaguuauuucuagguuaauaagauaguugaaucuagauggaaaauaaaagcuagugacugcuuucuguuuggcagucuauaaagagcuagauagaaugaugcuguuguuaguugcuuagauuuccauuaucuacuauucacugcuucaguuggaugaaucuuugugcugcucuuacuguguuagucacagugcuagauccuguguagacucccaaaauggaaggcuuuuucccucccccaaucauguuacauaaaagaugagcaaaugucagauuaaggaucacugucuuguggagaauuaggagagccuguuuuaaccuucguuuuugugcugucccaccauccucugcaguccucuaccuggagaaauagaccucagguguggggaaugccaugcuauuguucuccaguggcuuguagcguggguaaagcaaaaugcuguuaacaucuuuggcagucagcaaguaagcagaaacgagucauuuaaacacacacacaaacucuucuuucucuuucguggucaaauaaauaaauuuuugugacugugauuccuaguagcacuauaaauuuuauguaagcuugcccaguuacucaagaaguucauggugaccucuucucccccucacuccuagcaguuagcuagacaaacaucugugguuacuagcaaggaagcaggugacagaaauaugugauugcuucuguaagccauuauuacuuagaaaauacagugaugacucccaaggcauauguguggucagcauuccuaagcuucagacacauacuggcucauugauuaggacuuugugcucauagccccacuacuuggaccaucuucccuuuucuuaaguacuggcagccuagauacccugcauuuuaauguucauugcugauugcaauugcucuuaagcuuggauguaccugucauaugucuuuaagcucuaugaagucagacauuaucuagccacaauaaacaaauauccaaauauuucuuaguugacuaaaggaagaaacuccugaaaaaacagcaugauguucuguuucaaagcauagguuuuuggucaaauugagguucaucucuaccacuuaugaguuauguggccuugguuucuuaugugaagagugagauugaaaauauuaacucauuuauguaugcauauauacauguauauguaucuuagauguuuauaaaauccuuugcccuuuaccuaacauacaauaguuaccuaguaaaugcuaacuuaucaaugguacuuacuaauuugaucuuaacuguaaaacaaagguaacuuggaaccaguauguagaacugaucagucuaccaaguuaaguucaugucaauucugugcuuuauuuaauguccacaugucagagucuuguguuauauccuguagaagauaauugcuuccuuuggguauaaugucagcccuauaaucacugugcucugaaggcugaugcaggaggaucuugaauuugaggcuagccugggcaaacauaaugaugcacucucagcagggugggggaggaaggaaagggguaaaaaaaaaagaauuauucaguuuucuauuagcacuucaaaugcuccuuuuacugguguggaaaguuacagaguuugcugauaucacuuguguaacuuauuuaaccuuuuauugagcuacaugugugagcucgugauuuauuagaaagaguucaguguauuccucagaagguugguuuguuggguuauuuuagauuaauggugacaauaugugaguuuagaaucucauaauuuugaguucagcugaguuagcuagucaguuaauuacuaugguugagcaguagcuaaguaaaugcuuuuuuauaaaauuucuguauacuuaggacuauuaucagauacagugaaaucaagauauucuaguguugacuuuacaucucccaugauuaaacuaccaggaagaaccuguagaaccaaaagggauaguaacaauuaagugagauuauagaaggccauauuauauuagaagagggacgggaaaaccaaccuaaagugcacaaauaauuccauuaaggcaaaaggagucaaauggggcuggagagguggcuuagcuauuaggaacacuggcugcucuuccagaggacggauuaaauucccacacucacaugcaugguuggcagcucacaaccauguauaacuccagucucaggggauccaauauccuauucugaucuccaagaacaccaggcacacauguggaacauagacagacagacaugcaaguaaaacauccauauacauaagauaaaauaauaauagaggaaagggggauagagaaaugguauaucaguugagaguauuugcugcucucccaaagaacuagagauuauuucccaauauuucuagcucugggaaaucugacacccucuccugguuucuucacagaccagcacacauauaauguacacacacacacacacacacacucauucaagcacuucauacauucacacacacuuaaacacuauauaccugcacauacacucaaacacuauacauacacucagacacacguacaacaaauaaaguaauaaugaaucuuuaaaaaucuuuuuagaaaagaauaggacuuagugauaauuaucucaaguauaauaaaauuuuaaacuuuaaaaaaaaauauuuuuaggucuggaaagauggcucagugguuaagaacacuggcugcuuuuucagaggacccaguucaauucccagcacccacauggaagcucacaacugucuguaacuccaauuccaagggaucugacacucacacagaaauacaugcaggcaaaacaccaaucaaugcccauuaaaaaguaaauuguuaaaaaauauuuuaaagugucuuuuuaaagguaauaugaaugauuuaucuuuaaaagggacaaauaguauauaauuuuuauuuaaguuaaagaucuuauuuuuuuuccuguguguuauuuguuguuuuuucuuuuguuuuuuggguccccccucgacauuguucguuagaaauuuaucugauguuguucuaaagucgucaagagcauuaauuucaaaaaucugaaaaauagaaagggagaugcagcuauugguguuuggugcuacugaagcaggaguuagggagucugggagacauuuauuuuagguaugugcugcaaaggagucacgcaaaaaaaaaaaagaagaagaagaagaagaaaagaaaaaaggaaaaccuuuugaagggaaucgucuucccauaaauugacauuggaaaaccuguuuuaagugcaggugggacuuaaugcugaccucuacccaguaagcuccagagggaguaaguuaaaugugcaaacuggggucaaaggagcaugaauauaaaacggagcuggcugagugcucugugccaggauaacucacucuuaggucagcaaaccauaaugucagcuauaaaaauaauaagacaaaaagcaacguggaaaacacagcaagugugauaagaucagugcccucccccuacaaagggcucacauguuggggagaaacacacugaccacacuaaacacuggggcagaugacacauuucacagggugauucaauaaauucauaaacaagcacagcagaacaugguuaaggucgaguuuuuaaaggacuacagacuaggaacugugugugcaacuggaguaaagacagaauaguuucuggcggcauacugaagagugugguugaaucucaugaaguacaagcgauucacagacugugcuaagcacaaaccugcuuaaacgcugacagacuauaucagcaucaacagcaagauuuuuuuuuucucccaagaaaucccuuuagcuaguaaaucauuuuuaguugaguuuuguuuaaaacuuagauaugaccaaaagaggucacuuuuugaauuucauccagguucaugacacauccugaggguggggugagguggaguuucuuuuguuguuguuguuagcauaagccaaaacuuagcuuccuuuuuuuuuuuuaagcuuugaaagucuuccaacguauuacauugaggucagugcuagcuucuucgugucuuuccucagaaauaccuuacucucaguaaacauuuaguacagaacacauuuuauuugcuuuuauacuaaaaacaaggucaugcaaauagugggcauuuuccuucuucuguguaagaacauguguauauauggggcgcuggcgauugaacccagggccuugugcgugcuaagcguguacucuaccaccgagcugcccucaaacuccuagauuccuagugauucauaguuuacaaagcaaaaugaacacgagugugauuucuaccuucuagggauguauauacugaagagaagguguguuugcaggaagccccagggaagucgugggacccggaagacagucagaccuuagaaugcagucuggcagcaguagaaguggggcugagccaggcgaagugugucagccagaccagcugagcgucacauuacaagccuaugauaaaccuuuauaaagaguuguugugauuaaaaagaaaguucuuagugcaguccugggccauaaugcucagaaaacauaccuguggcuucaaagacucuaaauuuagaaagauccuugguucuauagauguuuuaaaacuuuagugaacaucaaaguugcagcauuuaguugccguaugucaacaaaaccauauauacauacauauuuuuuuaauuuuaguucugacguguuuauuuaaacugggagaguuuauucacagugucugguaugugaugacuaccuaguggauguuagcucccauguuuacuugauuucauauugauaagaggcuuaaaaaauacccucuaaagcuacucuugcuauuaguuuguugaaugaaaaaacuagauguaauuggaaugagaaaggaaguugguagaaagcaauucauuugaguuauaauggcauuuaguaaaauugaaauucugucuguuuuuaggugauuuaaaauacuuggcuuuaguuuugaucauuuaaauacuagaucugaagaccaaauauucaguguacuugaggggugauuuggucugucugaaugaauggauccauugucucuguagacaugaguugguuguaauuuucaguucugucauagcggaugaaaaccccagcugugucuuuuguuuucuaggacagaguugucauucuguguuguuuucuuuccccauucucucuacuacagcuguguugcaguggcuuggcgacauucuaaucuuucugagauauauauauauauauauauaugugugugugugugugugugugugugugugugugcauguauauacauauacauguagauacauacacacauauuaucuagguuaaauaguguugggcagucauuacuaaauacuuaaacugaugaugggaaaguuaauuugcuguacauucagguuacaaucuuagcuaaaagagggaaaguccaagcauuaaaguuaaagacaauucagaacuacuuacaaaacaagcggagaaaguguauuuuaaaaagaaaaagacuucucugguuuaugucagacgugugggguuaaguugagcacgugaacuggagaccugcggagaccugcggggaagaaucaguucaggucccuggugaguccguucucgcugacucgucuagacuagugacuuuggcuuuaaaugaaaauuaucauuggaauucuucccuaugguugagcgcuuuccagaauuggugcuaaaugaauguuagucuuguuucuacagaauaaccaacagaauuuuuaauaagugcuaguuaaauaacuaagcucuggguucuccgggagucugaggaaaccuggaaagagaacauccuagcauguguuuacugucauuccgaauaagucuuaaagauguacuguaaagauguacuuggucucaaguuuaaaaaucaauuuaguaucccauauaugcauucgugugucagccucuaaaauuaguauacuucacucacuuauaugaaaacaaaaauauauguguccuaaaacuccaaggguuucucauuuuuauacuaccuuuuaaaaaugccuaaugauagguaaauaauucacucagauaauauugaauucugauguuguuuguuaacaugcaaaugcugucuugccaaguaaaauaaaaguuucguaagcuuccuaccuuaucugacauuccacugacagaaguuaguuggcaugagauuuuuaugagacaaguuucucauaaaaacuuuuuguuucgccacaguuggucuagaacugggaaaagccuucauuuugcacaaggcaggggaguuauugaccgaagaaaauaauaaaauaaaauaaauugagaagcuacugaaagagugcuguuaggaacgggccaaauuaaagacuuuuuuuuuuaauugcuuuaaaccgucguuccuuagcuguccuucauuucccccucuaaucagggcugaggcaggguaaggaaggaaacacaggcuuugcgguuuuaggagguuacuagcucccguccaccuucccugcacucuaaacccuuucauccuagagcagcagugcucuccagccugagcuuuaaccagcaacugggcagauaguuccauguuggagcugaccugugcacucugccacaccauguguaccuacuaaguguucacaaaccccaguucuggaaacgagaaaugcacaaagacccagcugggagcucugagcucacuguagccugggcuuguuacugagagcuacuaaccauguacccggaugcgacccugggaggccugagccuugucccaagagcccuugcucuccuccaugagaaugggguguuuagaagguguauaggccauuucuugggggcaucuuacgucuuaaggguacauagaaaguagcaauggcgaggcaguugucccucugcugcccugugaaggagaacagcagauuugcaaauggaagcaagaguuugugugcauuuauuuuuccagaauauauuuuccuuuuaaaauuauacaacugaguggagaguggccuuuuccuuuauuccuuauucuguuguuagaaaaacaagccauuaucuuugaaaugcuuccgcuuucuguguauuucacuggcagguuauuuuugauagauuuugaaauauaaagugcuuuuguuugugguuuuuaauguuugguucaugccuuuuuuuuuuuuccucaugugguccaggccaaccuccaaaucccuguuuauccaagggugcccuugagcuuugaauccucugcccccagcauuagaagcugggauuacauguguguaccucugcgcuuggcuugcccaugacuuugccauagccccuauguacugagaaucauucuggaagaggcaaaaauaauuuugaggaauaguugaguuuggaguuuuugaggaucagugaacuauuaaaaauaggcaaaaauauaaauaaugaauucuuauaucuuaagcuuaugaaagauggucagccuuguguaauggacauauacaauucagggcaagggaaaugacuccauggauaaagcuuucuuuuccauuuucauguguauuguguucguguguguauuugcaugacuuuugcaugugugggcccaagugugugcagaugugguacacaugugugcacaugcauguaaagaccugggguugauguccaagccauccacaguuagucuugugcuuuccuucgucgaggcagaaccucuccugucagaccugagcucacugauaugacuagucuuguuagucagcuugcucuggggacuucccaucucaccuuccaauuguagaagaccgucagacacaccuugcauuuacauggguucuaggauuugaucucugguccucuuccagccuguggguccagcacugaacccucucccccuccccacaaacuuaauauuuugcauguagacauauaaccugauauagccuuugugaagaccaauuggucaguaucuaagaguuucauauauauguauacuuugacuuagguaauacucugagaaauuaucuccaugcauaucaucuagaaguaguaaaaguauaaauaugugguacucaccggcuguuguugauaauaacgaaauauggggagcaguagacagacgcuaauguucauggcacauccaacucaucagaaacccaaguucuuuauguuacaguaauugguuuaauuuucaugguuacugccaaguaugcucuauuuuacaaauagaaaaccauaguuaagguuuuacaguuaauaagauuugaauucggggcguagggugauggcuuaguaaacuacuugcuaugugagugugaagaccuaaguuucauccccagaccauaaaaaucuggggacacucauucuugacagaguauaguaaggaugucacuuuaccuguguagccuaccuccucaaaaccccaagcccagcuugaaaugagauaaacaucagaaaguucaacuagugaggcauccuauaaaacucacagccagugagcacguccucccaaaacugcaaagugugagaaacuguuggaucuaagaaaggcagcucaaggucguauagauucaugguugguccuggaaaggagaaaggacauuagaugaaaacuaaggaaaucuaaacaaaguaugacauuugcuauaaauguauaauacugcuauaaaguguuaaugauggggagacugggugaaugggaacacuguguaauguugucugaauuuuuugaacaccuaagauuauuauuuuuaaaauaaacuaauaaucauaaugaauaacuuuaaauuuuuuauuuauuuaauguaugagugcucugcugcuaauacauccacaggccagaguaagcgcaucagauucccuuacagaugguugugagccaccauguggugucugggaaucgaacucaggaccuauggaagagcagccagugcucuuaaccgcugagccaucucaccagcccgugaauaacauuuuaaaguaauuuuaaugcucaggcauccauuugagaagaacgccugaacaucauuuguuuauaauacuuuuaucauacugagcuccauuccucccccucagucuuucagauccauccccaccucccuacacucccaacguuggguccaguuuuucuuuuaaucacuugaguccguuugugcuacucauacacuccuggacguggaaccuugaggccuuaggcaugagcaaccguacuaggagccaugcccuuaaacaguaacucuuuggcugaagagauggcucagcggcuaaagagcacugacugcucuuccuaagguccuggguucaaaucccagcaaccacuuggugacucacaaccacccguaaugagaucugacacccucuucuggugugucugaagucagcuacaguguauuuauauauaauaauaaauaaaucuuugggcuggagcaagcagggacugagugaguggggguugaccagagcaagcaggggcccuaaaaauucaauccccaacaaccacaugaaggcucagaaccaucuguacagcuacaguguacucacauauguaaaauaaauaaauaaaucuuuuuuaaaaaaacaaaagaaaacacuaacucucugucgccuguccauagcuucuggguuagggaugcagguuccaucuucacugcucugugcuggcuugauuguguugccuggcuugaucuugugcggguuuuguacgggcugccauagcggcugagaguucauggguacagagguccugucauucuagaagauuguuuccuuccagccuacgucagccucugcucuugcagucucuccugugacguucccugagccuggccuuacugagaggaagugcguuucuuuagaauuuuaauauggcugucaugcgggagcagagcugagucacauucuuacuuuugaagaccugacaucugaauuuuaaaacucaugagcagcaaauauguguguguucauuuccuuagcagguuguuucugcuuauuuuguguguuguuuagauguuuuaaaacugugcuuguaguuaauuuccuguuucuuuguagaugguuaucuuuaacauaaucaagccucugaaccucgguguuuuuuuaagguugaccccagugagucccugaacuucacugacaauauuuaaucuuuccuuacuuaucagucuguuucuguuauuuugguucugacauuugccuucagauaauuucuaacuaucuuaacaaacacacguauaugauauuuuaauauguaucaggauuuuuuucauaagccagacauuacaccuuuuccuccaguccagugguucucaaccuuccuaaugcugcgaaccuuuaauacguuccuuguguuguggugaccucagccauaaaauuauuuucgucacuacuucauaacuguaguuuugcuacuguuaugaaucauaauguaaauauccaugucaucaacugugauguaaacuguguuuuccgaugguuuuagaugacccuuagaguuaaaacucacaggcuggaaaccacugcaccagucauccagugauugucagauuuauacaugaguauucugugaagauauuuacuuauaucuugaggugacuuuugacugucaucaccagcaucuuucagccucuugacauacgaguguuuauuuuaaauaauuauuuguaauauuuucugcacucuuccuuuuacgagugcuaggguauuuguguauucauuuaucuguguggugcugaggcuuggugugggcaaugcaggugcuggaaaaacacugggccacacuguaccccagcucaugcuccugguacccauuagauagcaugucuacugcgcuguuguuuaugucuucucuaggcuauacauuuauuuaaauguugcuuuccuucuuucacuggugguuuuaguuaauuuuuuucaauuacuacaagcugagacuugucuugacugauuaugugaggcuagugaccagguggcuaaccaacuauuuuuuuccaguuccuuucuauguaauucagaucuggaaaugcucuccugaccaaggcuucagucucucuccagggauuugcucagcucuuguccugccccaguccugagugcuguuuuuagaagacagcuugggucuuuaccaucuugccuuuggccauugucucuucccucuuagaauauaaaauauuuugaaguguuagcauucaccaauuacagugcuaggaauuagacacagucaucagcaaauucaguugugacccccucccuguaaagccagcaggacggugucccguuuucuaaccaggacugauagagugucucggguauuauuugcccuuauucuagaauuuguauuucauuugccauuuacuguccugcuuuuuaauaucugugcuuauuuccaucuuuuucccuguuagauugcaaacuuuuggaacgcuuuuggaaaauacagauuguuuucucauuacaacugcuaaauagccuuguauuuagcaaauaugccagaaaugcuauuuuaaaaaucaguuuuauucuuucaaauauugguuagagauuuuauuuucuuacgaaggugaaauaugacauuuuuuuaauauuaagggauugugcaacuaaguuuuaaagcuguuuuaaucuccuauuuaaucauuuaacuuaguaaauuuuuaauuagaauuuaaacaaaauauaauuuuuuauuucugucuuuucaauuaaaaauaacuaccauguuagauuuacauuaaaacauaguuugaacuauaauaaauauuauugacaacucagauaauugaauguagaguugauauuauaaauucuaaguauuucuauacuucgccauuauuugccauguuuuaaaaauaaaaauaaaccuuuaacuuucuaaauaagcuacuguuuucaacuuaaaauaauaauuuuauaaaauaguuuuuagaaaagauuugaaaacuuugaguguuguaugagguuuuucuaguaggaaaaaaauguacaauaguaagauaauaaauaggaaauuccggacgguuacugugucggaagcgucggccauaggagcugggacugccaagagugggcuauaaaguugucggcuuuccccagggggcugaguaaguaagaaagcaugucagaucacacggucaagugcuacacuaggaaaccaaggcagugucucuuguuauuccucaccaagucauaccaccauaugaaguacgugagccauguugucuacaacaccccugcgaugagcauguuuacaguuugcugugacugauucaugucagaucacugagcgcaagccagugacauacgauauuguuuauuaaaggacagcugugguguugucuucugagaaucaaggaauuuccuauaacagcauguucuaaggcauuaguaaaauagaugacauuuuuuauauuguuaauugauuaaaaaugaaauuauuuuggaaaacaaauauuaaaaauuucuaauauuucaucaugaaugauugugcaugccuuuaaccccagaaaucgagagggugcccagccucuguagcaaguucuaagccauccaagacugcaugcugagacccuuucuuaaacaaacaaaaacuuuuaacucuaagcuacuuccuucaaaauauaggacacacaucuucauaauuuguuccacauaugaauguccuaaguauuauaaauguagauucguuagaauuguacauuucgggcauaugugagaaaaucgucaagccucuguuuagagcacugcugagcccuguguuuguaacugcagugaauggaccuaaaauucuagaugcuugaauugaacuugggacucugugaccacuguuagggaauuauuuggucuucagcuaguccugacaugagguaggugucuauuucagugcuauucaggauaguagcuacagcgacaguggcggucagguacuugcaacguggguagugugauuaaggaaguauauuuuuaauuuuaauuguuuuagaaucagauaacuaugguauagagcuaugcuauagcaaauauuuaagauaaucaguuuuauagagaaaaauaauauuuuggcucaauguuagaggcuccagcccacaauugguugauuccauugcauuagaaagcacaccauagcaggagcaaaacuguccauccuccaucagagagcaggaaagaguccagaagacacagagguguacaguccccuuuaagacuuucccuguccccagaccccacauacucauggcacauaagggcuccagaaccuccuaggacauuaccacaugaacauuuuacacaucaaauccagagaauagcaguggcugaucauguauugagcagugcagcucugaugaguggaaccaacuacuuaccuccucgggauaaaaacagaaccaguagaaaacgauguugucuuauagcaauuagaaaucugaaauuuguaagacacauguguuuuaagguaaugauuauuuauuugcaaauuuacuuuucuguuuuugagcuuuaaaauuaaccaggauauuugaguacaagguucaccuuuuaaauauuaaaagaguuguuagucacuagcacuaugucaagacacuucaaaauucuuuuguagacuauuuguaacagcagaaagcuauggaauauugaugcaggacuguuuuucuucaguuuccagaguguggauucuuuggcauguaugauaaaauucuucucuuucgccacgacaugaacucagaaaacauuuugcagcugauuaccucagcagaugaaauacaugaaggggaccugguagaaguuguccugucagguaagcaaauggccccuucccccugucucuucucccacagagugguccgcugcgcuuggcuuuggcacuggguaguggcuugcuucuuuaacguggagucaugguuucugcacgcuuuucacuuucaggaaggugauauagcacuaugagaaaguagaagaacaaacugaauuacuuaaguguuuugaagcuugagggauugccaguuaaacugaaaagaaguucuuuuucugugggucaaaaucauaaaggaagauuaugguuauuucucuucccauuucuguuaaaagcaugaaaaagaaaacuaagguuccacaaagagaaucuagauaaagagagaaauaugaaagacuuggaagagaacguggcagugcugguucccugugugauuuaaaaacugccucuucccuuccugaucccaguggacauugcccguuuccgcuccugccuugccccucuugccauucccguucccuaacucccaccauuuccacuuacccaacaucaagugggcaggguggucagugaguagugugagggccagaggaaugccacaggcaagauuagaaugcugauaagagaaaggaagcaagcggucacagacacccaccgccuggccgcucugcccucccgcagucuuguagccuauugagauccuuucuggccauggugucuccuuacuguuccuaacagcucccaucuguguuucugauucuuacaucucccuggcccccugcauugaucguucuacaccacagcccccaggcuuccccuccacucacaggagacucgugugcuggucuccucucuggucacaaccgcaagcauucauucuuucucgcugggaugcugucaucaaaccgcaggcgucacuggugacguucgggugaagugagagaguagggucugacccacugcuucauggcucauggagaaaagcaaguccugcucauguggacgcagugucuguuuuugcagaaacaccguggcgaugagguuaaguuccauagcacuuuuauuuuuacguuuuacuucaguguuuucuuucuccauguagccuaagcuaagcaguuuuuaaugggcuaaggaagauauaauaaguagcuguuugccaucuuguuaugagaccaugccuccagauuuccaacuuggcuuauuugggacauaacucagugaaagcugcuggacuucuaaaagaacuguuuuuuaaaaccauaguacuggaccagaagauggcucagcaaaaaaggccucugaucccggggcacacaugguaggaggaaagaacucaugccuacaggguguccucugaccuccacgcaugccagggcacuugcuccucccuuaacacgugacacaauaaauaaaucuuuuuuuaaauuaaaccuuguaaagcacaguuuaaaugcuaaaauuaauuuauuuuguggucagauaaaacuuucagagaaguuaccuuguauuuucauauaaauggauauggugaccauuccuaaguaauuugcaauuauuaaauauacuugaauacuuuugauuuuauuuuuauuuuuuuuaaagcuuuggccacaguggaagacuuccagauccgcccucacgcucucuauguacauucuuacaaagcaccuacuuuuugugauuacuguggugaaaugcucuggggacugguacgucaaggauuaaaaugugaagguaagugcuuuuaaauuuguguauuaauuugaaagaggauuuuacguucgcauuuuugaauuaucaugaaagacaaaaaucauaguuggugucuagguaauaaggauuuagaguugcggagaugaggacuccggucuuuccuuugccuccaccuacugguucuuuuaggcaacuugaucgaccucucuggagacuccuuucucugugaagagcgcucuacccauuucauaaaugguuaaauaagguaacgugaauaaaauauuugacacaaaacaguggcuuaauaacuauuagccacuuauuauuauagaguuuuaauauacuuuuaacuucuucuguacagugguaaauuuggcaaguuguaaguuagaauugcuagggcauagcaaaucaugagacauaguuugauuaagaagcaguggagggucaauuaacuuguuuuguaaaguaccagcagggaaauccuuuauuaaggcuuugcaggccguggucucuauugugucuaacucugcuguuggaguauagaacuaaccguaggaaccggaaaggcggcucaucagcugagaacacuggcugcucuuucagaggaccugguuucaaaauccaguuccacacggugccuugcugcauguaacucuuaaucccugacaaucucaugcccaaggcaccaggcauguaugugcuacauauacauacaugaagacaaaacauucacauauagacaauuuuuaaaaagcguuaaaaacucaacaguuaaccguagauaauauguaaauaagcagcagacuguugcaauaaaacauauuuauaaaguaagggagcugucuuaguugguaaagugcuuaccacacaagcaugagggccagaguucaguccucaggacccucguaaaaagcuggguguggugacguguauugggacguuaggaaacaaggggaucccuaggguucucuuacaguuccaggccccagugagagguccugcccccaaaacaagguggaugucuccuacgcucagauacaaauaccugcgcacacuugacacccauagaacuuggguguuauaugauuaugugaauuauaauugcauaauacuaauacuccauauuauuauuuguuaucauuuuauacuuacgaacaccgaaauuugaccauauaauuuucucaucauugaagaacaucuguuucacacaggccacuguuugccauccgauagugcgugaagccaguaguggcucuuaaacuuuugccaaguguuauagagcaugcuuugcuggguuccaccuccacaguuccugagucuguagauuuagggacgagccuaauaguuuauguuuccaauaaauuuccaggugguuauguuagcuaucauaagucaagauucacuacucuaguuaaauuaacuuuucuaaauaaacuuuucuacauacuauuccuagucuugaauuuguuauguuccacaucaccugugaucuuaguuauuaauuaacguugguauuguugcuggugaaaauaaagaaguacuggguuuuaugugucauauuucaaauaguuacauucaaauuuuuuauauuuuacucuuaaaauauauuuaggcuguggauuaaauuaucauaaacgaugugccuucaagauuccaaauaacugcaguggaguaagaaagagacgucugucaaauguaucucugccaggaccuggccucucaguuccaagaccccugcagccugagugugugccccuucucagugaagagguuuguauucucaggucguagaaagcauuuuacaauuuauuccuagugauuuuacaagguauaugacauccuagcacaguaauguuccuacacuuaagguacauuaaauguaauaaugaugacaaggcuuaccaauagcaguagauuguauuaugucccuugggauugcacugugauagccuccuuucacuauccuggcacccagcauccauauuucaccuaaucuuacauguaaucgaucauaaggccagauuuccuaauacacaacuccaauuauguuucucuucaguagauaacuauguuagggaucuccagaggagcaagaccuauacagugugugugugugugugugugugugugugugugugugugugugugugugugugugugucugugugugucugugugugucuguguguguaucugugugugucuguguguguaucugugugugucuguguguguguaaaugacagaauuuauuauaucagcuuauaugaucagauucucagaaguuccaaaaagaaucaucuauaggcugcaaagcaggaaaaacuaauagcuacuuagaaccuagaagccucaggauaugagggacugcugacuggaauugcacuggagagcugcugguaccagucugucuucaaagguugaugcguguggagucugacaugcacagugauggugggaggaaacagaucucaacuaaagauuagcacaguaugcaaaauggucaccuuucuguucuucauugcaucggcacccacagccugcucaguggugucacccacguucacagcaugucuuucccucucagguauuucucaucauugaagaaugucuguuucacacaggccacuguuugccacuggaaagugcuugaagccaguaguggccaaguugcuuugcucugcuccaccuccagagcucugagucugagguagcacuuaccuagaccuacaggguagccuauguuuuuaaaugccaucacacuuuugaaaccuuguuugugagucuaacauucugccaaguguuuggguacuagauuauagaaaacgaggaauaaauuucgaaaaauaaauacauaaacaaguagauaaauaagagccaagauguaaagcucugcugaggaaggaguuaagcuugaaaacaggcauauugggagcaaacccuuaaguguaacugaggcugccuuugucugcgcgcacaaggcuacuuccaucauggucauaaaagacagugugaagagcuuuacgaacauagagaaauucucgcuguaaaauucagucugugacucacucugcuuagcacaguacuugguauuuaguuaauauaagugacugaaugagcguacugguucucaaaacgugagguggaucacuagaucuguuaucuacgugacucuggagacagagugcuuaaauggcuuuccagaguuauagggcagaauaguaagaaacacucaaguuaaauucagaucuucuuauuuuuaaauuaguuacuuuucccuaguguauuguuuauuccaaggauaaauacaguagauucaugugcuuaggaguauuugaaauggcuuacaucuguaaauuguaaucuugccaucaguugguuuuaaagccacugucauuuauauaucacugcucucaggacuccuguacacuaguacagugcaaagcuuugggcuauuguccauuuaauaaaauccuuacaaauugagauagccaaguaaaaauguauguaauccucuucuaaaaauucuccuguuuguacaccacuuagauuuuugaaguagaaaaagaaaggcaaucccaauacucaagcaaagaucaugaguucuaggccggugagacccugcuuaacaacagcagacacccaagggagagaggagaagaggaguguguguauagagguugagaaggagaagcuguguauagacauaggcaaggccuugggagaagauugguaguagaacauuggugugucuuacacacugaaccacagagggaaccuaucaggaaagaaguauauugcuuugcgagccccacgaauggugcucugguggcagcuacccacgguugcuugguacugcuuggaaaaggcagaggaaaggagaaguacugccguccuauaguauucacaggguauugguucuagaaccuucagcagauaaugaaauccauuacuguucaacuccucuauagaauuuggcaggauauuuggauguaaccuacauacaucucuugaauacuuuaaaucaucacuagauuauuugugaucucaauacacugaaaaauagaauuaucauugugaguaugagggugaucagcuauaacaucugucacccugcugaucaccaguguugaucuagcugaucuggcccaugagcaaauauguauuccuucuuccuucccgaauguguauccugcaugagguuucuccaauaaagggagaccaaccucuguugguggagaguaagagagagcaguuagaagguaaagcaacccugaagcugaaccaggaguggugaaggggcucucagaguccugucuuaccaucaucagaggcacaccaucaucccaguuuucuuaggggaaugaggaauacguuucuaaaaauggaugggugggugggugggaaagcaggcaggcagauggacagacagacagagauggauagauggauggagagauagauagauagauagauagauagauagauagauagauagauagauagauagauagauagauagacagacagacagcaagauauaaagccucacugaguaaggaaauaagcuuggaaacagguauguagggagcagaaccuauuaacauaacccugagguugccuucaucuguguguacaaagcuauuucuaucaugaucauaaaagacaguguaaagagauaaaagaacagaauuuuuauugaauuugguuagaaugaaagcaauaagauuuaaggauccacaacuuaguacugacuauuugaagguggaaugguugaauauuccucucaguguauuucugagggaccauaacaggacagaaggacacuagaaggaaagcaucaggggggucugagccagugcacaaaauaucucauagauucuccaguguugauuaaaugugcagaguuggugguuuuuuaaugcuuuuauuuccuuucgaagagugugugugugugugugugugugugugugugugugugugugugugugacugauaauuggcaauaauguuacaaaguuuugugaggaauugauuagcuuacaacuaagcuaauuggaaauaaguuacuuuaggaaauuuucuggcuacacauuaauacagaaaaacaauuaagguaaugcuaauuugcaaauagagguuguaaaaacaaggucagaguuuucacucaguucuuguguggaugucaguggucccauuuuaaccaaauucucuugcuaaaucuacugaccuccucccuucugcugcucaguaagucugccauagcucuccugccagcaucacugacaggcagucacugugacugaggggucagggcacacugagggaaggaaaaaauaaucugaguccacuuucauauuuagaugaggauagaauuuaaauaacucugugacugcuaccaccacagaccgacaauuguaccuggcacacauggucuguccuaugucccuaaugcccugauaccagcaggauauaaacaaagguacuacuggccacuggcaaauaaaaacguuacagggguguccucuguauuggaugacuaauagcuaaaucagguuuacugugccuuguauaauuugaacuugagacaggccaaauauaguagauggaggagcaggaaaugcagaguaaacugagacacugagaauaaacucagagugcugccucugacagugaagacaaggacuggagugucauccugucagucaucuggggagguguccagacgucgcagacgucgugucuccaaacaugguuauguuuagaucaccuuccagauauauaauagagcacuuagcauauaguaaucacugaauguacauucaggaaauggaauaagccacacugaacuggccuauaacuuagucugauuauucccuucauuuuugucuuccaccauuuaguucagauuucuacaaacauauuguaguauuuguggggaauugugaaggaagucuugucccggcuauuugcaguaaugcggugugagcagugacaggcaucccucagucuggugcuuuucuugugguuaacuguguggucagcuuugcuaugaagucauugccaggguuugguuuuauuguaaaaugcuaaaugugccucucauacaagugugugugugugugugugugugugugugugugugugugugugugugagagagagagagagaggggggggggaagagagagagauugagagagagagagagagagagagagagagagagagagauugagaacgugcaugcaugcacauagggguugagagauggaaaaaagaaaacuauuaaguagguugaggaaucuccuuuugguggugguaaaaugagcaucauuguaaaggaaacuauagaaagugcuguugguaguacugccuaccuaagcagcaaagucaaucagaagguccaaacuauagaacaaacuuuaggccagcucagugaagcgggagauuguuaagucuuugggguuuccucaugauuugaccuguguccacauuuucauuccaucuucucagcaccagcuaugucuuagucaaggaccuucucuucuuaaaggguauguuuuguggcccucugaaaauguagagaaauaaaccaaauggcuaagcuaccaugugaauugcccacuguuaagucaaaugaguacuucuaugcaguagucuggggccugcguugucacuaucuucuuaaaaucauuacuaaauuuauuuauuuauucccuuuacaacccaauaucagcccuuccucuccucccaggaccccaucacgaaagaacuccccugaaccacccccccuuccccuucucucuugagaagaggaagcccuccucugggugucaaacaccaccagcccccuaaccccuacguugcacaucaaguugcugugggacuagacacauccucucccauugaggcuagacaaggcugcccauuuaggggcgugggauccacaggcuuagggacaaccccugcuccaguuguugggggaucugcaugaagaccaagcugcucaucugcuacguaugugcaggggcauagguucagccugugcucgcucuuuaguuggugauucagauucuagaagcccacaagggucgagauuaguugacucuguugaucuuacuguggaguccauauccucuucuggucugucaaucuuuucccaacccuucuguaagauuccucaagcuccaucuaguguuugggugugaguuucuuugcuucauuccauuggcugcuggguggauccucucagagaacaguuaugcuagguugucugcaagcauaacggagugucaauaauauugucagaaauuguuuuuugcccaugggaugggucucaauuuggggcaguaauugguuggccauucccucagucucuguacuaucuuucucccuacauaucuuguaggcaguacacauuuugaaggcucuguggauagauugcuguccuuauccuuccacugggaguccugccuggcuacagaaaguggccacuucaggacccauauccccacuacuaggaaucucagauagaguuauccccacagacccucuggaccucuucccaucuccggucucuggcacauccuagauauugucucaaucacagugauauuuucuaguuccaucauuucccugugaaauucaugauguccuuguuuuaauagcugaguggcacucuguugugucccacuaucuuaacucugugcuucuuuuucaacggugcuaaaacugcaaucugcuggugguuuuucugcucucugaaaugauucuccucucuucguacuuguguuaggaauuacucaaauucuucaaaagucuguacuucccucacauaaauguugguaaauuaaguccaaaggaagcugcugagacccacaguuuaaauguugacuuuagcauuccagauaaagaacaugugcucccaauacuuuguaagauuagccuauacugacagaacuuacuuguucuagucacauacucaccaagagcccaguaagagaaucccgucguggaguggucguccgaucuggauggaaaagaugguaaugugcagggucaaagucccucacacauuugcuguccacucuuauggccgcccgaccauaugccaguacugcaagcgccugcugaaaggccucuuccgccaagggaugcaguguaaagguaggguugccuacgcuucuacaauucaucgguauucuuuagaguaaauacaaguuuaaaguaucuaaguuucaguagcauuuacuaugaaaauuguucuuguaguuaguuuuuaaaaagaaaggggggaaauauagacacacaaauacguacauacacguuccaaacuuuaucuccaguguucuguacuucuaaaaagaaauaaucagagcaacuauaugagagaucaugguacuauuuuucauuuaaauuaaguauaagaccacauauuuguaagauuauuagauuaugcgugaaguaugaggaggaggagacggagcuaccagcgucuuugcaucguacaaauggcauuagcuucacuacauagaugaagaagcuuaccccugguugggcuaagugacugaaagguuggaaaacuauuaaggccaucagaaguugaaaccaaacuauugccuaagacuugaguucuuagagcaagacacuguuuuugagugacguaaaggaaguguaaccauaucugauuuuacugguuuaaaucauaagcuggauauuuauauuuuagauugcaaauucaacugccauaaacgcugugcauccaaaguaccaagagacugccuuggcgaaguuacuuucaauggagguaaaauuauuuauauguauauauauauuuuuuuuuaacuuuuauaaaagaucagaaaaggucauaacucugguaaggcuguuugcauauuuuauuuacuggccuuguuugcgauugucuucugacuuaauaacugagcagaacccagggaucagugacacagcacgugaguagcuaacgccuuccgucucucuuuuaaccaucuugcuacuugggccuccaggacccagcgguguugcauauugauuuccagaucacuuuuaaaguuuggccgucaucuuuauucuuuauuuauugacguuuaaauguaagaccaacccucugaggugauucugauaaaugccuaagguacaaauccauuaaauaguuugccugagaauuagggccaagaagugacagagcuagaauuugaaucuaugucuggcucauuagucugucuuuuucucucaaauaaucuaucacucucuuccuaaagauauuaaaaauaaguuauuacuuuguuuuggaaggaaagagcuuacagcacaugcuguaagcuuccaccauaauuuuccuuuacaguuuauauggcugauaaaaguaaauguaaggagguuuuuaggaauaggauaaugguugaaaauugaacuccuuaacauuaauuaacauuuucuguauauuuucucaugguucucaguugucuugggucugcuuagacugauauuaaguaccauaggugggguaguuuauaaacaacagaaauggagucccaugguucugaaggcugagcaguccaggaugcuagcagagucugaguuuagugagagucggaagacgccauucaggcccaugguagcaugcuaacgugugaagaggcucuggggacacuaauacagaucguaggagcagagccuucagaaccugauccuuucaaagguuccaguucugagugccauuaccuuagaagggagauuuaauaggcagaauguggguaaaaauaguuauuaacaccauugguagaauaugacuaguguuucuaacgugccugaagucuuuucuagcucuguaguuuacacuuuuguaugugugugcuuuccuaccuuucaguaaauggauaugaaauacucuguauucauuuuaauguacacuuuucugguuccucaugaguuuggauaccuuucaaauguuugcugguuauuuauguacccaccccaccccccacuacguugcuccuucacaugcuuuacuuuugugauaauuugacauacuaagccuuucuucauuuauagaggucauuguaacuugguauauuuuuagcagcuuggcugagauauaguuugcuuguucucuacuuugcccacuuguauucacaaaguuauguggccauuacucuaucuaauguuagggauuuucauucucccaaaaauuauauacuucauauucccacccuauucucauuuuauuagccucuagcaaccaguagacaacuuucuauuuuuaugucuuucuauuuuagacauugaacauaaauacauucauaauaaucaauauggaggcugguggcuguuuccuuuuacuuagcacaguauuuucaggguucaaacguauuguugccuuugccaguauuuaguucuucuuauggacaaauaauaugguucucggagaaauaagugcauuuuauuuaugcagucaccaguuaguagauuuuugugauguaccugccuuugggguucuuagggauaauguuguuaugcacauuuuaguaugucuucucuguggacauaugguuucauuucuuuuggauaccuaguauguaggagguuggccaacuugauaacucuuuauuuaccauuuugaagaccugcccgacuuccaaagccacuguacggguuuacagcccaccaguauuuaaguaaauguuuugucuuuuauuauugaacuguggaauuucuacaaauauucugaauacaacucccuuaucuaauguuuuuacauauacuuucucagugguagagcacuugccuagaguuugcaaggcccuggauuugauccccagcacucccucacuuugaaucucaaggauauuuucucaaguuuuaaaacuuuuuuucuaguuaguuuuaagacuggucugcuuaggugcauuacuauucuauuaaaccuuccuagagccgugcagcguggggacugaugcagacaugcccauggauauugacaguagugaugugaacagugauggcaguaggggcuuggaugacucagaggagccguccccgcccgaagacaagauguucuuccucgacccgacugaucucgacguggagcgagaugaggagacuguuaagacaaucagguaaugcauuacgcugcuaauaaaggccacggcaggucaggagcuccauucaggaaagguggccuuucuuuaaauguaauuuuaaauguaauuuaaaaucuaaauaaaucaugguuaauuauugcaugcaccacaguauuucugaaauaaauucuauuaccuuugcuaucaacucaagguagaaagcaagagaaucuuuacauucuuagaaagaaaagaacuuuguuuaaauaaagucuggauaaaauagcucacuguagagcaacuacuaaaggugccauaugaauucauugaagcagccuguuucuucacacguacagguaaccaggugguccagcagugaagagugcaucccugagaugcgggcacacacacaccugcacguucucuccagcucuuuagaaccugauugcauuuguuacacuguuuaauuuccuuaauaccuauaaguaauuucccuuagcaguauuauuuucuccaauaugaucgacugauuuugaaauuugagccaugugaaguugaguaaacauguuuugccuuaugaauuuauuuuucugccuagggcaagaaaauuccucaacagcaaacucaaaugaccuugcaggcuccaaaucaucuggcuggaagauucuuucuguuccauccaucaucuccccauccccuccccauccccucuuguguggccauguccuuccugaaggaucaugacaaacaccauuaguuacaguacuauaguaguuuaauaaguucacuacaugucaguguaacagagcuaauuuauuuuccuuuuaagucacugucuucuuaaaauacuuuggaaaaauauuagcucaguuauguuuuagaaacugggugaggugugauuuuuuuuuaaacuagauauugaaaauauugaucauaaauuguaaauauuuucuaguccauccaccagcaauaauaucccgcugaugaggguggugcaguccaucaagcacacaaagaggaggagcagcacaguugugaaggaaggguggaugguccacuacaccagcagggacaaccugguuaguaccacaggcgugugugcauguaugccuggaagcugggugacggcucugcugugugcacugugacgguuaagauaggagugaacucuguacugacaucguauccacuacagcagugugcaaaagcuaugcuagaaugaucgucaagacucaaaaggaucaucagaguaauggucaaaauaugauuaugcuaaagauggaaagaauuaaaauugcacaggaauagucaucuuugguaagguaggaagcaauugucuugguguguauagacagcguaagugcaccuauucucgcagaucagggcagcgaagaggaggcauuguaaaguuagaguaggacagcagaggaagaagacucagcagaguggaguagcugagaguacuggcugcagagccagccugucguaagccucuuagcaaaacuaacuuuucuuuaugccucaguuucuuugucuauaaagucuguauaguaguaguaacuuugucauacauccaagugagauaauauauaugagaagaacuuagggcaauauuuagcauauaguagcagucaguaaaucaguagcuguuaaaauuugcugaauauuuuuaguaagccuuuuuagaauacugugaaguuagacuguggcaguauuuagaucucccuggaaaaguuccuuugagcaauggacggcaguugacagagaaaaacucacaucucgucaaagcacagagugguucccauggaauacucagccccaaaugagacaguaccaccauguuauaccuccucucacacaaggcucagggaccacugugaaagaggcagagagacugaggggcagagucggggaggaccccagggaaaccgucuucuggacgugacaagacugcugugaacucagcagcuguggcgucgccgugacaguggaaaggggcucagacgcuccuguuccuagccgagggcuucgggaggacagaaaguugaucuucuuuaagaguaaggcucccacugggucagcuaugcucagauggcccacacccaggaauucaugacuggcaccaacuggacccuggguuauucuuuaaagagggacacaaacuuuggggauuagugugagaucugggcagaguuaggggaaggaauggggauaaaauuaucaaaauacauuggacacaucuauaaaaugcucaaagaauaaaaauauuucaaaacguaugaaguguuuaauauauuuagcugguuucaguaaaguuuuacauggugacagcaguacagauuacagcuauauauuuuuucauuuguuuauaacccauguccuuucaacaggaacauaaaagaaauauacacacauaugagaauuuaguugcgugucucaugaugaauaacucaauaaauacuauuaggguaaccaauuagccauuugggggggaaaugaccauaacguaaaucgcauuucacauggaacaaaacuaaaugaaucaaacuauuuaaaugguuucacguuaaugcagugggagaaaccgaacaguuacuuuauaaagauuccguguuggacaggggagaaccaugaaccaaucucauggaagaaagucuggguuuggcaaacccaaaaacaagacaaaugacaaacuggaaaaaguauuucaacguaugcuuucgauaagaacuaaucaagaauuugugaaaaagccaacaaauugauaauaaaagaucacaacacaauaaaaacguuaaauaauaugaaaagagagaucacagaaaaaggaaauaaaauuauucuuauacauaaagugugguuuuauuuauaauaaaaauaucaacuucaacuugcacugauauaacagguuguuuguuuggcuuuugcuacaucagagaucaaaacguuuagagaucuaagucagugauucucaacuuaugggucacauccccuucuggagggugagugacacuuucgcagagguugccuaggaacaucagaaaacagauauuuacaucauggcucauaacaguaguuauaaaguaccagcuaaauaacuuuauguuugggggucaccacagcuugaggaauuguagcaaagggucagaguguuaggaaguugagaaccacuugucuaaguaguuaccccugcggcuacaucaccccaauggagaagaccaugaauuaggucaagucuuaauuuaacaccaucaaaacagucuuuuuauaucuuuuuaauuuuuucucuauuuuugagaauuauauauauauauaugugaaguaucguacauguuccauuuuucuccauguccccccagcacaucacccuuucaacuucacaucuucuauguaugugugugauagccacucacuuagugaguacugcagauaaauucccaguggaggaugaaaaccuaccagugaccacuucuuaaaaaaaaagaaugauucucccucccccagcaguuguccacuguuagugacuccucauuaagggaugagacccaaagauuaucuacuccacccaugccaggauuuugucuggcuugaucauguauagaccauagguaaccacggcuacuuauauaaguucauucccugaagauggcauuucacagcacccuccccaucuggcucucucugccuccugugugauguugccugagcccugguggugauggcauaaguaucagggucccauuuaggacugagcacugagucuuguucucagcacauugaccaauuauguagcuguccacagacugcuguccaugacccaaaaaaacaaacaaaaacccucugauguagcucgauugcagcgcaagccuggcagcuccuggagcuaggggaacugcagaaguauggcucuggggcucuguauccaggaacuggaugaauagggaugguuggggccucagaaccccuugccugucugugcuuggggagcagcucuguuuauuuuuugacaacauccagaaauuuagcauagaaguaaauuauauaaaucuaugcaugugaaugaaugauguacagcuacuucuguguaccuacauaaauucguaugaaaggacccccuaaaaccuaacuucacuuggguaacaguaagaaaugggauauaagucaaugugggagugauacacuucaguagauucccuuuuuauauuuugaaaauuuuaaaccucauuguuuaaacuacucagaauagaagaauggauggcaaagggaaagugcaaguaggaauuacuuuugagccaccuuuucugacuucuguuuucaauagagaaagagacauuauuggagacuugacaguaaaugucuaacauuguuucaaaaugaaucuggaucaaaguauuauaagguaaggauuuugcauuuuauaaaauguuaaaauauugugauacugauuuuuuuuuguuucguaaaguuuuguaugguuaacuucauuuuuauguaaauguacuuauuaugacugccuaauagaggucaucguuaaguccuuguugaagcaacugcccuccacuuccauuuuacacacacacacacuacacaccaaaaaaaauaaauaaguugucugguuuuggccuauuacuuggacuaaacguuaaauaauaauuuaggccaauguauggacgagaaggaaugcuuaagcaacuuuauuuauuuuuauuuuaugcauauugguguccuaccugcauuuaugucugugugaggguagcagauccucuggaacuagaauuacagacaguugugagcuaccaugugggugcugagaauugggccuagguccuuuggaacagcagccagugcucuugagugcugagucaccucuccagcccccagccauuauuugugcuugcucagcuuaaggguuaugcuuccagaaguguggucacaggagaugcagcuaaugagugguaccgacagacguuagucugcagguguuggauguggaggcagacuauccugcuagaugcuuuucuuccaacaucgugaagaccugcuauagcauuucauuguguaggguguguguguguguguguguacaugcacuugcaccugugcacacacaguaucuauguaggggcagaggcagaugccagaugucucuuucguuuguccguccgucuguccuuucuuuuuuucuuccuuccuuccuuccuuccuuccuuccuuccuuccuuccuuccuuccuuccuuccucuuucucucucucucucucucucucucucucucucucucucucucucucucucucucucuuucuuucuuucuuucuuucuuucuuucucuuuuuugaaguauaaggcuuuguuuuguuuuuuguuuuuguauguguguaugaguguuuugccugaauguauguguaugucugaugcccuuaguuacaagaaugggguauuggguccccuggaauuaguauuacagguaguugugagcugccacguggaugcugggaaacggacccaaguccucugcaaaaguagaaagugcucuuaaccacugagccucucucaacccccacccacccacccacccacacacacacacacacccacacacacacacacacacacacacacaccuuauuuuuuggaauaagcucacuguucuggauagacugucuggccagugagcuuucccagauccaucugucccugccugcuaccccuuagcucuggggaccugacagguccacaugguuguaagcacuuuacacaucucccaugccccgagucuaacacuccgugaccugccucuagcauuacugaacagucaagucauuuaagacagacauaccauaauacuuggcugccuaauccauaugcuguauaguguguuggacuuaguggcauucauagaaaugcuuaucuuugcuucuaguguauuuuagaaauaaagauaaguguuuauucauaguuuuucaguguucaacuuuuuuacuacaggaaauuccacuuucagaaauucuccguguaucuucaccgcaagauuucaccagcauuucacaaggcaguaacccacacuguuuugaaaucaucaccgauaccgugguauacuuuguuggugagaacaaugggagcagcucucauaauccuguucucgcugccacuggagugggacuagauguggcgcagagcugggaaaaagcaauucgccaggcccucaugccugucacuccucaagcaaguguuugcacuucuccggggcaagggaaggaccacaguaaguggaagcacauugguggcuucguuucauuuuaaacauuugcagauacacuuguguggcugugcuauuucauucuaucuuuaaugcuuaaguuuugucuuuaauugccaauaccauuaguuaauaccuuuaugaaguuaugcugaguaucauucauauacacauaugugagagagagagaguauuuguguguguguguguguguguguguguguguguguguguguguguguguguguguguguguguguuggcuccaggauauauauauucacagcuagcuaccuucaucuccuuacauuuaaacucugcaucucccagccugcugucagaucugagguggguaauuuuuuugcuguucuauaauaguagcuacuguggaauuguuagcguugaguggauccagucuguaagacaaagaauaguaccacagugcuuagcagcuuaguguguaugaauugcuuuuuguuuugggauuuuugugugugugcgugugcugacauaaaguaucauguuuacaguauacucauaaaaucugauaggucagaaugauguuacuuuuaaaugaauuacgacagaaauuuaaaaauauugaaguggccauggugguacacgcuucuaaucucaacacugaagaggcagaggcagguagaucuauaaguuagaggccagucuggucugugaguaucagccagggauauagugagauccugacucaggaaaaaugggguuuggggugggggagagaauauuaaagaauacuauuauuccaacaaaacuuuaaacccaaauugaaugaauauuuauuuaaucguuaaaaaauauuagagucuaauacagcuuuuaccuuauuggaauuauauccauagagaauuauagagaaacaucaucauuggacaaauauauuuauauuaaaauaaguaucagccacuuuccaaaugcaauuuaucucagcuuaccuguauuauuuuaugcaacuguuucaugcauuacguuaggucuaaaacuaaaauucaagagagaaaugauagacgcuacuuaggggagaugaguacuugacuguuaagcagcagcagaugcaaugcagggacgaaaucaggaagguuuuacuguagacacugagguguggcuaggagaagcagggcuucauaguagaaaacuugauuuggaauuuggccugcagucaaggguaggauaggcagagguaaauaaaagguagaagggguagugcugcuuuuguuggggagacagguguaaucacgagugugaaggcuggagucaugugcagccuuugguacgccugaggagggauggguggguggaugcauggcuaacaggguuuacguucugggcaguuuagacagcacuagcauuucaucaaaacuaggagccuuuccccagaaacauuagagacauacaugcacauuuuauucuuaacuuccaaaggcuugcuuaaaagucucuaaggcagaauccuagaguaagaggggagaugagggaaaaugcacacaguugcugcucaccaugcugugugaucuugggcuccaguguucugcauccaaagugggaggaauaauaaauacacacagugcacugggcagcgugcccaagacuuaacugauauucccauuuugucugaaacugagagaaauuaaagcuggauggauccagauagaggaggccauugagagaaaagaaaauaaugaaacuaggaaacaaaccacuagaaaggcauuggcaggcacagucauuuugcuggugugcuuuuccuugaucagucuuaaauuuuuaaauuacuuacugguguacugguaugcuccuuuaauugcagcacuccaggagguagagggaaggugaugucuuugaguuugaagccaacauggccuucauagggaguuccaggacagccuagguuacauagucaagacuauucccuaaaaaaguagaagauuuggagcugggcagugguggcacacgccguuaaucccagcacuugggagacagaggcaggcggauuucugaguucgaggucuacagagugaguuccaggacagccagggcuacacagagaaacccugucucaggggaaaaaaaaaaaaaaaaaagaugauuugaaugacauaaaauauuuuugaaguggcuuaauauuuuuaaauaagaguuucucguguguguguguguacacacguguacaccugaggacaagaccagaggagaguaucagguccuuuucuauucgcugcugauucccuggagagcacugaaauggacuagacuuuggcuagacugacuaggcagcaagcucucuuaauccuccucucucugcaccgcacaaagcugcacaaggccagacuuggccuuuuaaaacaggugcuggggauuaaacuuggauccaaaugcuuuugcauacuaagccguuccccaaccugaauuacuauuugaaaugaagaauuugcuuauauuagugcuguccuguguuuuaguaugugcaguugugaaggaaucaucaugguucguuucucuggguugucuuaauggcuuuuuggucuuguuuccauauuucccuuuucuuauugcuuucuuuauuuaccacaguaacucaucaaaacuuugugggacuaugucaucugacuugaggcaauccccgggauacaugaggguccaucccaucucaguccugucucugccuucaagagaccguugucagccacuugcuauagaugucuuaacuggggaaggacuugggaggaugggaguccagacgaacuacuacauuguuuuauuuuuccuuuuucgaaguauaaggucauauacucugaggucuuuuuuuauaaauuccuuuuaccuacucuuaauacauagaaggcauauuucauuaccacuguguaaauuuaucuaauuuaaacuuuuuaaugaaaguaaugaauucuuuuuuuuuuaaugugcauggguguuuugccuccauauaugucuguguaccacauaugugaacgaugcccccagaggccagaaaaggacaucggauccccugagacuagaguuacaaaugguugugagccacccaauggaugcuagaacucaaaccaggucuucugaaagaucggccaguauucuuaaccacugagccaucuguccugauacaugcuuuuuguguuuuaaaacaauauaagcaguauagauacaaauauuacaguccucgcucccgagccuacaucacucacucaccagaaguagcauuuuuaguuuaauucaaacacugcuacacuggaacuugcuuuuuccucuuuuguugaaugcagggccucauacuucacacauaguaggcagaugcucuaauacugagcccuuaguaggacauuaugucacagaucuaugcuguuuauuaaauauuuagaguauuauuuguguggaugugucauauuuuauuuacucaguuucuuguugauggguuaguauuguauauaacauuuuaaugcauauauuaucuauauugauguaauuuuaaguuugauaagcuauggauuuccaagaaauaauauuaagucauauacuaacuauuuuguguuuuucuuauauuccauucuauguacagaagaucuggcuaccaguaucuccgugucuaacugucagguucaggagaaugucguaaguaauaauuacaucccaugugcgcagaccgaauaauuaaaauaagggaauuaaugugaaaaucuuaccaggauuaaguuuauauccccaagugugggaacaggaccaagggcagaaggugagaggugauggagucacacgaugaaccccgaauccugggagucagacucuggagagcagcaucagggugcagagcugaguuuauugugcagcacugugcaguacacauaagcuuauaggcagugugugagccaaucccaagccccuaaauccucggccaaucauaucugaccauacugucaccaugcuccagugaaaacccugccugaugagguaacucagaaggaguggggggagaaccgucaccuguuagaacuucuaugaagacagggacguagccuagccacugcccuggccucuguucuuuuggcaaauuuaaaucuaaugcaguguucggcagguccagacucuucaaggagucgcaggaacaugugggaaacucagacaucgcuccugcugagcaacuuccacccuguguggaacgugcaugcgugcgugcgugcgugugugugugcaugugcgugugcgugugcgugugcguguguguguguguguguguguguacgcgcgugugugcgugcugucucucacgagcuuggugcucacugacuaggcaguuggccagcagccucaggaucagcaucucgcaccugccugcauuggaauuagaagcaugaagcaccacacacuucuuuuaaaacuagguucuguaucaaacuaagaucuuugcacagcaagcacuuuacaagcugagcuaucacccuagccuaaugauuuuguugugguuuuguuuuuauguuuuaagucgaagauagcagucuuguguuugguaaaacuuaguucuuaauuuuuuuauaggucaguacugaauaugaaauuuauuuucaacucaaagcaucuuuuuucccugaaggguuuuugguugguugguuugguucuauuuugagacaggucuauguagaccaggcuggccuugaacucacagacaugccugucuaugccuagaagguaggcuagaauuaauggcaugugucaccacacccagcuccuaaggguauucuuaaagaauaagguauauaaguuauauauaaguugcauauugaaucauaguguaaggccaggcuaacuuucucuaaaauccaaaaagccuuugcuucauaaaauauuuugugcuucauaaauuuuuuugccucuaacaugaaauuaaaacuaaguguuugagucagcgacguugcugugcuugcuugaugaagaacacugugcuugcuugcuuucucuaggacaucagcagcguuuaccagaucuuugcggacgaggugcuugguucuggccaguuuggcauuguuuauggagguaagcaaugacagccuguuacauacauaucuucuaacuuguaaacucugacgacagcugacauucuuuuagcucacaguucuguuaagugcucuccuccucaauggcugguucauaugcucccaacuaaaaccaagucucucuucauuuccauagcagaacuaagaguggcagggucaggagauuacuucuacaguagucuucaugucuucuugcagcagcucguacguaaagauguguuuguauuggcuuaugugcacuguucacugaaguauguuucccacuaguuuccaaugcacggucagcauucaucuucucaggucugaagaacugaauucuugcucuguccugcgguuaagaacacugauuaaaccauuuagcaucuguaucucaaaaucuugacagcggcuuaaugaagguaguaaacugaguugcacugcacauaggcuuacuggacuuaauuacaacaaacgugcccaugacauaacuguaagcugugaccccagauaggaugugaacccuugaccccaccuucaguccuccccuucuuucacaccacucuuggagugagccuuucagagcaucagcaccgcauguuaguauuaggacauucagaagccugugguccguguccauuguucuuagaguaugcaggcugcuacagucugcuuauguaaccuccagucuaauuacaguucauuuuuuauuucuucaaggcgugcuugcaugccucuguauuugaccucugcaccuuucuccguccuuuaguuagcauguguuuguuuccagccucaacugaaggaccaccucuacugcacugguucucagccuuccuaauaacauggccccuuaauacaguuccucuuguuauggugaccccccccaaccauaaaauuauuuuuguugcuacuuuauaacuguaauuuugcuguuaugaaucauaauguaaguaucugauaugcaaaugagcccaaugaaaaggucguucaccaccccccagaggcgugugcccacagguugagaaucaccucucuauguguuuucugaccauccuauugcucaucugaguaucugcauugugcuuccuccaugccccugccuuacggugggcauccuccugccagagagccuguaacacugggucucucucaucuuccugcggaacucugaggguagccuugaggauggcuguuuuguuuuccaaguaucugcuuggaacugugccucacccagaaaaauguguggguuuuacacaugcacacaucugugguuugcaacuucagauuuguuaguuuuauacuagugaggucucuggaagaccucacugagggaaggguaauuggucugaaguaccagacaaccccugucguuuaaagcagucaggauuuuagggcugugcccuugaaacaguuguaauuuucaaguuaaucaacagguggagagcaagucccguguguuaaauggagguaagaaugugccugcuguucccaccucuucaacggugaccccacuuaguuaguccagcgugacucguuuguuucaaugggugaaugagacacuguuauguacuuaccuuauaccuagaaguugaaggucuggagcuugagagucugcuguacuuaaccacgcugcugacuuggugaaccuagacuaaaagucacuaguacaucauuuccaucuugacagacuccgaagacuuggucagggcguuuaaaaacugucacuuauuuacuaugaucuguuacuucucagcaagcaggccauggagguguuaugccauuucaggucaugaaauugccuuuauuacaggcaguacaauagaggaaagcaucauguuuccuagaauguggaaaagaacaugaacagaagauguaagaauaaauaaauaaaacuucagucuguggauaaguugucaacccagcuuuucuguuauaugugagcugccaguugauucuuuucuauucuuugacaggaaaacacagaaagacgggaagggauguggcuauuaaagugauugauaaaaugagguuccccacaaagcaagagagucagcuccggaacgaaguggccauuuuacagguaggacuuaacgguggcucccguagccuggaguuugauuugugagacuucgaaugaauauuucagaugaugcagaaaggauagguuugggggucuuuuggaucuuuugcauacugaagauuauaauguauaaaaguuuaaagacccacccugcugugauuuuacuuuuaaagcuaguuugauucaaaucuuuuuuuuccugagugaaaucucuaaaaauaauaaagggaauucaguuuaaauuccuuuagagauacugauccuucugcuguauuuuuaucaugucauuauuuuacucaucagauuuucagauacgauguaaauaugcuaguuacucuaaaaauaaacacuaauuaaagcgaagugugccucuagcaguaagauguuguucuguuaauucaaggucucugcgcugcguuucuucaguaaaaguuuggugcuguuuaguuuuguuugguugggauuuuuguuguuuugguuuuguugacaccaaggguugcuggguagcccaagauaaaucgcaugcuccuggugguccuccggcuuuaaaucuccugagugcuugauuacagaugcaccaccaugcucaacuuacuaaagauauguuagcagauguaaaucacauaaagcgcuugcauuguucuuuugaccuaauauuuuuaucuucuuugugaguuuaagcaaaugucagugguacauuucuuacauuauuauugcugguaaguagcaacuacuucauguuuucagaggagggauaaucagaaguccccugaucagucgguccccagcucagaucaagccugcuuccagcaaagucagcguuagguagaauauuaauauuauuuacauaggcucuguauaagaguguuguuagccgggugugguggcgcacgccuuuaaccccagcacuugggaggcagaggcaggcggauuucugaguucgaggccagccuggacuacagagugaguuccaggacagccaggacuacacagagaaacccugucucaaaaaaucaaaaaaaaaaaaaagaguauauuguugauguuuuucauauuuacuuuugaaaucuuguuugcuguccaacuaauacagaagacaauaugaacauaaagaucuucaucuagguauuaauuucucuuuggcuuugaucacaaacagcccuagagugaauauuuaacuugggaacuuaaaguuacugcacacagugaauagugcuuguuuguaucaguguacaauuagguauuuuagguugucucuagauacucagcuuucacuaaaacagguauuugagggagggaguucguguguguguuuguguguguccaaaauugugacuuugguuauuccuugacaguguauaaacucagcaaaaucuauauguguagauaguuuaaagaugaacuuuaacaugcuuuaaaugggagauagaguguagugugaacuugaaacacaaguacuuuguaaaacaaaauuuccacauaauaccuuauuuacugauugguacacgcuagguaugucggucagugucacguaccccauggucaguguuuggaccaguugugccuuucuguuaauggucuuugucuaauacaaaaggaagggugagaguuaaauauuuuccuuuccuucuguaucuucauauaaucguuguagucuuuuaggugguuucaugcuaagacuaguuuucuacugaaguugaucacccaaacacccuuccacuucugcagaaucugcaccauccugggauuguaaaccuggaguguauguuugaaaccccagaacgagucuucguggugauggaaaagcuccauggagauauguuggaaaugauucuguccagugaaaagagucgacuuccagaacggauuaccaaauucauggucacacagguauuuucauuauaccuugaaaccaguaaaccuaagacgagucaacagccccauuuugauauauugggaaacuaaggaaugguagccuuaauaaaagugaaacaauaauacuuuuagcuacauuugacuaaauauaguagaguuuugaaauuauuauacauuucaagaagucgcauugggauuuagcugauuuucuaggcauuuaaaaaaaaacccuuugcaggaguaggauuacuuuuaaauucuauuuuuauuuuauguguaugaguguuuugucugcauguauguacauguguguggugucaguguaggucagaagaacuagaguucaacuaucuuguguggacuggggacugaaguugguccucugcaaggacagcugauccccccacccucuguaccaugcaucuucucuccagguuguaggucagcauggaaagucagggguucagggugguuuuaauaccuguuugccaucuuacuuugcucucaguugcuccucaaauccuucucccuaacagauacuuguugccuugaggaauuuacauuucaagaauauugugcacugugauuuaaagcccgaaaaugugcugcuugcauccgcagagccauuuccucaggugagacauucucagaacuggauuuagaagcauuucuaaauuaacaacauuugcaaaauuuccuccugauacggaacagagcucugcauacaaccauuguagucucuggcugccagucugaggcagcagcuaaaucauuuaaauucagacuuuauuauauugcugguauguauuaacacuuuuucagauuaaauaagucucaagaaacaaacuuugagguuucuuugggguggggcugaguucuaauuauguauaugagacuuacauucacacguuuaagcucuucaacucucugaauagagaagucaccaaauucaguuaugucucaguaaguuuuacucauaagacauguaucauaugacauauacuagaaacagcaagcagccuuugaauaugccuccaacucuguucucuagcaguugucugcacugugucuguauagacaccaaaccccccucccaguuccuaaaucacuuugucaguuagagcauugccucuggggaggacuuagcauuuggcuguugggcauagcugcaaucacuaguaaccaaaacaaucuaaauugaugcaacacagucaguguccugagcuuugcuaagcccaucauacuuccagagaacaugguagugguuguggucauguucauauguaaccuuauucaacucuaaaccaacuggaguaguagucugucagcacagaaagcacuuacagcucagagguucucgacuguucauuaucaucuguaagucuuguuuacuuaccugcugauccauaacauccugccaacagauacucaaagauaaagcaaaaugaaggagucuucgaauuacuguaguuuauuuuucauguagcaaaacguuugaauacuuuuauaugucuagacacuuaggauucaaaacugaaacacaauuuuacagaaauagaaaagggguauauuagucaggguucucuagagucacauggaauaucuauauuuuaagagaauuucuugugaugacuugcagucuguaguccagcuaaccucaaaugggcagccgugaguaggaaguccaagaaucuaguaguugcucagucccucgaggcuagcuguuucagcuggucagagaaguagguuccaacagaugugcuggcagguaagugcaagcaggcaagaagagugaguuuuuccuucuuccagugucccuauguaggccuccagcggaaaguauagcccagauuaaagguguggauuggaacuugauuugucccagguuuacccugaauucagauaucugucugccucaaucuccugggauuaaaggcguguacuacguugccugagccuaaauuuuucauggccaacaugccucaagauguccgggucagaagccuaugucuuccagccucaagaucuggaucauaggugugcccuccauuucuggguuguaguuuauuccugauguggucaaguugacagccaggacuguuccaggguaacagggggcuccucaauugaagaucagcauccuccauccauuucaucaggacaacaaaacugaauccuuguuccaugacuccauagagaacaaauuguuuuuaaaauaagugcuaggauagcucuucauacugcuguagucucagagcuacaaauggaucugccugccucuggggagauggcgguucacuuggccugucuauagcuguucguguauagucggcaccuuugcuuaagugcacugagcauagcuagggacagguauugauacauaguuugauaagcuuugacauauucaauuuccaggugaagcugugugacuuuggguuugcccgcaucauuggugagaagucguuccggaggucagugguaggaacuccagccuacuuagccccugagguucucaggagcaaaggcuacaaccguucucuagacauguggucggugggcgucaucguuuaugugagccucaguggcacauucccauucaaugaagaugaagauauaaaugaccaaauccaaaacgcugcguuuauguacccaccaaauccauggcgagaaauuuccagugaagguaaaagagaauuaaguuucagguucucaccuuuagucugaaaucuuugggaucaaaaucaucccgucucuucaucucccugagucaguaccagucuuugggcacucuauuguauuuaguuuauuauuauuauuaauuuuuauucuugagacagggucucacuuuguagcccugucugaccuagaacucaccauguagaccaggauggccuugaacucacagagauauaucugccucugccucugaagugcugggauuaaaugugugugccacugugcaaggccaaguacucuacuuuuaaacuguuuugucucuuauuuuucucaaaauguuuggucuuggcaguaacccaggccccaccagccucauccagaaacuacuaaaguggccuuuuagcugugcugcccacucgucucucugauuguucagucacugcuacuggauccaucugcagaaacacaaguuucauguauuuggcuucccuuuagccacaccugcuauagguuucugauguggcccuuguuaaagaaccuuuugggccucaccucccacuucucacacaaaccuaguuguguacuccuagacucuuuucuguguuuugcaugucuuuccucuagccaacaaccucuccuacaagccucuuacgauucuucaaagccuaccuucugaguggccuguguguccuccugaccuaccccuccccuaagcuuuaaagaucuucuuaugcuaacacuugagcauuuugucuuaaggauauguuuggcuaacugauuaucccagucuucagaauagcauuguaaaccccuugaguagacauguuuaguuuauguacuuuauaccuagagugaccuuuuguaucugcaggucuuuuuuuccaguccuuccgaucccuucccagaaagcuucaugcuauaguugucaugacuagugaaggcuuuucagucugucaugccuccuucuguacaugucaagaaugagccagggcugucggcauacacuaggaaucccacgauuguggagguuucaaagcuuuguacaagaccuuuucucagggaagggguggggaggaaaagacagggaaaggaaugcaguugguccuguuuaauuauugauggaguacgccauugcccccaaccuguuugcuaaaaccgacagugggaacuuuugcuguuggcuccacuucauucugaggauauuuguacaagaagggugacgacgucugccacguuuucacaccacgcaagggagagcuuugugauuaucauugcaagagggaaaccuaucuggaaccagucugcuuuguucauccucaaaugacaguaaugaauacuuagaacccaugugcuaaacacauccuaagcuuuuauaguaagcugacugcaccuucccaacaguuucauuguguagaugaggaaaucaaggcacagcacggguuagcauagaccaugucauccugugguguagcacaagucagccuggcaaucuggcgucaggguaugcguguaaccacgcugacugccaccucaguaacggaaaaaguugucauuaauacuuauuacgggccacuucuguguguucaguucuguguacuggagaagcagauuucguccaugccaucuuuacgugaguccaucugcuccccugcaggcagaaucacagguuuggguucaguaccccaaaacucauauauauaauuuugcuuuucaucuagcaauugacuugauaaacaacuugcuucaagugaagaugagaaaacgauacaguguugacaaaucucucagucauccuuggcuacagguaaaaggaaaaaaaaaaguacucugcaucguccucuccugugaguuugucuucaccgaugaaaccagucuaggagcaacagguucagcauggccugggauaaucuaggccucgguggucauuaucgugccauggcgugggccucuggacaagggcugccugucacucaagucaguguugacaagcaguuaaauacccaggaacagaaacaaugaauuaauuagccuuucauaaguacuuagcugauuggguauuuuuuaaauuaacaugguauacuguucaguauauuuuacuuuaaauguccacuaaaaguuuuucucuguuuggccgguuccuccaugaguuauuacagacauuuguuccaaaaccacaagucugcacuugagagugugcagaacagcugugcaacuacguuguaggaaauggagaguggggcuaacacuaaacaagucacuucugggcugcucagcacauuagccuguaauggacuccgauuucuaagauucaccuucaacguugcccauucagaauaccacaguuagaacuuaggaagaggaguggccaauugugugacuaagguuauaaacaagaaggggcugucggcauacugucuauuuuaugguucacaaucauuuucuuuuccuaggauuaucagacuuggcuugaccucagagaauuugaaacucgcauuggagaacguuacauuacacacgaaagugaugaugcucgcugggaaauacacgcauacacgcacaaucuggaauacccaaagcauuucauuauggcccccaacccagacgacauggaggaggauccuuaguugucagugcgccgaccucaauaaggaaggauuucacuucaagagcggauacuuugcugcauggcugguggccucugcaggcuaccauugcaaggcggcagcaccgugaggaaguagaaggacuuguggcaucaguucuguagcucauaacgaguagguacaugaagggaaacugaguaauaaagucaaaauggaacuucuauaaauuuuuauagcauaagcaauaacugguucuguaauuuuuccuaauccuucacauuagcacaaugugaguuagcacuuaauuuaucucuuuuaccucuccuuuucuguuauuacaucauuuguuuuaaaggccuaugacugucuaguuauugcuuauaagguugauuacucaacagguuugcaguuaagcaguaaccaugaggcuaacagcauacagcuugcuguaaggaccuuuaguguuuguccacugucggaggcauugcuuccuccuuccuggacccgauaagcagaccauuguacugcuggccuuccgguggaugcgucuuuccauauggccuguaugacagaagaguugucacauuuuccauguuauaacagucacuaggauaaucgaacaauugguguuacaaaugaauagaaauagcuggucaucacucagcucugccucugaacacguauguucucaauuggcaccaucauguuacaguaugccacagucggugggcacaacgcugcauuuaacuaauuuauccucaccuggaguugaauaauguauagacaaaaucacauacuagagagggaagcuaacacaggucaguagaugucacuguuaucuguuuccucuucccuuggccuuuggaugggguuuccaauaccuaguguuuuuaaauuagcauugucguuugagcaguuuggaggagugacugaagucaaacaugaaaacuuaguuuauugaggugggaccuaauuaccaguagagcggauggagaaggaguaagaacgucuuacacuucagcuccaacagccagcuguuuuguaguaguuauuaauacaaggucaguaucccuaucugagcugcucuacaccaggaagguuucacugccagauacugaaauguuugcacacucuacuaguugagcaucccugaccuacaaauccgaaauccuccaaauucaagaaacuuuggaguccuucagauuuccacauuagugauauucccaccugugcuuuacccaaagagaaaaagauccaggaccauccucucacaagaaauauaguagcuguuuguuucuucauuccucacuagucacaaaaaaaaaaaaacaaaacaaaaacaaaacagguuuuucuuguuguuuuuccuuuucugugcugagagcaagaauuuggaaugagaaagccuggguuuaagccuaagugucuuuacucuguggaucuguggggcugagcagauaacauugucugagcauuuguuugacuuaguuucucagucuguagaguagacaccauaaauucuuccuucugccuuccuccauguggcugugaagauugggcuaugugaccacuugugacaaucuggaaugccaggguugucgcuuaccacgggcucugagauagcaaaggaaaaacugugugugugagcagaccaaaacuaagugccaucccagaugagaaugcagcugcagugaucugucuaaaauuaaaaauguucuugaggugacagaaacagcaggggugcccgguuguaaauguuuaugcuuugaacuguccucacaauagucacaugacuaagcacacuuaaaguugaggcacaggguuaguugucaaagugcauugaguuuaaauauggauuuaaacccaggccuauauccccaaucccuuuacccgucccagccauugacaauguacuguacaucuguaagaauuuccagaagacuuuccaaacugucucuguaauuguuuucauacaguaguugugaagaguaauuuuaagaaacuucuaagaauggauuuuuccauuucugcuaagucugcuugaccaguauguacaagguggaacucgugugugucacuaggcagcccacggugguuuuaccaugggaggugagaacuaacugaaaugacugcugguuugcuguacuucuguaaucagacuuuacaagccaugacauuaauugcacucuguuuuugucaaagcccugugcuguuuaaagagagacuguaaaggcgcugucacggugcggaguugaguaaccacuccacuguuuaaccugcauaacuuuuugucauugucuuaaagccaagcuguguuugcauauaugaaaguaauuguuucuuagaaacaugugacaauuuucaaaguaguguauaaugacacuguuuaguacauuuuauauuuuuuguuacaucccacuuuuuguaaauauucucaaaacuugauaauaaaauguauuucucuaucaccaua

SEQ ID NO: 8749 - RNA, 13576 nt, Mus musculus
cagucucuacccaguccuuaaaaccccggaguagagggauggcgcaucgccucuggggugcguugcagacaccucugcgacgccagcuugaaaacugccagcgggcugggauuuaacuccacuuuaucaacucccacccccgacccuucucaacugcaaccccaacuccgugagaaagcccugacuuugcggggucccaggugcaaacuugagacacuuuugucccuguccuccauccuaaucuaaguuuaggcucugauugagucaagaguaggugcuaaagcagcgggccucaggugucuaggucucggggucccuggggacucucagguugaagccuugccagaaucugggcagaggcuccagagcuucucccagaucccgcugcucuacaccgcuggaaaccacgcuucaucgcaggucagucuguccgcggagccacuuuccugaggucucuucagggcaguucuugaaggucagggguggggguauuagguacuuuaaaagaaaccugccucagugucugccacccaccggcauugugucggaauucugggaaccguuaggcagcuggggauuuggaagccgauaggucucugcuggaggcugaguuggguaggaaacauaguuuuaagcaucuugcccagaaagcuagccuuuaccugaauuaugcacugccuccucucuacucaaucccaggguaaagccccaugcuggggccgagacgcgggacggagggcacucuuuuuuuccuuugcacaccugaguuucacgguuugccuuuguguccccagcauggccaccagccuuagugcagacaguccacagcagcugagcucgcugucuacccagcagaccacucuucugcuacucuucuccguccuggccgccgugcacuuaggccaguggcugcugcgacaguggcaacggaaaccgugguccucgcccccaggucccuuuccuuggccacugaucggaaacgcggcggcuguuggccaggcgucgcacuuguacuucgcucgccuugcaaggcgcuauggcgacguuuuccagauccgucugggcagcugucccgugguggugcugaauggagagagugccauccaccaggcccuggugcagcagggcagcaucuucgcggaccggccgcccuucgccucuuuccguguggugucugguggccgcagucuggcguucggucacuacucugagcacuggaagacgcagcgacgcucggccuauagcacgaugcgugcuuucuccacgcgccacccgcgcagucgcggucuucucgagggccacgcgcuggcagaggcucgagaauugguggcagugcuggugcggcgcugugcgggcggcgccuuccucgauccaacgcagccggucauuguggcgguggccaacgucaugagcgcugugugcuucggcugucgguacaaccacgacgaugcggaguuccuagagcugcucagccacaaugaggaguucgggcgcacagugggugcgggcagccugguggaugugcugcccuggcugcagcuauuucccaacccggugcgcaccaccuuccgcaaguucgagcagcucaaccgcaacuucagcaacuucguucuggacaaguuccugaggcaccgcgaaagccuggugcccggggcugcuccucgagacaugacggacgccuucauccucucugccgaaaagaaagcgucuggggccccuggcgacgauuccuccgggcuggacuuggaggaugugccugccacuauuacggacaucuucggagccagccaggacacccuuuccaccgcgcugcuguggcugcucauccucuuuaccagguaaagccuccgggagggcugggucaguccuucuuuuccuccuuugaaaaaaggagugccucugggcgcaggguuugagguuucgcgcugcgucgccccccaacccccaauuccucgaaacugagaucucagguaagauaaggccggguucaacugggcaggccaagacaugugcucccccucuauaaguguugccaggacuuuccagcaucucugauguugcgccccacucccuauccccccuuccccgugauagggaacaaauguauuaagaguccuuccccacaaaaaaaaaaaaaaaaaaaaaaaaaccaaccaaacaaacaagcaaacaaacaaacaaacaaacaaacaagaauuuuacugugcuggccuaucagcuuugagccuuccguggcucaauagaagcaaaauuggaccgguuccaaguuuaaggggaaugcaguaacuaaacacagcgcacagcgggucccagggaggcugugggcccuacuuccaacuucgggcaggguucuguuaccaggcuaaggaagccagcagaggucuguguucccagaggacaaccuaagaauaagguuuacccugaggcgguuccaccacaaaauaagcagguggcgucaauucuguggcgugccaucauccucuagagaggagucuaggugcuggugggagucuugaucucugggccagggaucagaccucuauagcgcaaggcugaacaucaggauuaagcagcguccccaccuccuccucgcacucaggugguuuaaguaaaugaauccuuuaugggaauuugacaauuaccuauuauuuaccuaaaaugcagauuuacccuguauuuuaucuagaagcacuacuuguuuuccuagagaauaagacagcgguucucaaccggugggucacucgacccaugucgccuaaaaccacaggaaaacacagauucauuacaauucauaacaguagcaaaauuacaauuuugaaguagccacggaaauaauguuaugauugggggggagggucaccaaaacacgaggguugcagcauuagggagggugagaaccacugcccuaagaagugcugaagaugcgcucaccuuugaauuugucacacaggaucugguuccuauuagaauucacacaauucguauucccuuagaucugcuuucucauuuuaaaaguaacguauauuuaaaauagcuuuucaauauuaaagucaaaucguggaaacauauugggacuagugagaugagggggcagaaauucucuuaaagggcauugaacccaagauuaggaaaaaggucuuccuagaauguauugucaggucuuucacaucccaagauaagcgaguacucuuugaaaaaagaaaaaaaaaauuauugagcuguauaaguuguucuccauguguuccaaagaaauaaaaccauuucagggucacuuucaaugaaauaaaggugacauuauuuuuccuuuuccugaaaaggcuauguaaccagagugggcaaauuacgaugccuguuuagauacacauuuuauugaugcagucgccacugguacgccuuaaacacuggggcaucucuccagcacagauuuuagcaauuuugauggcuauauaauacccuguucuaguuauauacauuaauauaaucagguuuaacauuaauuaaugcagguuuuggcugcauugugaguuuugagcauugcuaugauuaaacaucauuaucccuuuuaagcuauuuucugaaaauagauuucuagguauauaauauuggauuuaaaaaugagagguuaaggaauugccuuuauagaguuugcugcgcaggaagauuuugaguuccaaaagaauuguccccguuccuagcaaaagcagugcagaccuauaaugggucccucaucuuacaagcuggggcucugcuuugugaguuuaggacaugcguagcgucaucuauccagagaccaauaguacuuuauaaaauagaaacaaggaauugccuaaggauaugagagaagaaaaauaauuugcuuucaggguggcauuuuaauuucuguggguccagggcccuuuugccuuuguagauuucuuuauaaaacauugaaaauauauuuuauaacuacacugauauaaaaugaacauguuaaaguguguaugugaacaucuagcuguaaguccauuuguuaggucuguagguuuuaaaagauaggcaaauauuuuccugggugucuaaaagguauacucuugugcauuuuuagacuauuaaaaacuggagaguuuuauuuucucacaauggaagauaaauccuagacuacaagaggcuuaucacagaaaaauaaaauuauuauuguuuaacuuguaguaccgagugugagaaauuaguaaccuguuuuagacuuucuuucagaaauuguaauucagucacagaccuagauacuuuguggaauuaaaauagaagugcagugugcugcuaaggaaagaugaacugauuuucucucucucucucucucucucucucucucucucucucucucucucucucucccucccucccucccucccucccucuguuccuccuuucauacuaaaaucaaaacagauacccggauguucaggcccgcgugcaggcugaguuggaccagguuguggggagggaccgccugcccugcaugagugaccagcccaaccugccauaugucauggcuuuucuuuaugaaucaaugcgauucuccagcuuuuugccugucaccauuccacacgccaccaccgccaacaccuuuguuuuagguuacuacauccccaagaauacggucguuuuuguuaaccaguggucugugaaucaugacccagccaaguggccuaacccagaggacuuugauccagcccgcuuccuggacaaggacggcuucauuaacaaggcgcuagccagcagugugaugauauucucagugggcaaacggaggugcaucggugaggaacugucuaagaugcuucuguuucucuucaucuccauccucgcucaucagugcaauuucaaggcuaaccaaaaugaguccucaaacaugaguuucaguuauggccugaccauuaagcccaagucguuuagaauccaugugucucucagagagucgauggaacuccuggauaaugcuguuaaaaagcugcaaacugaggaaggcugcaagugagaggccggagggagcuggaauguuuaaggaauaccuaucucauuaacuggggaggaaauagauuuuuucccccagcuucauuuuuggccucagcucucagcagugaauggaaaccaaguggucugaagguggggcaugcucaccaauucauggcuccucuuggaccugugcuggaguuccuggaaguauuuuggaauugaagagcaaaagggcccaaggaauuuggagccuguuguuuuuuggguuuuucagcuaaacacaugcacacauaucaacauguaugcacaacuaucuaagaaaguauuucaguaauucugccuuuuuggguagauuugugagggaacuucuaugugcagaaauugaccccauaggaaacugcaguaagcaaaggcuuaggauauacccaagauucaaagacaugugauuucaguguaaaauguaaagaccagaaguccuccuaccaagagacagcuugcuuggaaaaaugcuucaacuccuuuauagcccuggaugaggcuuucugccugccuguugaugggccucccacuuuagaauggaccauaaagucaguuguccccuaagaauuuauggcugauuuaacaacugcaguagguuuuagagauuagcgaauuuaaagguaaauuguuuaggugguaaaaaauguuuauaaguuaaagccgaaccucauuugggugcucagaugaaguauuccaguuauaagggagaaaaagauuugcugggcuagcuuacgguuucaaguuugggauuguaaugaacugguuucaguaauaagucugauaaacuaaaaaaggaacccaguguucccaaauaguauucaaugcauauaaaaauuuaccuaacugcucauaaacaucauaugaauauuaacuauucaaucaggaaaacacuugaauaauauauuucuuaugucauauugcaaaccaaaaaguauaaucaguugagugaaauuugcccaauuccaggaaacgagccugacuaaaucaauccguuuugacaucagggaacugaguaacagaacagucuuuucuuauuuauaguucauacaagggacaaaucucaaaacuaaaccagcgaaauauguucugaucugguaauuguaguuacaacauggaugguucuuuuggaauugaccccauuaauauguuaagcuuacaaauucuugguuugcuucgauuuuuaaauuaguuuaaaauccaucuugauuauuucguuccaguugaagcuagagaaaaugugaucauuaucucgcagaaggugagaaaccuaaccuuugccuaagaacaaaugccaaauguaaaaauaaauaaaugauaaguaaauaaaggccaugaauguucuggguguucauuagagaccauaugauaggaggcucacuacaaccaguaauugguaguuucuuuuuccgaguucuuacuauuguuguuguaguuguuuuuuaaguugaguauuaaagucugugugucuuuuguuuuuguuuuuaaagucagaaucugaagauugucuugggagguuguuuaacaacugcuucuugagacagcagagaugccuaaaaucaguuucuuuuauuuaggauggcacaccacgaugagcagccacuuccuggaagcugagagagguuagaaauacauguauuccgauuauguaaacaauccgaaagcccuuugagaagcguuggauggguggaaaaguggggacagggcccgugggggguuucccauuucuguuuucauuucgauuagccugaacaaaagaagcccucagcacucagagagcuuacugcuggcucuguuucauuaggcuucuuggaauuuuccuaucaaaauuacaaaggaaggggagugcgauagucucugugugcagaggcugcaagacagagaaagcaugaggagaagagagaagucuagaugguccccauucacuccaaauuaguuuccugaaguauaaaauuugaggcaugaauguuuagacaaaaggaguuuugaguggcaggcuuuaccuucaagugucucuuaagaguggcuggagcccuggcccuuuccuccuaucucccccaucuauuuugugguugcaaguugaauuauaaaaaauuacaauguaaaccuuauuuaaauuucuccacaacagaaccccuugaaugugauacgcagguugugucaguauuuuaaaggccuuaauuucaacaaaaauuaacucuaugcaauaauuuuuaaguuuuucagacauuuuaaaagcaugcgccuuaguaaggcugggacggugauuugagcuuccauggcccuuuuacuaugagaaauuuacaauagugaaagucuucauguaucagucuggacuccuuauuaaaccaaccagacccggauguuuugugaauguaggggucauuuucaucugaugcuuucagcaaaggagaaaguagagggggcuacuuuguuuauuauauuuagaaccuagugaaaggaagaaggguacaagccaggaaagaguaauaauugucauauuuggaagcucgaauagauuacaggcuuagucagaaagccugcuuuuguuucugccacagagggacuucuuuugcugcucaccauguuccucagaguaucuacuucagaucagugcggcaaaagcaugucucauuaaaugccucaucuguacaguauagcuuggacugugucagaacguugcuuuuccccccaaaacaaaaacagaugccucagguguguuugauggauuaaucacaagaauucaugccccagaacuuagccuugaccugugaaauauuagcacacucuuaugcauucccaccagggcuguacuacauuaagcagauagaucaccauguaugcuaauuaguaugcuuuucgcugugacacaauuguaugguaaaagguguauguuaccaggugauaauaacccaggaauaacuccccauuuagcugcuucuuguguuauuguacuuugucauauauguucuuaacauguauauagcugauacagugcacacagauccuccguacacagaauuaacuaacauguagcuucuaccuuugauauaccaaaauuuaaaauguucugucuucauuaucucucaugaaacauuguuaccuaaacaauaaaacccaaugucauaauccuaugaaauuucuuuuuuuuuauguuacaggaaauacagucuaauuggucauuuauuucuacugugaucaugugucuugcauugaaacacugugguauacaguuccagcagucccuacauguauuaauccagcuuucacaccacaaugugguguguaccugccuucaacauuguuagauaccagugcauuacucucuaauguuuaaaaagaaaagagagaaaaugcauuacaaacauuuucuugggucaucccauacucuagccuguuuucucuuuuacuuuuuccaguuucuuaauucaauaguuuuucaucauccaguuuuccagcaaauucauggucuuuacauuacuaaacuuacaaagaccaacaaagaguuaaacuuguaacucugaaagacuggauugaauucuuaccaugcgggaccuaacauuucugcucuaucugaaaaugcaggcuacgaugaucuccacccacagcaugcugguccuuucuuugagcgugcaguucauuuauuguuaggauuuguguagcuugauuaguaagaguagcuggugcccaguagaacaggacagaugagaaacgucucccaugcacgauguggaaaugguuuucugaggcccuguuuauuugguaagugacacagugucacaggacccauagccugggccucacuucugcacacauaggcgucagggcccugcaaugccagagauccucacuucuuccagacaaccacuccuguuauuagaaaagcaggaaaacaagcaggaaagccaaggcagcgcuucaugccacugauacuuuggcugggaacaucaguucagcagccaaagggauggcugugaguugggcuugaagaauagacacucauuuuucagagaaaugauaaaagguucuuggaaaauggucauauccguuaaggacaaguaagagaaauaauuucuuggugggaaaaagccuaaaaccuccaugggaucaaguuuuuuguuuggggacaggaagugggagagaguaaacccaauucaucgaauagaguucaggcuugaugcaggugggcgugaaggcagcucugggcaucagccagaugaacucccuggaagcucagaaaggcuguucuggggacacuccaccuuuuugcauauguguuccagaaacuaacuggcuuuuagcccucucuuauucaaguucagugaaacuuugcuguauggcuugggugucuuagucacccgugagagaagaggaaaaagaaggaaaacuaaauauauucagauacaaaaacaauucuguuguauuuuggauuaaacuauuugggggguaagggauggcucacuaugcaaagugcaagcacgaaguccugcauuuggauccuaacacucacacaaaagccagguguggccgugcccaucuguaacccuggcacgggggagagacacaggagaaguccagggcucgaaggccagagcagcuggaacagugagcucuggcuuccgugagagauccugucucaaaaaguaagauggagcagugacugaagagaucccaaugcuguccucugaccuccaaauacgcccaugccagugaugaugcacauacaggcacacacaccaaaacacaggagaaaucuaugcaaucucuaagcaucaguuuauguuucaaacuccuuuaccugacaagacaagcacaaacuuuaagaagaaaugguacuacuguuuuuuuuagcuuguuucagguaagagaguaagaaauagaaggcaggacuacuaaacaguuuuggauuagaguacuaaaauaagcuugagcacacucuaguauggcagucuuauggggguaauauagaaaauaacuuagaagugugcucgucuggauggucccugaaagcugugccuugguacuguucaucucuucccaacuggccuaugauugggaauagaaggugguuugucagccauugagacugugaucuucagucacagcaguuuccuuucuuucaggggacauacuauugcagauacacucuagugguuucauuuauuuauuuauuuauuuauuuauuuagcaagcaaguuggcauuaguaagcccuggggcugugugaagcucccaggauucucacccagugccgaggggaacacaaaaugauacagugugacccgauuccaaggcauucuccuacagugaggaaauaaguaccuauuuccuaaguguuuaugguggcucuauucauaauucauccaaacuccaaaugacauuucuuucaaaggugauuagcuaaggugaaugugguacagccauacacuaggauaggacucagcaauaaaacugaauaacugugcauaaacacagcuucuagaugauugucaaagaguuaacauugguuaaaaaaaaaaaaagucagucccaguugcuugugguggagcaugucuuuaaucccagcacuuaggagucagaggcaggcagaucucugaguucaaggccagccucaucuacaggugaguuccaggacagccagggcuaccuagaaacccugucucaaaagauaauaaacaaacaaacaaauaaacaagcaaaaacaaaaacaaacaaacaaacaaacaacccccaaaagcauggaaagguuaucaauaugauuucuugcaauaaguuuacugauggagaaggguagauuugauucuucauuauggaaauaguuacauggccauauaauuuuauuaugaugaaaacaaaaguuaaaaaguuuuaagggguuguuggcguaagugagcuuccaaggacuugauguagguuuccagagugcauggcuacuauuucuugccuaagcaacaagauggacacucugagaggggaggucccgcccagguuggugaagaggggccaaggccuguguugacauccuugcuauuuggaugguguguauuuguguguaugugugugugugugugcuuaugacagauucuccaaguucaauaggaaauggccuuuggaguagaaccuuccacaagucaaagaaauauuuuuaauuccauuaggguguuaauuguguacaaaccuugcacuguuauuggcagggguauauacagggaaccccaggcucugagcucauggagccaauaaucuuaguggaaugaauggguggguggacguaaacauaacauuuccaguaaguuugugauacaaucaauaaacagagugguguguguguguaguaugggcauguguauacaugugugugugugguauguguauguguguaugaguauguauauggugugaucaguuguguguguuugcauguugggggcuuguuuacaaugaauacuuagggaaggcucugcaggaggcaacagcaaggggcaaacauugacgaugucagcuucauccuaaguuguccucaugaaggaaaugcagacagggagucagcagacagcacacuaaucacccacagcaguaacaaaagggcuggcuacacccauuaaguugauuucauagucacuuaaaaucuggguaauuugaaguaaaauugugugagcacgcccuaugacagauguugugggcaaauccuuaaucugucuuggcuucuguuuuugccaaauggcauuggcgugguccagaccauucccugacuucacuggcucauucuagggaggaaaauucagacagcaggcuucaggagcuaauguccuuuucaacaaugcuuuuaaaaguauauguuacgguggauccugguacaugcuguaauccuaacccucagaaacagagguaggagucuauuaggauuguccagaggcuauucucuacacacagugaguuugaggaucgccuccacugcuccagacccucucucugagacaaaaaucaaacaaaaacagacaaaaaguguguucuaaugaucugugggauugcuuaacgcuguauguacugaacgccuccagacugacugugaaucuuuuuuuuuucuggaauacucaacacucugucucugugccauaugaacacauuuauuacguauggcugauaaagacugccaccaaaucccaccuggugugcagagacugaguugcuuggggugagacuguaugggagagcacagguccucugcuggucagcagccuguguggagguuucucuuuuucuguauggagguuuacuuuuuuuuuuuuuuguuucacccacacaguucccugggacaccaggcaucaggcuacaucuagcucaccgaggccucagggaaggcugugcugaggaaguucaggguguuccucucccuucugaggccauccauucuguucccuuggcuccugugucacugcugagcugauacggucaggcuaaagggccaccuuuguucucauaccaucucccuaggcucuuuccucagauuccacagacccacaggaaauccugcugcucugagucugaguuuggccuuaacaccuaaagguagccugggggacgauggacgaagcaguagaagaaaggggaugauaacucauuguguucugcaguguggcauccaggaaccaguugcuauacaaacaagguaagcucgcccuccucuucuaacuucaaaccuccggcaguggcucuaagaagaucuauggagaaguugcuaucagaaaccaacugccuguuugucuuccccagacacaucuuagagcucauuuucuuugcgacaguguguuggggguuggaccauuauguagacuugccccuggcuuugcagagcacaccgaguucuuucuacugucugcuacugucugacuggagugucgaucucaccucagugaaucugcucccaagcuccccguuuaacaccuauugguucccucuuccaggcucuuucaaaaccccaccccugcucuauucugucucugugggccaaucccagcauguaucucaagacagccuaaagucaacaugauuuuguuuuggguuuguggucugugucuaguucccacuccucagaguguaaauuuguaugucugauucccccacuagaacagagcuugagaaaacaaaugugcucaccagaguuuguaugaucauccuuccaaucuccccccuccccccucacuccucaauccccaacagacugagaacugccaucccaggaaugaugucucuacgauggcuucuucuugcaggacuaagcaugaagccuugaccuaaaaacuuauggaaggauaaugagcaguugaaugugguuucucgucgacuugggaugcucuacucugggaaccuccaccccuucuccuaguccauauggucaacucauccugaucuggccuucacccauagggggacaagucaauaccccugguggaaaacagacucaggucaaaagaacaagauaugaagcaaucguaguuauguuuaaauugaauuugcaagaacuaaagucucucaaauacugccaucau

SEQ ID NO: 8750 - RNA, 1712 nt, Mus musculus
aucucauaaaagacauuuauuggaaggucgaauccagggggaggagagaggaguccagagguggcugcccucuuugcuccuggggagaggacagccggggauuggacaaaaggcaggcacauagaggauuucuuaggaggguggagacuuccagagucaggauugguaggauuucaagucuugaucuuagggaguucagggauuggcugguuuuccugcucagugauuggugcuuuuuccccccacccacuuuguuuuaacugaugccaccauuuugacaggugcggccaucuugacagucccugcagaacacugcucagugacauggugacuaugaaggugucagaagggagagcaucggaucccuaggaagagcaccgggaagcuccuaugcuucccugagggcugcaccgccucugcugagccaccucuccagcccuaaaccuacgccuuuuagaucuuagcuuuuaaaacuuuuguaccugaacuuucuugcacagaaacuuuugcacugucaauuuguauggagcaucugacucagacaaaaacuuuugggcaaaacuggugcaguguuuuucugacugcggaugcaguugcucucgcucaggacguuuccuuaucuguccccagcucugcaauuccuucuuugauauuucuucgguacacgucagucuuaucuuaauuuuaaagacauauuucuaauuuucaguucugcaagcggccucucucucucucucacacacagugguacaguuugcagaaacgcuuagauuccuuaggauucuaaaaugacaagcgacgcaaaguauaaaggagaaagcaacauauguuaaaagaacgaucacacaucuuucugggggaagaaaugccuuugggggaaaaaaaacaggcuagaggagggaacaacccacaacugggaaaggaagagguucaaaacaagugcgcagaacgaaucuuaguuuuccaaggcuuaaaguaacagggcacuuagggcgcgguggguuucuugcuagcuagacaccauaauuucaacccaguaaguuggucacugaaauccauucggggguggauuggguuggggugaacuguacuggaacuagauuauaaaaaugaacacaguaccugcccuuaagcacguccaguuuuguuuuguuuuaaaacaacaccuuuaguuauucaaaggccuuuugcaaauagaaacagcuaaaaaccuuaaaacagucuuuaggcuucacagaggaagugaguugugggcuggaaacgaacaggauugugagaguuuccuauuuuggaaaaugaagacgaucauucagaacagugagaauagggguuuuagaggaagguugagaauauguaacugcagcagggacuuggauagguaugucugcagcaauagguccgguuugcaggucaccuaugcccugcgcagaccugugugcaucaucucgcuggcucgccacagucaguaacagcuaacgguuguucuguuuaguuaguggcgcagaguccacgcgcuuucgggggcugugugugguuaggugcgcggagauucuccagguuucccucaucuuuuuaaagauucuccaggucucccucaucuuuuuaaaaugaagaagaaaagcauucaaauuagcgggaaggcgguuaacacccacagccccgacucugccgaacgcaucgccggcuccucacauucacccgguaucucagcg

SEQ ID NO: 8751 - RNA, 7236 nt, Mus musculus
uaucaggauuauuuguucaaucucugcagauuuauugaacaaacuuaauuuuugaauacagaacaauuaaagcuaaccaagugcaacagauaagucugccaauuacacauagcuucauaccaaccacuuauucaaccagucaaauucuaaaaacagaacccaaaugacuuucaacauacuagugaccacucagccaaauaaauuuggggcagacaacuucgaugaaaaagccuaaaauagacaaggacagauuccugugcuauuguuuuuacaccaaggcuaagaaauauaguaaaaagcuuguccaaaaaacguuugaaaaugaccauuacugcccuauuaugcauaauauauuuaaagucugaguaagaaccuacuggcuacaccauucuaaggucuaccagacacuaccaaaggaggaaaaacccaaaacaaaaacauaacaauccuuagcuacaugaaaugcuaauauguaagguuuacaaaacugcuuuaucuuauuaacacuuugcuugacaucucuuuauaccagcuuggcaaaauagaacaaugucaguaaccaagcuaaccaagugcaacagauaagucugccaauuacacauagcuucauacaaaaucuagcucagauauuaacagguuuuugcacaggauaaggcaauccauucaaaagaacagaggacuggggcuggauaauuuugcaaagcugguuuacaagguuuuguuccaaauucagacaauuccucaaacaugcauuuuuugguauuaaauugguuguuugaaaggaaaaaaguacauugagcagaauuaacccaacuuaauagccugaaaaacuacacuacuaaaaucucagccgcuagaaaucaguuucuacugacaugucaguaacucugcuuauuuucugucaugcaccaauuuguaggcuuaucaguggucccucuaagcuugacaauuccaaauuguuaacaccaauucucaauuuagagaucugacaugaugcacucaugcuauuaaggacucaaagaucaucuuacccaaagguacaagaguaaaaugaaaauuucaaaguccuuucagauccuggccaguguuacguauagaacaguuaaugauguuuaacuaacaccauuaaacuuugaauacaggcccauauaaauauggccaauaauucucuugauuguuaccuugccugaugcuuacccaauugaaaaguauuaauauugaacacaaaaaucaaaacaucuaguuagaaacauuuuauuuaaacgugucaaauaaaaacccacauuuucagaccauaagauguuaauacauucaacaaaacaauauuuacugcugugaauuuuacagaguaauaauccagauccauuuugauuagaugguugaugauccuuccuagguuacacuuuacagacauaacaaaucccuuauaauaauguaaacaaaauaacuuuucccuaacgggugaacuugagaacuucaguccauucuuucuggacuugcacuucuguguggacuuccugauggggaacgacuaaaaagaaaaacauuaaguuuggaaccaauuaguguaacgaagcuucuuguguacaagucagagcaauucaguauuucaguacauucaaagggaucaaauaccuucuaccaaagaucuaacacacaaaaaaucauauauccccuuuugaacuugcuugguauuuuuccuuaaagacucuuaauuaugugugugggacaaguggcuggagaggccaaagauaucagaccuccaccugacauagguguuagaauuauagaauuugcaacuauuuucaaauuucuucauuguaugcacauuuucucuucagcuauuauacauaugagagagaaaaaauguuccuuaagcaugccauugcuacaagacacucaagacuaaaacaccuuacauuuuucuaacacgcgugguuaaacuaaaauuuuaauaggaaaauaaaaagccaucauugaaaaauauauccaaucuauacagcaccaacuuuccaaagaguucaaagacuagaguaggcaguuguucuccaggaggccacauuuugacaagauuuggcaacaaaauguuuagcuuaccuucuuuuaggagauggagaucuggauuuugaucggcuguuaaaacaugagaaauucuaguaagaaaaagcaccaaccaaucuucuuuuuaauccuacaacccccccaaauuacaauaaauugccauauuacagcuaaaauuucagagccagucucauuucuuuuaaaaagccaauuuuaaagggcuuacauuuccaugaacuagugaacugcuguauaauuacaguucaucuuuuacauuauucuaaagcacauuucucuucucuauucaccuacaacuuuuagggccuuuuaccuccaaaguaaaaugucacauaacauuaauuucuccauaaauucagccaagcaauaggucauguauaaaugaaguucucaauuggauuaacaaggugcagauauuucuacuuauccaagcuuugggcuaacacccauuucucaauaauuuucaacacuuugaacucuuuggauauuggugcuauauaauuaacuauaagagcacuaaaucggauagucugacccuaccugcuucuuggucgugaaauagaccuggaucuugaucucgaccuugagcgggaucuuaauaaaaaggaaaggggacacaauuacacaagcaugccuuuauaacagagcaccuucccagauaggauagauaggauagaaaagaguagagacaauugcugcacaagucuugccuucugucuauccaauguagcacagaugauccaacagggagauuucaaauacacagagaaccacuauuucauaugacuacuuccauuauguacaauuuggucacuacuucuauggaggcacaacagccccaucuucaaacucuuauaccacaauuaucaagugguucuauccaauuacuaaguugacuuuagucugguuaucagaguuaaagguccguaguuugucaagccaaguuagacuggccauaaaucuuuuaaaaaaccuugggacccuauaauuaagucuaucuagagaugguucaguaacuuucucaaauugauuaauuuaugaguuuuaaacagcagugaaguggcuuuuacacacaacugcuucaucuguaguagaaauuccuauuuauaaaaaacauguuauaaccuuuuaaggacuucuuacaaugaauaggaguaaaguugacuuaaauacauugaauccaaauguaaggguaaccccuaauucaggccaggugguaauagcaaaacaccuuuaaucccagcacuugggagguggaggcaaauggaucccuucaaguuuaaggccagccuggucuacagagcaagggcagcuagggguacacacacaaaaaaaauguugucuauuaaacuaaaaaguccacucagauuaagaggcaggcagauccuggcucccuccuacucucaaacuuacucuuuccaaaaauguuuuaaauuuacauucacuuauucagaguauauguagagaagguaaugucaccaucucuagaagucagagagcaauuugggggaauugggucucuccucccuuuacauugguuccaaguuuaagcaaguuaucagguuugauggcaagcuuugucacaauucucuucauggagauagcauccuaucuggcuaaaauaauuuacuuuuaaaaaaucuguuuugagauggggcauguaccuuuuuuguccuccaauccccagguccaaguuauuuagucuaagugcuaggaguacaggugugcacacccuaauauugaagcaccccauuugaaugaagauacuucacugugucaccaagacaagacgauccagccaggauccagugguggcgcucaccuucaaucccagugauuagguggcagaggcaaguggaugaguucaaggccagccuggucuacagccagggcuacacagagaaacucugucuugauaacuaaagcuacgacaauccaucuacuaguaagcaggaaaaaugugcuacauacuggaaauaccucgauccuauuauagaaccagaccuagaucuucugagugaagcugaucuugaucuacgaagagacacagaccuugaucggcgaggagaugcugaucuugaccuaaaauuuaaagaaguucuuaagcccaucugucuuacuuuuucccacuuguuaaaauuugaauuuuacaaauuucucaccuccguccucggcuccugcugcgggagcgagaguaucgccuuccccuggaucgggaaugggaucuagaucgugaccuauuuuuuaaguuagaaaaauacaacauauuagacgauaacucaguuuuaguguuuguguaccucugcugaaaucaaaucucaagacuauuuaaaauuuaguaucucauuuggaaaaacucugggccuauuaaauuuuuuuuuuuuacuaaccuaaaaaaagauuuguuaaaagcugaauuacaacuuagaauuacaaaauauaaaacgccauaauguguauuuaaaauaaaccuugcaaguuugcaggucgacccucuuuggcccauggucuaguaguaggucuaguagaucuagaugaucuagaaguaucuauagccgaucgcugcaucuagauguuuucuucaaucuaacgacgaucaaacugacagccaaaagagccagaugaggcuugauugacgcaagaagauuuuucuaguugggaauguggucaaucugguguuccucuuucuaaagcggagggggccccaauuguaagccaaauuuacuguuacggcgaucaccgacucaaauuuucugcccuuuaaagaauaaggugaagcuagguguagaugacucgaggggaucuggccucuuaugcugaucaccucaaggucuaggaggaucuuaauugucggauuugcaaggcgccucagcaugauaucauaaggcucgugacauucugaaucaaggcgacugacucaaacgaagaaaccugaaagguuuugaccagguugauuauuaauauaguaacauuuuuaauuaaacaaaaauuguaaaauacaccuguacaauuaacauucaaguuuauagaaaaacacuaguuucugccuugcuaauaaaagaauuacuuugauuaacuagaauaccaaccauuccuucauuaauuaaauaccugcuucuucuucgucggcuauagcgaugacagucauaagcauaaugucccuuuucaccacacucauagcaucuaucauuaggaucaaagggacgacgggcagguggccuaucaaaacgagaucuccgaggcaugccuguugauaguucaacccucacucgagaaccacaaaucacucuacaaaacauaagaaaaugcuaauguuagaauacacaugugacuucuagauuuaaaaauaucaacugcuauguauauaaagaaaauaucuaauaaaaauuaauuuauuaaaaaaaugucaacugcucauucucucuacacgguuagucuuuuguuuacaaaaccccgccaauuccaccuuuaguccuaaaucuuaaguuauccagugccugaaggguaaggcaugugagaggcugacagaaugagggcuccaaccaccaccggagcuauauggugaguuccaggucaacauaggccagagacacuaucaaaaauaagguccacccccagagagucuaugauuagcaccgagauuacuuauccagcccgagggaauauuuuaaagaaauuugaaaaacaacccacuuacuucccauccaauccucgaacugcauccucugcaucucuagggucuucaaauuccacaaaggcgaauccuggaggauuucuggcaauccacacaguucuuaagggcccauaguaacugaaugcccuuucuaacucuccuuuaccagcaccaguucccagguuaccaacauauaccuugguuucuguuuaaaaaauguaaacagaacaaauguuauucaacgugugauagggaauucauuucuuuaaaacagaccauccuuaaagagcugugcaacguacacguuuuguuuuggagacucugagccagcuaagugaucuacucggagccacccuacaacuauguuagcuauacaucgcucaaacgacucucaggccucaaccucccugaggcagcuagugcaccaccaggucuggcucccuuuauuuagaggucuucaccaaguacuaaaucuuacagcgugaaagacuggaaagccagaccugcgaccaaguucuggcgcucuuauaggaaggaaacccugggagacugcagcgggagcaugguagacuugaggcgugcgggguggagguggggcccggcucgggcccgccccgccccccgaguccccgcagccucgggcacaacagcgcgcgggcuccggcggcccggccugcggagaggucuacagcgaggaucagggccgagccaguucccggcuuccacagcaggcgcaggcucacccgaguccccgccccagagccagaagccacgcucgaaacggcgaaggaaaaaaaaagagagagaaaaaaagccgucgccgcuugcagcggucuuccccucgcgcuacuccucaugccgaccaauuguuggacgacgcgcagcucgcagcugccgguuucguuccgucuccagcccaacccgaaucuuaacgcccaucaucacuccccggcuccaguggcgggaaagcgcugaggaaaugcgccaccacggucaucaaugugcucaaaauggcagccgccgccgccgccgagggcgggggguggggugguggaggcgggcggcagcgcggagaaauggccaacgccaccacggcgaccccgccaggcuucggccuguccaggagagaccaaaaggcgccaagcgcccgggcccuaagcggcacacaugcccuccagucccgcucgcccuccuccuccccgcccccgcggccucgggcuucguacagcgugcgcaggagccgccauuacgcacgcggaauaaccgucucuaaccgccgcgccgccccugcggccccgcucugcucggucggcgggcagcaccguccuccccuggggcccuggccgcuuaccuccuccauaccgcccguagcgugacaugauggccggcccguguacucggcucuagcuuggaaugcucacagcgcgaguagcacggaagcggcugcgcaaccuccucugccugcaaucccggcggcacuacaa

SEQ ID NO: 8752 - RNA, 4054 nt, Mus musculus
caaagcaugcugggcucaggcgggccgacucaagcccgcucggcggcgugugagcuaaguagaaauauagccagggucucugcggcguuucccugagucgugcagaguucuggguauggcggccucuggacaggaccugguguuggagcucuagagcuucgcuaacggguccucagcgcuuuacgagaaaauuggcgcaaagcccguggagagucaucuagaaagaguaggugggaauccgagaacuccgcaucaguuaugucugucagggguuuagggcgaaauccuuuuaucuaaggaaagcggaacggaaguggcugcuucuucuuuuuucuaaaaaagauuucuuuauuguauaugagcacaccacugcuuucuucagacacaccagaagaggacaucggauuccauuaccgaugguuuugagcuaccaugugguugcugggaauugaccucccagucggugcucuuaaccgcugagccaucucuccagccccgaagaguuugaguuaucuacgggccagguucaaagccagguugaaagcgguauccggaauugggagcagagggugggacuagacaugccacaggaguuuuaagaauuguaccuguggccauucacuauuaccaucagucugaauuauaaauaccccuucccagauauacuaaacaaaacauucucaagaauucuccaaagauaguaucaguuucuuauaccccagaugggcguuuugcuuguucuucugagaucugagacggcacacuauguuaccaggcuggucucagcacuacuaguagguagggacuguaggugugaguuaagacuggcucuauguaucagugcuuacuugcauuaagaaacucguuauuuucaggcaaauuacagacugccuacagaauggcgaucauuaagacauuugcuugggcuggugagauggcucaguggguaagagcacugacugcuauuccaaagguucagaguucaaaucccagcaaccacaugguggcucacaaccauccguaaaaagaucugacucccucuucuggauugucugaagacagcuacaguguacuuacauauaauaaauaaaugaaucuuuaaaaauauuuuuaaaaaaagacauuugcuuguguggaauauccauagugauuaacccaaauugauaaugguucuagaucugggcaacugguaaccaugagcgaauggaugaagaaaagccccuuagaaugggaagauuacguuuauaaagaagugagagugauagccugugagaaggaguauaaaggauggcuucuaaccacagauccagucucugccaagugaguaugcaacuuaauuuugugaaaugacaauccuauguacuggccccggauauccaagcugagaaggcagaucaaucaaagacuggucauucacacauaauaauugcuuuugagccuaacugcugcuguuuuaacuaugggaugcuguagcaaacuaaacauaguuauaggaauagaaaagagaaauucuccccucuucuaauucuccuuccagagggucuccuguagccaagguuggccuuauuuggcuauauaguugaagaugauauuaaacuucugauucaucuacuucuacuucugaaugcuaggacaccacacccaacuuuauuuauuuuuuuaaaauaagucucauauaacucagacuggccucaaauucauuauguagcugaggauaaacacgaaucccugauccucuuaucuccaccauauccaauugucaggacuugucucaaaagguaaaaaaaaaaaaaaaaaaaggacugaagguacauagaugucaaggggaaaaaugcccaugcuguuuauuggaaaauuuuauauuuauugaaguacuaaguaguuuguuuguuuguuuguuuguuuguuuuuugagacaggguuucuguguaguccuggcuguccuggaacucagaaauucgccugccucugccucccaagugcugggauuaagggcgugggccaccacacccggcuacuaaguauuuuuuuuuuaaguuuuaauuauguauuuauaugaguacacuuuuguucucuucagacacaccagaagggagcauuggaucccauuacauauggcugugaaucaccaugugguugcugggaauggaacucaggaccucuggaagagaauuggugcucuuaacugcugagccaucucucuaggccuaguacuacguauuuauaaucuuacuaaauuucuguagcacuguggaagauuauauaauagccucucucagucucugcauuuagcaugaaaugccucagacuuaaugauccuucuacucuaaccucaugggcacuguggugacaagcugaaacuaauaugauugaagcuaauacgauuuugaugucaaaaguugaggacaggauuuaaaaaagaaagcuauuaaacuaauuccauuuaugauuacaaacacucaaaucuucaauaaaauacauagacauagacuccuacaaacagacuuuguuuucuuucuuuuuccuuuucuuuucuuuuuugguuuuuggagacaggguuucacuguauagccuuggcuauucuggaacucacucuguagaccaggcugaccggccagacuuuguuuuaaaaauccaaaaaagaauuucacuucugugccacucuuuucaaaagucuaauaauucgugugugugugugugugugugugugugugugugugugugauuuaagaaagcuccacaccacucaaaauugugacauucaaaauuguaguacauaggaucuugguuggauccuagaacagacgaaaggcuguccgugggaaccucauaaagcuaaaucacaucugugguuaguuaaugggaacucuuaguuuugacaaaaauaccaucaggaugugcaguguuaacuuuggggaagcuuagugauggguggguacucuguaaugacuauaacuuuucuauuagaaauauccacauuuaagacagauggccuaauucuuaaauaagugauagggaaggaguaggggccaagcuuuuaaucccagcacacuggaggcagaggcagaggcaagacuauuucaguccuuuaagacuauccuggucuacauauggaguuucaagccaggcagggcgacauuuggugauaagacuaaucuucccgagggacaguuguucccucuuguugaagggaccugaguuguugaugauggaugcucucauuccauugccucuuccuaguucuuaagguuuuucuuuuacaaaucugcucugaacuuccuuugucuuuaaagcauuguccucguaaacuuccuugaagauggcagauugucugugacuggaaucaugggccacucugugcagacuguggaaaccauaagugaaggggaccacagaguacgcgagaagcugaugcauguguuugcaucuggagacuguaaaggauacagccccgaggaucuggaagagaagaggaccagccucaagaaauggcuggagaagaaccacauuccugucaccgagcagggggaugcacaaaggacucucuguguggcugggguucugacuauagacccaccauacgcuccagaaaacugcagcagcuccaaugagaucauucugucccgaauucaggaucuuauucaaggacaucuuucagcuucccagugagaggccaagcacugugaacaugcuggcuucaccguuugguuuuguauucaauucuuccaauguaaguugauuauauuacaagacaucagaagcacaugaggguuauaggugugugugcguauuuuaagguuuuguucagaucagaucagaugaguagaucaugagugcuggguuccuuaggaauugaagguacaagagcagugccucugugaaaauaacacagggaagucagauuugaaaggagcuuuucuugugugugauuuaagauaaauugcccuuuuuugugagacaagaauacauuuugaauagguauaacaaugaaauaaauuuauaaauuucaauauaagauauuaaaguaaaaauccguuucggguucuuuugacua

SEQ ID NO: 8753 - RNA, 28887 nt, Mus musculus
uauugaacugcuuuuaauaguuaaacacauuucuuuuagccaauagcauuuccaucuaagucuuuucaagaggaauaaaugaaucuaauagggguuacaggauaagguuucaguugugguacccagagauuaagugaccauuguuucugaggaaaaaaaaaauaaaauaaaugaagucaaaguuccauaaucuuuuuuuuuuucuuaaauuaacacucuacaggaucugcuucagucucaucuauaaguuuauccaagggcacugaugaagugccuguccccccuccuguacccccucgaagacguccagagucugccccagcugaauccuccccauccaagguaaaggagaacacugguuaucuagaaacuguaaucucuagcugugucagcgguuaacggcaaguccauuucuugcuggcaggcuuauauuucaaaguacuuagguuuaauaguucaaagauuaaguauaaauuuaucaugcaagauguuuauauuuuuuccuauaaagguaguuauaggaaugcaugcaaaccccuaaguuuaaagcuaugagcauuacuaacggaagaaaccaacucuuaucuacaaggugguaaauaguaacuuggccuugugugguucuuuuauauuuugcuugugagccuugucuucaauggcugagccauugcuucagccuucugcaguucuuuuaaaauguaugaugugugugugugugugugugugugugugugugagugagagagagagagagagagagagagagagagagagagagagagagagagagaaugggguaggguuugugugaagguauaugauaaugaaaccguacugaguaucugcugaaaguuauucucugagccagacaggaagagacuuaaauucuagguuacagagauccuaaagacucauaguaacuaagcuuucugccuguuuaaauuuacccuguuuauugauuauuuugcaaguuacucaauaauucuuuuugauuuggagcaacccagagaacagaagcagcagaauaagucaagaccauauagaguucaugaaacaauucaguacauuuaaaacguaaccauuacuguuaggguaguuuguuugccuaauauguacacugccuuuaacacuuuagcccugcgggggggaggggguaguuuaugcuaaauuagaauuuaguguauugugugaugggcagucaguagucaacaacaaacuuuugacuaaucuugacaaaauuaguuuuucccuaagaauggacagaacaucuugauuaacacauaggguaaaacuccacguucuauacccaguguucugucaguagcaugucugaaaaccccaaguuaacuuaguaaauuuauggugcucuucaaaugaaauuaacauguuguauucuuuuucauuuguuagauuaugucuaagcacuuggacagccccccagcuauuccuccuaggcaacccacauccaaagccuauucaccacgcuauucaauaucagaucggaccucuauaucagauccuccugaaagcccucccuuguuaccaccacgggaaccugugaggacaccugauguuuucucaagcucaccauuacaucuccaaccuccuccuuugggcaaaaagagugaucauggcaacgccuucuucccaaacagcccauccccuuuuacaccgccacccccccaaacccccucuccucauggcacgagaaggcaucugccaucaccaccacugacacaggagauggaccuccauuccauugcugggccuccuguuccuccacgacaaagcacuucucaacuuauccccaaacucccuccaaaaacuuacaaaagggagcacacacacccauccaugcauagagauggaccaccacugcuggagaaugcccauucuuccugaguuccucuaagcugggauaguuuccuagcccccagauccauugcuggcaauggaugcacugaacaugccagcacuggggaguucaaaugagaacuccaaacacuaacgacucuacuucacgauguaguauaagacaaugaguuuuaaccuacauggaauuauggaauaaaaugguauuccagcuuagaauguggaaacugauugcaccuggaaaucacgugaagggacuuuucuggccauugggcaggaguccucauauugugaagugaucuuuaucauuaaagggauggaaaacagucuaauguccaacaagcccauauguugacaguuuuuguaauucaaaauauuaugcacuuuuaaaaaaucuuaaacagggaucuccuccuuuguuuuccuuugcuuuacucuucuacuuuagaauauuuucguaaaaguuauucagaggacugugagaaaaggcugugguaccugaccuuguugaaaucaaggcccagcacuguacuacaguccuguuuacagauuauuacagugaucugaauggguaccgaggcuucaccaaagagguacuuuuuguuauuguuauuguuuuaagaauaauuaugccaauuuuaagaacauccccuacccacccccacucacaaacaaaauguggugguguugccuuuaaacaaaaaaugucaaugucauuaacaugauggaagaagaacauuuuaaaacguaacugucaaguauacgauuuacgcuuaggagacuguucaucuaugcuagacugucaucccccagccccuuugucucacagaaguuuacugguaauguauguccuggcucguggcugucccucuaaccguacacagaaacacaggcacccaaugugaacgagagcacucucugggccucccugacaccuuucauguuuuacuaauaguugaguaguuagcauaccuagaauuaccuugcauugccuaaaucauguguauauagugaauguuauauaauauaccuugcaggucuguuauuauuuaauugaauaaagauaaacuacuuuguuuggcuggcauauauuaaauuauuauauggagaaaaugguugauucuuauuucuuuggguugaaaacauacaaacacuaagcauaaaagcacauguggugguaccuggguaucuaguucuuacggaauaaucucaaguuggaguuuggcgugaagggaaauacuggcuuaaagugggauagguaucuuuuaagcagaaccuugcaucuuuuuaaaauuucuugagcaaccauacauauuugugaagauuuauauugaacauucuacucugcuuaagaucuuugguuccuucagagcuucuccuuagaguaucuaccugcauccuuaauaccacgugaugauucauggagccuuguacugcucuucugagucuaacaaauacugugacugaaaugcaugcaacuugaagagaaaacguuuucuuauucuccacugugucugugaacuguguaguauuccauucuuugacagccaucaguaugugcauguguccucaguaaugacgcagccuuucaguaacccugugacugccgcaucauaguggcaacuuuguauuuauuagcgaguuaaaugugcaccuugguagugcaguauauagucuucuaagaacagaagaacauuaauuguaucaucaugaggcagucuaguuuguuagaguugguucauuuucacucagcuauguuagccauuuuuuucuuuguaauaaaaagucuccuuuuuaaaaagaguccucaaguuaauuucaaaucccuucuuggaugcaaagugugcauuaggccauucauugaacaaaugacuauucguugaacaaaauuagcuaagcaugcuuacuaaugcugcuccguaugacuguaaugcacaugcccaaaucucccaggacuuuuuagaccagccuaacugucccuaaaacuucccauggcuuauugaucgcuguuugaucaucccguccuuauuucaaaugagaaucuaagaaaagcaacauuagaaacccauucaguaucuguggcaagugcugccuucaacaaggugauggccccuuucagucugccugagccaacaagggaaggagagcucagaucugaagugaauuauauuucucccacagggagccauugucuaucccacuguucuaagagaccacauaacccugcagucauuuuauaugcaucauggauagaggauauuuuuauucuccaauacaacaucuuggcaaaaauauuuucugcagcaguaacauuucaaaaauucuaauuggaugcucugagaagaugagaaagcuguauccuugugugagccauuaucuggcuggcagguuuauccuuagucauaaauguccuccuucugggauaagaaguggcagaagacaaaugcaccauuaagaacugcaucugaauucgaaauuacaaggcagccagugcagcaaaacuugcuuagcuaugcucccagauauggggcauuucuuccagaaauccaagugucagcuaauguuuucuuaugcuuggcucacaaagggaguuccucuugguggcucauuaccaauauaauagaaaugcuuuuucacagcuaagcucuuugaaaaacagggacagaaaaguaguguuucuuaauuuauuaagacaagauauuuacucuuuuacuccuucaaauguguuugaagacuacaaaugacaaauauugaaaaucugccuaauuuauuuuauuuuuuuuuuuuugcuuaaauaaagcuguugggcaucaaauugugaguuuaguaugccacuauucucuaacucgauguuuuaguggaucugaguugaaccaagaauaccaaauaaacacaaccagcagaacagucuacuaaaggacuacuaaggcugaaggcaaugcuacgauuucaaauucuuccuuaaugcaaaccaaaagugguauuuaucauaaugauaauuuaaguuuugcucacauuauuucacugucuuaauggcuuaaauuagggauauuugauaguucuggaaaauaaauggggauguugucccaguuagaguacauacagaagaaaacccuuccuauccucucugccuuuucaaaccaaggcaaccauuuauuccugguugucugcugcugggugguuuugcaugcucuucccaucucugcuguaugccucuuguacaggugcagguucuguguauuccguguuaaucuuuaccaguaaauacaccucacaagguuacuuucaguuuggcugaaggagaacugugcaguaaaaugcgaaggaaagcaaugacuuuauucaaugguuuuuuuuuucauuugaaacacuauuaacuuuuaaaauaauuucauagucccuuauacauaagccaaugaaauauucugaguucuaguuagaaaaaaaaaagcaugaauucuacaugauaaaucuaaacaacaaaaacacuuguaaguucuuuuauauguuucaugccuuauuuuccauuuuugacaccauaaagugcauuuucugucaacugugagcaaauuucccuuugccuuuaauaaacauagugcauuaaguagccaguugcugaaaaguuacaaagcaaguuagcuaaaggugggucauacuggacuacauucaaagaaccaagauacacaaaagaugcaaguuguauguguguggcuuagagugcaccugugcagaugcaugccgccuucaguagcugccaaaugugccuuuaauuaaaaacaucucuaauuuuuuuuuucuucaaaucaagucagcauuuggggacgugauuagggcaagggacuuggggguacaaauaucuggugaaaucaccagagaauuuguuugucaaagugacauguguaauuuuaguugagauaugucuguguauauaugcguauuugccuuuguuuaggagcacgguuauuugcugaaauaauuguuaaaaaaugcugucagucuuacuuugauguaaagaacaaaguguggucuguacaucuaauaaugaccuuuguaccuaaccauguuuguuggugaucuuuguauucugugugcagcaauauuugguuuguguuaaagugaaaauaauggcuguuauuuuucuggcauuacuaagauaaauugaaaaauaauaaagaaaaauaccuuauauagccuauaaguguguuauuuugcaagcauuauuuucgagggcaguacuuggaaguuguuagugauucuaguuuagcuuauauuugaccagguagguugaucuuuggguauacacaggaugacguuucagaggcagucacauuuccaaaacaaugagcuuaggcggugcacccagcuggggucguuugacaugaaagagcuuaagguuguaucuaaagaauuuuguaaauacagucacucaaaauguaucauaaaauaaauauauuaaaugauuauuagauucaguccauuuauuucaaaguaaaggcaagccaggccuugugguacaggucugagagcccagcuacuggggagacugugucaggauauuauucaaggcauaccugggcaacugugaguucaaggccauccuagaaccugucucaaaauaaaaaggcaaaugggggugggugcugcucagugauaagagugcuugcugacagugaagcccgggucucauccccuguaccagagagaguaaagcaaauaaagaagcaagguaagugaggccuaggcaaagggguguauaaggcccugacugggacagaggcucagggccccuggugcucggaggagggagggcccgcauggaugccugcagugcugacuccuggcauguauuaucgaauggauucuaggccuucgaucggguuuacuaacuguaaguaagauuaacacugauguuggugagauucgccuuucugcuuuauaaucaaaaguaagugcuaggucaucgaagaggagagagagccuuacgucgcuuccguucuaaaacagaacuaaagaggccuucuccacauuugagccugaauuucugcaccuuugauagacuacaaauccugaaaagcaauuuauggccacacuaaccuuuugggaccuuuaauagcugguuucauugccuugauaagugauuaagaaauguaagauucccaguggcagaguaagcaaguguggagcagaccugucuauucugcuucuaguacucccugggugaaugacugacaugcgcaacacaaugucuuccacaaagcacuugacacuuuuuuuuuaaauggcaaauaaaaguauaaaggaugagucugcuuuagaaaacucuaaagagguuggcugucuguccugacauccuaugauuugauucaguauggcuuucugugcuguuuaucacuaugcagauugguuuugagugaccuuaaauuauaagcauuugauaagagcccauuugacuauucagccacaaauaaauauuggucuuacagaacugauguuagaacauaggaaugaagaaaaauccauuucaugggauuuacgagcuaguauaaauauguagacaauauuuuauaaguagaauauuguacauuaaaaauguaacuacagggcagugguggcgcaagccuuugaucccagcacuugaaaggcagaggcaggcagaucucugaguucaaggccagccuggucuauggaggacagccagagcuacacagagaaauucugucuugagaaaacaaacaaaacaaauguaacuguuaugaagagaaaagaggacuggugaguagaaguguggaauuuaacuguagugauuaguuagccucauagagguacacaaaccuuccaagaggugaaauaaugagacaucuaaguggcucaggcaagagccaguucaauaguucagaggcaggggcauccuugguauaucugagagcaccgaggcugcuaguguaggugagaaauggauauggauagacuauaaagaggugccacugggaguuaagcacugaagaucacuuaaagcuuuaaacgccauugucaucauucuuagagcccguccccaaccugggcaucaccgcuccagggaggacuugaauggccuuucacagggucaccuaagacuacuggaaagcacagauauuuacauuacaauucauacaguagcaaaacuacaguuaggaaguagcaacgaaaaugauuggcugggagucagcacaugauauuaaaggcuugcagcaggcgcaagggugagaggcgcugacuuggguuggggcugaagcauuggcaagauccacuuuacacucacuguguguggggaaggacuaaaguaagagcacgagggggcggacgagggcagcggagcggaagccagggcaaagacugagucgggaccguaucagaccacgcccacuucaccacagcccgaacauccugacagacacaaacccagagcugucaaagccaacuucaaggcuugaggccagagcaacacgaaugaagauuaccacuaacugagguggggaagauacugugggaaaggcuuagauauaaguuugaacauuuaaaaaaguaaaucugacaucaaaggaaaccacaaaucccagaaugcuuagcagccacaaguccuaaagccacuucuguuucuaaaucacugugugacaaggaaucccaacuuuacuggaagcauugcuguuuugggcucuuguagaaacuuacuaauggcaauguuuugugaaaaaguuaguauaaacacuagauaauuuuauuguccuaagacuguuaucuaagacauuuagucauucauuugucagggcuugcaauugauuuuuuuucuugaauauaaaaucaguuugccaguuaauaaggaauacuugccauguguaugaauguacuuuaauaaaauuucaaugcaaagcgcuuauuacauaggugacaaauuuaggaauucaaaaucucagaauagcuaaauguaaaugcagcucuguggaccaagcccaaagucaccccacucuaacaggacugaggcaguucugggaauccgggaaucacagugucaucgcugagaugacauaagaaagacgagguggaaaagcaguuagccaucagcuaccacagaauuccacuucaggaguuucauaaacaaucuagcuucaaucucagaugagcuuaaacucuuacaaaaugaaauagcccagcaaaagaaccuuagcauuguaacccacacaucccuuucucagaugguccaauucugaacuccgagaaauaacaugcuccuugcgugggcuuguauguagacucuucaaggcugcaagucacuccugggaccuccuagcaggaaagucugcaucucugguaaaguggcuucauucuccuaucacccggaucauuuccugcagacaccaguggucagagggcuggagaccagagguagagcaacugucucaccuugacuucaucccuaacucgucauuaagccaaauaucacggucacuaaagcccccaccuccccuuucagcuuacagugcuaucuagaaagauuauggaaugcgccagaaggaaacagaguaacccauuacucuuuucauuggagaaguguuuuaguaucagugagaguggcaugauaucuuuaauugguucugaagaugucuguaucuucuccucugauuggcguuuuccuuaaacagaaaugugagggacugagcugacggugcugaaguuuggccauaugcaaaguggaagugauuuaugaagcauuaaaaaaaaaagcaagcauagccuugcccuugagaggacuugcugucuuaauaggaagguaagacaaaucucaaaagaugaaguagucacaccacacaggaucucagaaagaugaggccuucacguggaucuuaaggauccgcucagcgggaagaggcagagcgaggcugugaagcugacugagcuggaagggcauggcucagaggcgguggagagccuggguuaguugcauuccuuuaugcagaaccgcggucagaaaacuaaaaguccuuauggagagugacccuaaaccaccggugauggcgaggacuugggaaucugagcacagacaagagcuguguuugguauguggaugugcuggggaucugggaagcaggagcgcucagaggugcaggaagaacugcacucacccagcagccaguuaucaggaaguagggacccagacuggccacauuacuauuagcuuaauaauauacaauaguggucugcagauagagacagggugugcugucaaaauaaaaucugaaaggcguguaauauuuuaaaacuuucuaguaaccuacuguuuugaugacaagcagguuaugaaaggaagagaauucuuauuuuuguuugucguuuaauuguuuuacucuccacauccgguugauuggcauugugcuuuuaaucacugcccagaacaauuuuagccugguaaaaaccugauuucaguggucuauuaaauuccaggaaaugaaaaccuuagcugauauuuaaauauugaaacuccaaaaaauuuguaguaauccuuuauauguuucacauauuuaauuguaugcugacagcuguguucccaauuaaucacugggcaaagagaaaguuguaguacuuaaaaauaaagcacccagcagugcauuuccacagaagcacugugugaggauaucagugugaauacugucuuuaggcaacugcacaccacggagucaagugguuuaaaccucuuuguuuuguuucuuccuacuauaaaucugauguuuggugucaaucaaggaaaaggaugcauggccaucugcagcgugucuagguucaagagcacacuguauuacuccagagcuaggcaggccucacucaaguaggacuuaguccucuacuugggcuauaaaagcuucuauucuauaccgcucagagacuugcauaguacacuccugaguuuucacucugaucuguguuuguaguaaucacuguauaaaugugaccauuagagaacuggugcuggggucagggcuggggauguaacucgauggcugagcauuugccuggcacggcccagacccugggugcaaagccucugaaugaggguggagcuaagucaguguuccuugucuccuggucuccugggcuugagugggucucacacucaugacaucuacuggaucugugacugcugcaguccccaacacagcccacacaaggaacagauuugucuuuggccccaccccuguucacucuacugauuuccacaagcauagaacaaguuggagagcauuauaucuuucaguucugaagcuucuaaguaacuuuuuaaggacaaauucuuuagaacucugguuuguacacauaaaauucgguucuguuaacccuaugccuuaaaagacguuauauuuugccuugaggucugaaagauaugaagcaacacaauuggacccucacauagaguguucuggucuaagcacagugggaugaauucaugaacuaugcauuaaaauuccuaggaagcacaaaauucacauccaugcuaaaaaugaacacgauuauuauuauuauacuuggggaaugacuucaaggugcaaguuuuuggucuuacaaacauuuauuuuccuccaaauuuaguaugcuuuuuccuguaaugauguggaaagucuucaugucccuuuucccaauccugagguucauaaaggcaagucuuaaccauagacuaaucuucaucucuucaguaucuuguauguugauuuaauuucauauguaaauguuuauauuaguuuuccuuagggauuuauacauugauauauauauauauauauauuccugcagagauauauacaagcuuuuacccuccucuuaccacucgacaauacaacuguaaauguauuuacacagcuguuccuuggucaaggucauuugcaagagcaagucgguuucugaagaaaucuuguuuggugggugaaggauccauugagggguucucauuaguuuuuucccuguauucugauccacuggaccuaaaaucucagcacacagauaaaguacagguugauuugguuuucacgucuuuuauccaaauuguuuugcauuuguaaaacaguugccuccuagaccuggaauccuuuuuuacuccccuggauuucaaaacuuaagauaugugcaucuaaacuuugcagugaacauacagaaucucucucuagugcugcaugggggcuacugugacaacuccauaugucaguguaaguuaccauggacaagcacuauagcaggaauagagcucaauggaauaacuacuccacagguuaccaaggcccuuacauuaaaauggguaucaggggcccuugcuuaaucuagacauuacauuacaaacucuugcuuuugcuuguuuucauuuuuaaaggaaagguuuauugaaaccaaccacacauauaugcuacauuuguagaaugcagacaucaguacaguugucucaaccaccacaaaggaaaccaagacuacucgauagucagcucaguccauuugagugcccagucgagggugcauucuuccuuucucuugguuaacaaguuaggcaauccauuccagaucuguaccuucuccagucuguucaugucagaaguuccuagagggaggagcuuucuaggaauaaucucucauacaacucgacugacgcccucucacuaauuuaaacuuugagcuuggauggguaaaaguagccaguaaccaagaaccagugucagaguccuacugaggauguaugagagcgaugcuccagagcuccugcugaagugaacacuuucuccauacacugcaucgggccugauuuuccuaaacacaggugcaaggugacuugccuccaagcucuuuaucugucauuggugcacuauuuuuguguccuuguuugucuugggagauuucuguugguuacuuuuuuuguguguaggagggugcuuuauuuuguucuauuuuggugguccaggggguugaccauagggcccucauacgcaaggcaagugcucuacugcaauguauccccagcccgaguccuuguuguuaauaauuauugcuauuaauuaugaaucuguauuuacugaguuuacugggaagaauucaaacacccuuuucuacucuucaaguaaaaacacugacccuauggaaacacuaaagaugucuggaaaccugauaaaucgacuagauauuuuaauuuuuccauuugauaacagaaaugaggccauagcuaccuagcaugccuuuacuucuaguuagaaaggagcacuuucccacuauauccacacagagaaaaaguauucucucagcuucaguacaucuggguacucaugagaugaaaaaaaaguaccuggguagggcaaacucuuuucagggaucggcuuaaacucccuaugaacagacucgcaacuucccucaaacucccgcuuugcuuucggcucucagaacuccugccucccucaaguucagaucaucccugcuuggcagaguggcgcccuaaauguuaauaagucacauccuggcucuuguucguucuuucccugucuucugcuaugugggagccuagaagcccuuccuucugguuuagggcagggagcagggguucaguugcuguugucuauucucaacuguuuucccucaugaaaauuucucaacaaagucauuagucuacaauuaaaaccucaccucacauuuucucucucacuuacaucugaucucuccaaagcccaacaugucauacuuuuaggugcccacaugcaacuguugggaguuuaccuggaaaugggaaagcuuugaugucaccaccagccccaaggaccacagaaaucuucaccaguugaguucccauuucugaaacaaaugccaaaaucgcccugucuaguuuccacaaacucagcucagacuuuuuuuuuuaacugcucuucuuacaaaauguaucuucccuuuguuuccaguacaaaugucuacauuucugaauauuaauuacuaaguaauuaguggcuaacuguuuucaaaauacagaauucuacuguagcaaugguuccaagcucauuuucaccuuuuuaaagacaauuuuagcugacuuuuauaauccucaacauacuauagguauaccugacucuuccaaagguguaaauaaguaggggggaaaaaaccccugcagaaucuaggagaaagagacaguguguuuucuuuuuauuuccuuucuuuguaaaacacacaaauggcuuuugaacacccuacaucauuuuggcaggcugcagggcacaucuaagcagauacuacagggcaggcaggaacucucugggaaggguacaauggcugccaauauauucugacacauaguuacccaaucauuugacagaaauggaaacgaacaaaaccagaauggacuugucacuuguuacuaaccuuccuucaaaugacagcaaaaaagaaaacugcaagcuggguagguaggucaguaaguacaauuuugcaacagauaacccugaaaacacuggagugggaaagggggggaggucuaaucaagugcccagaaucuccaacuaagaaagaccugguucucugauaucagaaacuaccuugaaggagguagggcacugagaugaaaaggaucagaggagguggagaagugucuguccuauagugaaaaaugucagccaaccacaguguucccagcugaugagucagcacccuguuaauacuguggacuguuaaugcuguggacuguaacugcggcugcgcuacccuuucauuggacuaugagcuccaaaaugggcaggaacugguucuuguccuuguuuugugcugggcagaaccuagaacacuaagacacuuaaauggcacuccgaguugguggugcucuaaaucucucguccucuuacagcagccccucuuggacuggaaauuugcgaaagaaaacuaaacgagaugugauagaacuacaaaguaguagaaggaagagugggcuugggguggguguuaggagguagaggaaaugaauauaaaagaaccaacugguuuuuagaauucugcuuucuguuccacagggaggcauauacaaaaacugugagaagacaccaaacaaaaaagggcucacugacaauggaauauauaggcucagaaguacuccugcccaugugugaaugaaacagacuugaugccauugguggaaggaguaugacagcuggacuagaaauaaucauauaaauugcaaagcacuaaaaaggaagagaaagggugaaaaaauauaaucagcauucagaggccauauucuuuaucuucuacugcccacaaaaucaaugcugaaaacuggaggcuccgucuccgcccccuugcucaccucuuugacaaggucucuccccaccauccugcacagcucagaguacucacucacccaauaaugagaguuagacagaaagaugcaaaagcauuugccuccgcuuugaugccagucuggguuuaagacuuugacaguguccauagauacacucuucuaggggaauaauccauagauacacucuucuaggggaauaauccauagauacacucuucuaggggaauaaucaucuuccaccuugcucuaagggaggagggcgaggacucagccaagcauuggccuuuacuaucaggucugccccuagcaucuaagaaucacauguaaacuguguaaagucauuaccauucucagauuguaaguuaggacacuucacucugaccagcgcuuuccugguaucuacccagggcaaaugugccugagauagaaacaauaaaaggguuacccuuuuccucaaauaucgugggcacuuuuucagaauauauuuuaugaugucaacuugacucugccuuuugaauccuugugggcaugagcauucggcccucccagcucagagggaagagaacccuuucucggguuuucugcugcaucugguuccaugccuagcuucaucccgaagcagcacucuggguguguggggccaccagccaaacaagccccuauggaacaaaaagcgugucaguguagagaggaccacaccucggaggacuacgggggagggaagcagcaagccccaagcaugacacggguggcuuuccugggaggccaggcuccggagugauuccgguacccaggguuagcuacuuaaggucaccggcuugcugccaacugacuuccugacacaaaauggcuugacauuuucuaccuguacuucgucuuuuacaauaaucuagauuuaagucuuuaauagucuccauacagauuccucuagaccgggauaguuuaucuuuccuccuaugcauuccuggguucagagugcaagucucuuugcaauggccgggaccaugucauucucaauccuauaugcaugucuggaauuguacacacauacaagaaugguguauucacaucugaguuaggagcacaggcccuucucucuguaaagccauacaugagugugguccuuauugucuucagaugaaagugccggaagaggcuauuuaacuugcuucuuuagcccuugccacuccccaaagacucccuaagcacaaagcuguccugagaccaccugcaugaugcugacugugcuagaccagaucuuggaagccaggaaaaccugucucaguggcucccccuucaccuccacucaggaaauacuucacacuccaaacacaaaggacagugccauuacuguugauagugaugugacuaaugcagacugagcuaaaaaagaacgaagagaauccacugaccucuucccuaagaaacauguccaacauugccagaggacugaaaggcaacuaaccaacaugaaccuggagagagcuacagcaagucaucugcauuauaccaaggucugugggggcagggagcuagagaaagaguaaaaccuggccuucuaugacauuuaaaauuacagcuucaacagcacauuugugucuuguuuggggcacuauaacuaagugacuguucagaccgagcuacaaaaaagucaaaguauaaauaaagcgaauauacauacuacgaaagacuuucauuucuuggacaaucccccacccagugagggagugcuuuucagggagccccacuaggaucaucuagcuuccauuucagaccacccacucacgcuccccugcgucccccaguuccaggcaggugcauuuuaggguguuccuccucacuuuggcuaguguugccccuggguauaaaggagcagaucucuucccugggccuuguauggcugauggggcuuucuuuuuuuaacaucucuugauaaucaggaauuuguaaaggaaccaaugguagaucuguugccaauuauuucccaacagcuaguaaucagucauuauaaaugguaguaggugacaaacaauuguuucuuuggggacucuuaugacuuaaaaauuauccaacagacucaagcaguguguguccuuggggguuuggaguucuucaaaggauuuagaaccuaaaucccaaguucagacuggcaaguugucugcuucuuccuggucaugucauaagcaguuauagaccagggaaaaaacuauaauccauaacccuagagaggaauuagacaguucuuaagccuggaccccuacauaacguggcuugaggguccagcaacagucaugcaugcauuaggcugccuagccaaacuggaaggagacuguagggcugugguuaacugcauggaaggagacuguagggcugugguuaacuguagaaacgaugcucuucuuuccucuuccuccuccuucuaguaacaacaggcaaggaccaacaaucagauacccacuaaucucaacaucacccucccacugcaggagaauuagacaaaucauuaaaaaaaagaaagaaagaaagaaagaaagaaagccagcuguaggcuuucccucacuuccucuaucaagaccaguaucuaaaucaaccaguaacucuaccuucaaggagaaagugauuucccaguaaguuuccaaaaggcaacaguaacaccuucauuuaguuuuuguaauauuuaaaaaguaaacuugagguuuaaaacugacuuaaaaugaugucuacuaagaggaaguaaauagcgagcagaucucccugaggggaggaccagugauaguggagacagcagccaccuaggcaggcaaagguuggacugcugcaucacuugggggucacaucucccuuacuggggccuggcccuaccucccaaucugcaacaugacacuagccaaaaugucugcaguaauaaugcuucaugcaacaguaagacuuagaaagaauaaggaaggaacgucuuuuguuuccuaucuaaauggacacucugaaagucuucaauaggaccugggcaaaacccauucauccuggaaagccuuacagaguuaucaacacccaucucuaagaacauggauaaugaggcccacgagggcagaagggccucagugucugcagaacacuugccacagguggaagaugcccacccagggaggaucaugccccucucaacccauuugccaggguaggcccucuguucacuccucucaaagcaucauuaaaaaugaggaggaaggauuuuaagaaguggcaggggagcugaguuugcuucuguucagaaauugaauacaaacacuagauuuaaaacaguuguguaugacgggcuacuuaguaaucacgacuguuaaaaccucaaguuucugucagagggaaaugaguuacaacacuguuuuaucuaagggcuacucacuucuuuuuaaagagcuugcggaaugagcugcgaaagcccccuuucuggucuugccugggauuuugaucgcugaaagaagucuguucacucucucuuucuuccuuuggacagaaucgaguggcauccucuaggugcaucuccugaaaacacacaaaaaaaaggaguguuuuuuuacucuuuuccauaaaaaucugcccuggcugugggaugguccuucagcuuugccaccugccucuccuacucccaagacuaccugugacaggagagagcuggccccacaagcugcccucuguucuccuuugcuuucuauugcugugacaaauaaaggccguggcccaaaagccacuugggaaaaguugcacuuccaggucacagucaagcccugaggggaggcagggcuggaacucagggcagaaccauggagagacgcuccgcucugcuccucuagguuugccuagauugaccuacaucaccugcggggacagcacccucugcuccccccacacacacccugguccugggacuggguccuccucuauccauuagcaaucaggaaaaugccccuccaggccuggcuacagccaccaaaugcagccauguccucaguuuaaguuuuucuucccagauaacucuaguuucuauuaagcugauaaaggauuaaccaguacauuuucugaccuuaacaugcuugccauggcacacagaauaaaaugaauguucuucuuuucuuuuuuuuucuuuucuuuuccuuucuuuucucccuuuuuaaauguguauggguauuucaccuguuucuaugucuauguaccacuggaucucccagaaauggagucacagauagcugugagccaccauguagauacuaagaauugaucccugguccuuuggaagagcagcuagugcuuuuuuuuuuuuuuuuuugguuuuucgagacaggguuucucuguguagcccuggcuguccuggaacucacucuguagaccaggcuggccuugaacucagaaauccgacugccucugccuccugagcagcuagugcucuuaaccacugagccaccucuauagcucccauaaauauagaaaaugaacuuugcucugauaucaacugugucuugcugaauaaaccuacccuugacuccuggcauugguggauauguuccucuuccuacaaaauaagaaaacuuaauaugaagggguuuuguuauuguuguuguuucacuuuugagggaaacagagaucaaucaggaugugcaacuauguaaccauaauuuuaaaguuguauuaguaauucuguauuuuaugggguuagaggucagaacuguugagaaauaccaacucauguaucuaaauuaugaauuugcuuucaagcuacuuauauaguucaaucucuauuuaaaguacaauuaaaaauaaagauaccuuuuuguacacuuguuuauuuucaaaugugagauguauuaucaugugcacauauacggauguguuagguauguacaaaaauuuauauccuacaugaacagaauauuuauguugaggugacugugauucuaaaaacaacugcuuaauuuugaguagcccaauauuauaauuuguauaugcucagccuagggaguggcacuguuagaagguguggaccuguuggaguaggugugucacugugagugugggcuuuaagauccucacccuagcugccuggaagccaguauucugcaagcagccuucaggugaagaugcagaacucucagcuccuccugcaccaugccugccuggaugcugccaugcuccugccuugaugauaauggacugaaccucugaaccuguaagccaguucuaauuaaauguuguccuuauaagaguugccuuggggcuggagagauggcucagugguuaagagaaccgacugcucuuccgaagguccugaguucaaaucccagcaaccacaugguggcucacauccaccuguaaugagaucugaugcccucuucuggugcaucugaagacagcuacgguguacuuagauauaauaauaauaaauaaaucuuuaaaaaaaagaguugccuuggucauggugucuguucacagcaguaaaacccuaacuaagacagaaguugguaccaggaaugggguauugcuaugauaggccugaccaggcuuuuguuuggaagaaugugaauuuggggauuuuggauucggaaagcacugcaaugcuuuaaauggggcuuaaaugggccauccuaguaggaauauggaagacuuuguugcugugagugauuugaacugugcagaccuggcccaagagguuucagaggagaagaauuucagaacgugauguacagacuauuuuugugguauacaggugaagaaugugcuuuuuguccuuaucugaagaaucuaccugaggcuaagguaaaauuacacugacaaagaaaauuucaaaaaagcccagcagagacuuugucaugaagaguauuuugaacaagcauagcacacuuagaaaagaaaaauauauaauauauaguauuaaggaucugaauccugucuguguucgaggauauuaaauugaauuaagggagugguaaucugggcaagaucccgcucagcuaaauuuagguccaggcaugguaguacacgccuuuaaucccaggaggaaaagacaagcaaaucucugaguucaaggccagccuagaacagagaaaguucuaggugaagaaaaaguuaaaucuaggcuugguagaccacaccuuuaaucccagugcuuaggagacaugcacauaaaucucugaguuuagagucagcuacagagcaaguuccaggucagccaaacuuaggcagugaaggaguuggaaacagaaagcuggugauaauguaauacaacacagggccauguuccagcuccagcaagcagcagaacuuggcagcuuuggccauguggcucuggcuuuagaguccaaaauagaagggacuacugggacaauugaugcugguuagcuggagcuaagaaauuaguguugauuaagaagagaccaacaucacuaaggugaaaucuugugggaaguguuuucugagagcacaaagaagcuguguuccagagauagccaaguuuguaccucaugcaacagcuguacuuguuaauauguaagagucacccaggugguacugguuuugaaggcaugaaggggucaugaagagaaguugaggcuuggcaccguagaggccauggacagccauuggugaaggugcagcuucgguuuuaguugauggcccaggacugaaggggucaugcaaaggaguugaggcuuuuggcaccaugaagagagccuaugagaggcuauugguaaagccuaguaggaguguaacacuccaguguauuggagaugccaguaccaugggaugaucaccaagaacagcaguggcaguggaguggaucaaccugagcuuagagugcuacagagggcagagcuggaaaagugauaccaucccuuuggaggagcccagaagaucaugugaaacaaacagcucuaacauugaaguugccuuggaggcccuaagauguucaaggugccagagccuaucugcugaggaaagcugcuaacggggaguggaaccagcccaggagaaagaaguuuguuguagucaacaaagaugaaaaaggaguuggagaucugaagacugccuugaaaucacacauggagaugcagaauuugaaguuugcccaucugguuuccugucuugcuuuggggauuacaguuaagugauuggaugaaugucagaagagacuuuggacuuuuaauauuguugagacugcuauaguuuuggggacuuuggaaguuggacuaaauguauuuugcauuaugcaauuuuuagguauggcccccauggacucauacauuugaacaauccuaugggggccagggaguggaaugugaagauuuguauaugcucagcccagggaguggcacuauuagaagguguggaccuguuggaguaggugugucacuguggguguaguauaagacccucaucuuagcugccuggaagccaguguucugcuagcagccuucagaugaagauguacugcaccaugccugccuggaugcugccauguuccugccuugcugauaauggacugaaccucugaaccuguaagccagcucuaauuaaauguuguccuuauaagaguugccuuggucauggugucuguucacaacaguaaaacccuacuaagacagccuaagucaagauggaaaauacaucaccagugcccugccaguccagcuggguggcugaguccuugugaggagcaaagcauggguagacagguuuucuaggaaacaucuagaucugacuuugagacuucuaccugggguuguagcagccaaccuagaaagucugugagaugccacuaagauuccuaacuaaaccauggagaccagcauccuagugguuuaguguaguguuucuccaaguacacuccuggcacccuaggacccucuacacuugcuuuuaccuauggacucuuaagccccauucucgagucucuagagcaggcgucucugguguauacauaauuguuaugcauacuuagauacgaaagccaggagcuucagacuggcuucugcccaauccacuuccugucucuaucaaaugccuauggcuccuaaacagcuguuucugauucagugguacagauucuggguuuauaaaauuauaaaauauuagauucaugcauccacuacugccuccaggaccacauuaugggaggucucuaaaggaaguaaggcaaagcuauucugcuggccagaacaccugcuggagacaggacaucccagacucagaauuuuggagagggcuucggagaaugcuugggcuugauuuugccuccuaucaacucuggaccuccauuaaagugaucuuuaacucaacaccaaauccuucauucaggaaaaccaugaaugguuuaaggaaaaucugucugugaacuuggucuugguaucguucaucaguauagcacuucauacuuuaaaaaauaugcucucaaacuaucuuacuuggcuggauauucauaacccugugagguagauaugaucuauacuuucuaaaaguuuuaucacaaaugcauuauuugggaugaagggauggguucacacaugccagggcacauguggagaucagaggacaacuugcaagauucaguucuccuuccacauguacguucugggggggggggggucaaauggcauuuucucaagcaggguggcaagugccuucaucugugagccaucacuagccccaauuuuacugguuuuugacggaauguguauaaugaauucaggcuuugaggaagucagagacaaucuuugaggaguuggcucucuccuguccuuggugggacacaaagucaggucuucugguuagcaccucugucuuauuuuuuauauaaacuuguuaugcgcauuucugccaugcguguuuggugccacaugcacgucuaaugcuggaggagaccuaaaaggcaugucagauucccuggaacugaaguuauagaaaguugggagcuuccaugugggugcuaggaauugaaccuggguccucuggaccagugcucuucaacacugagccaucucccuagcccccuaaguaucuuaucugcauagauaagaaaacugcaagcacagagaugccauucaaauccucuaaaagcaggagcuguuugacagcagagccugggcuagaaaggagcccaaucagaugcccaaucagaugccccuugcaggaaaacauacucucuucucucuugacucucaauaaagacacuaaaaacuggcuucaugaggcuuuucuggccacagguggggcguguagaguggauuugaaggagguagauggcuuugcucaggauacaguuuuacagacuuaucguuugcagcugaagcuccaaccauauccccaccuuaaacacagaugcacucaaacaugcuuguguuacauacacacgcacaaacauguaugugcuacacacacaugcacaaacacguaugugcuacacacagcuccuucuccccuaaacucugcaugauucuuccuuggagucucuucuucaucugaccugugucuucccauguuagggagugcuggaauauuguuauugauuagagguauguccagcaaauagccacaaauauauuuauuguuugcuucucagauacaauauuuguuauuucuguguuuuucuccugguaauuguuacaauucucaaaaauuucacaugagcuagggcaaaaaacucacauauuuuaugaacauguaaaauaaaaagcauucuuuauagcugaguacacuacuugaaagauuuugguguaugccucugccuauccccggugaacaggcauuuuuaauucccuucuacuucccucuuaaugaacuuucaagauuaucuaagauggauuugucucagaaauuuugcccgauagaauuuuuacaguuuggagauaagaaaccagagucaaaaaaaaaaaaaaaaaucucaauccugaagacugucagcggcuucacuagaccacaauacuggguguucguucccucugcugguuuaacuccuagaacucaggugggcaguaaacuccaggcuugccaugauccacucccuucuuuccaccuuucaucaggcuaaagaaaaagcauucccaguugugcuaugcccaaguguccuuucuuuaaagcuuccauaccuugcuuuucacccugcccccaauagcuucuacacacuuuuuaaaaucuaauugagauauucgguguacuuagagggcauucuguagccucaucaacccaagaggguuugagcuauccauccuguaggcccccagaacggcguaauucugugugcuaagucuugugggacauucugcacuguugacuucugaagcucuggcaaacagcacagagggccugguacgcaaacacuguguuugcuggaaauuaaaugugucuguaaccgucaaucuaacccacucucuugaugaugaguggcacgaaaggguggugggauagcugagugcuaucuugucaauaugcuuagucacuuguuucugucacauugaaaacuugugugucugcccaugaaccugccucuucaugguuaguauuggaacauacauuuaaauaucccaaggcuugaagacaccaacgucagauaccaaaaugcuucaacauucacugaagcuaaaggcguguuugaaucaaggcagccuuuccuaagaaagcaagggaaaaugaauucgcuuugcaacaaacuucgaagucuacacugggacagggcaaccugcguccucccuagauacugggaguggcuggcacaccggugcucgcuccggucuuguacauuuaagccaggaagugcaccgggcaggccugcagcccguaggaagguacaauucguucacuccuugauucaugcucuuugugugcgucugggucccagcucgcccucucugccuucguguucucggcgugguagccacccugcccacucgccuucgaaggccaccagggccacagccuguaaccacgcgugugcuggcuccgccucugcccgcccccuccccgccgagggaaccggggcuggcccugagaucuaggcccggggcgccgaggcgggcgacggcuggguuuuacuuuacccuccuuacuuccaaauaggucuguuuuucgcuuugggaccucuguugggggaagaagguccgcggcgccccgcgggaggcggcagcggcggcggcggggccgugcggggcgggagcgcgcucgaccuugagcggcgcgcggccgccgcugcugcuucgcgugcuguagaggcgcggggccacgcccucggcgggcggcgugcgcgggaacuccuugagcgagcggcucagaggcuuggccuugccgugcgccugcgccugcgcggccuccagcuuguaggcgccgcugcugcucgccggcgacguggcgcucuugggcagcggcugcagcgcgugcuccggccucucggccuccauggcgaagcugacgggccgcaggaagcagauguccaggcuggacucggaggaggcaggcgagcaguugucgaagagcgccggcgccuggaagggcuccucgucguagggcgcgggcagcgcgaagaucucgccgccguacucgaacuccucguagccggcgggcacgaagccgcgcgcgucgggcaggagcucgggcggaccgcgcagcgagcgcuccacguugccuagcggcucggcggaagacggcucgaaguccaucuccgggauggccugcagaggcccggcgagcgccuucacguccugcucggccgcgcagaacugagccggcgccagcaggcucucgggccgcucgugcuuccugcccuccagcucccagucuccaggcuucccgggcugcaugcucuccaugaggcucugcugcugcuggccuuucuuugccggggccaucagaugucuuuaaaggggaaacggcacaagagagacuaucaaauagugcugagcacucgucgaccaaucggccaaaggccagcuucucuccucaucucccaggcaccuucgugggucaccuaaaaagcuccacaaacugacuagagggcuuucucaagugacuggagagauagcucagcgguuaagagcacugacugcucuucuagagguccugaguucaaaucccagcagccacaugguggcucacaaccauccguaaugagauccgaugcccucuuuccaguguacuuauagaucgauagauacauacauacauacauacuacaaaaaaaaaaaaaagcagcagccaggaaagucucagcuuccaagcucagucacugagacaucacauggcgggcagacaaaggcugucacuauugcuggggccugguggaagcucugaaccuuccugccaccaccucugccucccaaggcaugucuuuucaauuuaucucccugucuuacugugacagagucauauagaauaccagaaaaugaacuuaauauaacuccuagaucuucacacguaaacaauuguguuccugaauaaacuguugaacucuggaugcugauauaguggauaaacucauguguaaaauuuauauuucuauaacaaagguuuuuaaaguuuuguagcuguaaagcaguuugacugucaucucaaacgacccacaaaacaauguguuguaaaaccuauuugaauuugcccaguuuugcaguuuuguugucugggagcacauaauuuuuacacaguuuaaaaagugaagaauacccaucacuuaggauuuuuguuuuugcuuaccuacuagauaucaaugagcuacugcacacugaccaaagugguuauucuuauuuauauuuuaauuccgucaggauuauauauggaugcacaugugaauacuaacaauauuuuaaggcauugcaagacaucuucgagugggacuuagggcuuuaaguuuacagaugugaagaaaguaaagugacuuuacaucagugcucuuuacucuggaagaguguagaaacagccaaaguuuggcccgggugugaugcacaucuuucccccucgaccuguuguacuugaaggagaauaaacacuucacacuaauuaaagaguugaaguaauacucaaagugaauuucuacuuuccaccucuuaauacuuuuuuuuuuaaauugagacaaggacucuauuauguagcucuggcugccuugggacucacucuguaguccaggcuggccuugaacucagagaucugccuaccucugccucccaaguguggagauuaaagggaugcaccacugcccagaagccaccuguuagcacuuucuaaaucugccucgucuuucucugggauccgucaaacgucuugaugaucaacugcuuggcuguuaauauggaaacaauggggcaagggagaagguggaggucugcagagcacauuucuaauccaggaccgcuugcucaccuauacaaaucaucuacaaggccaauacuguuaauguuuccauagcaacagauacucacgagacagcaggggcggaacuggaagaggaaggauaggguuggagcauuucuucugaguggaccccacugucguggacagccuccuggccugcauugggggaagcaucuuggccagcauuggcacacugggaagccagcccuuuguacagcuuugccauagaugaccuaagagaaucgaaauagucucagguuguacagugcaagacuggcucugugaauacagagauuaugcaagaaaaa

SEQ ID NO: 8754 - RNA, 92302 nt, Mus musculus
caguugcgagcagguucaguuugcuaguaggaagcuccggcgcuacaccggcggcggcagcggcagcgguagcagcagcggcggcgacggccaagcggccggauuccccggcagcgaccucgggcccuccccguuccccaccgaccccugcucccgcuucgucccguucugggccucucgcuugaguuccccgcuggcgagcgggcgccaccggccggagcguccauccacgcgccgucucucggcgggccaggccgugccggggagcgcagccccggcggagggcggcccggggcggagcggggggccugccccggggcgguggugcgggaugccgccgccgccgccgccggguugcguuggcucucggcgagcggcgcgcgugucggguggguguccggccgcgggccucgccccccagacuccucgccagcgcuagccgggccgcgcggcgccccgagggggccgggccgugcacgggcuguggcccuucuccgcgccgcgagccgccgccccuccgcccgccccgaggcgccccgcgggcaccaugcaggcgcagcagcugccuuacgaguuuuucagcgaggagaacgcgcccaaguggcgggggcugcuggugccugcgcugaaaaagguaggggcgcggaacccgcuucccggccgcaguccgcgcggggcugggcgaggguggggaggcggggcgccacugucgucuuucuucccggucucggaucucggggaggucugcucgggcugcgagguuccccgcguccgcugcuccagcuguugacacucgcccggggugcgugggaaggccgcacacagucggggaggguuggucuggaucauccaagcgcggaggcggggguuggaggagccucgguuuuccguggaggucaacgaaggccauugccuaccuucucgaucuuccgaacugcggucaaccucucguuuuaggaguccgguacucucacuggcucgaaagugccuuggccacagugcuugccuaaguaauugcgagguugccugccagcaagaacauggccugcucggcugugcucguccucagucauaacuccccguuuucuugacccccucccccauuacagcggugaugcacaugccacuguauucagauugguucuuuugaagugucugagaaucuuugaacgucauuugguuugguguuuugcaucuuuuuauuuggaaauguugcuacauuuuaaaagcuucuaaagcaacugucuguccuuugguuaggcauuuuggauuuuuguuugccagugguuaaaguuauucgugaauguugcuacauuuuaacagcuucuacagcaacacuuagugacauaguaaauacuguacuaagacaucugaaacaggugugcuugaauggauuuuaaaacaaccagauugguuuuuguuuucauuugccuuaccuguagaaauuguuuuacaauuuaaucucccauuucuuguugcucagaugauuuucgugcuaucuuugcuaaaaugcaguuuuguuacuacugaguaccuggcguuuacugugccauuaugcagagccuuucuauuuuaccagaaagucuugaaagguauuucauacucccagaggccaguaccuuucaguuucucgucugcccuguucuccccuuccccucuugguauguuauguggaaacuguuggcuuuguuggaagacuuugcuuuuaucuuucagacuuagguuccugcgcuuuauccucaagugucucccuacuuacaaaccucuguauguuuucuaagaaaaucaaagagaccaccuuguugugcauccuuaaugacuccaugagacuucaguccauuucuacauuggcuuuaccugcacaauugccugcuuagcuuggagaauuggagaagaaugccucaugaugcuagaaguuugguauuuugacaggacaggaugaagacaaaaaauugauuuauauguacaaaagcucucauagaaccaguuugagguauauggcuuaaaagcaauagcuccuauucuaaggaaaccuccaaaauaacacucgaggcuccuuuagaaugguagacagagcauuguagaaguuggcagacuacucuaacuugccacuugggugguccuugcugaaaucuauuuuguguggcuggcauuguggauuuuguuuuguuuuucaauguauguaauuagucaccaguuucuuuuuuucgagacaggguuucucugcauagcccuggcuguccuggaacucacucuguaggccaggcuggccucgaacucugaaauacgccugccucugccucccaagugcugggauuaaaggcgugcgccaccaaccucccggcagucaccaguuucuuaaaaugagaacuaucacauaaacucugagguuuguuuguuuugaauuauagauggacuggccauacauuuucaccaucaacugcuagaguuuugagugacugcuuucuuuggaaaggguuuugucuccaguucaucaguguugcuuguguucuaucgcuucaugguugguugguuuuccauuugaagcagagaccucccuguagaagugauaugaagagggaguuuacagagucucccuaaugugugagguucuuucccucauuuacauuuccaccugcaaugcucuuaagacacccaagacaagguuggauauauuucucauauucugaauaugcucuuuuguuuuuuuuuuuuuuucccgagacaggguuucucuguauagcucuggcuguccuggaacucacuuuguacaccaggcuggccuccaacucagaaauccaccugccucugccucccgagugcugggauuaaaggcgugcgccaccacacccggccugaauaugcucuuguagcugaaaacuugaauuaugguauguguguagauguguccuuggacauuuuguguccuuggacauucugugugggugucuccuuaucuugagcucuucagacuuuaaacuacuugcguagugcccgacuguguguuuucauaccugaggcuuuuuggauagccugugcauuuucucuggucuaauacuauucaaccccagagauuuuucucaaccuaguggcccauccuaacucaacagugaauuuuaaguccuaauuuacuuguccauauucacauuagcuacccuauuggacuuguuguacacaggugcuaggccuuacaccuguuagcacucauuuugguuguuuuguuuguuuguuuguuuguuuguuuuuguucuuuugguuuugguuuuucgagacaggguuucucuuuauagccuuggcuguccuggaguucacuuuguagaccaggcuggccucgaacucauaaaucugccugccucugccucccaagugcugggauuaaaggcgaugaacaagugucuuuguagguuaccuugaguuugucagacuuuaaaguaaauuauuuagaaaucuugcuacauuuuuuuaaagcuucuaaagcaacauuguaacuuaguaaaucuucacaucucccuccuuuugguuuggcguuuugaauuucuacccuuuguaugcuucauuuaguuugccaguaguuaaaguuauuuggaaauguugccaauucuguaaggggauacucaaaacugacccccaccaccaguuuuuaacuucuugauuaacggcuuuaaacuuuuauuuaauuggcucaaaacugaagccuaggacuccuuuccguacugcugccugccuucaggccaaaccuucugcuuaucaaccucuaacaugcucuuggacucugcucugcuaacugcuuggaguuuccgagguuacugugguaaccucucaguugaguuccuuacccccaacccaccugccuuuacauauuucagaaguuauaaaguacuuucgaacauguuauacauuuguucaaaauuguugauguccuuuaaguuaaaguuaggguuuguuuguuuguuuuuuuaagauuuuuauuuauuuuauguauaugacaaguacacuguagcugaucuaggaaacaccagaagagggcaucggaucccauuacagaugguugugagccaccaugugguugcugggaauugaacucaggaccuuuggaagagcaguuagugcucuuacccgcugagccaucucagcagcccuaaaguuaaguuuuuuaagcauggaauuuauaagacggcuuuaccuuggccuuccuguuugauuuccuaccuagaucuuucuggagagcacugcuccuuuuccugaauguauuuauuaggccccacagugucuuuccuacugcaucuaucacaucccacaaauacuugauucuuguuucagaacagguauggccuuuggcacuaaggauaaaugacauauauuaagaagacuaagucgagggaaggugguaguggauaugucuggagagaggacuuguuuuuaagccagggauuuuguuuuuguuuuuuuuguuuuuuuuuuuuuuauuagauauuuucuuuauauucauuucaaaugcuaucccgaaaguucccuauacccucccucugcccugcuccccuacccacccacucccgcuucuuggcccuggcuuuccccuguacuggggcauauaaaguuugcaauaccaaggggccucucuucccagugauggcugaauaggccaucuucugcuacauaugcagcuagagacacgagcuccagggguacugguuaguucauauuguuguuccuccuauaggguugcagaccccuucagcuccuugggugcuuucucuagcuucuccauuggggagggcucuuuguuuuuagacagucucauucuacagcucagacuaaucuugaacuuguagcuuagcuguccuggcucaucuacccuagugcuaggguuauaaguaugggcuagcuagcacaccuggccagugagguguuuuaaguagggaguaacaccuggcuugagguuuagaagccucacuuuggccaacgaagaggaagaauaaggccuaagguaagggagagaagcaagaaggcugucuaagaggaaauacacauuuggauuaagauggaugcugugugagugguguugaaaaggcagacccguugggaccuagcauuucacuaugugacuguaggaauguuaaggaagucaaguuugcuugcagcuagucacugaacuuugggauggagagacagguaacauaaugaaaugauuuggaacauguugaucuuuuuuuuuuuuuuuugguuuuucgauacaggguuucucuguguagcccuggcuguccuggaacucacuuuguagaccaggcuggccucgaacucagaaguccaccugccucugccucccaagugcuaggauuaaaggugugcgccaucaugcccggcggaacauguugaucuuaaaggccuuuuggaucgucuaggccuuguucuccaguuggcagcccagcuuugauacccaaugcagcagauuuugaaguaugaaguagaguagaugaaguguaucuauagaaaaacuuauguaugagucagguuugaugguacaggcaguaguagauuagagcacacaccuaguguguauaagauccuggguuuaguucccauuauugacaaaagaaccauauguaugaauaccguggcaggucuauucagcuccacacagcaaucgaaauguauacuauccguaaucgacaaggaaaugagugaaugaacuguggugcagccguauaguggaauacaugggaauguagguuacugaugcccaugcaguguggccaacccgcuaaauaaccaacaaaccaaacuaaaaccagcauguucuauaggcuucacucucauaaaccuguaggaaaugcaaacugauacagaugauugguuauuauaaaaacagacgucuagaugguuaugcugacacaggccugcaaucacacagaugagaaggaagcgcaagaagaccaggagcgaaggucuuucuuagcuacacagcgaaagaacagcaaaccaaaaggagacgucuaugucuacuuaucuugaguaugcuauagugcuagguggugucaaaucauacaacuuagauauaugcggcuuaguguugacuaguuguucucagugaagaccaauguagccaucagcuuagaaucugcuacugucucacuguguuugcuuuaucacaccuauccacuuucccucccguuaaucuguuguuguguuuugagacagucucucccaguguagccugaaaacacugugaagcccaggcuggucucagacuuguggcaaugguccugucucugccccucccccuccagugaugagcuaacagguaugagcugcucuguccagcuuaucuaauuuuuuuuuuuaaagacaggguaucuauccauucauucacccauccacccaccuguaacucuaagccagcucuggcuguccuuugcccaccucugccuuccaagugcugggacuuagggguccacuaccacaccuggcacuuaugugauauccugaugaauuuuguaguugcagguauaagcacacuuuauuccuaaauccuucaccccacaucaguaacuagaaaucaauagcuuuuuaaaaacaguuccuuuuguuuuaguaggaaguuccuaugcaguggaacauacagacguuacuuggagugcuuaaugaauguuuacugucaaagccucuauuaaaggauggaccacucccauggcucuugagguucccuucgugccccucuucccagagguagccgccacugcugcaacauuucagcaccucacaucgguuacucuugucuguucuggaauaucauguaaaugaaucaaguaguguauauauauuuuuuuauuguuuucuuuuuuucaauuuuuuauuagauauuuucuucauuuacauuucaaaugcuaucccgaaaguccccuauacccuccccccacucugcuccccacccacccacucccacuucuuggcccugguguuccccuguauuggggcauauaaaguuugcaagaccaaggggccucucuucccagugauggccaacuaggccaucuucugcuguaguguauauuuuuagugaggcauuugagaguaugcuuuaagaauuccguccuuuuuuucccaccaugugaacuaugucacaguuuaucuaguggauggauagcugaugcuuucaauucggagcuauuauuaaagcugccauaaauguucuuuaaaaauugcaucuauguguuugugcauguaugcacaugcaugcacagacguggaggucagaagacaacuuacaggaaucuguucuuuccuucugccauguggaucucucaaaucaaacuggcgugguggcaggugagccacaggcucaaauggucuuguugagauggugucucauguaaccaggcuugccuugaccuccuggugcuccuguguuugucuccuggauguuggguuacaggugugcacacucagcccccaugguucuuacaggagucugcuuagagacagcuuuuauugcuuguacacuaguaccgagacauugcuugcaggauagagaucuguuuaugagaaacugcuagaccuuuccccaagauggccaaaccauuuaaaagucucucacagugauagaugguggcuccuugccagugugugauguuacuagucuuuaacuuuagugguuugaagugcuaucuuauuuuaacugugucuuguaucccaugguagauaauuacauugaucacuuuuuuauauucuuuuuugcacugugugugugugugugugugugugugugugagugagagagagagagagagagagagagaaugaaugagagggggcagacagacagacagacagagaacagcuuacaggcauugauacucuccuuucacuguaugggucuucaggauccauuugaggugaugagguuuggcagcggcagcagauacauucugccccccuagucaccuuguugguaccuucugcuuuuauguucuuauuagucauucuuguuuauuccuuuggacagugucugcucaacucuucuuucccauaaaacauugaauuauuuuuuucuuuuuaguauugaauuguaagaugccuuacauauucuggauaacuguccuuuugauaagguauuuuuaugauauuuaucuaucuaucuaucuauuuauuuauuuauuuauuuauuuaaggccucauguaacucagggucauaaugguucaacuuccuugagugucugcaucuuaaguguguacuaccgugcuggguacacaucauuucuucuagucuuugauuugcagauuuacuuucuaguaguaguguuuuaugacaaguaaaguuuuaaauauccacacaucuauccauggugucaagcagcccacauugggcucggccuuacuguguggcugaggcugacuuugaacuccugauccuccuaccuucauguccccaguucugggauuaugggccuaugucaccgugucugcuuuguuuuugugaggucuaauucuguagcccaacuuagcuugaaauucacuggcugaccuugagcucauaauccuugugcucuaccuuccaagggagccaccuaguccagccagauagaaauucugaaggaucacuggcauccacauggcagcucacaacuguuuguaacuucagugccaugggcucuggugcccuuacagaacaacaggcaaagcaaaaacaaaaaaauuuaucuuugauuuuacagugcuaaggaaaauuugccaggguguagggagucuuugagugaaaguugacugucacaggaaugcugcaucucugagaaacggagucugccuucgucugcuugccaugcucagugaucgacuaggaggggcugguuacaggcauggccccugcacaaacacagcgguggauuucagagugcagcagcuggggcccuuagucaguuauccugccuccagccagaucugagagggccauuguuguggccaaccaggcucuucucuggcuaugaauugccugauugggauaaaucauauacaguuuuccccguguaaaguaggugauuuggccccuucaacacuuuaaauguuacaaaaaaaaaagguaucuuagaguaaauaaaaauaaaaacuuaauuuucauuagaauuuaauaguauguaauuugcuuccgcugaucaaauaaacuguuuccuagugugaggcugguuugugcaguuaaauauguaguuagcaaaaccacagauaggacgguaacucugaagaaaacagcucagggaugccuagauaaucacugccuuaacuaaccaagugcagccuuggacccugcuuacugagguagacagaaacaauggccggugaaguuccucaugaaauuaaucuuguuaaauuuccagugggauuggagguacccaggggagaaaguaauaaaagugggaaaauguuuucuucccaguuuuugaggcauuguccugaugcauagcuaagacuagccaugaacucauucuucuagcuucacugaaaagugauuuaaaauuuuagaauuauggacacuuaauuacuaugauguuauuauuuugaaacauuauuuuauauaauacuuauuuaugcuuuaugauaguaugugugcuuugaugucaguuuuggagagugucaccaaauaguuuucagggacuugaacacagguugucugucuuggcauuggaccuuuucuuguucagucaucucccugggcccucauauguuauucuaagauagggauuuuuaaacuguaaaaugauuuugagacucucuuuaaaaaguacacugugugugugcauuacacgggcuuguguuuguggguaugcaguuacgugugagcauacaugcaugcauucaugauaugugcuugagugcacgggugcaugcaggcguuugccacacuuuguagagcucagagaagcaagcuuggugaucuaaguucaaguucaacuccugcacguuguccucugaccuucaugugcauuccuggguauguaugcacauacauacacacaacacauaccagauaauaaagggaaagaaggaauguggguaaaaaucuauucugaaauuuguugaaucuuaugucuuaaaacacagucaguuuaaaauuucuuucuuuuuccuuuuaaaguguaguuaagggcuagagauggcucugugguuaagagcauuuguugcucuuguagaggacgcagauuugguucucaguauccaaaugauagcucacaaucacucaacuccaguugcagggaucugaugccccugucugaccuccacagacaccaagcaugcacgugaugcacagacauaugcaagcagagcacucauagacaugauauaaaauaaauaagucuaugaaaauaaauaaaccuaugaaauuaauuuuuuaaagcuaucaaaaaugucagaaguuucaauaucuggaaaaacuuuuuugucuuuugcuuuuucuggucagaguaucacucagauacaguuuauauguguccacagaauuuaaaaugacauuaucagagaagucagagaucuuucaguagaaauucacacauggguuuauaggaauaauuacacaaaauaagugaucccucacuacauuucuuuuaaagcauuuuuauuuuuuuccagacaaggucucucuguauucuugguucucaguguaguugauguguagcuuacaguuaucacuuaaauagcaaguuugcauucauuaugaaauuuauaacuuguuuguuucuugggcaagcucucauauagcccacauugaccucaaauugaauaaguaguggaggauggccuugaacucuugauccuucuccaccuuuguaguccugggcuacaggcaucugccacccugcccuguguuaccauuuuaauguagguauugucccuauuuuauagaguagggaguaaguaugucugucaucuuucaaauuaaagaaguggacuuagaaucauaucuuaaauuacucacauguguaaaagugcccugcauagaguccucauuuauuuguacaauaggggaaagucagggccgucuuguaugcguguuuaaaaauaugccuccuggucuucuaagauuuaacaaagucuuuauuuaguuaaauuaugguuuuggguuuuguuuguuuguuuguuuguuuggucuuuugagacagaguuucucuguauagcccuggcuguccuggaacucacuuuguagaccaggcuggccuugaacucagaaauccgccugccucugccucccaagugcugggaucaaaggcgugagccaccaccgcccggcauaauguacuuuuacaaauguauuacuucacaauuaagauuuaauuuguauuuacuuauuauugugugugcauuaccgggggggggggcgggggaggaccacagcuuuaugucuaggaugacuuaguaaagucacuuuuguuguuucaccguuacguggguucuggguccuuacacgucuguccaguaccucccacugaacuguuugccuguggauaugcaugugccucucaacgugugcacacaaaauaagucaaaugcaaaugcuuuucuugaacucaugugugacucuaaaaaguaauaauguagcugggugugguaauacacacccacaugcaaaaacaauacucagagccaguugcaguaggauuuggagcugaaggccagucccagcuagggcgagacccgucuuuaaagagaagcugaugugagagguguggucugagagccgaugugagagguguggucugagagcugaugugagagguguggucugaggcuggagagguguggucugaggcuggagagguguggucugagagcugaugugagagguguggucugaggcuggagagguguggucugaggcuggagagguguggucugagagcugaugugagagguguggucugaggcuugagagguguggucugaggcuggagagguguggucugaggcuggagagguguggucugaggcuggagugaagccuuccuggugcuuugaucaucacuuuucagauuaacuuucuagaccuagggaaagcuugcagccagcagugugugaaugagaaucauccuagcucuagguggguguagguggaucucugagaucaaggccagccuggucuacaaauagugagccccugucucaaacagaagagucagggguaagauguuguuuucuguucuguucacccccuuucaugaaagccucaggagcagauuuacaauaaaauaauauauauagugcugaauauuugcuuacauuucaaaaauuuagaauucccuguuaccaucagagagauuuuauaaaguuauagaaccuuuauuuaguguacauguguguguguguauuauugaacauacacagugucuauaucuaaagagaguaugauuucccacuguguuuaacagaucuuggccauuucaggaguuaagugugauuauaugguaaagcccaaucaaagugaaaggauggauuuucuuucagaauuugaacugauugcuuccauaaaaguuaaagacagacaauuggcuaauuaaauucuaacuaaaaagcauaguuugauuucacuuaaaugaaacuaaaagagagaaacuguauuaaaccacuauccaugccuuugugugaauuaacuuuaccuaccuuucuuucuuucuuucuuucuuucuuucuuucuuucuuucuuuucuuccuuccuuccuuccuuccuuccuuccuuccuuccuuucuuaaauuuguuuauuuuauguauaugaguacacuguaguuguacagaugguugugagccaucaugugguugcugggaaucgaacucaggaccucugcuugcucuggccccacucccucuggcccaaagauuuauuuauuuauuauauguaaguacaccguagcugucuucagacacaccagaagagggcaucagaucccauuacagaugguugugagccaccaugugguugcugggauuugaacucaggaccuucggaagagcagucggugcucugaacagcugagccaucucucuagccccaugagccuuuuauuuuuuuucuccuuauucugaaguuugucuugguuucucaucgcuuaagauugaaauuaaaaacagaauuugcguuuuaaaaacuuaugaccaaacucauuggaaugacuucauuaguguuaaagguugaggauuaagcacauuccgugaauucuaauuggauuaauauucuuucucagaagcacugucuugcugggcggugguggcgcacgccuuuaaucccagcacucgggaggcagaggcaggcagauuucugaguucgaggccagccuggucuacaaagugaguuccaggacagccagggcuacacagagaaacccugucuugaaaaaccaaaaaaaaaaaaaaaaaaaaaaaagaagcagcagcacugucuuauauaauagcugcauagaauuuaguuuauauuucaguuagucuaucauaguuuuucuaagcauuuauuuauuuuauuauguuugguguaugggacagagaauaaaacugagggccaugugugugugcuagcuaaacauuacuguaccucuaguccaccuuguagguuuuuaaauaguuaauuaacuuuacugccaauuaaguacuccuauucauagacaguacauucuaauuugcuuauuucuaggcugucagugcaaaauguuuaccuuuuccuuauguauaaguacaaaggccagguuuguagcuguauccuuuaaauuauacaacuuuccuucagugucaugugaguuccccagcuccaccugccggguacccuugcuugcugaggcauccuacaggccucugauuuuggaaguuuguuuauuaagacagaauguagccgggguuuacccugaacaucugauccuucagccucuaccucccaaauuuuuggauuauacacaugugcuaccacaucaggcugguauucugaauuuuuaaaaaagguuuuuuguuuugguuuucuuuuuuauguauuuugccugcauagucaagaagauggcaccaggucuccuggaagcagaguuccaguucugggaacugaacuuggauccuuuugaagggaaauaagagcuccuaacugaggagccaucucuucagcccucccuuaauuucuuaaagguuugaagucuaucacaaacagugacuacaacuuaggaguuuguuuaaagaauaaugaaauacaaagucauuuauuuuuuuguuuuugaaacaaggucucauuauauaacucaggcuggccuugaacuuucuauguaguccagaguggccuggaacucuugaaaauccuccugccuuagcuuccugaguguugggauuacacgcaugagcuaucauuuucaacugaaauaacauuuagaaauuauuaucaucaucauuacugcuuuacacgugugggugucuugccugcacauauguucauacaccuucuacaugucuguuguucacugaugucagaagaggaugccagaucaccuugacugagagucaucgucaucgugugggugcuaggaauugagcuuggauccucugcaagagcaguaugugcuuuuaauugcugagccauuucuccagacucuuuaagcugucccuaacuacauuauauagcacaugccucuugccuucauccacugagugggggaauuacaggaacgaauaaccagucucauguuuaacaauuuuuaguuuuugaauuuguuuguuuauauguuagcuucccaguuuugucucuuuuaaaguagauuauacuucaguugcuucacugaccauuuucuuguuguauguacacaguguguucugugguugguucccaguacuguucauugacuugacagucauuugauuuuguauguucaaauuugcucagcuguuauugcuguucuuauuuucagaaugauuucauauaaaacuuuauuuuaaauuucuucuugaauucuuugauuuauauguuaacaauaucauucuuuauuguuuuuuauauaaaucuuuucaugaauuugauuucuuuuuuuuuuucuuuuuuuuuuuuuaagacaguguuuucucuauguagcccugcuaucuuagaacuguguauagaccaggcuggccuugaacucauagagauccaccucugcuucccaagugcuaguaggauuaaagguaugaaucacugccugacaaacauuucaagaaguuauuuuuagauacuguauuaguuacguuuccauugcugaugccaugaccaaagcuuaugguuccagagguuuaggucagugaugauggagugaaggcaugguggcaggcagcuggaacagcaccugagagaucacgguauugauccacaagcaagaggcagagagcacacuaggaguggcacaagucuuuuggaaccucaaagcccaccucuagugacaacaccuguucuaacaaggauacaccucuuaauccuugacacacuuccucuaacaaggcuacauuucccaguccuucccagauaguuguaauaauugggaauuaaguauucaagcaugggagucuguggggccguucucauuuaaacuaacacauacagguuuuuguuuguuugucuguuugucauuuguaguucaaagcugcuuguauaggguauauagguucccagguuucuaacuuguaacuugcuuauagccagauauguaauaaguaccuuguggggagguauaaugguccguuuuuauuacugcuauguguaccagaagauugguagaaccaggaagauaggaaauguucuuuuuucauuacauccacguguaagccaggcaugguggccuaugccuguaauccuagcacucuggacauuaucagggaggauuaugaguucaaguacaaccuggguaagauacugucucaaacugaagaugggauacaagaagagaaaggucaguauaggcucagugugucuggggagggacuuguucuugggcuaccugcuuuaccuuaacaguugcaaggggccucuuguauuuuccauaacagaacgggcacaggauaaaacauggaugaccccaguaacacauaacaccacuucuguguaauguuacuaccuuggccucugcuauugaaaccuagaugaagggaagggccaguggauggcugugucaaagcuuuacugggcucuugguucaaccugcuaugaacccuaaauggaggaaaggguggcaguagaucuuauccugcccccccccccccaagguacaggcugaacagagagggaguuaaugauuggcacuggagaaauagccuagaauggagaugagagucucaucugaggucugugguugggaguucauggugagaugcuagaauuggcuagucaggguucaaggauggggaccugggagugaggguacagggagcuaugaggacuagcuaggaggaccucagacgggaguguugguuaaggaucuaggacccuacaaacacagauugucaggguacagacauccuagcccccccccuccccccccacacacgcuggcugcugacaccuccccccaacacccuagcaaugucagcaucucugcuagcagcuacaaaagagcccagagcuuuagucaggccuuugucauacaugauggugguaaaggacucagucuagagcuuugaagggagccagccugaaaauagaugucucccccaaaaguguaugugaccaccaaaagcgaaggcaugggaguggucagcagugaaaaggagcagcguguccugcucauagguaagcuguccugccuucuuaauggcaguaaagcaugaugguuuagucagccgcucgguaagcuaugccuucaucgugauuuugguugaugcaacguagacguuucagguucuccugcacagcagguccauggucaccucugucauuuccauuaggggugaguguucagccuuuuagaggccuauaagguggucugucacaggucuaggcaugccugaaugaacuuuguacuguuguguuaguuggguauucagcaucuguauaucuuugggaaacauuaauuuaugggacagaguaucaugucacugucuuugugggaagcgagcuauauggagugaccuugcagucagcugugcuccaggaccgaggcaggccuuucugaaucuaagcacaguugcaguguaaggugcaaguuaggaaggcuugugcaccgagguggugggugauugcuuucacagacuucuccugguuucucagugugauacauuacagacgaaucucauugccgcacugauguaugugugcaaaucagugaccuugacauuggcucuuaacuccucagaggcaggcuauggaugugccugucuuuggggaucugccugucuauguuguaauugcucugcguccauuaggacuuggguucagaucccuaggacccacauuagaauaacaaaacccaggcacgacugaguaccuguaacgugcauuggugagagacaggcagaucccuagagcucacagccagccugccugccuauccaaaaaggcaagcuuccaggucaagaagagacauugucugaaggcaauaaaguaagacaccuguguccugcucugccuucuccauuauaugcaauugaacacucaugugcauacaggccggugcgcucucucgcacacacacacaaacacacacaaauaaaggaaauagaagaucuaggcuuucuaaagccuuuuuagcuuuuuauagagagacauuagcuagaaagggcuauuaaagauucaucagaauucaucacuguuuucuggcaguuuacccaaggguuccugaguaucucuggauagcucauauaucagauagacagaaauucauacaaaaucuuguaauaauagcaaauaaaauguuguauaaugugcuagaguuuacugcagauaaagugaaccauugccaguuuaaaauuuguaaggugcuaucuuuuauugaacauggugauugugucuuacaaauggaauugcugucacuuucaguaaaauuccuguucaugucuguuauugaacucaaggcauaugccuugauaacuggcucugccuuguuuuuaaagacagggucucucgcuaaaguuggaguccacuaauuggcuagauaggugaccgacccccugucuuaucucaccaggacagguguuauugguacauaccacacuuggcaggugaaggauuguuuuuuuguuuuguuuuguuuuuuugcaguuuuugauuuuuaagugggcucuagucauucaaacauggucuuacguuugcaugacaaacaugagacugaaccucccucacuaauaacuaauaauuagaaaggaacuugguugauagcuacuuagaagcauugcuccaagugacuuuaggauucacugcuaguaaauuagccaugaggauauagaaagucaguuugaaccauaaaggcacauaauucagugugcagaaguaaaguguguucccagaguguuuaaaaggguaaucgcaucaugcuaaguguaugcgggagugaauuuaucacaaugccuauauacacuagucagaguauguuggugaaugaaagacuggauuuaaaacccugaacccucaguucuccauuauuuuaacugugcauagccauugucuuuugucaggguucauugcuguaaagagacaccaugacuaagacaacucauacuaaggaaaacauuucacuggagcuggccuccagguucagagguuuagucuauuaucauggcggggagcauggcagcaugcaggcagacauggugcuggagaaggcgcugagaguucuacaucuugauccaaggcagccaggaggggacuguguguuucacauuguguauguguguguagcuugagcauauaagaucucaagcugcugcccccacagugacacacuuguucucuaacaagaccacacccacuccaacaaggccacaccuccuaauagugccacuccuauggccaagcauucaaacacacgagucuaugggagccguuccuauucacaccacccuagucaucuaguaaaguagaagaacugguaaaccaguuaucauuaggcuggcaggcaggucauauauugacuaugguuaaaaacguguggguaaaugguugcagcuuccagggcugcugcuucacugguaaaaucacucaaguuuuaaauauucucuuacgcaguucugaguuguuagaauuauuuuccuucaaauauuuaccuuuaaaauuauauaaaguggauaugaauguacuuggcauauacauuuuuuaaagaagaaucaccauuaguauacuaauaauguuuucccccagcccuaggcugucacccuccccauccugagugcuuucugucaguaggugcaugucuuaaaacgcaucacucucaucaggagagguuuuucuugccauuccuagcuuguuguugaguaauaguucugacccacaguaagcgauaaagggauacaaaacuguuuugcugguuauuaaaaugcaagcuuuuaguagccaacagccuuaagugauuaugaaaaaaagucagggaaaaauaaagaucauuaaaugauuguucauuuuuucacaguauagcagacuaagucacaaauuguaaaagcacucauugcccacccggugagagugugugugugagaaaguguguguguguguguguguguguguguguguacauagaaaaguuagaggacaacauguuuugggugugagcucuuccuuuccacuuuguugaggccggcacucagggucucucuauuuuuccuuuugugcugacucuucccugcugucuggccugccaggcucuuggcaguucuaaugucuuaggcucccaucuggcuguagagugcugugcuuacaaauguguaauuuguauguggaucaaacucuguggucaccaggcuugugcgucuaucgucugagccaccuccuuggccccacuuugguguaaggugacuuuguguucacugucuguacugggagugcuuugcacaguagguacuagaugcuggagacucauuagugaaccucauagacggacccccgcggucucaacauuguguaaggaagguggaguuaaaaggggucagagacccaucagaggucaguuucauccaagaagaaugcugacugacuguccugacugguucugggcagggguccuacauaaacaauguuuuaucaccaucuuagccucucccucauguuucccauuucuacaaggcacugcaaaccauaguauaugcaaaaaauacugaaauuacaguuagguaacuagauuuaaaaaaaagaauagcaugcaugguguaugaggcugggaacaaagauugugaagcccugauuuuuuggauaacauucaaucuguauuuguaggcuaguucauauuuuaauuacuugccuuuuuguuuacagguucaggggcaaguucacccuacucuugagucuaaugaugaugcucuucaguauguugaagaauuaauuuugcaauuacuaaauaugcuaugccaagcucagccccggagugcuucagauguggagguauggcaaaugaccgcuuuuguuuucuuuuaacugcauguaucucgccguacguuggcuguaauggcagugaaggagaaaaggacucuccaguucauucuuccaucucuguaaacuuugaacuggguaugugguagcuucuaugugucuuagcugugaaacguucagauuguacuuuucagcuuaaauaaacagcuucauguuacuacuagaauggucugaggcaaacccucucuauguaaaccaggauggccuugaacucagagaucccuguucauacauacauacaaacauacaaacauacauacauacaaacauacauacauacaaacagagugcacgcaaagguuuuagucccaaaacauuuccuuuaaauuucagagagucaaaaggcugauaauaaaauaucucaaaguaucugagggagaauuauagaaacauuggggucacaggaugaacauacaaguucccugguaaaaguuacaaagcaaauguggacauguggugacacacuagagcugaagguucccaagguauggacggcauuuaaagaguuaagaugccaaucaccaguauugugguacaaaccuuuaauaauagcacuuaggaggcaggggcaagaggauuagguuuccagaucaauuuaaacuacacagggaguucaaggcuagccugggcuaugugagacccuaucugaaaaagcaaaacaaaagaguucaaagaguacuuuauuuuuaccuuuagcuccuucaagucccaggacuucaguugggugggaaggcgugggaccugacaugugaguguggagcauugauguaaggggucuguauagcuuauugacuacauuucacgaagccuuaccccauccucaggguuacagagggggugauggacggaaggaggggaagaagaagaggaagaggaggagggaggagggaaagagagaaaacaaacaccaaguaacacguuuagucagguuuagaaaauacuguauccuggguaauucucaucucucaacucauuuacaguagauucuuuguggugguuugguuuuguuguuguuuuugagacaggaugacauauagcccaaucuggccuugaauucaacuugcugcuguauagucaagagugacacuugcucugccugccuccaucucccaauugcugggauuucacgaguuuccuaccaggccugauugguuucuucuguaaagucagacuuuuaauucauaauuucuuuuaaauauguguuuauguuguuguuucacagagaucuugaauaguauggcuugcaugacucuaucacauuagcaauuucacuuggguuuucuuugauccuagcuauaaucuuccaugguuuggcagaauccagacuuacaagaaaggcucacaaaucucaccuuguuuauuauauugauguugguacauuuuagaaauuugcuaaucuacugacauugcaaacauaaaucagauauuccuauauauauauuuacauaacuaugcuuguuuaauuucaucuuuaauaaaaacaaggaacagaaaaccauaugaaauucucauguggagguuuuggugcuggggauaguuuuggugagaacauguaagaauaugacuaauagaaguaccagucacguauguaaucagcuuuauuauuucuuuuuaacauaucuauuggcauugcauacaguuuuaucaucuguacacaucuguguguaaguauuuacaugagcgcaggcacccacagaggccaaaggaguuggaugccugucuugguuaggauuucuacugcugcagugaaacaccaugaccaaaaagcaaguuggggagaaaaggguuuauuuggcuuacccuacauaauagcauugacgugcaucauggaaggaagugaggacaggaacccagauaggggaggaaucuggaggcaggggcugaugcaacaaaggcuguggacgggugcugcuuuuuggcuuguuccccauggcggcuucuaccugcuugcuuauagaacccagaaccaccagcccagggguggcaccacccaaaaugaccugggcccucccccaucaauuaauuacuaauuaagaaaaugccuugcaggcuugccuacagcccagucuuauggaggcauuuucucaaucgaaguuuccucauaucugaugagucuaguuugucaaauugacaaaaaccuagccaugaaaaucugaaguuauaggcaguugugagccaccugacaucaguucugggaaucuaacuuaggucuuuuggaagaacauuacuugguuuuaaccacugaaauuuaauaauuucaaagugcuguuuuauaaaauucuguaucuuacaacaguucuauggggguaugggaauaucuuucucuuugcuugcauauuugaaaauugacccucagaacaguauugacauaaaugaagauccaagaaaaaaaaucaauuuuccagggcuggagagauggcucucugggccauaaaaucacuuuagugcauugaucauacaaaaagaaguagacuagaaaauacuagugugcuucauaaaauaagggcgagguuuauuuaggaagcccucuuacagcucaguuucuuuauaaguguauaauauaaacuauugaaaaguuauuaucuaacuacuguauguauuuguaugugaaugcacaaagggaucggcguguggguucugggcaucaagcuuggucgucaggcagggcugccagugcccuaacuugcugggcugucugcaccagaauggaaauguaguauuuuuuacugcauucucucccucucucccucucucccucucucccucucucccucucucccucucucccucucccucuccccuccccuccccuccucuccuuaauuuauuuuuuuacguucacauacaaaguaguguguguuuuuuuuaauauugugugugugugugugugugagacagacagacagacagacagacagacagagagacagagagacagagagacagguagggagggagggaugugaguguaagcgugcgugcagugugcguagaagucggaggacaucuucuggagucuguucuucccggccuguggauuucugagauaagugacggacacaaguccucaggguugugcagcaagcgcaugcuccgagcugagcuaugucacggccaggcaggaugggcagcucccagacacaggugaaugucauuuauaccuaguucuuacgcauucuaucccucauuucuccuuuuugcuggcuuuucuucccucagauaauccucccgucuacuaucauguacugugucuacuuucguguacugugaguugagguuucagaguguuaggacucacaggcuggagaaagcugcaacuccaggauagagcucuuaccugggaugcagagggcccugggugcaacccaaagccagaccgugggaagcggaggggaggggaggggaggggaggggaggggaggggaggggaggggaggggaggggaggggaggggaggggagggcacaagggcuuguguucuggauguucuuuuguaucuuccccuaccuucccaacuguuugcgcugccaccauuuuagacccuuuuaucacccuuaucauacaggauaaagauuugcuacuuuauucuauguuuguuuguuucuuuguuguuguuuuguucuuuaagacaggguuucucuguagccccagcuguccuggaacucacucuguagacgaagcuggccuugaacucaagagaacugccugcuucugccuccccagugcugggauuaaaggcgccccacugccgugcaccaccacugcccagcugcugcuguaauuuuuaacuacaagaauucuuuugacuucuaauuaauuaaaacaugacauuuuaaauauugguaucuggacagccuugaacauaaaaugaagagaggauuagauaagugccuauagaucugcuccuaggaugugcuaaaugcaccuaugccucccucacacccagcucuagaguacccaaggcaguguauuuacugauugaacuuucauucagguuugcauucaaggggcaauguucacuucauuuuauccuacauacaaguugaauacugaaaauuuguucaagguuuuguaauagcgaccucuacuggcucuagcugagguaugugcaaguggauuuuaaacaccugaagggagcuaauagugaauuacauuaaaguagggaauuuagcuauuauaauggcucguucuuuaacugaauaacuucuagauguuagaauugaaauagucugcuaaagaugggccuguucguucaugguagguccaccauguuaaagcacggguuagcagugcaggccacugaggcucgugaccuggaugauacggacucucacaugaaugcuacuuguauuuauaacugggguuaaaguaaggaugaaauaaauaagaauuuauuggaguugauauuugcaagucuccuuccaugaaacugugaaugauguuuaaggugacuuaccagucuugccauuaguguuaaugaaggugggugcaggauaugauuuaccuguuaauaaaaacuguccuuagucccuuagugaccuaacuaagaaacuaacacagugacaaucacagacuuuuguuugcaguguaaauuacgugaaaagcucgcgcauacucuuuauuucacaguaagcuuuaagugcugagcuguauuugcuuguugcuuaguuauuauucccucuuuucuaaggaacguguucaaaagaguuuuccucauccaauugauaagugggcaauagcugaugcccaaucagccauugaaaagaggaagagacgaaauccuuuaucgcugccagcagaaagaauucaucauuuauuaaggguaagcugaaauaagccacaugaccuaugaaaagcaaaauaacugaaugguaaaauccuuuuacauuuuccagggauucauguugagguaagggggugcugugguagugaguaaagguuggacaacgugguuucaugucacuucaaaccaguaguaguaaaucaaagacaccuggaaaaguuauauuauagauuuuauuuacuccaggguugcuagaaaauauaauuguagauauuucucucuuucuggucagagcuaaauaucccauaaagcuuuaaagucuguuagcauuuuguguagggcuaucugugagacugcagugagggucuguguuuuugugggacaaacaagcugguccugcuuaaauaaguuaaccacuuuaguguacccagaacuagaaaaaugccaagaauccuaagagugcuaguuugguuuauuuaccaugacaaacaaaauaacucucuuccucacacacacacaaauaccuuauuguaauauuuaaaaccuuaguacaaguuucuguuuuuucccuuugagacaaggucuuacauuauugcccaggcuggccuuggccugagugcuggcauuaaaggcuggcauugcuacgcccgacggacugaccugugcuuucuccucuccuguaagacuucaucuuccuugggaacuuguggcuccacagacgcacauacucucugugaagucuaauaauaggaucauuuaaaugcuuaguagcacauagcauggaggguguuuguuuuguuuuuaauuuuguuuuucauggaaagccaagagugugucaucagguaauauaccauaugcuccccacaccaagcucagacuuugugguuaaaccacuuacuuacacacuacuguguacugcuccaguacuguacacaaccagagacgauucugcuucccucuguguguacgcacguguguccuacacauaauaguguguguguguguguguguguuucucaugaaugaacuagugaaaauuaaauuauuaaauauugguagugaugggcuucagugaaaguuaagcuggguugauacuguuuaauuuuguaguugauugauuagauuuuacuguguaugacguuuaaaugugcuuuccuuuuaauuuuucaggagguccucgguuauaaaauugaccaccagguuucuguuuacauaguagcaguauuagaauacauuucugcagauauuuuaaagcucguggggaauuauguaagaaauauacggcauuaugaaauuacaaaacaagacauuaaaguggcaaugugugcugauaagguaggagaaucagcuucuuuguguuguauucauaaauuauuacuuaugauuuauuggaugcuaauauacucuucagaaagaauagaauugugcacugcauuauguuuuggggagagauuuccaguaaccucauagcauacauccagguuguuacuguauggaaauaagauagagguggcugguacuuaaguggcuuuuuaggaaagaagauauuuucugaugggauucuauuccacuuucuucacacucuggccauucugguuauagauucuacuuauguauguauuaguguuuauucuaacagaauaaagugaaagagauuaucuggccugaagaauuaaaaguguugugauauuuuuaaauggagauaaaguacuugauauuuaugauuacaacugaaaaugaauacaaaguguuugcuacuuuguuuuaaauguguguguguguguguguguacagcgcagggauucagagaagucggaacaaguauucgaucuccuagaaaugggcgcacagaggguuuauggugcuggaaacugagcccaggugcucugggcaagcugugagugcuuuuaacagccaagccaccucucuagcccaucugcuaaaagauuuauuuuuauuacuguggcacaugggaggggcauucugugcacaugagcacaguuguuugugaagaccagaagagguaccagaccccugaaguuauaagcaguugugaauugccugacauggcuucugggaacugauacacuuguguguucuuaaccacucgccugucugucuaacccucuugcuugcuacuuuuuaaaaugaaucauauaaguaaaauauuuuuuaguaucuauuaugugcucauacagaaaugagguacagaaaaauguguuuaaaagggggcugggaucuuucuaacugguagaguguggccuaggaugcauaaagccuuggauuugguuucugguccuggguaaacagaaugagaugcgcgugugcaagcagaaggaucagaaauucaaggccagucuuggcuacauagugacccuauggcuagcuucaguuauaugagaccauaucccuauaguuuaaaaaauuuuuaaaaaacaaugcuucaaaguuguugaaaggugacuuacguuguagcauaagguaaacuauacugcagugacacuguacagggccacaagagugggaagggugaguuucagcaagaguaaccguggaaaacuuuuugaagaaacuuuuuguauguauagguguuuaaccugcauacaugccugucgccauguugaugccugguugccaugguuaacugauucucuagaacuggaguuaagauugugagccaccuuguaggugcuaggaaugaagcucagguucucugaagaacauuaauuguuccuaaccucugagccaucucuucucuaaagccaucucuuccucccccccccucccccacagggcauguuuguccucuugugggggugggggggaugccuagggcauuaaccuucaagggagacuacacuauuauuacugacacuuucauuuuaccucugacuacauagguauugauggauauguuucaucaagauguagaagauauaaauaucuuaucuuuaacugaugaagagccuuccaccucaggagaacaaacuuauuaugauuugguaaaagcauucauggcagaaauucgacaguauauaagagaauuaaaucuaauuauaaaaguuuuucgagagcccuuugucucuaauuccaaauuguuuucaucuaauguaaguauauuuuguuauuuuugcauguguuguuaacuuucaguucaaauuugaaguuauauaauucaugauuucuaauuuguccugaucacaaauaaagugcugccacaguuucaagagauuaaacaucagaaauugaaagacagaaaucuaaaauagacuaauuauguaagugaaaaugaaaucacauaauaaucaauuuaucucaggggauagagcgucuuguguaggugggagauauuuuugauucagugacuuauuugagucauuuaagugauacuuaucaacagcagccguauugugggacaccacauucagaggagucagcaacaguccugucucgucagggcggagcuggaaauguaggacgaagagucguaaugcaagaguaacagcggaauuauugggaacacaagagaugagccgcagggcagugcccgugcuaaccgugcuagaccuaaagaacguucagugaugagaacagugccagcucuggagcuccaggcaucgcaguuccugggcauuaaauaaaacggagagcagcugagagcacagcccaguggcagagcacuugucuaaucugccugugaaacccuggguucaauuuccaccacuuaguuuguaaauaugccaaacacuacuuauugaguuaguuuagauguaugaaaugcaugguauuuaaauugcuucauuaaauuugcuuuaaaaaauagcaaaggagggauaaagauaucugacacaaaaaucagcaaucaaauuugcuaaaugguauucaguaucagagaauuacaaaucgaaacccuagcgagaugcuugcguacacgucuuagagaaaguuaaaaaaagacagugucagacauggagaagaaugcagugauugacugcucauggguuugcaaaauuucaacauuacuuguaaguuauaaauuaaauuaguaaaauuggcugguuuuguaacacauuucuacauuuucugacaauucuguucuguuaguuuuuugcuuagaagaaacaacaaggccacacaaaauagcaguuuuauuuuauagcucagugccuaccaguugugaagggagacugugcuuugcucacacaauggucagcuuuucaccaggaguaaagaaugcagggcugacgcaugcaucugcauagcugaaccuccaggacucgagcagagauucguagauuugucucucuacuuccuggacaauaacugucuagucacagggagugagcacucauuuucuggcugggaggauggugggagcugauacagaggagacauaagggaacuuaaaaauuuuuuuucaauuuuuuuuuuuuuuuuuuuuuuuuuuuuuaguuuuaugugugauuguuuuccugugaaggucagaagagggcacuagcucuccuuggacuggaguuaauagaugauuggagcugccauguggguucuaggaccuuaacuuagguccucugggagagcaucuauuaacugcugagccaucucuccaguucucauaaggaaguuuuuuaagacaagaaaacauugugaauagugacuguuaggagguuacagagaggaauaacuguauacagucucaccaaaaaguacauuuaaaguagguauaucucauugcauacaaaccauacuucaaaauuaacagaauaaaaauaguaaucaacagauuuuaauagaacaguauaaaauuuauauggucuccaagaaauguaggaaaugaccaacuuauuagcagcaguauaaugacauuugaccuguuugcauagaauguucccaguaguagaugcgcacagcagggcucuggacuauaaauagaacaaugggaagucacuuuugcuaaugaguuuaaguugucuuuugcagagaugaccuuaguuuaaguguacugaaagccagucagugguaaauacauuuuacaguuuauucacgugauccacacacaggaagauaaaauugcuuuaaaugagcuuuuuggugagaucguauggacucauuuauccuuauuauuuaaccaugccauuguagagauacacaauacuuucuugccuuagacaauuucuuuauaucccauccacauuaaccuucgccauccuuauucccagaaagccaguuauuuuaugauauguuaauuaaagguugauagaaaaauuacaugaauguuagacagaaaacaagaauaucacaguugaauagacaauuaaaauauuccuucauuuucccauuacaugucugguaaacuuauguaucuagauaaagcuguacuuuauccuguucuccagccacaacagacugaaugcagagacaaauagaaaaguccuguucucuguuaaacuguauugaagauuaguaaagagaguaugaagauguucuaaaacaaaaugauugguagagagacauauuucuuaauuguauaucuaucacuaaagaauaaauuuugaaguauuuucuuauuguaagucauuaaaauuccucaauaucuacauuauaccuugauuauaaaauaauuuuuuuacugaaaagauaucuuguuauacaauacaauaugauugaauuaauuuuucuuucuccuccgcaggauguagaaaacauauucagucguauaguagauauacaugaacuuaguguaaaguuacugggccauauagaagauacuguagaaaugacagaugaaggcaguccccacccauuaguaggaagcuguuuugaagacuuagcagaaguaaguauaucaauuauauugucaauuauauagcaagagaagucugucuguaaguacauuggcauuaaaaugggguucauaauuccuauuuccagcucaagucacauaccguugcuucuuuuccaucauaggucaacauuuauuacuguuaccagguacagaaauaguuaucaagcacuacgcccagucucggugucacucugaaacuuugauagaaagaucaaggcaaggccacccgugagugagaaaagcuuggguguaggguccuaguccucacagcucacugcucagaucacugcuguguauuacauguguggcuccaggcgaguuaccgauauuuugcuucucuauacacauuuguaaagcaagaagaauaacaauaagaagucucaaauuuuuuuuuuguaaguuaagauaaucucccuuaaauauuuggcuaauucccuuuacauaguaaaauaaccaguacgugauagccacauuuguuuuuagaauugaacaaugaggugcuaggaaacucagcccauggcauagacaguucagaucccaugggagucugguaacccugaguaucuccaaugcuaacugugaguuaauuguagugagucaucacugguagucacucugggguuucuugcucuuguccugcucuaaagcccauuuagucuuuuaguauaauggugcugagcccaugggaaagaagagaggaaccagggaucuaccucuuuagguaaacucuccccagcaaacaugaggcccuugguuuaguucccagggccauaugaacugggugugguggugcacgccucguaacccucaguaaugggaaaguagaugcggggguuugagaagaugggugccauucucagcuacagagcacgcugggcgucaggcuagauccaugugaagcucuuagagcucuguggaaagcaccaagaccaagagcugcuugggguuuacagguuacaaccugucauggcaaaccagagugggaaccuugaggcgggaacugcagaagacuggaggauagcagcucuggcuugcucagcuugcuuucauaucuaacucagaacuuacacccggggauggcaucacccacaacccacagagggcuuagaacuucaugucagucaccaauccaggcaaucaguuggggguguuuuucucaauaucgguucucucaaucuuuugucaaguugacaaaugacuacccagcacagagguucuaucucagaaagcaugggacaaagccagugcccuggguaggaaccuccaggagaguuaaggagagaacacugcucaaggggcugcacagcacagggucagggaugggacagagcaagaggaguugucuuguuuauagucuauaguuggcaaauacaagaaaacacuaaaauauuaggugaguucacaguaucggcuuagagaaaggacgagcauuccuaugcugucacacaugccagaacauagaacuuuacaggcagaaggcacccugucucagaggcacaguaagcauguggggcaagcgcgauggccccgcccauaaagcacugugcaggccuaacacuugguaccuagggugucccagccuuaagaguuuaaucccuagaacgugugguagaaagagaacugacccccaaauguuguccucugaccugugcacacuaguacacacauacacauacgugauucuacuauuacuacuacuauuacuauuacuacuaaugauaauaaaacucaaaaaccuaacuaaaaguauauaagaccuauuaagaaaaauuguaaaauauuuagguugauauggaauguacaaguacaugguaauacauucuauguuguguuuauggauggaaaaacucagcauugcauucauguuagucauucacaaguagccagagcacagcaagcugaucuuuaauagguacaaaugaggugugguccaugcucauaaucccagcacugaagccaggcuuucguugcaaguucuagcuauccaaugagauccuauuuagguugucucagccacugccuaccacccacucagaagaaugagggaagcacauggaggagauuugcuucaucacagauuucaguuuauuaaauaggaauaucagaguugcuaccaguauaggcagacaacgaaugaaacagaauggaauuacaguuuugacauauggcacagauugcauugaucaguagggacagaacaaguugauaauuaaauuacgaguugacccaaaauguaaggaagcaggaaggccuggagcgucaccugcuacgugacacuguaugguguccagagcccuaguccagaguguucagauaugguauucuggcuaguaacucuuucuuaaguacuuuaaaaacaguacuagagguaauuaauacauaauuuguauuuuaucuugaaucgcuugucuuauuucuuaccuacuacauucauccacugaucuucuagaaccagccacugcagaggugaggcgcucuggaccugaagcugggugugugugugugugugccauauaguagaggucggaggacaguuuguuaagucacuucuauccuuccacucugugggucagggauugaacuaaggucaucaggcuugucaccagaugugucaccagaugugucaacaggugucuuugcucaccggccugugucugucccuccugacaguuuuauaacuggaauaggccacaggaucaaagaugggaagggcccuacucucugugcuaaaaucaauagaccuacucuguguuucaucagcaaucaucguacucuuuuagaccuugcuaugagugauaucucaauggugauugguauauuaaugaugauggauuuuuuuuuucacuuuggauuaaguuaguuuuaugaaaacagaauuuuaggugauagaaacaguuacuucuuauuuacaaaauagggaaguaaaugucuaacaccaaaaauauuuuuuagauuuauucuauguauuuugcuucuauguauuuguaccauauaugucucugguacccccagaagcccgaagaggacaucggauauccuggaacuggaguugugaugguuguaagccacugugugagugcugggaaccaagccuggguucucugcaggagcaauaguaacugcugagccauuucuccagcccuccccccacacccggaagacucagucccuaccaucagcacucuaaggcucgagucuuacauaccgucuguuguccagguucagcugugcucgucucuagggccgggucaggccacucucagaacaacuccugguucacagaagcggaagcuguggccgagaagcagcacagcacacagugacucugcugcucagaagaaagaacucguggauucuuucacuugaggauauuagauuuauucuguuaaaauuauaauggccauucgguuuuuauuuggagccuuuaggaggaauagguuucuguagauaaguuuauaauuuaaucuuuuguauuuugugugguggaccauuucuuauuuaugacuauuuuuacuuuacugucucccuuuuuucaggaacuggcauuugacccguaugagucauaugcucgggauauuuuacgacccggauuccauggccauuuucuuagucaguuaucaaagccuggggcagcacuuuauuugcagguauagugauuguuaaauugcacaauguuagaaaaguaaacucuaaaaaauauuaaauccuuucccuuuuuaguccauaggcgaaggcuucaaagaagcuguccaguacguccugccccggcugcugcuugccccuguguaccacugucugcauuacuuugaacuucugaagguaaaaaaacucagauuguuauuuauaaagcauucaagugucaucguuugccacuucacuugcaaacaugugagcauccacacacauuagucuauguucuuuuucuuuguuuagcugagaagcaauuuuaagcacguuauccaaaagacuaacgugcuuucugacuacuuaacuguaaagcaguugcccagguuuauuuauuuuacuuuuaucugcauuuauuuuaugcugacuuuauucgugugccaugaaguuuuguuucuucaguuucuucugggguaucuuuuucugugcagccuccucuucuggcuuuggaacggucagugaggaucaugucaauguggcaggggggccauguauggguuaacccggccaugagcucuggaggugcgucuguuugucugucugucugccuuucugucggcgucucaggggccguguucaccuggauuugcucagugacuagaaaucugucuaaacccuuaaguucagcauuacucucucauuuuuaagugugugaagcaaaaauucagcacucuuuuggcuacuguccguguguccagccccacuguuuggccugggcacaccuaccgccggaacggcacacauugcuucuuuaaagugacauccuucagauccuugguggcuuuguggauaugcauacccuugauggccugggcagucucccggguguucuuaaagugaacucgaagguuugagccucuugauuuguaugauuuugugggguuuucugggucaagccaguguugaaccaucuucacaggucaccucuggccacuuagaggaagagcccaguuuuauuuuuaaucauguggucuguuugcuuauauggugauucuuugaaagcaacuuuguauauaugcauccacaucuccaucugaggaccucaauagcuacagggacucuccucagggacccaauaugaaaauaaggcuaaaguaauaaaaacuguuaguucaauagauuuucauuguucagcacugcagcaaugucuguuaaacucaguguuguuauuauuuuagaagcagugaauuuguauaccaguaaaaguucuccaacugaucauaguucaaaauauuaaguaaaaaaauucuaaaggauuaguagccacauaaaacuugaaaauuaguuuauaaauaaaagcaagaagcuuuaaugagaauuugaaagguuauaaaauccaagcaguuuaauaaggaaaauuaaggauugcaagauggcacugugacuggcacucgucacagaagccugacagcuugauguugaccccugaagcucacaugggaagagagaaccagugucccagaguugugccugaccuucauguccauacucucacacacaggcgcgcacgcgcacacaugcgcgugcauacacacacaagagaacuuauaggauggaaagagagauggcuuagcacuugcugcucuucuagaggaccugaguucaguuucuaacaccacacugggcaacuaacaaaugaccuguaacucuacauucagagagcuccagugucuuugucuggccucuuuaggcgccugugcacacacagcguacaaacagacacauaauucaaaauggcuuuuaaagaaaaaguuaguuagguaccaaguucaaccuugucucaaaacaaucagaaaggccagcaaggaugugcuacuacugugugagugacuccugggacccaugugguagaagggagagacuucugcaaguugcccuucuuaucugucuccauacauggacacauaaaagcaagcgugugcacacucuaaauaaauaacuuacuuuuuaaaaaggaaugcuuuuuaaaauuaucugguaugguggaucaaaccuauaguaccagcacuugagagagacuaaggcagguagauuacuaugaauuugagaccaggcaaagcuacauagagaauucuaagccaauccgggcuacaguaugggaaaccuugccuuggggaggugugggagaugauuuucauauagauaauuaagacuucucaggacuuuaggauguaauguuguucuacuguguguguguguuccugguucauaguaugacuugccuuacauugcaaagcguauaugauaugguaguacauggaacagggcacggaucuguccauacacacacucaucuuuuuuccauucuggauucuuucagaaugaaugcaugacuugaauuuuuauuuauuuccauguguacacacaagcaaaugcacacacaagugcaccaaguguacaugaggccagaggacagcugacaaaguugguucccuccugccaccauuguggguccuggggauuaaccuugaacccuuguuccugucaagcugucugccagucuuacuggcgcuucagcugugucuguugguuuaccgcucagcucauuuuuguaggggaggauuuucaagguguaauacuguguaugucuguaggcagguggugcauaaguaugcgugacaggaguccacaccggggagcugaagaagucuucaguuauucaucaccuuaguuuuguguguaucugacagggucuuuuauugaauguagaaccugccaauucagcuagaauugcuggccagccauuuuaagggucugcuugugucugucuugccaaugcugagauuauagcugccuaauuguggucuuuuuguauuuuuaaaggcagggccucuguaucccuggauguccuggaacucaauauguacacuagacuggucauaaacucacagaaauccaccugccucugccuccugaguugugggauuaaaggcggguguguagugucuaacuuuuuaaguggcauuugaacuuggguccucauacuuaggcaagcauuuuaccaacuaagcuauuuucccagcugccucagguucuguuuugagaugcugguaucaugacauacucuaaauaaauggagaacuggucaauauacacuauuagaagguuugaaaaguuguaugauacaccaauguauuuguagguuacuuagggaaacuauugaagagguuccaauguucagugaaccaaaagaugccccccacugcacccucugauucuugguguucuauuuucuuuucuuuggagaauuguuaugaauccuaaaugcccaucuauguacucaguaauucuggagacagcugauugcaugagauugggcagguggaaccgaaucauaauuuaucuguauguggaauggguucagaauuuggugacacugacgucuuucuaccuguugugcagcuagagaaaagucacuuuauuuuuuugaucccugguuuucuuguuuauaaccugcuuauuucacaagguaaggcauucaaacagugcauuuguaaagguuacuucaugaaugacaaugacaucggcacuugcauguuuucagcacuggagauguuucuuacugucuguaaugcuggccacuaaccacacccacauuuuccugcccaccagagcucugcuuuucucuauagucucugucuuuguuggcuagugugggccccacccaucacaccaccuuugauucuucucucuuccuuacuggcagcacucaugauuuaacaucagaaaugaccauguauucagccucaaguguccauuuguagugacaucaccuucauaucacuguuuagacacaauaacaacuucuuuauaucaucuuuguaauuccuugaacucugagauggaaagguacaguugguucccuggcaccugcaacaggaagucuagauucuugaguuccacugcugcugucuguaguuuuaucucagucgucaguucugcccaugagcuugagcagcccuggguaugccagcuccgugcauggugccauuuuuguucuuuuuccuccccccuggccugguggaaucccucuuuuucuaagcccccuuuuauuugagaguuuguuggguugcagggucagauaccccuuuguucccaagcugcugcugcugcuuucacaccuccuuacagaucugucauauugguauugucugccucgucuucagacacuauguucccugaggaaacagaacaaagccuguaugcuucugaauucugccuagcacaguaccuggcauuuaaauuguuuauuaaaugcucauuaaauaaugaggagcaaaaauagguauuuucucaauuccuaucuguuguagcuuuaaaaaguuuaacuguaaauuuauguauauguguuuauuugggaaacuuagaaugccuuaaacuuuacaaauucauaggauagaauucugcuguuauuugccuaacagugucagacaaagaaauagaguaauguaauguuuccuguggguuggggacauuaggaagagauuugucaacggauacaaaacuugaguuaggacugaagaaggaaagaaguauuaaacuuuauaguguuaaucgaaauaugauuaaaaugaauuuaauaagcuuacucagaaaauauuaaaucacauggaaguauaggauuaaucuaaggggcuuugccuaacuuugaguuagcuuccuaacauauguuaccuagguaauguaggaagauaaaggaaauaggcucugacuucauuagaauauaaguguucugcaguuuuccuuuuuuuuuuuuuuuuuuuuuuuuuguaaauuugcuuuuucaaacccuuuucgcuuaucagaagaagugagcauuugccacaagccuugaaauacaaccucggcuccaucugcuuaggucuuguuuguggugacugagacucugacucugugaauucagaaaauguggcuuggggauggggaccuaaaggccacuccuagaugaauacauauaagauuacaacaucacagcccacucuaaaggcucagggagauuguagcuggggauggaccacuuaagcauuagcuagggucugucccacacuaaccaagagcucuccugucugagugcuugggugaauuccuuacuggauugggucuuuuucucaugacagaaggaauaauaaauucaagagaauuucagccuaguguagaacaugcuuacagcauccagggccuggaacaaagauucaagacuagccuucaaaauggaaaaacaaaacaaaaacaaacccauauacacauacauuuaugcauacauacauacauaacguguguguguguguacacauacauauagugccuauagcaauaauaauaauauuguauaguuuugaaaacugcugagcagauucuaagaauuuacaucugagaaaaauauuugacaguauauauuuuuaaauauuuugucaagcaccauauuguauaccauaaacauauauaauuuuuacuugucaauuuuuuuugagacaggguuucauuacuugucaauuaaaaaguaaaauuucucaaauaaaaaauuuuauuaagauuuuauuuuuaaucauauguaugccuguuugugcguucaugcgugugcacccuuucugugugaaggugccuuuagaagcuagaguuguuagacacccugggacugcacuuucaggcaacugugagcaacuggguaggugcugggagacaaguucuggaagaacacuauguccuccucuuagucagggccaucucuuugaucuaaauuuugacugauuuuaguacuacuugaauuuuuaaaauuauuuccucaaaauuagacaguccuuaggcccuuuuauuaguuagaaacauuaaaguuaauauuuuaugaaguggaaaaaaaacuuccuuuguuguuguuucuuggagacaggguuucucuguguagcucuggcugucuuggaaucucuuuguagaccaggcuggccucaaacucacagaucuaccugccucugacuccugacggcuuggaucaaaggcgugugccaccauaccugaaucaaugugagcuuuugaaaaaucauaugcuccuauaaggugacuuuuuuauaugaaauuuugcuggcuuuauuaagcaaauguagauucuuacaacuaacuguagugaccaaaacucugauuacuaggaguugguucacccaaacuuaagcagcuucaguuauacccucaagaauuaccccguucucuuugcaguaugcugacuccaucuuacugaaggaaaagugaguuuucuuucauuuuaaaaaucagguuaaagggggaguggguggguaggggauuggggggguggguaugggggaccuuugggauaguauugaaaauguaaacgaggaaaauacuuaauuaaaaaaaaauaaaacaaucaaaaaaaaaaaaaucagguuaccugaugcgccagaaaauaaaccucuugcuuuugcaucggggaaaaaaaucagguuaaagucuguuacguauguaguauguacuguuauguaguauguacugcugauauuuucuaaggcuauaccaaacuauaaacuuaguggcugaaaacauuagucuucaguaguuuauucuuucugcucuagaggcagagagcaggaguugagagggccugcaucuucgagggucuaaggaacagccucacuugcucugaggaggcagcagccaucaggguuccccugagcuucauggagagccucgcucuggacgcucuggacgcucuggacgcuguggauguggccucugccugcaucagaucaggcacaucacuucccacucugugucaggcagcgucucgcugcccuuuccuuucucacagucgagcuuuaggguucggccauaaucuagcaugguuucauuugauuacuuaaaccugcaaaaaccuauuucuaaaaagguuuuauuuauuucaguuaauuguagacauuaguggaaaggucuuuggacuaacagucaugacccuuaaguucuggucuuuccugccuauucaucuaaguaaauguuacucauuuuauauuauguuggagaagaguagcuucuagaaauacaaucauuaauucauauguuccuuccuucuuaaauuagggaagccauucuagcuauucuguguucugauuaacgugaacuuuaaucaguuacacacuguggagggggaaaggaauguaaguaacucaguaguagaaugccugcuuacuaugaacaaaguccuggcuucaguccccaguaucacaaaaaccaucuacaguuuguuuuguguuaaaauugcugagucuuauucuugaaaauacuucuguaaauuguguuuucucccccccccccuuuuuuuuuuugguuuuuugagacaggguuucucugugcagcccuggcuguccuggaacucacucuguagaccaggcuggccucgaacucagaaauccgccugccucugccucccgagugcugggacuaaaggcgugcaccaccacgcccauccggcuguguuuucuuuagaagcuccuucacagcaucugugccgugguuuccugggagccgcucuguccgugcuguccgcucuguccgugcuguccgugcuguacauggacuauaccaucaguacugcuuugccuuuguuuccuucugauagucaggggccaggagcagauaugaaaaagcccagcucuguagcccagcuagccuuaaaguugaggggaucuuucugccucagacucccaagcgcuggacuaguuaugggccaccacaucuuaugcaggggccucccuacugcuuauaucuaaggaacccaaaagucaucaaggguaugagugacuccuuuucuaugaaaagguaaauuugggggcuggagagauggcuuagugagcacuggcugcucuuccauagguucugaguucaauucccagcacccacaugguggcucacaaccaucuguaaugggaucugaugcccucucuggugucugaagacagcuacaguguacucauacauagaauaaauacaucuuuacaaaaacgguaaacuuuaucaucuggauaggccauacacauugucauuaucuucugcacagggcguacacacucuuacuaugcuuuagaaugccuucuuaggugaggcugugcacacacaauaccaucuuaguagaguuuugguguugguaacggucgcuguggaaagcaaugagaacgcuucuuugcugucauuuacaugacugcagcugcuuuguuucuguggcaagaauaagccgccucuuuaaggauaauuagcuuuguuuuacaugauuuccuaauuuaaaucaauuaaaaaaaaaaagaauggacagacagaaagguuuuuauuaguugugugugaugaccacgagccuugaaccccaacacuugggagauauucagucgcuccucugaguuugaggccacccuagucuacaucgugagacuaucucaaaacagucuuucauuacacugaaaugcggaacacuugccuguuaacugugaggcaaaaagaacauuuaaaaguauuucaucagagagcuucaugaguucaaaaacuuaggggcuggaguaagcugugcugacccagugcuuuucuagcacccguauaaacaguggcacagaccuguaacacuagcacuagaggggagccaggccucaggauugggaguucaaggccagacaaaggcacacaaaacugugucucagaaaaaagaaaagaagaaaauggaagaaaaaaaaaacacacaaaacuuuggguuugugaauuuuaaaacacuaacagagaggcugacgggguggcuuagugguuaaagagcacuggcugcucucacagaggacgcagguucagucccagcaccaacaugccagcuagaaacugucugagucucuauuugaagggguaugacagccucuucuggccuucaaggcacauugugcacagacauacaugcagccaaaauacccauacacagaaaauaaaacacaagcaguauuguccauaugccaauauauucauauacaaaaugcaaguuaaaugauacaugaaggacucugaaacagauuuugaauugaaaaccaguguaucccuaaacauguuuuggguauaugcucuauauuagaauucuguacauugggaauucuguauauuugcugaguuguaacaaaaacaggagccagagaggcggcucccuagggaagagcacuugcugcucuuccagaggacaagaguuuaguuccuaauguccauguagggugguuugggaacaucugucaccucagcacugucaucugaccuaugagggcacugcacucacauguauaauccauauccacacacacacacacugcacucacauguauaaguccauauccacacccacacacacugcacucacauguauaaguccauauccacacccacacacacuuaaaacaucuuuaaucagaacaaaauacagaggggacaauacucucccuauuggcacaucuugcucuguauguuaaugacuugaaugcuucuggacuuuacauuuuaaagacuuuuuaaaaaauaaucauuuauuuaugucgggagggguaagcagaggauggaguagcacguguuuuuggagaucagagaacugcuuaagggagucauuuuucuccacccaccauguggguccuuaaggagaacugaggcugucaagcuuggcagcagcugccuugcugagcaguccugccagcccuggacuuuauuuuugauucuauccuuaagaguauccuugugccuagagccaugcuuaaacuccuaugggagucggaaacaguucuguguugccucuucucaggaacaugaccaaugaguacauacgugacacugcuuuuuucaaggcuuaacaguucuuucuaaagugguuccucgugguuuucacauggaaaacuuggugauguguuacuacacaguacuacacagaaaaguaaaguucucagagacagagccuucugcuuacagagcucaggcugaccuuagacucccgcuacagugacacgcaugugcugccaaaccuugcagaaacgauaauaagaacugcuguuuuucuuuggagacagcuucucguguauccgaggcugccacuucuuccuguguccugugauuaucugcaaccaugucuggacuacaugguaucagagaauagaacucaaggcuuuaugcaaacuaaacacuaccaggcuacaucagccuagaaaaaugcuucaaacaacugaaaggcuggagagguggcucaguuguuaagacacuuguugcuucugcacuggacccuaguucagcucccagcauccacacaauggguuacagccacuugcaacuccaguaccaggggaucugaaauucucuucugacuuuuuugggcaugaagcacucauagggugcacuuucagacauucaggcaaacacugacacaugugaaauaaauugaaaaaauauaucuauagaacauuuaaaauuacugaaguagggaaagcugaaugagcaucauuuauccuuaaauaaagugagguccuccuucugcccuuuccacagcaguuagaagaaaagagugaagaucaagaagacaaggaguguaugaagcaagcaauaacagcccugcuuaauguccaaaguggcauggaaaaaauuugcuccaaaagucuugcaaaacgaagacuaagguaaauauucucacuuuaaagucucuuccuuucuauccugaaaguugugguacaaguucaggagccuuagcccccccccccccccccccuugaguaaacaaugaagaaaacaguauuagugacaagcuuggucuuucagaggaagugacaucaaagccaggagaguuuguuauuguuugaaaaaccuuucauauuugugcauuuucccugcuuacucccagacaggaccuccugaggagcagcugguaagcuggaggggacggagcacaguguaccgggcagagcugccagcgucauuguuguagcagagugaaauuagcaguguugcuuaguuugggaauuguauaacucagacauugauucaguuagcaggucuacuuucccauuauaacaugugcuguaugcuuuuaucuuugagucuugugcauuuaaaaauacuuaauucauaucucaauuuuuuuuuacuguguugggcuacuuuuuaauaguuaucuuucuaaauguuuacuauucaagacagagauaauuguuuuguaccugaguuuauauaguugaacaucacuguuauuuuuauaaaucugaaaaaaaaaucugugcuuaguucuuauaguuaugauuauuuguggaguuaguaaauaucacgugagugauguuguaaauuauauuuugcccugucaccuuaucugcaugaacucucagaucugucuuccgugugcuaacagugucuuucccuuuaccccagugagucugcaugucgguuuuacagccagcagaugaaggggaaacagcuagccaucaagaagaugaacgagauccagaagaacauugauggcugggaggggaaggacauuggacaguguugcaaugaguucauaauggaaggaacucuuacacguguaggagccaaacacgagagacacauauuucucuucgauggcuuaaugauuugcuguaaaucaaaccaugggcagccaagacucccuggugcuagcagugcagaauaccggcuuaaagaaaaguuuuuuaugcgaaagguacagauuaaugauaaagaugacaccagugaguacaagcaugcuuuugaaaucauucugaaagauggcaauaguguuauauuuucugccaagucagcugaagagaaaaacaacuggauggcagcacugaucucuuugcaguaccgcagcacccuggagaggaugcuggacguaacggugcugcaggaggagaaggaggagcagaugaggcugcccagugcugaaguguacagguuugcagaaccugacuccgaggagaauauucuauucgaagagaaugugcagcccaaagcugggauccccauuaucaaggcagggacagugcuuaagcucauugagaggcuuaccuaccacauguacgcagguaagaaacacgcgguggcuagaacgguuuccugcuuaaacgaauugauuugauggguggguuacugucccugaaauagaaaacuaacaacaagcaaauccuucucuaggagaggagcauuggcuaaaaccgucacucuguauuucuuugaaguuuuuaucuuuucuaucauauuuacaaagagaaacggucacuugucuuuaacguuacccaguaaaaagcaguagaaauaagaccaagccucaacaugauugucuaaaagguagaauuacucaguauaauuauuuuuuucuuauucuauaacuggguuacaaacuaagugaugcauuagguauucacccaccaucaaaauugugcugguggcaaaaaugcguauuuucuuaaucuccauuccuacaucuauuuaggaaaucuggaagccauuuccauuucaguauuuuguucuuaaaguuacuuaugcaaacaguuuuaccuuaacagguuuuaaagaaaaccuagagagaugcuagguagaauucaguacagugguuaagggguaaagggcauacugagccgucuuguguggucugacacacaguggggcguuugauagcugccauuucagaauugccguggagcagauagcgcuccgcuuagacuuugccccuucaccagaucagggucccuuuaugucccagaaccauaguuuucaucucaaaaaugaacaucagaucuacaccauaguguguugucagaaaacauacacgaaauacugacuaugaaagcuauuucuaaguuuagauggaaauuuuuaaugucuuuucuuuaagagaaaugugugauuuaaaauuauauaacucaucauaugguauucuuaaauaccugacuaugaaaauuaaccucucccuauacuccucauucaaggauauuccuauuuuuaggaaaugcaaguuucuggggaagaauauuuauuuuccuguuuuuuaaaauguccucuaagugaguucuguuuccuuuggaagcuauucuggugcuaguaagauuaacucucaaaaauauccuuuaguuuucccacuuuguaaaacugaagaucauuuaacaaggacuuccuucccuucaauuuauuaaauacaaguagcgcuucgugugguugggaacuaccaaagggagagaagguaauuugagugcuguuuuuuauuagugaucucaaaccgcuuuaaaaugugugguugccuuuaucuguauaguucugguauacaagcuggaguuuaguucugcuuuagguaucuggacucuuugcaggccuuucauaguacaucgauaguguuuuccaaaguccaguucuuacaaugacucagcuccucugaacacgcauuuccaguggcagugcccaggcgcugaggcacgcugaacaugucauguauguucauguguaugagucacgucaucccgggcuccacuuuacuguaaacuucaccagggacucuauagucaguguguuuacuauucaaaaauuuaaaaaagaaaauuuaagcugccuagaaguuacauaaaaaauagauuaccuuucuuguuauauauaaagcuauuuuaaagagcuacaguuuuuaguaauuauuauaaacuauucacauaaucuucaucaaccuucuguauacuguuuaaaauuauaaaauaacaaaaauacuuuguuaacccaaaauugugguuuucaaauacucuaaauaacuuuucaacaauaaaaguucaaguugucuaucuugcuacauugucuuuguuuuuaaaucuugugaauuuaaaaccuguucacuguauccucaauacagcuuggcuuguuuuuuauggaaaggacaaaggaaaagccauauaaacucaauuaaaaaaaaucagcauguggauugaugguggcacugcagugucacagggccuggcuuugugcccuggguaaucuuuugaaggcgucauucuuagaguauuuagguugucuauuuuaccucugcuugugaaggacacaguuuucucuacagcauggucagcaaugaucacuggagacuaaauagggcaagcugcucuuuuuuuuuuuuuuuaauuaaauguauuaauuauuucuauauucuaaaauuuacauucuguuucuaaaacauuucuguaauuuucuuugcuguuguauuugacaaaaauaauuuauaauuagcauuuacaagcuacaacugauuuauuuauugauuugcucuuuucgagugcgucuacacuugaacacaccccgucaguagaucggugucauguggcccaguagucuuuaccccucgugugugcaaagcuaccuuugucaugaugucaccaugcacaccuaaggacuguacugcugucaacuuacgcaaaauaaaguaacauuuuuauggucuuaaaauaacacugaaauuucuaacuuuauaccguuuugaugaagucuaguuuacugagauugaaugagauuacuuuaccuuuuuuuuaagauuucuuuuugucucucugugugucuaugcaccauguguguaaagugcuaguggaguccagaagagggcgucagguuuccugggacuugcuuuacacucagguccucuggaagagcagcuggugaucuuaaccucugagccuucuguccgaucccgcuuugcuuuuuuuauuuaaacguauauguguaugugaguacacuguugcuguuuucauacaggcucgaagagggcaucaaucccguuauagaugguugugagccaccaugugggugcugggaaucaaacucaggaccucugggagagcagucaguacucacuuagccaucucuccaguccccuguuuuacuuuuuaaaauuaaaagaaaaaaaauuaaauccuccaguauuaaagaaaaauaaaaccaagagugucuguguuauaacuaaguuuuuuuacauuguucugaaguuuaauuaaauauuuuauuucauaaauauguuacugauauaacugguguccaccagcaacuuuauaaguugugagcuugaaguaagugaaauuacugcuauuaauuuacucacuguucuuugaugucuuuaaccugcaguauacgauuauuuuuuuaaccuagacuaacuaucccgucaagcccauucuugccuuacuauggcaguauagagugugcuuuugauagacacccauggaucuguaagauauaaaaugaguauuguaaggucuccuccagcuacaaugacaacauauguagcuaucacuuguuagaugauuuuacgagcuuuuaaaaaaagauuuuaagaacuuucaugugcaugucucuggaguguguauaugcagugccagcuuaacugauguaaacaaacauuagucuguguuuuucuuuuauucagucuccccaaauaaaaaggggguuuuuugaucugguuaauugguuauuaggguguuuuuguuaacaugcaguagagguuguggcuuacacugaaacaaaagcuaaaauuaauaaugcuuuuuuauuauauaguaaaagacauuguauauaauacaugaggaagucugauaacuaguggugaauauagcacuucgacaucauguagaguauuguaaguuacuuagacaauaaaaauugaagagaaauugacucacauuugauuaguucacguucagcuuggcuucggcuaacuugauuucucaaguguuacaacaauaacuuagacagagcuacacaccuguaugccaggagcugucuacaccugaguuuauaacagaagccaagaccccuguggauuguuugaguugcuagaaaucuuaccaguuaauuacagaaugaaaucuagaaaucaauuucuuuuuaaaaaauauuuauuuauuguuuauuuauuuaauguauaugaaugcucugucuucuuaaugaaagccagaggagggaaucagaucucauuacagaugguugugagcuaccaugugguugcugggaauugaacucaggacaucuggaaaagcagccaauguucuuaaccgcugagcgaugucuccagucccuagaaauuaauuucuauucagcagaauauauuuucuacccaugucccacugacacuuucaaacugaauuuuuaaaaacuauuuuaauauguuauauuuuuaaaagguauacaugaugaauaauaaaaaugacguuuuaauuacucucaugguggcuauucauguggugcaaaugcagguauacugugaggagauagaguuuuguuuuguuuuguuuuguuuuguuuuguuuuuaauugaaauagguaguaaguucugagcauugugaugagcaguucuguaugcaguuggauucuauuugucucuuuuaauucagucccuggccgguacucagccuuguuguacuuuacuuuguuagcuauugagagaggacaggcagccagcccggcauguuaacuucaucagccaccugagugcugggauuacagguguuugccacuagguuuuucccugacagagccuaguuaauacuaucagaauaguaugcucuauaaauaaugcuuucuggaagaauguguuuauauaacaugaauuaaaagauggauaaugugcauaaaugauuacagugugacagucuaacugauaacuugucuaucauccccaguauuacuggacccugacuagaucagacuugggggaauucaccuugaacacuggcaggaaaauuacucaguuggauuauuuuaaauuuggcagugauacgaagacagucuccuuaccuagaguaacaaucacaaagccgugcgacaagggaaaggggagcaggaaguuccuucacagaguucuguggacacugcccuguagcuaaccugagcugcagcaacucugggagaaaaaggcuugguggucuggccaugagugguagagaaugggcugcugacccugaggcaggagggcaguuaaguuagcugugagcugugccacaccguuuccucgauacuuuuguagaagauggaauuaagaacacuuaagacacuuuccugauguauuuacugcuguuuuuguucucaaauauaaaauguucaaaaaaucuacauuuagauuugagucuguaucuugcaugaguuagguuugggcguuuaacuuuuaaagucucugaacaauuuuugaucuauagggcagugcucuucuauuuuuaaccuugcauuuuuuuaaguguuugugcgucagcauagcgucuguuuccuuuuuuuaaggaauucaaaagugauuguuuguaaguccuggcugaggaguucauuguuucuuaggguugaaauggcuguauuaaagggaguauugucacaugaacagacauccugauuaacaguguucuaccauggcaggugggggaggggugcucugcauaaauagcuuuuuaguguaauaaauguuucacaagucuuaagaccuugccauauuaaaugccaaauguaaauucaaaguagggccagaaaaaggaagauugauaucucaaauuuaauaugcuguauucugaauacuagauauaauauggauagaguugaaguucagaagauuuuugaauuauugugcaccaaauaacaaagaauuguucagggguugaauuagcuauaaggccagcgaaauaaccguggucugggguauggcucagguggaugaaugcuugccuaacaugcaugaggcuuuggguucaaucccuggcaccucaugaacugggcauaguggcacaugccugucaucucugaauguaauguucaggagacagaggcaggaggauuagaaguucaaagccauccucaguuauauaguaaguuuugggucagucugagauacaugagggccuguaccaagaacuugagacuagcuucaguaguuguuuguauaaagaguguaugaaaacgaagcagaagcagagaaacucugaguguggugggguaggucaggaggaggucaucucugguggauuagcuccucugcuuggguugaaauuguagggucgugucugaguaguccauguccagacugacuuuugguuauauaucagaagagacagucaaaucaagcuaccaucuuauuaguggccauuuguucauguuuguaccuuaaagccaaauucugccugacuuaaauacaggaaaggucuuuuaaaauaaguuuguuacucaguaugaauuguucauugcuuuagauuagaaacaaaacacucucucucuuucucucucucucucucucucucucucucucucucucucucucucuguguguguguguguguguguguguguuuaaaccagcaugggaauauagguagcuuuuaauuuuuucuuaaguacguaagcuucugccaguuuucuuggaguauuuuagucguuccucacacaccccacccucccuuuuuggcaaggcugcuuuuagcuuccagccaaaauaagaacaaaugaaguuucagucagguuaggccacacuacaguaguggccacugcggagcauuuauuucguucgccagcaccagaagcuccucuugugagcagugugacaggaaggacagcugugcauucugacagggcaccaguuauaaggucaucauuagacugugcauuucuagugacuucuggugccucuaaccagcuuagcaguuacagcugcauucuggauuagucauguauguaaauuuguauagugacacugaaauagguugauaacuuguauauguuuagaauucagagcuagguggggcugauggggauccucugaucccgucugccuugauggaagagcaccagggcaggaacaaguggccgugcucuccugugcuccccacucugcugucugaccugcgcugcucaccuccccagagcucacacagcagcacggggaacugguguggucccgugugacuguguggcauggaggugcagggugccuuucccggcacugccaucagcuaguagccuaaauugaagagccccacuuuaaaaaauagccauauuuuucuuaaaacauacgcagcacuucucuucugucugaaacccacagcuuuuagccugauguuggguagcauuugaaaagaaauaguucugggugugauguuagauugucagccugaaauaaaccuggguuuggaggagcggugggcacacacuugcaauguggagcccagcccagagacacucagaggccucaucuagaauacacagcucucuagcaagggcgggcagccagccgagcagcccacuguggccccgcuguugcuuccuagacacacgcuacuuugagaagccucaccuuacaaauagauuugcagaacaggaagaagaaucuugaaagggaggguggugaugguaccgauaaauaccuguguuuuaaaaucuuguacagccuucuguuuuaaaaucuuuucuucuggaugagacuuuagucuguaacugaggaucucuguaacugaagacagacaauaaaauaccaacaagaaggaaauuguuaaaagauuuuauguaucuaagauacuuuuacuaguaacccacucuagccuuaggagguauaaacuaaaggaaccuuaaauaaaaccaaagaaguuuuuagcuggaagccuggucaaauaugccugcaaucccagcacuuugggcacuuugggcacugagacuaaaagcuagaggacugugaauucagggccggccuggauagcuagcuaggcccugucucaaaagcaaaaaccucccacaauaauauccuuuguucuguaauuuuuuucuucaaaguaaaaaaguauuaaguacuuuaaauucagggauguuugauaguuaaaucaguucacuaucuugaugauaauauauaccaguagauuagaucaauccaugaauuuuaguuuaagguuaaaaacuuacugugugaucuuuuaaggucaaauuuagguuucucagaaucaacuuaaaauuuuucuaaauauacucuaauuucacuaaacuuuguccuaguaaaagacuucuuauaaaauuaugauugauaauguauagguuuuuacugcgaucaguggauuucccgucacuuuauccauguuaauaauguaaacagagaaauguucuuacaagagacucaaguuaacagauguucucccuucuuuuaaagacuuuggacuaaucguggguggacccuagagagaucugaguuguagaacgagugguuuuuuuucagacagucuuacugugugucucugacuggccuugagucccggagacaugccuacuucugcaucugcugagacugaaggcccaugccaccauacgcaaggaaaugguuuuuggguuuuuuguuguuauuguugcuuccuccaguacaagaaaauguccuuuccuuccuuaugcagaagaaaauagccuaggcuccuuugugcccaucccagcucccuaacccuaacuuagaagcgugcucuaaaaaaagauccaaggaggcaagacuagagggucaucugacucaggaacuacuucaaauaaaagcaagggcuuuuuacaaccauguucucucucucucucucucucucucucucucucucucucucucucucucuguguguguguguguguguguguguguguguguguguguguguguguggugugcggcgcgaguguggagggcauagaggcgggagaacaaccgccuggauugaccgcagggccaucaagcuuguguggcaaaagacuuucucacugaguuugagacuuuuuuuuuuuuuuuuuuuuuuuuuuuuuagcaguuauaaauaaggcuuuuggcaauuaagcgauuuuaaaaacuauuuaacuuaccuuacuacuuuguaagauuuguuuucuaguuguaugcuuuguuaacaugaucuaaaggaaauuaggaaauguaguuaauuaaacuggaugucagacagaugggcugccgcugcugcuaucucuacaagguaaaugaacaggcaggagaacuuuugggauccugguagcgauggcaaccugguucaguucccuguccuugcuuuucuucacugaauguuccuugccaaugaggaguuaagacagggcaagaagucaguugauuauauuuuacaauuaguguuuuguuuugguuuuuugaggguuuuuguuuuguuuuauuuauuuguuuguuuuuugcuaccaauuuaugaagcaagugaagcuagcaguccauuauauaauccaaagccgucucucugguaaaacauuuaggggcuuuguaagccugaguauuugaucucuuuuaaaacuaaaaauaauaguuuuaaucauuguuuauacaagacuuuaauauuuuuccuuuuuguuccuagauccaaauuuuguucggacguuucuuacaacauacagguccuuuugcagaccucaagaacuacugagucuucugauagaaaggucugucgguuuuaaauguuuacguucuuuguuuuuaaaaggacuaagauauguuccccauaauuguguuaauaagcuuaacuguugaacucuugaaaauaaaagcuaacuuugauuuuuuuuaaauaaucaaaauuuuauauugcuuuaguacuuaaaacucccaacuucucagggucucagcagcacuggggauugaaacgugaaccuuuguuuuaaucuaagcaguauucccagccugaauuaaucaaguuaaagaacucugucaguauggaugacuuagaaccucagcugggcacaugccuauaaucagaacuugggagacagaggcaggaggaucagagcucaaggucgucuuugacugucauaggaauuuacgguuccccugaacuauauggaacuaugucuuuaacauaaugagacacuagaaauucagauuuuaaugguucauaaguucuaaacaaguuuucaaguuacuacauauugaguaaaaugaaucuugucaaugagcaaaugcuuuuaucaaggaaaauauuuuuaaucuacccaaagaacaaucaaguuucaagcauuaaucauccuuaaaauuaugucuccugauuuaaaguuaucuacagacuaaaaauggacauuggccucauuuguuuuaaauuuuacauauauuuuuauuuugcuucuaguuuuagcuguugacaaaacuaaccuuuuaaaaauauuaacuuaaaaauauuaucauuagauuagccuuuacauuauaaaaguggauuuuuacuuaugugucuguauaucuauaguaauuuuuauauuaucucuugauuguacugauaaauauaaauagaacaugaauuuggauuugauauaauauuuucauuauuuuuuguuucauguuagauuugaaauuccagagccugagccaacagaagcugaucgcauagcuauagagaauggagaucagccccugagugcagagcugaagagguuuagaaaggaauauauucagccugugcaguugagguaagcaguggagacacgucugcagccucaaaccuggguuucaaaguggggauguucaaagcggggcagugguggugccaucccagcacuugggaggcagaggcaggccagucugaguuccaggccagccagggcuacacagagaaacccugucucagaaacugaagccaggaaaacaaaaguggaaauguucgagaaacugucccuaagcaugguggagggaagcggugugaaugagagucucguuugaauugcuacagcuuuaugagaccguugccuuguuucaugugugcacucaauguuagauucuguguugugucgaugccacaggguguuaaaugugugucggcacuggguggagcaccauuucuaugacuuugaaagagaugcagaccuuuuacagagaauggaggaauuuauuggaacaguaagagguauguuuuucuuaaguuccuacuuuuacaugugauaaaauuaccaauaugguuacugccaguugauaccauuagaguucauuugaaaauauugaacuuucuuaucauacagcauuuagacuggauguguggugcguaccuuuauucccagcacacaaaaggcagaaggaguaugauuucuaugaguuuuaguacagccaggacuacaguaguaagacccugucucagaaacaaaacaacaaaacccagcauugacaacuguaaaucacucagcagccacccugcugaccccacauacuugcaucuguucuagaacauccugcugacuccacacacuugcaucuguucuagaauauccugcugaccccacacacuugcaucuguucuagaacauccugcugaccccacacacuuccaucuguucuagaacauccugcugaccccacacacuugcaucuguucuagaacauccugcugaccccacacacuugcaucuguucuagaacauccugcugacuccacacacuuccaucuguucuagaacauccugcugacuccacacacuuguaucuguucuagaacauccugcugaccccacacacuuccaucuguucuagaacauccugcugaccccacacacuugcaucuguucuagaacauccugcugaccccacacacuugcaucuguucuagaacauccugcugaccccacacacuugcaucuguucuagaacauccugcugaccccacacacuugcaucuguucuagaacauccugcugaccccacacacuugcaucuguucuagaacauccugcugaccccacacacuugcaucuguucuagaacauccugcugaccccacacacuugcaucuguucuagaacauccugcugaccccacacacuugcaucuguucuagaacauccugcugaccccacacacuugcaucuguucuagaacauccugcugaccccacacacuugcaucuguucuagaacauccugcugaccccacacacuugcaucuguucuagaacauccugcugaccccacacacuugcaucuguucuagaacauccugcugaccccacacacuuccaucuguucuagaacauccugcugaccccacacacuugcaucuguucuagaacauccugcugaccccacacacuugcaucuguucuagaacauccugcugaccccacacacuugcaucuguucuagaacauccugcugacuccacacacuuccaucuguucuagaacauccugcugacuccacacacuugcaucuguuuuagaacauccugcugaccccacacacguccaucuguucuagaacauccugcugacuccacacacuugcaucuguuuuagaacugguucuuuuagucucagguuaagccagagccuuaacugaaacugugguuacccuugauacaggcuggaauucuuuuaccacuguaacaccauugauaaaagugcaugguuagauaaguagagcagaucaggaagaaauaguguauuacacugagagauugcuuuuuaaacaucagcacuaaucagaaacauaauuuugagucuuuagacucauucaauuuacuuaugaaaaacuaauguugcuuaucuccaagguuuccuuuacuuucaaaaauucugugauuauaugacuccaaguuugccuagacaaacuuuguuuuugcaucuauuguucagucuaaaugaaaaucagaaaauaaaggguuaaguagauuacuuuccuauacaguacaaaagacaggcauaucaaaaaauagacuaauaugaucaaucaguccucauaauuggguuauaaaauacaauauuaauuagauuugugaauaugaaacuuauucuuguuaaucuuucauuucguauggaauauggauugugaaaauaguauuuugaacuaagcuucaaaauguuggaggugaaaaaaaaucaaguuacuuuaaaauauguuuaggaaagguauagauacaugccaaacuauugacaaugauuaccugugaggaacaaggaugagagggagaugggggaggggaacuuuuaguauuuacuuugcucauuugaacuuuauagcaaugguuuauucauguaucacuuguauuacuuuaaacauuuuuuuaaaaacaaaguguuaaagaguauuuaaauguuuguuaaaauguauuucagguaaagcaaugaaaaaaugggucgaauccaucacuaagauaauccaaaggaaaaaaauugcaagagacaauggcccaggucauaacauuacauuucagagcucaccucccacaguugaguggcacauaagcagaccugggcacauagagacuuuugacuugcucaccuuacacccaauagaaauugcucggcaacucacuuuacuugaaucagaucuauaccgguauguuauucaacauucaaacucagaagcuaucucaagaguucauuuuaaaaauggaauacauuaucugccuuuuagggcugucguaagauguaaaugagacagcauaugauguguauacagcauuaaggcauugcagucaguucugguuguuuugcccccuuagucaucuugaucugcuuaaauuaacuuugugcucuuucaguuaccccugcuugggaagcucgguucaaauccuggcagucccaguggcuuggccaaagccuguacugucuuguagguuugaagagucuggugugugccugaugcauccaaggcugagcacaaagcagaacauagaaacuacugcagcaguuacuccacaguacacgauagagcgacugcuguguuacagcuaagccucagccaguuagaacccuuuauaguuuaaauugauuaaacuaucugaaaaauaugauucugguuugaaauuuuacuuaaaaucucaaaauuauuauuaaucaccaaaugagaaaaagagcuaaauuuauaaauucucccaucuccauuuaucauggucccugagugaccauguuagauaaugucuaaaguuuauucucagaggcauuugcaggauggcuuucucuucuguccacuguaagagcaagaacaagccaagaaugcguuaguaauugcccuguccuaguuggcuacuuacuagauaccauuuaaguaacuaccucaccaucuuaacuuaguaaauaauaccuacaagugcuaggaaagacauuaugcaaaaguaugcaguaaaugggaaaacgaccaugcugcucugcgcagucgugcuagcgcucaggacacugaagcagaggacugccauguguuccaggccagcugugccagacagcaagaaccuagccagggcuacauagaagacacugucuuuaaaaauaaacaaaugagcaguaaauguauuaugcaagaguaucuacuaaaauaguucuaaucugaaaacauaaaaaaguuauaaauauuguuuucaccaacuuucuguugaugaaagagaacuuaaaaaugucguuuaguuuuucuucuguaguaagcuauauacgugaggagaaaugugacauugccauuuuauguugaugauuuuagggcugugcagccaucagaauuaguuggaaguguguggacaaaagaagauaaagaaauuaauucucccaaccuucugaagaugauucggcacaccacuaaccucacuuugugguuugagaaguaagugugggcguuuccuccuggggcagaggcagguuuugaauccagcggggcuguuuugcuucuuuagugcucucauuccccuuucuuguaaacucaguaucuuucuaaugugcauuuuaauuucacugguacuuugguuuuuaaugguugccuggcacuaaccacaugcgucuuacuuuaucagucuaggcuagagauggcugcagcuucuucccagcagguagaugcuccucccauacgcggcucucauugcucccuuucuacauuugaacagaccuaaucaauggugcaaauccaacaaugcuucaugacaaugauuacucugccgucugcugucaccauuuuaucuuacagagcuuuuuuccauucacucguguccucuguugacaguguguuacauuuuuauacuacaaacccaaaaguacauucagauaccuuaaauuaguugcuuuuuaaacaaggugagaggaaaaaaugggcauuuauaguguuuguauaauucuauaauuaccuuuacugauguucuuuguguagacugacauugcugucuggggucccugguuuuaagccugaagagaaccuccugugguccagugggucaacucacaacaagugugcagauuuauugcuguuuugaacagcagcucucucuugagauuaguucuguuuuauucugucuguucauaucuauuauugagcccccuugccuuucaguccauuuguuuuccauuuggugcuguuuaaaauuuuaacucuuuccucaucucuuucuagaugcugcuauuacacuucugugcgccuuaaccaggcuguccuuuagcucugugaccauacucucugauggcgacuuugaaauacuucaguuaauuuucaucuagucacucaaacaggcaguuucugcucccugcuuuuauuccacuguuuaggucauaccuuuuauuucuuuauaugcuuuauaauggauacagcaacuuuucaauacugcccucugccuuccacagcuuucucuuugcuacuuaaaugugaugcggacuaagcagguuagauguggggauggaugcccauaguuaggacuuugggaagacugguuccaguaugguucacauucucucucccaggcugcaccccgagcugcuaaauguugcacuacuaauucccgucuucauuccuuugucgugaacaguucccugguagcacagguugcugugaagaauaagccaaugaaauucuggcuucuuggaaguaaaguuuuuaagcuccuuaauaacugauauuuguucugaccugcaacuaucuuccugguucacaccguuccuagcuaacacacauuuggggcuacauaucuuccuuuuaucuccagauuucuuuccaguugccuuucauaacaacuuccacuguuccugaacacaccuuugcucuagaugugacacaauucuggagaggacaugacuacaagcugucuuuacauucuaagagcuuagagucaaagugccaagaaugaugcuguggccucagggucuagcauggaacccugucaggagccaagcaaagagcuauuuucccagcguucuaauuacccuacagccucagcccauaagugggcaaggggagggcuccguacaucuuaaauauuaaggaaauaaauauuauagauaaauaaauaugaagacugcacucagugaagcccuaacucagcaggguaggaacccauccagaugugcaccccaaccccucaaaaucccgggcugggauuaggugcuccugccccagggcucaaacaaaugcuccggagggaggaagaggaggggacaggagcuuaguugaaauacuccagagucucccuuuuaaagagauuauuuuguagauuuucuugaacaauuuuucguuuguagcuuguucuuagggucaccuccaaagacucauccgcauuaugaguuauggugagugggugugguuugcuuuaagaucacuggaguccaucagccgagcugcaccgucugauaaagccgagacgucugugcgcuuucauaacuggggagcggacaccuuagcuuuguauacuggauauuguuuucucagugaagaagccagaguccacagauuguacugggcucauaagaacaagcaguugguaacacacaaaacaagucuggaugaaggccugaggcgguucaagucacacaaagacagcuagaguugucugugagaucagagauaauauaccucuaaaaaguaaaaacuagaaucuucucccaaaauguugcuucccgguuucauuuuaaaguugauguauuuaaauacagaagcccuuucuuaccuccccacaguuacugcagcuaucauucuggggaacagacacacaaugaaugaaacagagagcaguguccuucgggucuuuaguaggcgauuuaaggggaagcguccccugcguuuucagugugugacagauucuuguucacucaucucagugguucugagcuacaaguccaguagaauuggacccaagagcacugaucuuaacuucuauacuuaguaaccaaaauaguuaagguauaaagcauacuugcauuacguuuuuaauuauucaccugauaagguaaauagagcauacauaauucuuuaaauauguuaacauguuuaauuuuauaagccauuucuuuugaugguuuuuaguauagagguuuuauucuuaguauuauauuagccucaucaagaauaauaucuguugcuagcuuuacauuuuaaaaauuuaauguauauuuacuuuugaacuuaauuuuucuuagauuauaaacuauuaacgucacugagaacuagguuuaaaauguuuuucuuacugacaaauuguuaauauguaaaaaguucucucaaauagaaagauuaagcguggacuaagcaguuuuuuuaugugugugugugugugugugugugugugugugugugagugugugugugugugugagagcagguguguguguguauguauguauguauguauacauaucacacuauauaauaaacuaauauauaaauuguugguauguaaaaaaaaaguacuuuuuuguuuguuuguuuguuucuagguaguauguuuuguuugcuucuuguucugggacuugaacccagagccugugcaugguaaccacaucaugagcugccccaccugccguuauuuacuuaguuuuuaaggaaaauauuucaacugacuuugcagcauacuaaugguuaucuuuuuuuuuuuuuuuuuuucgagacaguguuuuucuguuguagcccuggcuguccuggaacucacucuguagaccagguggccucggacucagaaaucugccugccucugccuccuaagugcugggauuaaaggugugcgccaccacugccuggcuuacuaaugguuaucuuaaaagcuauuucuauaaacauaacuaauuauuucuauauaucaaaaaacaaaaugaagcuggauaugguaguauacacucacucagaaggcugaggcaggaauauuacaagguuuaggccuucuucagcuacauagcaagacuuuccucaggcaaacagagaaaucccuauaauaggauuguguauaugcacacacaaaggaagcaaagguucuagaauaaacaggccuagcacauaccuaaugacagagauucacacauccaguaagauuugaaagcugacauuagaggauucacuugcuagauuaggaaaaugguugucugguauuacaguguaggugucagaagagagcaaugcgcuugaccagagccuuucucugcaguuuccuguccaacccuucagugugcauaugucuucuuuauagucauacugaacacuuuuugaaucagaguuuugggaaaauaaaaauuuuaauuucugguuuguuucaauuuccagauguauuguagaaacagaaaacuuagaagaaagaguagcuguaguaagucggauaauugagauucuacaagucuuucaagagcugaacaacuucaaugguguccuggaaguugucagugcuaugaacucgucaccuguuuacagacuagaccacacauuugagguaaguuuguacguguguuuaaaaggaacuuaggaauuugcaugacauggccacuacaaucccagcagcugugauuaucagcaugaugucauggaagcuggguggagauuguaaggacucaccucuuccagagcaugucacugugguuagugguugcugagagagggagagacauuuuauucaguaacuacagguaagguccuggguucauaaauaaccccucacccaagcuucuguaagcagcugccauuuacucacuggaucaccaagagagagggggcgaggucgaggagagggagagggaacgagaguaaaggccaggcaggacaagggaggacuggcugggaagcagaagggcuccagcaggacaaggacuggccagaaaucgcuguggggugaaugaucaaagugcauugcagauauguaugaaaacguuguaaugaagccugccauuguguauaauuaacaccugcuaauauaaaugggaaaucacuuaacaguuuuuaaguaauagguuaaauauuagacuuaccuaaauuucauaaugaauuguuuucucuuuuaaaauuaaguguucucauuaaaauucauucauagguuucaauuuguuaggagaaaaaacagcauuugauuuucuuaauuugugugugugcguacucaggugccuccauaggcacaugggaggcccaaggaaaguuguggaguagguucccuccuaccguccugacgggaucuccggguuugugcugagccagcuugcuaaccuacacucggcauuuuguaaugcucaguuaaacauucacauaaauuguaugagggaugacaagauagauuauaucaugcaugcuuuaaagcuuguucucaaguauaugagaaagguuuuuuaaaaaaguauuaaaccaggugugaucacucaacccugggagacagaggcagguggaucuacauguuugaggccagccugucuacaaaaugaacuccaaccuggaccuugucucaaaaauauauaaguuaaaaaguaaaaacaguauuaacauucuuggagucaaagcugauuaugaaugggcuauaauaguuaguuguucuuuugggauuuuauuuguuuuguuuuaagguuuuuuguuuguuugguuuuguuuuguuuuguuuuguuuuguuuuguuuuuggcaagauuugcaguucuuguagaacugaggccuccuaauuuuuauuuuuauuauuacagcaaauaccaagcagacaaaagaaaauuuuagaagaagcucaugaauugagugaagaucacuauaagaaauauuuggcaaaacucaggucuauuaauccaccgugugugccuuucuuugguaaguauuuauuccuaauugugcucuggauaaaacaaaacauuuuauuaaaugaguguagaagguagcaccguaauccuuucagguuguucuugcugggacuuuuaaaaaaaaucagaccuaguauagauugagcauccuaaugugaaaauccacaguguucaaaaccuugaaacuugcugaggugacacaagugucugucugaugucuguguggccucguuucaggagucauagacaaaaugucacuucacuccaagcacgguaagauagguaacucaggugauagaugugguagcacacgaaugugaggccagccuggcaugcauugcaggguccuaucugagaacaaaacaaaguaggugcauugaacagucaagcugcagauguaaggaauaugugguauguaaauaaauuuccucuuuagaccuggaacccacgcccaggauauccauaaacacuccaagugcucgaagcccucugaccucguucagcgaggacucaguuuguacacgcuuugcuuucuagucuaaucucugacagccaucacguauccuaucacucgugccuuuguggucuuauuauuuuuguuacugcuguaguccuccugcacaaguccacugccuugacugaccuguaguuuaguucaauaaaggaaagcagcagcauggugauggcauccauacuuguaugagacccucuagccacgcgucuaaacaacgucacugaugugcaggaggagacaggcuuccuucugcacaguagaccuuuauuguuaccauccuucuuugcacuggaggaugaaugccuuucauccuuucaagacugacuguccugucugaaccuguuguuuuucuugcauagagagugaagaugguaccugucuguugccuucuuguagguuccuccuuauauuuuacacauucaguauucuuuacacugcgccuucacacacaccuuuucccccagucagugcuagggcuggaacccagagcuuaugcgugccagguaaaugcucugccugggcuauacccagcucuugaaucagccucucuccucugccugugugcaugcuuuggugaccguucugcugaagguuuguagaaauugaucuauguuauguuugacuuucuuaguaauugguacauuuucuccuaguuuuaucuucaucuguguuguuuucuguguagucuaaguuguaguacacagaacaaugcuaaccuugaucuuuuccucaguguaucuauuuucucauauuucauuguugcacuuuaugacuaaacacuuuuacauuugcucguggguuuuugguuuuuucuuuuuuuuucucucuauauagcacuggcugcccuagaacucacuauuugaccaagcugaccucaaacuuagagagaccuuccuccucugccuccugagugcugggauuaaaggugugugccaccaugccuggccugcuuuuggacuuuuugaugugcacauuguaugugauuacaugccauauauguugcuuuuuugccauauguacauuuuauauuuuaguggccuuaaaugauuguguacaguagccauaugauagccauaaaguuagugugacucuuucaucauuaccccacgauucaguguauuacuucuuggcgucaauagauccauuuauacacucuuaaguuguguggggauagggaaggcagaacaguacgccauaaauaacacagaagggcgggcuuaaugucugucacugcuuuucccaacuuuccuagcaguaaaaggcaacucgggguucucgguccucuagcaguuggcucauacucugaugcacauacugcuuauagcacaguagcuuaggcucuuggucuuucaaaggagcaaaacucugggacaaugucuugucuauucuuagcaccuaggauacauggaggcaucacaaauguuuuuuaacuaaugaaagaaacuguauuauuuuagaacggaagagaauuuggccacuuagacuaguauuugauaggcacagugacaacuagaucuacauguauauauacauauccccacacacaugccuaccuaccuuccuaccuuuucccucccuucaucccucccuccccaccuccucuaucucuuucucaaaucagaguuugguaggccuagagagauggcucagcauuuaagagcacugaccguuauuccuagugccacauggugguuucaacugacuauaacucccucuucuggacaccauggguacuaggcaugcaugugguacauaggcauacaugcagggaaaaugcacauaaauaauuuaaaaauaauuaagcuugcuaguauauaguauugaggucccuauuaaauguguccauauacaaauauucuuugcaaaucacaugugcuuaaauauuuauaugaauguacuguuugaucaaaaaagcuuggacagcacuaccaugauuuuauucuuuugacuagucagucauuaaucaggcauacgauacuucuccaaauuuuaucuugauauuucccaaagugcuucuuguauuuuuacaacuuuauccaaguguuuuguuuauaacauguguggacauccuguucacuguaccagucauucagucauccuaaguacagagcuuaaagccuuccugcuauguccugcccaugugugugcgugugcgugugcgugugcgugugugugugugugugugugcgcgcgugcgugugugugcgcgcgugugugugcgcgcgcgccacaccauuguuggagggaagguacucuuagaggccaagagaggguguuagauucccugaaacuguacuuaaagggacaucugauauggauacugggaaucugacuugagcccugugauagagaaagcaagaacacauguaaacacugagccaucucuucaguccagugacuaauuucuuaaggcccaccucuuaaauuugugugcccucuauucucuccaggcacagaguaugauagccugcacacugcuauucuuuggcagucaguguagcuagcaauucuaaaaugcaaagauaugucuaaccuguuaucgccuauauaacagcuuuuuaaaagcuuuuucuuuuuucucuuaagauacucauugugcacuguaagauggccugauauuccuguaccacuaugccuagcaugaaaauuaaacguaccaaaaaauauuucacaagcugaguaccagaugcuaccauccacaaacacgucaauuuuugacuaauuuguaaaguugauuuuggcugccauugaauuuguacacucuuaaggacauguuuguuagaaagcacaagagccuaugcuuacuacaacacacagucauuauuuuaugaauguaccuagaagaguggccuuggugcugagaaacagacgaauaaaucaugugcccaaaccaaacaaguauuggugucaaugucaccuuaugcacacgcacgcgcgcacacacacacacacacacacacacaccauuauuuagaaguacugugcugcuaaacauuuacaacuacugaucuugcuuuuguccaacaucuugccagucuuauuucacuccacauaauaaauaaagcccuagggucuuaccaucacaaacagccugccugcucggagaaugcguccaugccucauggcgugggaaugucacacucguguccgcucucuuauucuacugauugaacucuuaauucacuuuuuugagauuuaaucuaaugauccuuuuuuaaucuuaacaacucaaaauaggaaagguaccucauuaugcugucauagcaucuuaaacauuacuacuacuguggcaucuccucauagugcaaucucaaaauagucacacacacacacacacacacacacagaguguaccuucauuugcuguaccuaaauguagcagaaaggcaguacauuuguauucaguaaacagucucagguauacacaugccuguuuuccaccccuucacgggaaaaaaagcaauguguaauuugggaggaaaaacaaagagaaguaauauuaagauaccaacaucagcaguugcaacuauuacuaauggacacuuucuguuuugucaggcccuaucucaaucuguauacaaauuuauuucccacagaugaauaacugaggcacagagagacuaagcaauuuaucucagacagcacagguagagaacaacauagcuggcucuagaaccuucgugccaggaaggaaccagagggcuggauaaagagcagaaguggacugaaguagcucaguuagaagggugccuguuuagcgugaaccaggcauggguguacacuguaaccccagugcucaggagcugaagccagaaggaugguccccagcuacaggacaagcuggagucuagcccauaucaccagguguacuaagucuaaaauaugcaaaaauuaugucacccucugcuugauagacuugaagccucgccucuguuuucacaaauaagccuguucaaauaugauccucuccaaaccgagagacuaaggacuggaaaggcuggagcugucaucuucugaguuugaguccuaucccgucccccccucgcuguucugccacuaugcuucaccaaugacagugugguuaaguuucuucaacccaggucauguaacagggaagagucuggaaggaagccuuuauucuuuaaaaauaaucuauuucugaaauuugaucuccuuuuccuugaauguuuauaaaacuuaaauauuuuauauagaagaaggauuuaauagacauauaucuggucauugguucuuugcuuauuaugacuaucuaugccuacaguuaaugagaaagggaaaaaaaccuuuuccuuuuccuucuuuagcaauuaaguaauucccuggucuuuucuaggaauuuaucucacaaauauccugaagacagaagagggcaacccugagguccugaggagacacgggaaagagcuuauuaacuucagcaagaggaggagaguggccgagaucacaggcgagauccagcaguaccagaaccagcccuacugcuuacggguggagccggacaucaaggugagugcagugugggagcgugcaaacuccuccucagccuuagacacugagugccucagaaaggcuguucauuucguagaggagaaaaggaaaaaggaaauuuaaagucaggaacucaaauuuucuuauauugaguguauccuaaacuaucuucaugaauuuaaaauauuuaauacuaauaaaaauuuuuuggcuuuuauuucagagguucuuugaaaacuugaauccaaugggaaacagcauggagaaagaauuuacagacuaucuguucaacaaaucccuagaaauagaaccccggcacccuaagccucuuccgagauucguaaguguccugugcucacacuugugcaucgcucacacuugugcaucgcugcagucucucccacuaugggucacacagacuuaaggacgggauguaaauguggugauugcaagugcuuaauaaguaaauagaaugagggccaucccaccugguuucaaaucagugaacacuaauauugauuuuaauaaauucugauaugauguaauuauaaaagugaccaauuuauauuguuuauuuuuaguuguaacaaaaguuaaaauuuauuucaaggacauggaauuuaagaaguuuauacuaauucauuuacaaucaguauauuuccuucauuuguuuguuuguuuuguuuuucaagacguuuucucuucauagcccuggcuguccuggaacuuguucugcagaccaggcuggccucaaacucauagagauccugcugccucugcuuuccuaguacugggauuaaagugugcaccaccaccacucccagcauacuugggaguaaugauuuauuagaaauguuagccaugagcaaugcaaaguuugcauaaaaauauuuuuaauaguucuuuuauuuuguaguaauuucuuagugccuagccaaguuuaugcucaguaucacuccucacucaucugaauaugcucccucacucaauaaagagucaaaaugaauacaaaugguuucuaagcggucacaguaaacugcuaaugucugugacucacagccagauuuuuuuuuuucaaacucuaaauuagcuuuuaaacaugaaccuaaaauaauucauuagagauauguaugucgacuccagugaggcacucugacaucacugugaaguggucauucugcagggaaagggcccuaaaauuaacacacacacaaaucaaaacgcaagcaacucagccuaucaguaaguaguccauaugguccgaaugcccuaauucccacaguuccugacgacuauccuggcuuuuccaacaaaguuuaauugccucaaauagcguuuuaaaaacuugaauuacaggauguauuucagaaaaauuuccaacccccgagaugcuuaacaagcauucugcuauuuauaucuauauuaaagcucaaucacgcacauuuguuucuagcaccuucuauaagaaauccucacagaggagugacagugcugcaccuggggcuccggucugaaccaucaugaaacuuucauauuggucauuuacagaaaaaaaggaaaaaaaaaacuuccuguuaaccaugauauuuuaaguauugugguuuguuuuuguuuuugaugucuauagccaaaaaaauacagcuauccccuaaaaucuccugguguucguccaucaaauccaagaccaggaaccaugagacaucccacaccucugcagcaggagccaagaaaaauuagcuacagucggauuccugaaagugagacggaaagcacagcaucugcaccaaacuccccucggaccccacugacgccgcccccugcaucuggcaccuccagcaacacagauguuugcagcguguucgauucugaccacucggcaagcccuuuucauucaaguaagugcugaaacuugacgugcuccugagaaguuguuaaguagugcccaugccagaggugagaguaaccucuguaauuguguguauauucauccgcguaaccugaguuucuaaagauacuagaauucuuuacaucuaaacccuacaacuugggagguuuuuuuaaaaaaguugcugaacacucucugaaugcauccaaguguacagcucgugucagaagaaacaaaggccauccuuaaaagucuucaauuuuguuuuuaaauuuuauuuuuugugaauguauguguuuugccuauguaaaugucuauacaccaugugugugccuggugccugcagagaccagaagagggcaguagacccugggaugggagugagcuuccaugugggugcuggauccucuagaggagcaacaguugaacaucagccuacacauuuauuuuauuugaauauaagguauaccauccccuccucaccacauucugcaguggcuucugauucuaccguacauaaaauuccaacucuuagaugacccuuccucagacucacuguaguauccuaauaauauguaguucuuggugaaacuaggaauagcacaugggcauucaaaccacaguuacugcuuuaucagcagaaauaugagagcaauauguuuggcuguaaaugucuaauagccacauuuuaaaaagcaaauauaacuuaaagaauccuuuguuaaaccuaguauuuaaaaaaugacuucagugugaaaucauauaaaacuuauuucaagacauacauucgaauuuaaguauugaaaaugcagugugcauuuccuauuaugccacaucucgagucaaacaaacccaagggugcuuggcagucacaggguuaucagccugacuuucuacgaaguuccauucacucuuagggaauccaugaggagcucugcaugcagcuccuaacaacacaucgccuuuuuacauucguuuauuguuagaucaaacuuucaaucaacuuuaauccucugugaauauuuccacauauucuucccauuggcauuccuagcuuaucaaacuccacccaacggccugacacagugccagcaucaggggcagcauagccucacuguugagguaaaggcugagaggcuccaaccuucgcauuaggaguccugcuuuaucauccaaggcuacucaugacuuuccugguucuugguaaaacacuuucugugugccuuguggaacuuuaggcugcuucuaaccuaaagaaaccaacuaaaaauguugcagauguauuuugagauuugucccagaacccuguguaguuauuucugugacgugcaugcaugcguuuaucucaauguacgucuugucuuugcacuacagaaaauuuguacugagcauuuacuuggcuuuacuugugacuaaggaacauggaguucacaguguauacuuaguguauaugaacuauugcacauauuuuugauaaguucagauauucacuaaguaaaaauauguauuuuucucuaauuuggcaauccucuuaaguacuaaaacacaaaacauacagauuuccagcuuguaugacuaaaauucauuauuguuggauucacuuagcugcaagguuucucccccuggaacagauauguguaacuccauauuauaaggacucccaaauaaaugaauuauugaaggcacauggaaacuaucaguugugaauucuuuucuuauuaguuuaggucacuaaaacuagaagaggugggaaaauaaacccacuuucucuccuuauguugaaucuaaaugaccagccaagggagagggcaucucuggaugcacuuuccgcucugguaugugcccgugggaaggcauuaacuaaaguuucuagacaaagagggaaaacucuuccaggagugaugaagcuuugaaauccuaaacuuuucggguuuucuuaacuacuuauuauaaagaaacuauuaauacucccuuuucucuuagugaaacugcaaagaacucauuuugaaauaaaguaacucaaguuaauauaaaacuauucucauguucgacuaaccacuacuucaucuguauuucacuauuucaucuguagccuauuuauuuuaaagguaccuaccagaacaaucagaucuauaguugugaggcugcucgagcuuucagucgcucugcacggguugucucuaaucugcaugccaucugaagcccuguuucccagucagaaagggcugcuguaacugcagccugcagccaucugagcagauuccauauuauuuauguuccaaaaggcugaagcugacuagaacuaauauauugguuguaauguucuugaggcuucguuuuauggaaguauacuguuuucuuuuuaaggaaauugaggggcgggaaagcuggcgcucggguuaaacaucauuuacuguuucugcaagcagaccugaauuugguucccagcacccagaaggcagcucacaaucccugaaacucuagucccaggagaccaggugcccuuuuuuggccucuguaggcuccagcaugcacaugacuuguacacacaauuaaaauaaauauuuaaaaacuaaaagugagaaauagguaaguaggucagugcuaagccacacacacacacacacacacacacacacacacacacacacacacacacacucacacacacauacacacacacacacacacacacucacacacacacacacacacacauacacacacacucacacacacacacacacauacacacacacacacacacacacucacacacacacacacacacacacacacucacacacacacacacacacacacacacacucacacacacacacacacacucacacacacacacucacacacacacacacacacacacacucacacacacacacacacacacacucacacacacacacacacacacacucacacacacacacacacacacacacacacucacacacucacacaccacacacacacacacaccacacacacacacacacacacucucucucucucuugaucuccacugagcuucucagaaggacugacaagaaaucagaacaccagcuucaugucauucagaauuuaaaagugaguuuuaaucuuacuaguguugcuaaauugcuacuuacacauaugaaaggaaacacugugugcgauacuggcuuaugaaggcagucaaguuaacauaagagucgccauaaggcugaauggauggaauguccguuuacucuccccuugaccacauaaacugaaaaacugucccaaauuaacugaguuauuguauauuguauacaaacagguaaaaguuggaaaucuuauuuuuaaauaguuggcucagugcccuauuguaggaaguauuuuagccacuuggguaguuguguuccauguguuuaguagugaagaaguguaacgacgauuuaaugacgauuuagagcagcccaggugucuaguguucucucucaauuuuccuucauuuuagugcaguggcugucaaccuguguguugcagccucauuggcaaacaucuccaaaaauaauuauauuacaauuuauaacaguaggaaauauuuuuaaaauuuuucuaggaauuuccucaaaaauucuaagaaccaaauauccugaaaucuuugaagguuuuggauacagaagcuuguuuuaaauauucaaaguucugaauguuuuaugacaauaaauguucugaaaacauauuuucaaaggugucugauaauaucuguaugacuuccccuuuaaucuuuugcaaaaugauuugagucuagcuaaguucuucacugcacugggcuuuacaguguacauugccuuccagggcagggagcuggcucagcagucuaaagugcuugcaccaagccugacagccuaaauucaaacccuggaauccucacgguagaaggagaaaacugacucuugcaaguuauguccuguccucugacuuuuuuuuuuuuuaagauuuauuuauuauuauacauaaguacacuguagcugucuucagacacaccaaaagagggcaucagaucucauuaggggugguugugagccaccaugugguugcugggauuugaacucaggaccuuugaaaaagcagucagugcucuuaaccacugagccaucucaccagcccccccccccacccccgacuuaaucacacauacuguggcacauggacacacugaacacacauacagauaaauguaaaaaagccuuccaauaauauagcaauauauuguuuucuaauaaauguucucauuuauauuaucacauuaaguaguaagaagaacuucaaaaaucccaauauuaacuccuuuagugagcuuuuucuaaacaugauuaugacaucuuuaaaacuaguaugucaucauauauacauuuuuauggguuaguugagaauaucaaugggagaaaacaacuuuuuccuguuuccuuuccagagguggcgaugccggucuuuacccagguuacacugccccauggcccaagucaguuuaccugauuuaaaccuaauuccugcuuuggcuugagaccagcuugaggccaccucccugcugaccuuccucccccaucuuauaagugagccuccccugcugcugucucuugagcauaaacaguugccuuaaauguguauucuucucaugcuuucuacagagcuuuuccucuuaaaagaccuuacuacauaaguagcuuccacaugcaccacuucucuuccgaccgcacaauucuaaguaugcuuuauccucaccguuaaaggagaagcagggcaugcaugcgcauaugaggcugcugugcacaucugagucacacaguacuuagccugcugacaacagagcgccagugguaaccgcauuaacuucauaaggacuaccuuauccuuacaacuaguuacaaugcauuaacuucauaaggacuaccuuaccauuacaacuagucacaaugcauuaacuucauaaggacuaccuuauccuuacaacuaguuacaaguuccaaacaguuagaaaaaccaggugcuggugcaguuacuugcucuagcuuuagacuaacaauucacuauaaauucuacuauuuuuaauguuuuaaacaaaucaauggcuuugcucuuuguacaaaugauuucaaaauauauacacuaaaaaauaucaguuacaagcuaaauuaauuguauauauuuucuuaaaacguaggagaccaaaauguugcugguggucuguggagaagcucggugggcagcgucugcuaugagagcgugaggcucugccugagcaucucccagacccacguggaaccucacgggaugucacaugcuugugaucauagcacuaaaucccagccagccuagaccagaaauguggguugcuugcccccccccucucucucucacacacacacacacacaauguugaccauuuggauauaagugcacaaaauacucuuagguucucuacuauuguaacauacuaauggugggggcaaaaugcuuaaaggaauuuaaaaaaacaccugccaaguacaucauuuuuuauuguuuucauaguuuauaaacuaauaguagcauaaauugucuuucagagcauaaguauugaggccuggauuacgccuucaucacuaagugucucuaagauggguuuugguuuuacauaacucuucuauacucucaucacuuuggucucacaucagguuuacuacauuuuagaacaguuccuguuuucacgaucagagcgccucugccuggugacauucuaaauaguuucaucaugguuaaagcuuuuggcugggcggugguggcucacgccuuuaaucccagcacuugggaggcagaggcaggcagauuucugaguuugaggccagccuggucuacagagugaguucuaggacagccagggcuacacagagaaucccugucuugaaaaacaaaacaacaacaaaaaaaaaaccuuuuggauuagaugugaugauucugauuuuguuuauauacuaagggggucuggacccaagcaaaaugugcacaagccucagggagcugcagauucucuccugugugucauguaagagauguaacacggcaagaucacagacuguuccuagaaacuaucuaaucuggguacagcauccugagagcaacagaacuagagaaaaaaaugaaccuaccacaguuugaaaaacaaaaacaaaaaaaagaccauuucaacgauuuuuuucaauuuacuuuuccaacagaaaucugaaaaauagacccaacuaaaaauuccaauuauagauuaacgaugguaacacuauuuuguucaaaaaguuuaaaaaacaaaacaaaacaaaaaccauuauuuuaggcagcuuuuucuuucugcauguuuuuuuuaaaaaagauuuauuuauuauuauacauauguacacuguagcugucuucagaugcaccagaauaaggcgucagaucucauuaugggugguugugaaccaccaugugguugcugggauuugaacucaggaccucuggaagagcagucagugcucuuacccgcugagccaucucgccagccccucugcaugguuuuauagcaguuuauuuuaaugaauagaauagaacugggugcugguuuauugaacugcuuuuaauaguuaaacacauuucuuuuagccaauagcauuuccaucuaagucuuuucaagaggaauaaaugaaucuaauagggguuacaggauaagguuucaguugugguacccagagauuaagugaccauuguuucugaggaaaaaaaaaauaaaauaaaugaagucaaaguuccauaaucuuuuuuuuuuucuuaaauuaacacucuacaggaucugcuucagucucaucuauaaguuuauccaagggcacugaugaagugccuguccccccuccuguacccccucgaagacguccagagucugccccagcugaauccuccccauccaagguaaaggagaacacugguuaucuagaaacuguaaucucuagcugugucagcgguuaacggcaaguccauuucuugcuggcaggcuuauauuucaaaguacuuagguuuaauaguucaaagauuaaguauaaauuuaucaugcaagauguuuauauuuuuuccuauaaagguaguuauaggaaugcaugcaaaccccuaaguuuaaagcuaugagcauuacuaacggaagaaaccaacucuuaucuacaaggugguaaauaguaacuuggccuugugugguucuuuuauauuuugcuugugagccuugucuucaauggcugagccauugcuucagccuucugcaguucuuuuaaaauguaugaugugugugugugugugugugugugugugugugagugagagagagagagagagagagagagagagagagagagagagagagagagagaaugggguaggguuugugugaagguauaugauaaugaaaccguacugaguaucugcugaaaguuauucucugagccagacaggaagagacuuaaauucuagguuacagagauccuaaagacucauaguaacuaagcuuucugccuguuuaaauuuacccuguuuauugauuauuuugcaaguuacucaauaauucuuuuugauuuggagcaacccagagaacagaagcagcagaauaagucaagaccauauagaguucaugaaacaauucaguacauuuaaaacguaaccauuacuguuaggguaguuuguuugccuaauauguacacugccuuuaacacuuuagcccugcgggggggaggggguaguuuaugcuaaauuagaauuuaguguauugugugaugggcagucaguagucaacaacaaacuuuugacuaaucuugacaaaauuaguuuuucccuaagaauggacagaacaucuugauuaacacauaggguaaaacuccacguucuauacccaguguucugucaguagcaugucugaaaaccccaaguuaacuuaguaaauuuauggugcucuucaaaugaaauuaacauguuguauucuuuuucauuuguuagauuaugucuaagcacuuggacagccccccagcuauuccuccuaggcaacccacauccaaagccuauucaccacgcuauucaauaucagaucggaccucuauaucagauccuccugaaagcccucccuuguuaccaccacgggaaccugugaggacaccugauguuuucucaagcucaccauuacaucuccaaccuccuccuuugggcaaaaagagugaucauggcaacgccuucuucccaaacagcccauccccuuuuacaccgccacccccccaaacccccucuccucauggcacgagaaggcaucugccaucaccaccacugacacaggagauggaccuccauuccauugcugggccuccuguuccuccacgacaaagcacuucucaacuuauccccaaacucccuccaaaaacuuacaaaagggagcacacacacccauccaugcauagagauggaccaccacugcuggagaaugcccauucuuccugaguuccucuaagcugggauaguuuccuagcccccagauccauugcuggcaauggaugcacugaacaugccagcacuggggaguucaaaugagaacuccaaacacuaacgacucuacuucacgauguaguauaagacaaugaguuuuaaccuacauggaauuauggaauaaaaugguauuccagcuuagaauguggaaacugauugcaccuggaaaucacgugaagggacuuuucuggccauugggcaggaguccucauauugugaagugaucuuuaucauuaaagggauggaaaacagucuaauguccaacaagcccauauguugacaguuuuuguaauucaaaauauuaugcacuuuuaaaaaaucuuaaacagggaucuccuccuuuguuuuccuuugcuuuacucuucuacuuuagaauauuuucguaaaaguuauucagaggacugugagaaaaggcugugguaccugaccuuguugaaaucaaggcccagcacuguacuacaguccuguuuacagauuauuacagugaucugaauggguaccgaggcuucaccaaagagguacuuuuuguuauuguuauuguuuuaagaauaauuaugccaauuuuaagaacauccccuacccacccccacucacaaacaaaauguggugguguugccuuuaaacaaaaaaugucaaugucauuaacaugauggaagaagaacauuuuaaaacguaacugucaaguauacgauuuacgcuuaggagacuguucaucuaugcuagacugucaucccccagccccuuugucucacagaaguuuacugguaauguauguccuggcucguggcugucccucuaaccguacacagaaacacaggcacccaaugugaacgagagcacucucugggccucccugacaccuuucauguuuuacuaauaguugaguaguuagcauaccuagaauuaccuugcauugccuaaaucauguguauauagugaauguuauauaauauaccuugcaggucuguuauuauuuaauugaauaaagauaaacuacuuuguuuggcuggcauauauuaaauuauuauauggagaaaaugguugauucuuauuucuuuggguugaaaacauacaaacacuaagcauaaaagcacauguggugguaccuggguaucuaguucuuacggaauaaucucaaguuggaguuuggcgugaagggaaauacuggcuuaaagugggauagguaucuuuuaagcagaaccuugcaucuuuuuaaaauuucuugagcaaccauacauauuugugaagauuuauauugaacauucuacucugcuuaagaucuuugguuccuucagagcuucuccuuagaguaucuaccugcauccuuaauaccacgugaugauucauggagccuuguacugcucuucugagucuaacaaauacugugacugaaaugcaugcaacuugaagagaaaacguuuucuuauucuccacugugucugugaacuguguaguauuccauucuuugacagccaucaguaugugcauguguccucaguaaugacgcagccuuucaguaacccugugacugccgcaucauaguggcaacuuuguauuuauuagcgaguuaaaugugcaccuugguagugcaguauauagucuucuaagaacagaagaacauuaauuguaucaucaugaggcagucuaguuuguuagaguugguucauuuucacucagcuauguuagccauuuuuuucuuuguaauaaaaagucuccuuuuuaaaaagaguccucaaguuaauuucaaaucccuucuuggaugcaaagugugcauuaggccauucauugaacaaaugacuauucguugaacaaaauuagcuaagcaugcuuacuaaugcugcuccguaugacuguaaugcacaugcccaaaucucccaggacuuuuuagaccagccuaacugucccuaaaacuucccauggcuuauugaucgcuguuugaucaucccguccuuauuucaaaugagaaucuaagaaaagcaacauuagaaacccauucaguaucuguggcaagugcugccuucaacaaggugauggccccuuucagucugccugagccaacaagggaaggagagcucagaucugaagugaauuauauuucucccacagggagccauugucuaucccacuguucuaagagaccacauaacccugcagucauuuuauaugcaucauggauagaggauauuuuuauucuccaauacaacaucuuggcaaaaauauuuucugcagcaguaacauuucaaaaauucuaauuggaugcucugagaagaugagaaagcuguauccuugugugagccauuaucuggcuggcagguuuauccuuagucauaaauguccuccuucugggauaagaaguggcagaagacaaaugcaccauuaagaacugcaucugaauucgaaauuacaaggcagccagugcagcaaaacuugcuuagcuaugcucccagauauggggcauuucuuccagaaauccaagugucagcuaauguuuucuuaugcuuggcucacaaagggaguuccucuugguggcucauuaccaauauaauagaaaugcuuuuucacagcuaagcucuuugaaaaacagggacagaaaaguaguguuucuuaauuuauuaagacaagauauuuacucuuuuacuccuucaaauguguuugaagacuacaaaugacaaauauugaaaaucugccuaauuuauuuuauuuuuuuuuuuuugcuuaaauaaagcuguugggcaucaaauugugaguuuaguaugccacuauucucuaacucgauguuuuaguggaucugaguugaaccaagaauaccaaauaaacacaaccagcagaacagucuacuaaaggacuacuaaggcugaaggcaaugcuacgauuucaaauucuuccuuaaugcaaaccaaaagugguauuuaucauaaugauaauuuaaguuuugcucacauuauuucacugucuuaauggcuuaaauuagggauauuugauaguucuggaaaauaaauggggauguugucccaguuagaguacauacagaagaaaacccuuccuauccucucugccuuuucaaaccaaggcaaccauuuauuccugguugucugcugcugggugguuuugcaugcucuucccaucucugcuguaugccucuuguacaggugcagguucuguguauuccguguuaaucuuuaccaguaaauacaccucacaagguuacuuucaguuuggcugaaggagaacugugcaguaaaaugcgaaggaaagcaaugacuuuauucaaugguuuuuuuuuucauuugaaacacuauuaacuuuuaaaauaauuucauagucccuuauacauaagccaaugaaauauucugaguucuaguuagaaaaaaaaaagcaugaauucuacaugauaaaucuaaacaacaaaaacacuuguaaguucuuuuauauguuucaugccuuauuuuccauuuuugacaccauaaagugcauuuucugucaacugugagcaaauuucccuuugccuuuaauaaacauagugcauuaaguagccaguugcugaaaaguuacaaagcaaguuagcuaaaggugggucauacuggacuacauucaaagaaccaagauacacaaaagaugcaaguuguauguguguggcuuagagugcaccugugcagaugcaugccgccuucaguagcugccaaaugugccuuuaauuaaaaacaucucuaauuuuuuuuuucuucaaaucaagucagcauuuggggacgugauuagggcaagggacuuggggguacaaauaucuggugaaaucaccagagaauuuguuugucaaagugacauguguaauuuuaguugagauaugucuguguauauaugcguauuugccuuuguuuaggagcacgguuauuugcugaaauaauuguuaaaaaaugcugucagucuuacuuugauguaaagaacaaaguguggucuguacaucuaauaaugaccuuuguaccuaaccauguuuguuggugaucuuuguauucugugugcagcaauauuugguuuguguuaaagugaaaauaauggcuguuauuuuucuggcauuacuaagauaaauugaaaaauaauaaagaaaaauaccuuauauagccuauaaguguguuauuuugcaagcauuauuuucgagggcaguacuuggaaguuguuagugauucuaguuuagcuuauauuugaccagguagguugaucuuuggguauacacaggaugacguuucagaggcagucacauuuccaaaacaaugagcuuaggcggugcacccagcuggggucguuugacaugaaagagcuuaagguuguaucuaaagaauuuuguaaauacagucacucaaaauguaucauaaaauaaauauauuaaaugauuauuagauucaguccauuuauuucaaaguaaaggcaagccaggccuugugguacaggucugagagcccagcuacuggggagacugugucaggauauuauucaaggcauaccugggcaacugugaguucaaggccauccuagaaccugucucaaaauaaaaaggcaaaugggggugggugcugcucagugauaagagugcuugcugacagugaagcccgggucucauccccuguaccagagagaguaaagcaaauaaagaagcaagguaagugaggccuaggcaaagggguguauaaggcccugacugggacagaggcucagggccccuggugcucggaggagggagggcccgcauggaugccugcagugcugacuccuggcauguauuaucgaauggauucuaggccuucgaucggguuuacuaacuguaaguaagauuaacacugauguuggugagauucgccuuucugcuuuauaaucaaaaguaagugcuaggucaucgaagaggagagagagccuuacgucgcuuccguucuaaaacagaacuaaagaggccuucuccacauuugagccugaauuucugcaccuuugauagacuacaaauccugaaaagcaauuuauggccacacuaaccuuuugggaccuuuaauagcugguuucauugccuugauaagugauuaagaaauguaagauucccaguggcagaguaagcaaguguggagcagaccugucuauucugcuucuaguacucccugggugaaugacugacaugcgcaacacaaugucuuccacaaagcacuugacacuuuuuuuuuaaauggcaaauaaaaguauaaaggaugagucugcuuuagaaaacucuaaagagguuggcugucuguccugacauccuaugauuugauucaguauggcuuucugugcuguuuaucacuaugcagauugguuuugagugaccuuaaauuauaagcauuugauaagagcccauuugacuauucagccacaaauaaauauuggucuuacagaacugauguuagaacauaggaaugaagaaaaauccauuucaugggauuuacgagcuaguauaaauauguagacaauauuuuauaaguagaauauuguacauuaaaaauguaacuacagggcagugguggcgcaagccuuugaucccagcacuugaaaggcagaggcaggcagaucucugaguucaaggccagccuggucuauggaggacagccagagcuacacagagaaauucugucuugagaaaacaaacaaaacaaauguaacuguuaugaagagaaaagaggacuggugaguagaaguguggaauuuaacuguagugauuaguuagccucauagagguacacaaaccuuccaagaggugaaauaaugagacaucuaaguggcucaggcaagagccaguucaauaguucagaggcaggggcauccuugguauaucugagagcaccgaggcugcuaguguaggugagaaauggauauggauagacuauaaagaggugccacugggaguuaagcacugaagaucacuuaaagcuuuaaacgccauugucaucauucuuagagcccguccccaaccugggcaucaccgcuccagggaggacuugaauggccuuucacagggucaccuaagacuacuggaaagcacagauauuuacauuacaauucauacaguagcaaaacuacaguuaggaaguagcaacgaaaaugauuggcugggagucagcacaugauauuaaaggcuugcagcaggcgcaagggugagaggcgcugacuuggguuggggcugaagcauuggcaagauccacuuuacacucacuguguguggggaaggacuaaaguaagagcacgagggggcggacgagggcagcggagcggaagccagggcaaagacugagucgggaccguaucagaccacgcccacuucaccacagcccgaacauccugacagacacaaacccagagcugucaaagccaacuucaaggcuugaggccagagcaacacgaaugaagauuaccacuaacugagguggggaagauacugugggaaaggcuuagauauaaguuugaacauuuaaaaaaguaaaucugacaucaaaggaaaccacaaaucccagaaugcuuagcagccacaaguccuaaagccacuucuguuucuaaaucacugugugacaaggaaucccaacuuuacuggaagcauugcuguuuugggcucuuguagaaacuuacuaauggcaauguuuugugaaaaaguuaguauaaacacuagauaauuuuauuguccuaagacuguuaucuaagacauuuagucauucauuugucagggcuugcaauugauuuuuuuucuugaauauaaaaucaguuugccaguuaauaaggaauacuugccauguguaugaauguacuuuaauaaaauuucaaugcaaagcgcuuauuacauaggugacaaauuuaggaauucaaaaucucagaauagcuaaauguaaaugcagcucuguggaccaagcccaaagucaccccacucuaacaggacugaggcaguucugggaauccgggaaucacagugucaucgcugagaugacauaagaaagacgagguggaaaagcaguuagccaucagcuaccacagaauuccacuucaggaguuucauaaacaaucuagcuucaaucucagaugagcuuaaacucuuacaaaaugaaauagcccagcaaaagaaccuuagcauuguaacccacacaucccuuucucagaugguccaauucugaacuccgagaaauaacaugcuccuugcgugggcuuguauguagacucuucaaggcugcaagucacuccugggaccuccuagcaggaaagucugcaucucugguaaaguggcuucauucuccuaucacccggaucauuuccugcagacaccaguggucagagggcuggagaccagagguagagcaacugucucaccuugacuucaucccuaacucgucauuaagccaaauaucacggucacuaaagcccccaccuccccuuucagcuuacagugcuaucuagaaagauuauggaaugcgccagaaggaaacagaguaacccauuacucuuuucauuggagaaguguuuuaguaucagugagaguggcaugauaucuuuaauugguucugaagaugucuguaucuucuccucugauuggcguuuuccuuaaacagaaaugugagggacugagcugacggugcugaaguuuggccauaugcaaaguggaagugauuuaugaagcauuaaaaaaaaaagcaagcauagccuugcccuugagaggacuugcugucuuaauaggaagguaagacaaaucucaaaagaugaaguagucacaccacacaggaucucagaaagaugaggccuucacguggaucuuaaggauccgcucagcgggaagaggcagagcgaggcugugaagcugacugagcuggaagggcauggcucagaggcgguggagagccuggguuaguugcauuccuuuaugcagaaccgcggucagaaaacuaaaaguccuuauggagagugacccuaaaccaccggugauggcgaggacuugggaaucugagcacagacaagagcuguguuugguauguggaugugcuggggaucugggaagcaggagcgcucagaggugcaggaagaacugcacucacccagcagccaguuaucaggaaguagggacccagacuggccacauuacuauuagcuuaauaauauacaauaguggucugcagauagagacagggugugcugucaaaauaaaaucugaaaggcguguaauauuuuaaaacuuucuaguaaccuacuguuuugaugacaagcagguuaugaaaggaagagaauucuuauuuuuguuugucguuuaauuguuuuacucuccacauccgguugauuggcauugugcuuuuaaucacugcccagaacaauuuuagccugguaaaaaccugauuucaguggucuauuaaauuccaggaaaugaaaaccuuagcugauauuuaaauauugaaacuccaaaaaauuuguaguaauccuuuauauguuucacauauuuaauuguaugcugacagcuguguucccaauuaaucacugggcaaagagaaaguuguaguacuuaaaaauaaagcacccagcagugcauuuccacagaagcacugugugaggauaucagugugaauacugucuuuaggcaacugcacaccacggagucaagugguuuaaaccucuuuguuuuguuucuuccuacuauaaaucugauguuuggugucaaucaaggaaaaggaugcauggccaucugcagcgugucuagguucaagagcacacuguauuacuccagagcuaggcaggccucacucaaguaggacuuaguccucuacuugggcuauaaaagcuucuauucuauaccgcucagagacuugcauaguacacuccugaguuuucacucugaucuguguuuguaguaaucacuguauaaaugugaccauuagagaacuggugcuggggucagggcuggggauguaacucgauggcugagcauuugccuggcacggcccagacccugggugcaaagccucugaaugaggguggagcuaagucaguguuccuugucuccuggucuccugggcuugagugggucucacacucaugacaucuacuggaucugugacugcugcaguccccaacacagcccacacaaggaacagauuugucuuuggccccaccccuguucacucuacugauuuccacaagcauagaacaaguuggagagcauuauaucuuucaguucugaagcuucuaaguaacuuuuuaaggacaaauucuuuagaacucugguuuguacacauaaaauucgguucuguuaacccuaugccuuaaaagacguuauauuuugccuugaggucugaaagauaugaagcaacacaauuggacccucacauagaguguucuggucuaagcacagugggaugaauucaugaacuaugcauuaaaauuccuaggaagcacaaaauucacauccaugcuaaaaaugaacacgauuauuauuauuauacuuggggaaugacuucaaggugcaaguuuuuggucuuacaaacauuuauuuuccuccaaauuuaguaugcuuuuuccuguaaugauguggaaagucuucaugucccuuuucccaauccugagguucauaaaggcaagucuuaaccauagacuaaucuucaucucuucaguaucuuguauguugauuuaauuucauauguaaauguuuauauuaguuuuccuuagggauuuauacauugauauauauauauauauauauuccugcagagauauauacaagcuuuuacccuccucuuaccacucgacaauacaacuguaaauguauuuacacagcuguuccuuggucaaggucauuugcaagagcaagucgguuucugaagaaaucuuguuuggugggugaaggauccauugagggguucucauuaguuuuuucccuguauucugauccacuggaccuaaaaucucagcacacagauaaaguacagguugauuu

SEQ ID NO: 8755 - RNA, 10508 nt, Mus musculus
gagggguggcuuccaccuucagggaacaggcgccagcacuaggcuacuauaucaacagacauaggauucuggauagguacucggagacuccaggugaggagaccuaggaaacaaggcagguaugaggggucagaaauguuucagaacccugacugcuaacguuguuaacgagaaaccaagcagagcuaguucaaugggaguaucggucgucaauaggauacgcaaagcuuucuuacuggggcggcaugguucugcucacuuggcucagaugcccaggaggcaggguccacugcugggaggaugauaugcguuagggaugaaucacauugaucuuacagaggagauggaacuguagugaccguagauagacacgccacguccagaccggagagagagcacgccaaugcuguucugccgcaggcagcaguuuucaaagcauuauagagugaaauagcgcccucuguagaaaucgguggauacgugguguuuagguauuauccuucgggagaguguagagacaaauacuaaaagcaacagcgaaaagcuugaagcuaaaauccaggugucucgagcuacccagcucagaaacugcuauuuuagucaccugaagaugacucugaccuuacaaauucgcgcgcgcguguguguaugugugugugugcucgcgugcacgugugcaagagagagagagggggagagggagagggagagggagagggagagagagagagagagagggagagggagagggggagagagagaugcauguauagguauuuggguaugugcauacgugugugugcuguguguuugugcgugcaugugugugugugaaagagaugcauguauagguauuucuguaugugcauacauguguguacguguguguugaauuccagagguugguuucuugggaucuucuucuauccaccuaauuauuacuuuuaaugauuuauuuuauuuucaauauuuucuauuucaauuuuaacaaaauaacuuuaauuuuucaggugugcauguguguauguguguguguguguguaaauucaaguguacccuuggaggcuagaggugucaaauucccuggaacuguugucauagucagugaugaaccaccugucgugaauaccugggaauccaacucagaucuggaagagcuguacguguucuaaauagcggaaucaucucuccaaaccuauuguuauugugagacaggguuucucauuagaccgggaacucccugguuuagcuacaguagcuaaagugccagcuuccgggaucugcugacuacuuucccagcacugagguuaagggcgugcgcuuuccacgggguuaaaggaaagaaaauaaacugccaaaaggagguagggauggacuugucgagggacagccaugucucagcucagcaguuguuuacuacuggaaaaucaggucacucccaaucuucucugcucuaaauaucuuucagaauauguauaauuuugcccuuaugggaaaaauaccuugcuguauaucuuuucuaaguggaguuuugcguuuaagugugacaacagcuuucuaaauguucauacucacugccaaaugaucuaccuaguuacacccugucuagguggagaggccugcauaccuauuuuguuugugguggcuucagauggaaccccugugccuugcacacgccaggcaaccucuguaccacugagcuacaccccuaacccuuucgaauauauuugagaccgggucuugacuaaguugcucagguuaaucgccaacuugcaaucaucccgucucagccucugguauaccacagcacucaucuuacacuauuugaaaaauuauuaauggugauaauaguuuauugaaauucuuuuucaguuuuagucauggcuuuauuuuuuaaagaaagcaauugccaaaacuucuguauuuaaacccuguuuuuuccuuccuucuuuaagaaauuucuuggcucucacuuuucaaguuuaaaaaauauccgauuugugcucuaguuagaauucugugcuacaaaaaaaaaacccgaugagacaacauguuuauacucucauaguagguauuuccaucuagaaacaugcucauuucaauaaaaucuuuuaaucauuucagucagauauguaguugcguucuuuaaaaagacuuacuuauuuauuuuauacgaguacacugucacuguccucaugcacaccagaagagggcaucagaucccaucacagaugguugugagccaccaugugguugcugggacuggaacucaggaccucuggaagagcagucagugcucuuaacugcugagccaucucuucagccccuguaguugucucuuuuaaagaguuauuuauuauuuauugugucugacuguucaccuacauguaugucugcaacguaugcaggaaggccagcaaagggcaccagaucccccggaaccggagugacagauggcugugagccaccacaugggugcugggaaccgaaccuggggccucugcaagagcaggacuugcuguucuugaccagagagcugccgcuccagccccagugggugcucuuacguguugacuugcuggugggccauaugauuggauuuccucgcacugaauuauggucgcuccuugaggucagaccacccuguguaugcuuucccaccaagcuacacugggguuuauacuggcuuccuguuucuucugcuuacacuuuagguuaaaagccauuacccuuugagcacauccuacgugaagcuggggguugguagcggggguugggguggggcugggaggcuggggcugggauccuuuuggggcuacacacagaaugaaagagaacuggccaaagaacuccagguucuggaucacuuacccguuuggguuucucuccagcucguuuaacagugugugaucacaguacucaaaaacuagaugcaucuuucucuuucuucugaacaccucgaugagguucacgagguuuggguguuucaacugcugcagaagaagugaagugcacagguuagugaugcgguuccguucacagcugucccagauaugcucugaugcuaggaggacacgccccuuuaucauucuagcuccugggcagaaggguuuuuuuuuuucuuuuauuguguguuggcguaugugcauaugugcgagggugcacauaugugugugugugcauguguguauggagccuagagguugacaucagguguuccuuuuuuuuuuuuuucuuuuucugagacaggguuucucuguguagcccuggcuguccuggaacucacucuguagaccaggcuggccucgaacucagaaauccgccugccucugccucccgagugcugggauuaaaggcgugcgcuaccaugcccggcuaaucagguguucuuaauugcucuccccuuuaacauuuuauuacuaauuaauuaauauaugugugucugagugcaugggcauaugcacacucauggaugugcaaugucaccugugugagggucagaugacaacuugcggggacugguuccuucuaucacuuaagucccgggcauugaacucagauugucagauuuggcugcaagcaucuaccugcugagcaaucuugucucugcucucccuuuaaucuuugagacaaggucucucacugacauguggcuccuaccaacucagugagaugggcgggguccagcaaguccuaggaauccuccugccucugccuuccagaccagggguugcagacacaugccauuuagcacaguguuugacauaggugcugaggaucugaacuggggccccugagguuuguacagcaggggcuuuuacuggcugagcgguuucuccauucucucauacagaauuuuguuaugguguuuaagaucaauugcucguucuucgagccaucagcuucaauguggaaugaauugaagaucuguaacaaguaaguagugauaguagcuaaacuguuuaaaucccccuggugagggccaaguguaagcaacguguucauguguaggcaccgugcaguguacaagaacuaggaacacacaauguauaacguaaaugaaggacugagucauuaugcaaaaggcuauaaaaugaucaguguuuacauacuuuacacauuaucauggccaaaaaaaaaaaaacaggcuuauuuuauuuuuaauuguauguuguaugugcaugugcacacacaugugagugcccgcaguguccagaagagggcaccagauccccuggagcuagaguuagaggaguugugggccacccugucugggugcuggggagcaaaggguggucugcaagagcagcgugaguucuuaagcugagcccaucuccccaguccccuuaccaucgacuuaugucagugguggcuuggacuggagugcagucugguuucuaguguccgcucucagccccuaaguuucuguugcaccucuuaucuuaggacucucccaggcucaugcauuuagauaugcuuuucacugggcucuguccucugguugaggcugcugcuugcucugauguacggagguuuuauuuguggcuucuauugacauguggaaaugguucagaaagcagucuuuuauauuuucuucuuucuuuuucguuuuucugugcaauauaauauuauauccauauauauauuuuaaauguuuuauaugaauaaauguuuugcauguauguauguauguauguauguauguaugugccuggugcccagagaggucagaaggcaucagaucaccuggaauuagacuuuagauaguuguggaacuaaacccagguccucucuuagcugcugagccauuuccccagccccuuguucaauauuguaaaccaaaaguaaaaugcuaaugaaguuugauaaccuauccccuggguuacuaaaaaaucuuaguguagaagucaguguaacaggcagaaaccagaacagcuguagucaagcuagcuaacauggcuacucugccucugccgagagagaccagauaguuuaggguucacaguagcucaccucugagaguggugggguauuagcuacaugggaagcuagggcaaaaaccaggacauaugaccucaccuguuuguaacuccuuucccuuguauaucuagcaaacagaucaauuuuccuacacacaacaacaacaacaaaaucaccugacagcugcugcccaauaguuggggaaaugagaaucuauucuaacuaggaaggaaauguguccagagccccgggucaaucugcauucuguguauguccaggacugaaagagccgaaggucaaagggcgacagggguacuuucacaagacacgcgcugcaagagagcucuagcaaaaccacggguuggaagcuggaccguuucccugccagguggacaagggauuuccagacgcugcagcuccacgcggugcccgaguguaaccuggccaaacuguccaggggccggccagcgauucacagcuccuuagcaaaugaccuugacuuagccggugcugugguugccugggguguaaaggguagugugaaggaaaggccaauccaaguuaaauaggaggagagugugaggaacauaaaggaggauguguucccagcuagcaagggagcaacagcaagaggcaggaaagaagguucugagccuggcggaggggacgaagcuugggcuacuuugcgucuuagguucacccuuagauuugggcuguuuuaaauuagaagguaaaccugcaagcaauaaucuaaguauuagauuuaucuaaagaccagagagggcgcgggagaagguuaaguuagcagcuuuuuuuggucuuagauccugcagcuuugcccaacaauguccgccggacccaacaaugucacuagcgcccucugccgaccaaguauuaagaucgaacuuuuuuuuuuuuuuuaaaucaaauucuauuuuaaauaaaacugcaacugauggggaaaacuuaugcauaugauacuugaaaaguagaaacaaucuaauuguucuucacauuuacaagccgaaaguccauuaaaaauaauaugagauacuuagaaagugacugugugcucuucaaacuguagggucuugcuaaugaacguguguucacccauuaguggugucuccaccccugggagcuuguuaaaaaugagacacuuuggaacccaucccagaucccucuaccucuaaacucuguauuucaguagauuuagggguuccacggauguucgcauuggagaagcacaccccaggccugaaaguucuuuuaaaaaauguaaggauuuuuaggcugggcaaacauuuccauugggaacacaugaaacuucuacauggaguuccaucaaagacaauggcaacaaaaggaaacaauguaaaaaccaugaagguggcugggugauucuuaggcacaggcagguccuguugauaccuccaccgguacugggggcccccucucugccgggaagggaagugcuccuguaguucugcugguugguuggaaaagugugugggggcaauguccagaagacaaggcaggcaucugguaaauaguggggucaggacacuuggguggauguuuccaaaucaggaugugguguacugaaggccaaugcuuccauguuuuaacccccuacucacacauccaguuaaagucagaagccaaaguccaacaaugcuucccaaaguggcugaaccccaggaguuaagucggacuugucgccuggcagugguggcgcacgccuuuaaucccagcacuuggggggcagaggcaggcggauuucugaguucgaggccagccugcucuacagagugaguuccaggacagccacggcugcacagagaaacccugucucuucucacucguuuuagugugccugccucacgcagcaucuucagagugcagaugccgccugcagagcgggacggaccuaccuucagcauacggauuucccgcagggcuauuuuccuaacgacacgaucaucuucagauuccacgaauuuuuugaucgcuacuacuuguccagaagauuuguuucugcacuugaauacaacgccauaagacccuucuccgaucuuagcuagcuuuucauacuuuuccauuuuaguuacagcgacuuaauuuuaguguaccggucgacuugaaguucagcguugcaccuggaaaauaagaacgacuuuucuuaaucaagcggauacaggaugguuugccuggguggcccaagguuuauuuccacacuuuaauguuugcuuuuuugugugcaguagaagugaacucucaaugguauuuuguuagcacagcucucuagucuucuggggucauuucugacaguggcucugugcugaccacauuuaguuaacacaaccaagccuuguccgauuuauuguuuuuauuaccuggaguaaaugauuaaaauacagggcuguaaaaugcagcuaagggggcuggacuuucauacccuugaauaaggaagguguuugccuucuuagcuagcucaccggaaccccaccgugaaggggaagaauugcgcaacaaggcagacuacaaagcucaacguccccaccugguggagaggagagggaaaaccauggucgcugaacaaggcggcuuuucucaggacacuauuuccuuaaaauguuuggauuccauuuauucugguuguuguuguuguuguuguuguguauaugagauauaugagauguguauggauaugauauaaaucugagguguauaugucuguguagaaggcgguaaauuuggaacggaugugagauugugugugugugugugugugugugugugugugacagcuagagugugguagucagaggacagcuuguguguaccgguccuuucuuaccacgugguccugaggaugugaccaagguuguaaaacuugccuggcaagugccuuuauaaucuguuccauccugcuggucaaggcacgguuauccuuucucuuucuucucucuuucucuuucuuuucuuucucucuuucucucuuucuuucuuucuuucuuucuuucuuucuuucucucucucuuucuuucauuuuguuuauuugguuuuuugagacaguuucucuguguagcccuaguuguccugaaacuugcucuguagaccagacuggccuugaacucagaccuccaccugccucugccuccugugcacugccaccaccuggcaaggcacucuuguucuuagcuuuuauuuguauuagggugaccaauucuuagaccaccccuaaacaaacaaauuauaauacaacaaaaaggucaaauuuucuaauuucccugcagucguuccauauccacaggacuucuuagaaaauacuagaucucauuuuuauuauuuuuuugcacuguuuuauguuuauaauuguggcuagauuaaacauucgaugagaaauaauaccaaaaugauuaaucaaaucaggguaggaauuaacauuauaaaaguuuguaaugagccucagaaaguccaccucuuuacccaguggaaucuuguauguauaaucuaauaacuguaggagcucacccugaaacagcagugcuuauuuacauauaguaugcuagggcugcuugauccaguuguacagguaagaaaauugaaacgcagugaagcaagugcagaauuacaaucggucuucuggguuccacacugcacaucugaaaucaccacacugccugcccugccucugaguuaauucauggcugucuuagucaggguuucuauuccugcacaaacaucaugaccaagaagcaaauuggggaggaaaggguuuauucagcuuacacuuccauacugcuguucaucaccaaaggaagucaggacuggaacucaagcaggucaggaagcaggagcugaugcagaggccauggagggauguucuuuacuggcuugcuuccccuggcuugcucagccugcucucuuauaguaccaagaccaccagcccagagauggucccacccacaagggaccuuuuacccuugaucacuaauugagaaaaugccuuacagcuggaucucauggaggcauuuccucaacugaagcuccuuucucugugauaacuccagcugugucaaguugacacaaaaccagccaguacaauggcauaacaaaauuuaaagaacugcucuguuuaggucuugguagaagagcuaacgguuaccauuccuugucuaacucagacaugcuuaauagauacuaggcucucaaucuugucagaaaucugcuaaaugaaacauuaaaugucuaagcucaauaugauagaagagccccuuccccccaaauccugacaguuuacccgccaaggucuccaagaagauacaggcacagcgacaagauucuaccuggauugugguaugauaaccacugaguaacacugcuccauugccuuucugcugccagggcuuggccuacaccauggacgaacagcggacacccagagagcuaaaugucuccuaccggcuaagacaaggugagucacuucucccacauuccuacuccacgggaaaagccucucaucuucugggccugagagucagacugacucaaguugcuauggagaccacaggggccugggaacugcuuagauaguggacauuaaccaaccucugucauuuuaauuaagggcaucuagauuguaaaguauucuucccagacuccuaacuacauugacggcuaagcuaacugcagcuugacaguuagaaacagaccucuagcuccuucccccagggugauccaccacccuauuagcugguuagacagauuugccuaacucauggacuugaugauaaaggauacacaaguucagaugcgagcuuucacagacauaaccuucuguuacuuccuuaccuaaacucagcuuccagggacuguuucgaauuccuuucccuuguuaugccacuguccuaacauuaauagaguucuuauaaauuagccuaacucuaauaaaacauuccaguauaugauccaacuuuuauaaucacagguucaaauuuuaaguuuccuuugauugucuuuuaacuauaaacuuaaaauguuucuugugcuacaucuaaacuaucagcuaucauaguuacacaaauauagauuuccuuuggcuaucuucucauuauagauuuaagguauuucuuaaaucuauaugaucaucuauuaucaagguuuuaaguuuccuuugucuuuuaaauguaaacuuaaaauuguuucucauuaugauuucuguuccaugaagggcuuuugucuuccugggcucaucuaaaagacucuucaugcaguuaacauacuuaucucuccuguaaacuuacaaucuccaggaaacccacucagaucgaccucucguggaucaaacagacucuauccagguaaguacaccugccaaucacuaaguuccuguaggaggcuguagccuccccuuuaggcugcccgagcugcaccuuaaagauggcgccugccagaugcagagcuggugguguaaacaaguccauauucgguggagacgugccccugccgcccugauuggcuga

SEQ ID NO: 8756 - RNA, 10508 nt, Mus musculus
ucagccaaucagggcggcaggggcacgucuccaccgaauauggacuuguuuacaccaccagcucugcaucuggcaggcgccaucuuuaaggugcagcucgggcagccuaaaggggaggcuacagccuccuacaggaacuuagugauuggcagguguacuuaccuggauagagucuguuugauccacgagaggucgaucugaguggguuuccuggagauuguaaguuuacaggagagauaaguauguuaacugcaugaagagucuuuuagaugagcccaggaagacaaaagcccuucauggaacagaaaucauaaugagaaacaauuuuaaguuuacauuuaaaagacaaaggaaacuuaaaaccuugauaauagaugaucauauagauuuaagaaauaccuuaaaucuauaaugagaagauagccaaaggaaaucuauauuuguguaacuaugauagcugauaguuuagauguagcacaagaaacauuuuaaguuuauaguuaaaagacaaucaaaggaaacuuaaaauuugaaccugugauuauaaaaguuggaucauauacuggaauguuuuauuagaguuaggcuaauuuauaagaacucuauuaauguuaggacaguggcauaacaagggaaaggaauucgaaacagucccuggaagcugaguuuagguaaggaaguaacagaagguuaugucugugaaagcucgcaucugaacuuguguauccuuuaucaucaaguccaugaguuaggcaaaucugucuaaccagcuaauagggugguggaucacccugggggaaggagcuagaggucuguuucuaacugucaagcugcaguuagcuuagccgucaauguaguuaggagucugggaagaauacuuuacaaucuagaugcccuuaauuaaaaugacagagguugguuaauguccacuaucuaagcaguucccaggccccuguggucuccauagcaacuugagucagucugacucucaggcccagaagaugagaggcuuuucccguggaguaggaaugugggagaagugacucaccuugucuuagccgguaggagacauuuagcucucuggguguccgcuguucguccaugguguaggccaagcccuggcagcagaaaggcaauggagcaguguuacucagugguuaucauaccacaauccagguagaaucuugucgcugugccuguaucuucuuggagaccuuggcggguaaacugucaggauuuggggggaaggggcucuucuaucauauugagcuuagacauuuaauguuucauuuagcagauuucugacaagauugagagccuaguaucuauuaagcaugucugaguuagacaaggaaugguaaccguuagcucuucuaccaagaccuaaacagagcaguucuuuaaauuuuguuaugccauuguacuggcugguuuugugucaacuugacacagcuggaguuaucacagagaaaggagcuucaguugaggaaaugccuccaugagauccagcuguaaggcauuuucucaauuagugaucaaggguaaaaggucccuugugggugggaccaucucugggcugguggucuugguacuauaagagagcaggcugagcaagccaggggaagcaagccaguaaagaacaucccuccauggccucugcaucagcuccugcuuccugaccugcuugaguuccaguccugacuuccuuuggugaugaacagcaguauggaaguguaagcugaauaaacccuuuccuccccaauuugcuucuuggucaugauguuugugcaggaauagaaacccugacuaagacagccaugaauuaacucagaggcagggcaggcaguguggugauuucagaugugcaguguggaacccagaagaccgauuguaauucugcacuugcuucacugcguuucaauuuucuuaccuguacaacuggaucaagcagcccuagcauacuauauguaaauaagcacugcuguuucagggugagcuccuacaguuauuagauuauacauacaagauuccacuggguaaagagguggacuuucugaggcucauuacaaacuuuuauaauguuaauuccuacccugauuugauuaaucauuuugguauuauuucucaucgaauguuuaaucuagccacaauuauaaacauaaaacagugcaaaaaaauaauaaaaaugagaucuaguauuuucuaagaaguccuguggauauggaacgacugcagggaaauuagaaaauuugaccuuuuuguuguauuauaauuuguuuguuuagggguggucuaagaauuggucacccuaauacaaauaaaagcuaagaacaagagugccuugccaggugguggcagugcacaggaggcagaggcagguggaggucugaguucaaggccagucuggucuacagagcaaguuucaggacaacuagggcuacacagagaaacugucucaaaaaaccaaauaaacaaaaugaaagaaagagagagagaaagaaagaaagaaagaaagaaagaaagaaagagagaaagagagaaagaaaagaaagagaaagagagaagaaagagaaaggauaaccgugccuugaccagcaggauggaacagauuauaaaggcacuugccaggcaaguuuuacaaccuuggucacauccucaggaccacgugguaagaaaggaccgguacacacaagcuguccucugacuaccacacucuagcugucacacacacacacacacacacacacacacacaaucucacauccguuccaaauuuaccgccuucuacacagacauauacaccucagauuuauaucauauccauacacaucucauauaucucauauacacaacaacaacaacaacaacaaccagaauaaauggaauccaaacauuuuaaggaaauaguguccugagaaaagccgccuuguucagcgaccaugguuuucccucuccucuccaccagguggggacguugagcuuuguagucugccuuguugcgcaauucuuccccuucacggugggguuccggugagcuagcuaagaaggcaaacaccuuccuuauucaaggguaugaaaguccagcccccuuagcugcauuuuacagcccuguauuuuaaucauuuacuccagguaauaaaaacaauaaaucggacaaggcuugguuguguuaacuaaauguggucagcacagagccacugucagaaaugaccccagaagacuagagagcugugcuaacaaaauaccauugagaguucacuucuacugcacacaaaaaagcaaacauuaaaguguggaaauaaaccuugggccacccaggcaaaccauccuguauccgcuugauuaagaaaagucguucuuauuuuccaggugcaacgcugaacuucaagucgaccgguacacuaaaauuaagucgcuguaacuaaaauggaaaaguaugaaaagcuagcuaagaucggagaagggucuuauggcguuguauucaagugcagaaacaaaucuucuggacaaguaguagcgaucaaaaaauucguggaaucugaagaugaucgugucguuaggaaaauagcccugcgggaaauccguaugcugaagguagguccgucccgcucugcaggcggcaucugcacucugaagaugcugcgugaggcaggcacacuaaaacgagugagaagagacaggguuucucugugcagccguggcuguccuggaacucacucuguagagcaggcuggccucgaacucagaaauccgccugccucugccccccaagugcugggauuaaaggcgugcgccaccacugccaggcgacaaguccgacuuaacuccugggguucagccacuuugggaagcauuguuggacuuuggcuucugacuuuaacuggaugugugaguaggggguuaaaacauggaagcauuggccuucaguacaccacauccugauuuggaaacauccacccaaguguccugaccccacuauuuaccagaugccugccuugucuucuggacauugcccccacacacuuuuccaaccaaccagcagaacuacaggagcacuucccuucccggcagagagggggcccccaguaccgguggagguaucaacaggaccugccugugccuaagaaucacccagccaccuucaugguuuuuacauuguuuccuuuuguugccauugucuuugauggaacuccauguagaaguuucauguguucccaauggaaauguuugcccagccuaaaaauccuuacauuuuuuaaaagaacuuucaggccuggggugugcuucuccaaugcgaacauccguggaaccccuaaaucuacugaaauacagaguuuagagguagagggaucugggauggguuccaaagugucucauuuuuaacaagcucccagggguggagacaccacuaaugggugaacacacguucauuagcaagacccuacaguuugaagagcacacagucacuuucuaaguaucucauauuauuuuuaauggacuuucggcuuguaaaugugaagaacaauuagauuguuucuacuuuucaaguaucauaugcauaaguuuuccccaucaguugcaguuuuauuuaaaauagaauuugauuuaaaaaaaaaaaaaaaguucgaucuuaauacuuggucggcagagggcgcuagugacauuguuggguccggcggacauuguugggcaaagcugcaggaucuaagaccaaaaaaagcugcuaacuuaaccuucucccgcgcccucucuggucuuuagauaaaucuaauacuuagauuauugcuugcagguuuaccuucuaauuuaaaacagcccaaaucuaagggugaaccuaagacgcaaaguagcccaagcuucguccccuccgccaggcucagaaccuucuuuccugccucuugcuguugcucccuugcuagcugggaacacauccuccuuuauguuccucacacucuccuccuauuuaacuuggauuggccuuuccuucacacuacccuuuacaccccaggcaaccacagcaccggcuaagucaaggucauuugcuaaggagcugugaaucgcuggccggccccuggacaguuuggccagguuacacucgggcaccgcguggagcugcagcgucuggaaaucccuuguccaccuggcagggaaacgguccagcuuccaacccgugguuuugcuagagcucucuugcagcgcgugucuugugaaaguaccccugucgcccuuugaccuucggcucuuucaguccuggacauacacagaaugcagauugacccggggcucuggacacauuuccuuccuaguuagaauagauucucauuuccccaacuauugggcagcagcugucaggugauuuuguuguuguuguuguguguaggaaaauugaucuguuugcuagauauacaagggaaaggaguuacaaacaggugaggucauauguccugguuuuugcccuagcuucccauguagcuaauaccccaccacucucagaggugagcuacugugaacccuaaacuaucuggucucucucggcagaggcagaguagccauguuagcuagcuugacuacagcuguucugguuucugccuguuacacugacuucuacacuaagauuuuuuaguaacccaggggauagguuaucaaacuucauuagcauuuuacuuuugguuuacaauauugaacaaggggcuggggaaauggcucagcagcuaagagaggaccuggguuuaguuccacaacuaucuaaagucuaauuccaggugaucugaugccuucugaccucucugggcaccaggcacauacauacauacauacauacauacauacaugcaaaacauuuauucauauaaaacauuuaaaauauauauauggauauaauauuauauugcacagaaaaacgaaaaagaaagaagaaaauauaaaagacugcuuucugaaccauuuccacaugucaauagaagccacaaauaaaaccuccguacaucagagcaagcagcagccucaaccagaggacagagcccagugaaaagcauaucuaaaugcaugagccugggagaguccuaagauaagaggugcaacagaaacuuaggggcugagagcggacacuagaaaccagacugcacuccaguccaagccaccacugacauaagucgaugguaaggggacuggggagaugggcucagcuuaagaacucacgcugcucuugcagaccacccuuugcuccccagcacccagacaggguggcccacaacuccucuaacucuagcuccaggggaucuggugcccucuucuggacacugcgggcacucacaugugugugcacaugcacauacaacauacaauuaaaaauaaaauaagccuguuuuuuuuuuuuuggccaugauaauguguaaaguauguaaacacugaucauuuuauagccuuuugcauaaugacucaguccuucauuuacguuauacauuguguguuccuaguucuuguacacugcacggugccuacacaugaacacguugcuuacacuuggcccucaccagggggauuuaaacaguuuagcuacuaucacuacuuacuuguuacagaucuucaauucauuccacauugaagcugauggcucgaagaacgagcaauugaucuuaaacaccauaacaaaauucuguaugagagaauggagaaaccgcucagccaguaaaagccccugcuguacaaaccucaggggccccaguucagauccucagcaccuaugucaaacacugugcuaaauggcaugugucugcaaccccuggucuggaaggcagaggcaggaggauuccuaggacuugcuggaccccgcccaucucacugaguugguaggagccacaugucagugagagaccuugucucaaagauuaaagggagagcagagacaagauugcucagcagguagaugcuugcagccaaaucugacaaucugaguucaaugcccgggacuuaagugauagaaggaaccaguccccgcaaguugucaucugacccucacacaggugacauugcacauccaugagugugcauaugcccaugcacucagacacacauauauuaauuaauuaguaauaaaauguuaaaggggagagcaauuaagaacaccugauuagccgggcaugguagcgcacgccuuuaaucccagcacucgggaggcagaggcaggcggauuucugaguucgaggccagccuggucuacagagugaguuccaggacagccagggcuacacagagaaacccugucucagaaaaagaaaaaaaaaaaaaaggaacaccugaugucaaccucuaggcuccauacacacaugcacacacacacauaugugcacccucgcacauaugcacauacgccaacacacaauaaaagaaaaaaaaaaacccuucugcccaggagcuagaaugauaaaggggcguguccuccuagcaucagagcauaucugggacagcugugaacggaaccgcaucacuaaccugugcacuucacuucuucugcagcaguugaaacacccaaaccucgugaaccucaucgagguguucagaagaaagagaaagaugcaucuaguuuuugaguacugugaucacacacuguuaaacgagcuggagagaaacccaaacggguaagugauccagaaccuggaguucuuuggccaguucucuuucauucuguguguagccccaaaaggaucccagccccagccucccagccccaccccaacccccgcuaccaacccccagcuucacguaggaugugcucaaaggguaauggcuuuuaaccuaaaguguaagcagaagaaacaggaagccaguauaaaccccaguguagcuuggugggaaagcauacacaggguggucugaccucaaggagcgaccauaauucagugcgaggaaauccaaucauauggcccaccagcaagucaacacguaagagcacccacuggggcuggagcggcagcucucuggucaagaacagcaaguccugcucuugcagaggccccagguucgguucccagcacccaugugguggcucacagccaucugucacuccgguuccgggggaucuggugcccuuugcuggccuuccugcauacguugcagacauacauguaggugaacagucagacacaauaaauaauaaauaacucuuuaaaagagacaacuacaggggcugaagagauggcucagcaguuaagagcacugacugcucuuccagagguccugaguuccagucccagcaaccacaugguggcucacaaccaucugugaugggaucugaugcccucuucuggugugcaugaggacagugacaguguacucguauaaaauaaauaaguaagucuuuuuaaagaacgcaacuacauaucugacugaaaugauuaaaagauuuuauugaaaugagcauguuucuagauggaaauaccuacuaugagaguauaaacauguugucucaucggguuuuuuuuuuguagcacagaauucuaacuagagcacaaaucggauauuuuuuaaacuugaaaagugagagccaagaaauuucuuaaagaaggaaggaaaaaacaggguuuaaauacagaaguuuuggcaauugcuuucuuuaaaaaauaaagccaugacuaaaacugaaaaagaauuucaauaaacuauuaucaccauuaauaauuuuucaaauaguguaagaugagugcugugguauaccagaggcugagacgggaugauugcaaguuggcgauuaaccugagcaacuuagucaagacccggucucaaauauauucgaaaggguuagggguguagcucagugguacagagguugccuggcgugugcaaggcacagggguuccaucugaagccaccacaaacaaaauagguaugcaggccucuccaccuagacaggguguaacuagguagaucauuuggcagugaguaugaacauuuagaaagcuguugucacacuuaaacgcaaaacuccacuuagaaaagauauacagcaagguauuuuucccauaagggcaaaauuauacauauucugaaagauauuuagagcagagaagauugggagugaccugauuuuccaguaguaaacaacugcugagcugagacauggcugucccucgacaaguccaucccuaccuccuuuuggcaguuuauuuucuuuccuuuaaccccguggaaagcgcacgcccuuaaccucagugcugggaaaguagucagcagaucccggaagcuggcacuuuagcuacuguagcuaaaccagggaguucccggucuaaugagaaacccugucucacaauaacaauagguuuggagagaugauuccgcuauuuagaacacguacagcucuuccagaucugaguuggauucccagguauucacgacaggugguucaucacugacuaugacaacaguuccagggaauuugacaccucuagccuccaaggguacacuugaauuuacacacacacacacacauacacacaugcacaccugaaaaauuaaaguuauuuuguuaaaauugaaauagaaaauauugaaaauaaaauaaaucauuaaaaguaauaauuagguggauagaagaagaucccaagaaaccaaccucuggaauucaacacacacguacacacauguaugcacauacagaaauaccuauacaugcaucucuuucacacacacacaugcacgcacaaacacacagcacacacacguaugcacauacccaaauaccuauacaugcaucucucucucccccucucccucucccucucucucucucucucucccucucccucucccucucccucucccccucucucucucuugcacacgugcacgcgagcacacacacacauacacacacgcgcgcgcgaauuuguaaggucagagucaucuucaggugacuaaaauagcaguuucugagcuggguagcucgagacaccuggauuuuagcuucaagcuuuucgcuguugcuuuuaguauuugucucuacacucucccgaaggauaauaccuaaacaccacguauccaccgauuucuacagagggcgcuauuucacucuauaaugcuuugaaaacugcugccugcggcagaacagcauuggcgugcucucucuccggucuggacguggcgugucuaucuacggucacuacaguuccaucuccucuguaagaucaaugugauucaucccuaacgcauaucauccucccagcaguggacccugccuccugggcaucugagccaagugagcagaaccaugccgccccaguaagaaagcuuugcguauccuauugacgaccgauacucccauugaacuagcucugcuugguuucucguuaacaacguuagcagucaggguucugaaacauuucugaccccucauaccugccuuguuuccuaggucuccucaccuggagucuccgaguaccuauccagaauccuaugucuguugauauaguagccuagugcuggcgccuguucccugaagguggaagccaccccuc

SEQ ID NO: 8757 - RNA, 2285 nt, Mus musculus
agggagaugaagacugaaaauggcugaauaaacugcugauagaagaacugguggucgugugguucuugcuggucgaggguggaugcgacaaaugguggcccguacagagaaccgacuuccccaccaaagaguucagaacuuucagcagucaguguuugccggcacgguaaguucacgguaagugaaacuuacgaccccaggaauuuugggaaggaccucagauaaaacagaggugaauauaaaguugccaggaagcaggcacaaaguaaaagugaaaccaugggagcguccucaucacauccgauuucuucagcucuucaggagcuccuuaaguccagagguuuaaaaauucaaagaaaaaccacagaaaaguuucuugaugagugugaugccaucgcgccuugguucgccgucucaggcaaccucacagucgcuagcugggagaagcuagguagggacuuagauguugccugggagcaggggauauugaagggaggcaugagggcaguguggaagaugguaaggagcuguuuggaugaugaacgcuguugcaaggcgcuagaagcuagccagcaaguucuggagcaguugaaagaggagaggucauuaaaaucugagaagguugagacauugucaagcagcucagaaagugaaacagaagaggaacuggagcgguuagcaaagaguguggagaaaaccaaauuguacccugacuugacugagcuaaaaaaggagaaguugaaggaaaagggaaguaagaauaagaaaggacacacagugccaucugguggacagaaaggacaaaacaaaagagccgagguggaggaggaagacaaauuagcuucggagcacccucccuaugccuccucagcagcagccuauggguggaccuucuguccggagguuuggagagagguuagauccuccuugcugggauguccuauuuucacugaccaagcagggcagagauaucaugagccucuagauuucgaaguaaugcccuugauaaggcaguugguuuaugaacaauguacccgagaguguagggcugccauuacgccuuuaaaaagcaaggguaucgaggcauggaugaagguuugccaagagcuuggugggccauugaccaacgcuggucuugccgcagcugucaugcaguugcaaaagaggaagagggaugugccucccggagcuugcuuuagguguggcaagcauggacacuugaagaggaauugcccugaaaaagaaaggggcucugggggaagcagaacucgcccccccuggguuguguccaaagugcaggaaagggaaucacugggcuagugaaugcagaucagucaaagacauccauggccagccucuuacuccuggauauggaggugcgcggccaagaaaaggacagcggggcccucgcucccagggcccgcaaauauauggggcaguggacaacucccagggggcggaggagacccggccaacacugagacauccccgcaaccgcggaaagccacugaagguuuagcaggauuggaccucugcucuaccaccagaaucguauugacuccccagaugggcacacaggugauugagacagauuuuaaagguccucuacaagaggacacuguaggauuguuauuuggccgcuccucgucugccuuacgugggcucauuguccauccaggaguuauugacccugauuaucaagggguaguuaugguuauggucucaucaccacgagguauuguguacaucuccccuggggauugaguagcucaaauuguccuuuuaccuagccuucaugggcgcuuccccuccgcugguaaacaaagaggaaaaggaggguuuggugccucggacguagaccugacaugucucucucuccagauggaccagcguccaguucuggaguugaagguggauggcaaggccauccuagggcuccuagauacuggagcugaucacagcaucauagcacagaaggauuggcccuagggauggccagugcaaaguucuaaucagaugcugugaggccuaggguaugcaaaagcuccggauaugagugcauggaaucugaaauggaaagaugcugagggccauucaggggaaauucagccuuacgugcuggagcuccccauuucuuuauggggaagagaucuauuaaaagauuuaggcuugagacuuaccaaugaaucuucaccuacuucucgacaucugaugcaggauaugggguggcucccuuccuauggguuagggaaauauuuacaaggaagaaagucccucauaauaca

SEQ ID NO: 8758 - RNA, 147976 nt, Mus musculus
ccgagggucuuucucaccuuucugauggggaccuccuccccuaaaccuagaagaaagggucggggcucucggauguacuugcucuuagaaaguuggggaauaccgucuugugcguggcaacuacuaccugcuggggcuggggcugggaccacaagcagcgaguccaacuuuguuacccggagucuggcgcguccggcgugucccgaccgggcgcgcgagccgggggcgcgcagggcccgccgggagcgcgcggccuccgggauggcggcugcgcaguggcgagcggggccgggaaccggagggagggcgugcgggcgggcggagcggagcggcgggcggaagccauguuggaacugcaccccgagcgaggggcugcgggcgcgcuccucuccuggugggugugacccggcucggcgcggcggcggggggcggggacgccgggcggcucgucguggucggcggcggccgcggcgugcagccgggcgauugugaccggcggcggagccgggccggccgcgggcgcucccuccgugcggcccccgugagcgcccccccuccccgggccgggagggagguggggggcacccggggcccgccaugaacccgggcuucgaucugucccgccggaacccgcaggaggacuucgagcugauccagcgcaucggcagcggcaccuacggcgacgucuacaaggugagggcaggggcggccgagccggggccugcgccgcgggggacggaacaaagaggcaggcguggggaccucagcccucggcguccucgccggagcugugcccgggacgcgcgggucucugacccucccaggcucuccugcgugcagucccgggaagggcugcggccggagccgcugcguuccugggagggcggagcggggcugggcgcuuguugccugggcagggucugugugacgaaccccggugcuggggcuuggcgcuugacaaaccuacgugccucuccgggaccugggaucauaggccccgguggcugggagcuacuguccgcccgggccugcuggaucuguccuaacgcugggcagccuccaucgacagcuuagccuuuagccucuuaacaucugcccgugcuuuagccuuuagccucuuaacaucugcuugucaguuccuuguaauuuuccaaguagucauguuuuguaaaaagagauggguuuuuggaggcaagacagcaacuucgagguuuuuuuuuuuuccuccaaaaagaauuggauaaugggguuuguuuuugucagugacacauaggaaucagauauuuuuccuuuucuuuuucuuucuugugugugugugagagucgaguaucuaggaagaguauugguuugacaagguuagaauucagagcuccuuagcaggacagcguuucuguugcagagggaucgcuucuaaaugugggaggauaaaucguucuucccuggccaguaaaacucuuggccucgcggagucugccaagaagggaggcggauagugccaaagguggcagcagucuugauuuaguugccuaucuacuuacaugguaacugaaguugggcuccuguuuuccagaacaccugaggaugcccagaguaugacuuggaaaguuuaguuuucacuuuauuuuugcccacgcuaaagcaaugggcuuuuuauucuugccucaauggaacgcauaagguaaguuagccaauaccucaggucuuuugugagugaucugcuuggcuuuugugaaugaucacauagcaccacacuuuccucuguugacaaagguguguggagcauaacuccaguguauaacuuagcagccacguguugaugaacuaaagacaggaauggacccagauuuauuugaagucuuuuuuuuuuuuuuuccuggacaagaacagcauuaaacagcagaguuucacuucauuccagucguauucuguguagagaggacgucaagggucuggcaaagguugcuagcacagaacaagagggcuggguuuguccccccuccagucuggcagcuucuagccaagaucuggaagaugauaaggccuugcucagggcaauggugagaggggacgaagccacguagaggggucaugauccgaaggccacagacaccagugugaagcugagaaagacggaaccugagcagccacagggauccuggauguggacccugguuccuauagaccuucuagcugugggacuuaggggaguccugccagggaggugaaauuagauaaggauuuucccuuucguuuuuaaaaguguguguguguguguguguguguguguguguguguguguguucacacagagaugucccuggaggccagaagagggcaucagaucucuuggagcugaaguugcaggcaguugagagcugucugacaugggugcugggaaccaaguuggagucauggaagaacagccggugcucacagcugcugagcugucuuuccaggccccauuucuuucuuuccuuuugguuguauuuuuuugguauacaggauuuugcuguguaucucaggcugacccgaaagucauaauccuccaccuguguccccugaguggagguguagacaugcaugacugcauccaauuuagauuuggacuucugggcugaggcucaggcuugcuugaguuagaucuacagaacacacgaaaaguguaaugaggauaucaacuucagaguuguccucuggccucuacagguguuagaugacauguuacucacacacacacacacacacacacacacacacacacacgugcacgcacaugaauauucggacuuuaaaagguuuccuaucaugauguccagguuguaguggagggagagagcaguuaggaagcuugggguauucaugggaauaauaguggucuugacuaagaugguagaaauauacccaaauccaagagcuagaaacugucugggggaacucugauuauuauaguaggugaaaaguuaaauuuucugucucauaaguggcaguguguacaguuaaguuuuggcacacgugccuguuuuucuaggucuugagagaguucucauguugcccagacugacuuggaaauuguaauauagccaagaaugauguuuuaccgagguuauauguagguuccugauaggaauaauuagccauguguuuacuauauuuaaaaacaaaccuaaacaacagcaaaaccaagaagacagcuugguagcacaugccuguaaucucagcccuugggaagcugaggcaggaaaaugcuggucaccaguucagggccagccuggccuacgugguaugaguaacagaauaggacugccucaaagcaaacuccuuaaauauaggugguaacuuaccugacuaaaaagaaaaaauucaagucuguaauucuucuaucugaaugugacagaagucuggcaaguugaugaaucuugucagccauuaaugcuggaguagcuaacauuucuggggugcuugcuaucuggcacacacuuacggaaaguuuccucccuccuccuacaacugucuugugaggcaggugcaguugaagaagcaggcauagggagguuuaaauaacuuucuaaaguugguagaugucagagguaaaagcugacuaguuuguaggcuaggaucuccgucagugggaggcaucgucucuauaaacaugggcugggacagauuguccugcugaauuucccagggaggaaacugaggcacgcuugccuugggcuuuuggacugucccauuucugaguuuggaguggcucuuuuggccgcuccuuacuugauuguguagccugccagugcacaucagagaaaagaagcuugauucuggcgugccagacucaucaccagagacccuggugaugucucugucccagagagucacuguguggugucugcaucauaccuccugccugcuucgucgcccagagcugaaccuuccuuccuuuuuacagccaagucacgcugugaagacacaccuuuuccacauuuguuugcuguuagauguuucugacacacaugcuccugaugagcuggagaaaagugauucuuguuucuaaaagccaguguaugagcguugcuccuuaagcugucagugaguaggcgcuaaaaauggaacgggucuauuaaguaaguaaguuaguccuaauuauaguaauucuuggaagguugguguuucaagggauuuuuauuuugaaaacucuccacccacuacagugacacaguuacuguauuuguagcuugguuauagagcgcugaucugggauguugaggaucugggauccagcagcuaugcggcuuguaaaacauacuuagcaucacaggacuaccuugucugggacuguucuugcccucauagguccuuucaguuggugcuaagugaacgacuugaguuuugccccccaaauaaauuuuuucccuuucuuuucuuuuucauuuacuccucccuuccuugcugccagggugauccauuucaucgacacugucggagaguacuugaauauacacuuuuaaaaagagaaauuccacacaacugugcacagucuuuaucagccauugagcauuuguacaaggguuaccuggguacugugagacagauacaugaagcuaugauugggccccgagaggaucgugaaguacucugaaauuaagaaacuuuauguuguauguguuuguucuuuauuuugcauguggaauggcucagcaagcaugccuagucaugggccccauuugacucaggagaguaugaaugcagcccaaacucaaaaucauaaauuuaccuaauaggugagggggcgggggggggggagauagagagauuuuuaguucaauuccaugguucuuaagugugaaccuuuuagaugaauaugcugcaucacauguuaaaagguaacauggaugugauguaagcauucuucauguucucggugagaauguagugagcauagauuugucauuggaagacuauuggagaaauugggaaguuuuauauagcucauccuguccacauauaauaucuucauguguuguacugugcuuucauacacaggacacuuuuccaguuuaguuuaaauuacuccuaccccuaaagucuuugcuuuuccagguuuauuucagaaaacccauuauguagucuuguugcuguccccagcucuagcuaaacccuggcuucucuugaguucugucccuuuuccuugcacugaucuuguugcccacuaggcgggccuccguguggugugcuauggccugaguccacggagccaucucagguucuagaugagauucucaggcauugaucacagcucauacacaggggaucucuaagcauugguggacgcuucagggaaggcugcaccguggguuuauuaaagacacgagagaguucagagggugaaaagagcuuucucuaaagcuucacagucugcaguugaugccaaguaaugguggaaggagaaaccugucuccauagaguugcccuuugacccccccaaacaugccuuauaaaagcaacaacaacaacaauaauaguaaagguuuagaagucccguguuaagccugcuaaacucugugacccagcaaacuucaagcuuagcuugguuauggugcuucacuucuccuugaacuagugucacuuuggaaauguugacaauauauuauuuuuaaucuacguauguuugaaaaucauuaucucagaaguaaaggcuacaguguaguuaagcuccaaagccccacuuauguggccgucuauauaauaagauuugaaauagauggggaauugggcaggagaaaacauugagacauaggguaauagagucagaaaaucaauguguaguauuuagagaaauguguguuagcuuccuuguaacugcgucuuuauagguauccagaugucaacaaagacugguuuucccgauauaguuagcauucaccaaaauaaaacuuuguaaagcucucgggguuuugcugguaguuuguuuguucauuuguuguucuggaggcagguacucucguagccauagcugccuccgguguacuaggacugcaggcucugcuaccacaucugcuggaacuguuguuaauucucacuucugauggagaaugaagacucgaagcacucgagaacagcugggccauagcuggcuggauuccugcucacaucuacuuccguggacagcaaagccuaccgcaauaguucucaucguguggguugugaccuccuuugugggggaugucuaaugacccucuucuggggucaccuaagaccaucagaaaacacggauaauuacauugcaauucauagcaguuugccuucagucuuugucucauguagucccuguaaauccacaucacacacaugguuuguauugagaugaguaauugguaaauugucuugugagaaaggauugaacagccaccguacacuggacagcucugauagaaagcugacaugguagggacagcgagcgagugguaaaaacggcaggguuuggcacauaguauuuauaggaaaguaaaguguauguccacuuuuaguuauuagaguuugagaccaaaaccuuacugguuuccucauucaacauucccuagaugccucagacucuccacagcugagcugucugugucaccauggcaaccuaaagagcagguucuagagccaggcucccuguguaaucacccacugacccccgccuccucugugugccggugaugccugcgaagguguuaggacugucauggccaauugcugcucgugugacuacaucuuuuuucugcuacccucacacucaucuuuguuucuucuguacuuccugucucuacuuagagucucugccuccuuuccuggcgucuagauggauugucuuuccauuuccagcaugucucagggcacgugguuaguauaauagaaaaauguacuugcaaguucuaauaucacuuuuaauaagucugucugugacccuccacccacugucuguccuucugggaaauaucuagauuugguagaacuggaauacuuggugggaggagcuucauuaggaauacaguaaguuagaauuaaacaauuugccaccaaaagugaaugcauauguauagcgagaaaagaucuuccacgaaagcauuaucagcuaacuuagaggaaggccccuuucuccuggguuuaagcaaugcucauguaaaauguuccugauagcaagcuggcacugugcacaccgaccacucugugugccccagcagcucucugcagccagagaagccgugcaagcaccaggcucucuuuugguuacauuuguagagaauucagcucuccucauuuuuucugagcuucucauuauugcaugugucacuaccugucaugucuuaccagaguguaaauccagagcgauuuugcuugauucagugcuguaucuugagggccuagaagagugacugauaguagauucucgaggaguaucuggaaugaagaagauggcaacgcaggagaauggcagcuauguggguagaggacagaccauaguuuccgacgggcagagcucacagcacaguacugcugggccaguccuaaggcucuggcauuagugggcacagaacguaaaguugggcauucggauccgaaggccuaagcaaggcucagaguuacaugcacgagaagucacuguuguuuuaugcugaagauuuaauggcuguaaguggguuugauaaccccuaacccaacagucuaaauuacaaaauaguccuaaaucaaaacacuguagugcugacugguguccagugggggauccaguccuggugugcugagaacgcauuaguaacauucuucuaagcagucugaccagcgcgcaugaagcagcugaacuucaccucuagacuuaguccuaaacccaagaucucaccaugcgcaugugauauuuaaguguuuagagagaucagaaaagagugugguucaaaguacuugcuaaggucucaucucuaauaaauacaccacuagguucuucuuuaaauguugcuguuugaaaauaugauugaauuuuuaggaaaaggacuuugcucagcaauaggaaaaaaaaaaaccuuaaauucaagaaauggaauuguguuuucuuuuugcuguuugguuuuuacaguucuuuuuuauaaucuggaagaggcuguguuucuauugcaacuaccucaacccgagauucuagauuaggguucccagugcaacagugcuggcuggcuuuguccuguaacugugugacugguuuucaguaagacauucuuguuguuguuguugcuuaaacucuucuuagaaauuugaaguaguaaguuuuuuuuuuuuucuguguaaaucuuccaccugucuuugacugaacacucucuuggcugcuuauagguuaaaagauacaugcuuaaaccuaauucucaaggcucaguggucccaaaggaccaguaagauuuagguaucauggaggaggcagggaagagagugggcagccaucaaggugaagauggguaaaggucugagaccuaagggagagauugacaagcauggaaggcauucgaggugggguauggagagaaaggauuugcuggauaaagcagggccagaccuguugaaagccaggggauguggguuagagacaauaaguagcaugggcuccaggagggagcucagaaggcuuuccugugggaguaauggugcuagaaguguccuguaguauucugacagucacaacaguggaucugaggggaagggcaaaaacacuugugagacacacacacacacugauguuguggauguuagugacagccauugcucuucaccacaguagcaaauauaucugcgaaauaaaaacacugcuaguaauaaaccggucauauuagaauaaaucacauuuuaaugaaaaauaacuuuucuaaacaaaaaaucgaaugaggguggccuugcuguuguuuugaguguguuuacugucuguuuaaagaggccagagucucaguucuccuuuucuagccuguggcgaugcuuggcugaaauacaugaagaagaucuggucucacaaguguggaguuggagaagagcuagagauuuuagguacuuguggcuuccucucucauugccugcucuugagaaguggugacuucuuuaggguuaauugcauguggagcuagaguggcggccagucugcuugcugucaugguccaguugccaacccaaccuuccagcucugucgucccuguaugauuguguaucuucgugcuuuggccauuuggaaaaaugcagguuuccuauguuaucugggucuucuucaaaucccccaaacaggcuuuuuauguucucaaauuagaaaggucuugagcuguguuuccccggagucugauucugcuuaaagugcuagcuggauguauggcugccacaaaugcugccuaucaguuguuuuauugaugugacagaugcauuuaauucauuuucaagaaaaugucugucauauaccgagucaugagcaacccagguuaucuguagccauuuugaguaaaacuggcaugccguggagaaguggcuagcucggcuugcaacccggucgcagaagagcugugguacugcaggugugucucucguauacgucuagugucaucacauaggauaugagauggcauguuacagugucaagauuuaaugaaaauaguuaacgucguacuccaacaaagacacgcuuugguaaaaacaaguuucccgcucugagucuggggcagugaagagugcaugagugcuaguuacugugugucuacuuccuugguuugugcuaaggcuuagucaugguggcaaauagcacuuuuuguauuguucugaaaauaguuuugacuuccuggaccaaaaagaaucucaggaaguuucagggacccugggacugugcuccaagguuauuugaaguaagcuaaggauagguguuugagucuugucacuauaacaaaacgccugagaaaaccagcuuaaugaaaaagaaggcuuaagcguggcuuauagcuugaaagguuuccaugccugggcacucagccugcuuccucugggccuguggaggugcagucuaucugucguggcugugguagugcgugcuggggaggcuuguucucaucacagcagcucagaggcaaagaguagcaggaagccaccgggccacagucccuuuuaaggcuuuguacaaggacugaggaaaucaguuucuuuugaggacugaagcauuauuaggaagacauguaaagcccuuaccucuuuucaaaguacuacagauucaaauagcaacgucuaaaaggaucaguggaccagcauauauaucuuauaaaaauuaaacaauaagaaaaaauaauauuuuaaaauagauaaauacuuuuaauguggcgauauauuuucuaacaguuuuuagacauaaauauuuuacaaauuuguuuacuauuguauauuuuaaaaaauuacagagggcuggagagauggcucaucggguaagagcagguacugcccuggcagauucucagguucaguuccaggaccacaucaggccguagucugucaucuccggcccugcguccaggugaucucacacucugggcacccagggcaccuccaugugcauggcacacauaaauagauagaugacucuuuuaaaacucacagugaaguacagauuauauguuucacucauguggccuuugacauauauacagcuguaugacccaguuucguaguaagauggacgguuccacacauuucagaacauuucaggaaguccccucuugugcuccccggcugaaccacacagucgugaugccccacuucaucccauaguuacucuugugauuucugucaccgugaagugucuuuugaacugagugugcguggaucacagaugagugcuuggcagcuggggaaccaccuagcugcacacacuggacccuugcaggcuugcccuccucugcuguugugcacuguacuuucauggcuccuucacugccguggucacuguaguuuugaaaguugaaaucagauaauguaugucuucuagcauuguuauguuuuucacaauugacuuuucuauuuacagccucggcuuuuuuauacauauuuuaggauuaguuuucaacauaaauacaggugcuugcuggaauuuuuuaaauuaacaauaauuguaaacuuuggaauguggcaagaaguauagagcagucucagggcacagaacucaaccauccuaauggucagauccaaucugcacagcugacugcugcucaggcugcuuuuaccgcuugggcgugcgcucauuaaaaaaaaucuuugagaaucauuaucguuuugcaguauuuuaucacauacauagccagcugggauuuugauuggaguuguaugggaucugcagaucaauuuaugaagaauuaaggucuuaccaacauugaaucuucucaucucuggguguaauauaucuauuuauuuagauccuuuaaaaacuacaucaauauuuuuuauuuuuuaaaaauucauaaauuuuaucccuagcuuauucugcugauacuacagcaaaaagggaaucaugggauacucaacgcaguacaucagucauuuuugugagccacguuuuuaugucuuacgagagucuucacugugcuagugauaucugaccuccuuuggcuuaaccuuguucaguuuuaacccagagcauauggacuccucuuaagaaaugaggagacuagaaaaaugacuauuuaagcaaaccuacuucuguaugucaaagaugaaaacaauggucuuauacccucagcuuauuuuuauaugugagauauuguuauauuuauaugugaacauuuugcagaaugcaucuucuuugacuuuagaaggaaaaaugcacuugaagguuguuucauauucacaggaaaagcaagcagagagcaacgcuggguuguuuagaagagcccacuguguuccuuucugauaaccagcaguuuaugcucuaauggaaggaaacacacuauggacagagagcacagcuaagcagccuuccuaagguagaaguugaacacuucaggguaacaaugaggcuuuagaugagaaaguuaagacuuccuggaaacacugaucuugcuuuagugcuuaaggaaaaauugggucucuguaaagaaucacaaggucagucagaaggaugugggcuggguagaguugguaaauuguuugccacgcgagcaugaggaucuggguucagaucccuccagugcccacacaaagccaagugcaguggcgcacgccugugagccaguguugggcaggcugagauagaggaucccuggggcugagaggccagucgcucuaacccagucagggagcucugcgugcagugauagacccugucucaaaaagcugagggcaagagcgaccgagggaggcacacaugcacaugcgauauaaacauauguauacauauacugcacacacagucacuccugugggauugaaguggacagaaauaaucgguaacuuuucuuagucaugggcauauggggaaaugagauagaugaugcuucagaaagcuaagaugcaggugaguaccacuuuagaauuugcagggcuugucagauggcucagcagguaaaggcuuguaucaccagccugaugacuugacuuugaucccugaaauccccaugguggagagaacuggccucuggcaagcugccuuccacauccauaaucauaccacggcaggugcccuccucccacaguaaauacguggaaugcaguuuugaaaagaacuaggaacacauaauuuacuuuguugugcuuuucauuagugccaaucuugucuuucugauguuuggaagcuguugguugggauuuggugacauuucuuaccaaaucucuccuuccuacccacucaaagguuuuguaguuuugagguugcccauagaaugcccggaugcauggugacucuggauacucccucuguucugguuggcugugcuggcucacuuuggcucaugaaugcugcagguugcuguguggaccuuuccugucuacaauggcugucucugguggccauccucauguuggcacaguuucuuggcuugcugacccucccagcaucuuacuccuuucuguacuacccaauguugaaggaauguuugguggguuuuuuuuuuuucucuuuaguuucuaaagugaggaaccaugugagguaaaggugauucuguccacaaaucuccuucauuuaucuuugcugccucguuguaguugcugggacagagguuugcagucaguugcccugcagcaucugucuguccguucucugauuggcuuggacauuuccccauucgccguagguguccugaggcuucacaguaguguguggacuuggaaguggaagugugguucuucucuaagcuuaaguuuuuguuccuguaccucaccucucuuuauuauucuauagccuuuguuuuucccuauauuuuaauuuaacuuuauuaucauguauaugaguguuuugucugcauauaugucaauggaccacgagcuuugugugcuugcucuuugaggauuccggaagaggcuguucugagucccuccacaguuacaaaagguugugagcugccauguguguucugggacucaaacccaggacccugaggaagagcagucaaugcuccuaaucacugagccaugucuucauucucaucuccacauauuuugaauuauugcuucaaugaagcauccuggggggacaugguauauaggccauugcuuuuuacauuguaauuaugaauguuucuagaaguuccuuuuuuaaaaaacuuuuucaagucuauguauaccuuuugcauaauuucuucaauuuugacucuuauguuuuguuuuuaaaaaauuagucuuuaacaucuucuuuugaagugucacuguaaauuuaaucuuugguagguuuaaucuuuguugguuuuguucuguguacuggcuuuuaaucaugguagauuuuauuuuauuucacuuuuccccuguaagaaucugugacucagguuaguggaacacauauguuugcaacagcuuugccuugccuucugcagaaaccucaguucuguuccugcugagauaggcuucgauguugguuuuacagugugggauuccucagaccuagugcugucggggacuggagcuccaggucacagugagcaguaagcucacuacaggaucucacugcgugugcaggcuggguuauauacgcaucccaggcuggccuuaaaccugccuguuagccugccucaggcucucaagugcaggcauuguagacguguaucacaaugccuggcuugauuuuaauucuaaaaagcccuuuacuccacccaccucauguucuuaaaaauccaagcagguuaccuaccugugcuuaugaguagccuuuaaaaaacaaaccccugguuuuauuguaauaaggguguggucucuucuggggaccuuuauuuaaggacuuuguucccuaaauauggccuucuagacuggauucuuuccgcuuagcggggugacuuggauauucaucucuguguuuuugugaugugguuuugguguucacugaguggcuuuaagaccucgggcccucacuuaccacguucauucaacccagcaucggacugguucauucaacucuagucuugcaguucccaccucgcauuagugugaugcuuguuaaaacagaugaauaagguugcaacauuguuauuacuaaaguccacaguuuaccugggagggaacuguguuacagcacagcucugugacagacugucccuaucuuacagaauaguuucacuguccuaaaagugaccaacucauggauuaauuuugcccuccccucccucacaauccaguuccuggucuguauacagguauacaaacacacauguguauguucuauauuaagcauuuuuuuguauauacauuuucccuuccaaaaugucauagaacuagaauuaucuaacauguggcuucuagacuggcuucucucacuuagcuaugugacuuggauucauccuuguccuuuugugacaugauaacuuauuucuuauauugaugauuaauagucccauucaaccugggugauuuacucuuucaccuauuugaaaacuacuuuaguggucuccaagcuuuugcauuguaaguagaaaugcaaugaauaaucauauacagguucuuacacaaaacuuucaucaugcuugaguaacuagcaaggauccaacuauggcuggauugugugguaagccuguccuuagcuuuguaaggagcugcaguaucuuccagaggggcuguaugcauucccaccagcagugacugagagguccgguugcuccacaucuucgucaguaguugguguuucccgggucuuggauuugggccacucuaugguaugcaugcugauaccauuuuaaugugcacauccuaacaauaugaaguauugaacauaauuucuacuguauguuuuguuauagcugugucuuuucugguaagauacccuaucuaaaguuuuuuagaaauuuaacugugagccaggcauggacuuaagucuacauuuuaagauuauaucauuaucuuagcacucaguagauugaaugaagcaggaagauuucaacuugcaggccaguuugggcuuauauagcaaaaccccauuucaaauaaacaauaaaaaauuggauugcuugcuuuugcuuugcuguuguuaauuuuaagaguuuaauuuuggguccaugucuguuacuaaguaguauuugcaaaggucucccccuuugucuugucuuuucauucucguaaugucuaugucagaccuggauuuucuaguauguuaucucuguagcuuugcauuuuuaucucuguaauuuacuuugaauggauuuuugucagagguauaagaucugggugugcauuggugggugggcauggugugagaguucuagguccagaaccauuugaugcaaagacuuucuuuguguagcuuuuguuccuuugugaaggccagcuggcuguauugguguggaucuauuucuggguacguauauuagugugcaacccuguaacaaauaccagugacaaaguagccaugcuuugauugaauugauugaauggcuuaaacaacagaaaauuauuucuggccagaauuccagagaugaccucuucauagggugguuucuuguguggagucuuuugcaggcguacagaagguccuucuccuggugucguuguguggcaaaggggcagugguguggaguuagauguagcugacugaggagguaaugacugggagaagcccuugaguuuagucgcuacugccgccuguggagucauuuucuuggacugguuagcaaugaauaaucauuugauggugagaggaggaggugacaccuucuguaguugauugccaaggaguuuggcccugcuguuuccuuccaguuccaaguuauuuugucucucuguuggucccuaagguuuuuguucaacaauugguugaccccagcuagaucccaaggaggccagguaaaagcaguuauaggacuuacucauuuaaucacagcauuuagguaauagggaacauuuuuugaauaaauauuacauuaugugacucucaguaaacauaaacaauucuuacaguccaugaccauauaagaaagacucuuuaggggagagagguggaaguuguuuuuuaaaguaugguuuagaguuaguggguaaguagaagaacguuguauuagagguaagucuugcaggggagggccuuaugaacugugagcaagaagggcuugcgcugguugguacuggucagagcguuuugcggggaguggaugugaagggcuuguuugaguauuggucaaacuaaaagaaauuauuuguuuuagagaauggugacauaaacugaauauuaauaaggaaagucauagcaaauacaugcacugaaaacugugugucggguguggcuucauagguguucuugcucuaaugugccccuuaaagcuagggaaggugaagucgucggugacuagaggucagguaggcguaaggucucagugagagcagagguugagcuccgagugaacuucagguccucuuugcugcagaucuuagguuuucuuguguugagcuagaccagaauacagcuugccauauaguuugcagaguguaaauuagacaugauaaagaaaaggaccauugaagauguuccaacagaauugaagggagagagcuacugauaggcagggccuguuuauuucuuagcuccuugggagaauggguauaggugguggccucuagucuuucagauaaauuccauguuuccuggaauguggcacagcaggucaagcguuagaucaaugacagagcauuguugucugauugaggcccuaaggaccuggauggagagagaaacuaaaugaagcaagauguggaguuagaccuccauagauugagguaugucucugguagaaagcugcccucuugggccauuucucaggaagugcuguguggaguuggaagaguggugagaugacagcagaaaagacacagcaagggagggaagacacaucuuuggccuaaguugucaagccgugggucuuuccuaaccuuuuuauuuugagcguccaaaggaauuuaugacucauggauuaaggugcccguugcaguuuuauguuuguacccugugcuguggguacaccuguuuguggaaguuguagugcuggguuugcuauugcaggucacuguuuccugaugaaacagggaagagagcgcugcauauccaagggaagugagugaguacagauaguguauccaucucagugccugaggacugggugcauguuguagaaggcugccccuugagcauagcagccaggaagcucuggcuccuuaggaagaagcugggacugcuugggaguaaccauggagcuugggccugucgacuuccccucaugaaaagagccgggcgggcguaccugaggccucagcuaccccacacugcacgccuccugcagcagccgugugugucucugccugaauugcucagagcauagagucagacagagccagaguccguagaggggagcugaggaggaggcuccaucugcucggcuccugcaguccaugcugcgcugaggcuuugcugaccacccacacugcuguaaaugaguuagcccaggaaacucgcuggcuugcagagcugggcugggcuuggugcuccuuuaggucuccugucugucuccucucucccuuacuccugagaggcaguuaaagugugggcagcgcagaccccaguauuacgaugcucucuccccucucugcuccuugggguguugguuuguuugcucguuuuuugucccucacccccaucccaguccucugguccucccacugcugagaaccgagcaagagcggaaggccugcggcagagcugugcuggcuuuccaggcuggcagcgcugucauuucucuuccccagcgcucugccgauucugaggacugcggcucugguuagugcuggcacggagcccgcaugccaggaauccgggaaucauggaacaugcuuugauuuuggaugcaaagauuuuuuuuucuucuucuuccaguaaaacuguggcuacaggagguuugacaaucucuuuucuucucccaaaacccaaaauuggauguuucuguaaauugcugggcagggcugcuauuuuugcuuuuuguuuuauuguuuguguugaguuucuuaaacacuuucugucauauuaugaggcaauacuugaaucaaacuuaggaaauauuuccauaacaauuuacauuguuuuuaugaaaagugauauaaaagacccuuuaggcaauguuuuuuuaugaauaaaguuuugccacuuuuggcaggcuuuggggcaguaucagggaaguaacguuucacuuccuggaguaaagauguauaauuuuugcaacauucucugcaaaaacuaugcauuucaggcacuguacuugaccccaaggucuagcuaggccccuggucuacuguacccugagccucagaacucagggaagacuucgguguuuaucuggcuaagauuuaaaacauuaaaauuuuaaauaguuuaauuaggauuaagacaagagauuuuuuuuaaaaucucuuuugaauuguacagauugagucgcacauaagagaugcucacuuuaucccgugcucccucuccggauucuucuuuugucaaguucccauaauacauuccuuacaaccaaguccucacgcugcuccacugcuccucacuguugcccugcccgugccucucugccgugcuagggucccaucuccgguaccgauacaguucacuagcagguuugguuacauggacugcucuggccuguaacaguuuugcagacuuuuucuuuguguuuuaaugaccuugaagguggcagguuagauggaagucauggagcuagggugcccgcccgccugcguggucagcaggggcuugucacucacaguguuuacauuugucaccuggcacccaguguuugcccagccugugcauagcucuucauagcugugauuccaagggcgugccuuucacaccccuuggaagaaagucucauacuggggaugggcaguuaggcuucagccaccacuuuuaagccagguguaacuauguauagcugugccuuugcccuguuaacuguauuuguuguugaugcuggggcugugccucagaugucaccuaugcuaaauacauauucuugcugugcuauuuaguccccaguuugcuuauucaauuucuuuaugaguguggauugauggcuacagugcacagcuacauacuucauuggaauuuaacugcaucuguuuguucugugucuuuuuauacauccacaccauauuguuuuuaacacauucuggcauuuuauuuuuuaauauuuuugggcaugacaacauacuuaggcucaucuguaaaugcuuugcuguggccuagaaucaggcguuucucaauaagccaugguucuucuuacugguaucagacaaccaagguauagagugcuugccuuccuuucaugacgcccaggucucacucuccugcguuaccccuccacaaaacaagcaaaacaaaaaaccuugaaaauugugcucugggucuguuccuugcuguuggacugccuugcuucuaggugcucucucucagcuggugugugugugugugugugugugugugugugugugugaagugucugagccauguaaauacagguaccuguaaacuuuuugguuuuuugagacaaggucuugcuauguacacaagacuggcuuugaaauuacagagcucugccugccucugccuccugagugcuggauucaaaggugugcucuaccauguccagcuauauaaauaguucuguauccaucucugugcauuuuagccuaacugaauucauaauagucucuuuauucuaguacgugaugguuccugccagccuucccuuugcuaucugucacccccaucuucaguagggagaaaccuggcucccauauuuguucaguuccaguauacauauucuauauauaauauacaguuuccauauaguaaccaauuuuaguguuaaugcauugcugugaagugaguacuucauucuaacuuacagauagagggauuuguggggaauguaagugacuucccaaggccccacagucaguaaggaaguacacuagaguugagcccagacagacagccagacugacaggagcggguguguagaccguggaccuccgcaaccugcacuguugcuucuuguauauauuuuuuaaaagguuuuuguuuuucuaaggaauuggggguuuggaaacaaucuagacaauuuaagauccccccaggaagugaggcggaauggcaguuaggaaagguaggcagacagaagaaaacuuuuuugaagagagacaaagugagauuguacuugcaagaacaggaguuuaugcuuuugaaaauguucuggaguaaaaauauagccaguguuucuuuuucucucucucucugaagcguuccaugcugauugccagaucacugcuucuuucugguggaagcauguggcuggcacccuccucacagaugccucuucacagagggaaaggaggaggucagcacugcaguuagcaaaggcguugguuggguuggcggcuggucaaaaccaacuuguuugaagggauuucguuauuaauguacaagagccaucuuaucuauauucuguguacuuguuuaguguuuaguuuuauuagcuuuuauauagaagaccuuagucacucuggaguuugcuuucaaacucuggaguuuugcccccucccuucaccccuguagcaucugacuuagauuuaauaguuuuguugaggagacagcuccuaaagccuguuacccaaugaguguaauucaggguugcauuuaaagaccaagugcuguucaucuguaauucuauuuuuauauuaacuccuccuaauuaacaccaacagugaucaucgugucugauaguuaugucuggggugauggcucagggguagaacgccugauugugcaaauuccuagguccuuacucugaacagaaacuuaagagggagggagaggaaaaaggagggcaggagggaagaaaagcaaggaggaggagaaggggggagugacuggacuguggcucuguugggucccccguggaaggaugcacacaguggaaggaagggaggaugcacauaguggaagggaggauacacacagcugccuccaucucaccaccguucccuuuuccuuccuccucuugccggcugcuuuucucccacugacuuuguagcagcucuacucucauagccugcuuccacuaagucaaaauuaaauagaagcaagacguugcgaaucaccuugucagcaaauagaugaaaguuccuuuucuguacugcguguggaggggguuagacuucuucuauugcuucaguuuugaagaaagcugaccauacauccugauuuuuguccacuguucuacugugagcaaguggccuauucuuuggagcucugagggccacagcugucagaucgccucucacucugaggugugucauuuacagaagagaaaaccuggcuaucaacuauaucuaaguuauggauuguugcaaguagcucagaguuauaguuucuugaaugucucaauaaaagaaggaaaaugacguggugaggguacauaagauuacguuugaagcugcaguuuaauuuugggugaauuacuccuuauacagugcguuaggauucccacagcacucacuuuccaucagaagcuucuaagggucaggcuggugcccauggugcccagcgugaaagagcugggguauguuagguagggcaggaagagcagggugggcugugggcguacuuucuaagaagcguugcggaggggcugcagggaugcuauggcugacuaauugagugcuugcuguacagucgugaagacugcaguccgaucccugcacgcacagagcaagcuacaugucccucaaacacugguaacuccaacuucagugacagugacacccuccuuuagccucuggagugcacccacacauacauggcuacacgucacacacaugcauguagaaauaaauaacaucuuuuuaaaaauuacugaagcauuucugaagaaaauguaaucuugaaauguuugccuagcauuuuacaagcaaagguguuucugaaaugugcguuuauuuuucccagaguaguuucugcagagaggacgauagauuccaguuuaaagucuaaaaucuaaaacagugauuaggauaggcagggaggugucauuuaaaguagggaugggaugucuucuccaucauuugcuguacagauguucaaagaauuaugcugccucucucugcaccuugucuuucgguggggaaguugaagaucuguuucugucuuugaggcuugccuguuucuguagugguuaggauggagucacggauguaaagaauaaaggcagagguacaaagcuguguuuaccucugacagugcuuuggcacuuguucccuagagaguuugccuugacccacuuuucugagggguuccccuugggagagggcaggagucugugagcccuguguuuaaucuuaccuaaagaguggaugcugucagcaggggaaggaauuaggccacaugggacuguaucagucucaaccacagccuguaggaagcgggugauggagugugcuaugcacacugacccacacuggacaccuccagcagcugccuucacaacaggcagggcugauggagcacucucuagacagcucugagaagacaguuugcacaucaccgugguggcacagguggguaggcugcugauccccugauuugcuuuuccugugacuuuugugaauaaguuuacuuuucaccugaccccacaccucagccaucaacuguguugcuguucucugaggagccaggggaaaguggaguuaccuuuguggucccuggccagaacccauguuuuggcucugaguguuuauuauuuuuuauacuuuucucuauuauggggggggggagaucugccucugugcccauguggagggcagaggacaacucucauggagucguauccuuccuuccacacuuagguggguucugcagauaaaaaccaggucuccagacgugguguaagaagccaaccugcugcgcucucacacuggccuauugagucucucucuggcucagcuacggccacaccagcuucuagagcuggagauugccugucccuuccaaguccuccucagugucaggguuggagcuugggugauccuauccuuuccuucuagugcaaggacuuuaguccuucgaaauauucuuuauguggaaacaagauuauguacacacacacacacacacacacacacacauacacacacacacacuaagaauggauccugggaggaaggaggaagggcgggaggauggggagcaagagaggcugaugggaaagaaaaagaaaugaugcaugcauacauuguuauauaugacgguguuugacauauacggcaugaaaguagacgaggaggauuguaggaggaaaggggguacgagaaggaggggcgaguaaagcaugagagaggcaagugagcaaguacugugacgugcgugugaaaaaguuauaaacgaugucaccacguagcauguguguggagaucagagaacacacuugugggaguuaguuuugucucccaaccauguagguuucaggcauugaacuugggugguaagugcccuaaccugcugagccuugcuggcacaagaaggcuauuguuuuacacacuagcuaaaaacuuaacauccuucuuuuauucuuugcuuauuuauuuacuuacacauugcuauuuauuuuuugaacuaugauggagucuugugcuuacagagauauuugacauagcagaauugagugaaugacaaaaauguucgucaaauaaaagcuuauugguuccaucaacuugagguggccauucggaggagggucagagcugcaguuguaguguuguagucuuaccacauaauagagaggcauaaaaacauaccaaaggaacaguagcucugguuuucacagaauaccuggcauaucauuggcuccuaaugaauauguagugaccaagcaggacccugcagccaucugcugcucucuucccuuacgccaugaaguaggcucugguuagaaagaauggaaguuagugcacuccgcuaggaauguguacuacaaguuuguaguauaauuucaguaaggaaaacaucagaauuuguguagacaggagggagggaauguauuggcccucucuaggcuuccuuugaauuggaucuuaaauaacagguuuaacuaaaaauaaagccuaggaaagcacuccugacacagaugcucagugccugcacccagauguaaggagcauaugaaauacaguuagcaagauacucacacauguguacuuaugcacacgaacaaaccaaaaaauaauuuaaaaauagaaguuuggugagauggcucagcaguaaaggcacuugcccccaaauccgauggccugaguucuauccuugggacuucccaugguagacaaauaaaaccugauucccauaaauuguccucugauuuccaccuaagcucugugugucacacacacaggaauaaauacauguaauaaagauccuucucgccgggcagugguagcgcacgccuuuaaucccagcacucgggaggcagaggcagguggauuucugaguuugaggccagccuugucuacagagugaguuccaggacagccagggcuacacagagaaacccugucuuaaaaaaaccaaccagccaaccaaccaaacaucaacaaaaaaagauccuuuucuaaaaaaaaaaaaaaagguguauugcuuuaguucuaguaugugaacagaaacucacaaaugaaguaauuggugaauuuauaaaaauaaaaacugaaguagacuauucggggcuuuggaucccuggugccaggguucaggugggggagcugaacccuagcgcgcuccacgguucugguuccguuguggaggcagacauacacaucucuggccucauauguguucaugugucuucucaucuccacaguaccacacaugugcauguucacucucacugugcaugcacacacucaucuccacaguaccacacaugugcguguucacucacacugugcaugcacacacucaucuccacaguaccacacauguguguguucacucucacugugcacacacacacucauuuuuuacgcauacaaacugauaugcuguguuucagaacauuggauccuguuguuuaccagacuuaaaacagcagauagaacauuaaaaucuuugguuuuucuaaacaccuuguaauauuucuaaaaauuccauguggauuguaugguauggauguguuucaugugaaugagaaaauuauauguagaaaggccuuuuuagaguuccacaaacagaaacuaugauaaauguauuaauacaugugauguccugcgacauaaugcuuuauacguuuagauaaguuucguuuuugagaaacuagcaaacuuuucaaaauuugaaaaaaugucuuuauccuucauauuucuaaaaguaucuuuaaucaaccauugagauuucuuaaaaauaauccuuuaaguacuguuuucauuauaaauaguuuaacauuucucaacacaguuuuucuucauacacuugcauauuuguuccaaaagcauguaacaagauccuuggcuguuacagcaaagugauuauaaugguuuucacuagaguuugaaauuauuaugugugcucaaagaaccaaaauuuccauagauagauagcuuugcaaaaauguggagaucuuugcuguauuacccauugcuuuguuauuagaaugaucuauuaugccaagcuucuagaacucugaauugucugcauuauuuauguggugcagauugcugaugaauaugaggagcugugaacucucaaugcaggcuguguguggugcagcccgccaaucugucaugcauucagcugccugcuagauaauacaguggccucuuccuauuccagagucuggacagguguguagccccuccucccuccgucuagaccagcgugcuccuguucagacuuguguauaauagaaaccaagaagauacuggaaucagggcuuacaccugucccagccaggcgcaucucuagacucuacugugggugugcuggguguggaaugugcaugguuauuuuuagucuguuuccacaguuucgaguuuucuuguuuguuuauuguuuuucuuuuaaguuugaguuuaucucaggaucuacuauacucgaucucugcucuucucuucucuucucuucucuucucuucucuucucuucucuucucuucucuucucucuaccuacuagauuguccugaagaagcuugucaacuggcuuaguuuuacuccuuugauuccuucauguuccuagucagcacuuauuccaaaccugaaaauaacaacuguguauuuguucguugguuguuuucauuuuaacguuaacauuuaacauuuuauuaacauaaggaggcuguagagaugguccccuauucacucagauuagaucucaggacccaaaauaaguagcucacaggcaccuguuuuagcuccagggcaucugucacccucuucuagccuccaagguacccauuuacuuauguauaugcuauacauaaguaaauauuuuaaaaauuaaacauaaguucaaugaauugaacauauacuuucuguaagcaugacuccauuuucuggguaugaaaauacaauaagacaguccaggaccucacagcuuuaaccagcauuuaguaaacauaauaaaaguuacuuugaugcagcguaauuauauauauugaggguccuaagaaaaauuacauugcagaaauucuuuguaaguuuguuugguuuugcucaaaaaguuuuucuaaauugcuuuuuugaccuccaguaacuucuauguaaaugauaugguauaaccaaauauggggcucauacaugacuuaaucccagcacccuggagggugagauuggagaauuuccacuuugggauaccaaaaaauauaaauauauuaucugacuugcuaagugugacacauggacauagcugugaaaccaucagagcaauaauaaauagauccacgauucucuuaagguuuuuuuuuucuuuuguccuguauaauuacccuucauuucuccacucaccucuucuuucuuuuugauuucuuaaaauuuucauacagauauaguaccuuaggcauaucccuuccucucccucccuuuucucaccccucucaauuauuccuuuuguucugcuagauacuucgaccucauuuuuguuuucuacacacacacacacacauucuuuuauaaacaauucuuuacccguuccucuguuguuagacaccuaaugaguuccugauguguugacuuggaguccuuucacaaaauaccaagaauggcauguuugggucaugugauggauauauuuugcuuucaguuuauuuuauguuguaugaauguuuuggcugcauguguaucuaugcaccgugugugcgcagguuccccuggaagacaaccuggggucaucaggucuccuggaacuagacuuacagacgaugaugagcugcagugugggugcuggaaccaaacguggauccucuggaggagccgaaaguucucuuuaccacugacugugccaucucuccaguccgguauuuuaaguccugugauaaaccuccauucagauucucauagaaucuggacuggcucacacucccaucccacccacaguggauaaggucccuccuuguuguccacauucugccagcauuggauacccguguuuguguucuuuauagcugacacucagacugcugauaaaaucucacucaggguaguuuugacuugcauuucucugauggcuggugaagauagaccuuuuuuucaugauuuuaaaaaaaaaaaacuuugccauuuguaauuuugagcacuaccuguucauuugguuagccuacuuauuaauuggguuauugauuucuugguuuuuuuuacaucuuuguguguccuagcuuuaccuucugucaguauagcuaacaaaguuuuguucgauucuauaggucaucucuucuucuauaauuugccuuuucagcuccugauucucauuguuggcuauggcucagcccccuucucugccugacccugagguauuucugcugcuuuccccacugcuucaguuuuagggcucuugggucuuagauucuuuggcuuugauuuuuuugcacggugagugauaucgucuauacguugaagaaucugucuuuuuuaugauguguauuuuucacuucuuuguagagaaucuuguuuaucacuaugugaguuuauaucugagaaggagagagccaucaauaaaaccuaaacuagcuaucugaaaagauauauaacagaaagacagaccucugccaagaucagucaagaaaugaaagucauaaguaguauuuauugguuaauaucaauaaugaagaggacauacucgucaauauagcagauacuuaaaaacacccaagagaauauuaugaacaauuugugcgaacaaaaagaaagccuaagagauagcuggcagaguugagacguugcgauaucccagagaagagacugggacuccuguguguuaggaaucaaagcagagggaaggacuuagcaggcuccuguaauuccuugaauggaggggugggcguggcaggcauguccagccuucugacauggcugccagcugucaucuguaaaguacaugcuggagagccucgaagucauaaauaaguuaaugaucuuguguugggcuucauccugggcugcaugggacaugccugcagggauuuggcucgggcaguuacuaccagugaauugcaguugaggguuggugcugugugaaccccuugggcugaugcaaaucuggagcaccuagaagucucgucugcuuguguuaaaacaggcucgaguuccuguuuuuaaacucagcagcuugguuuucuauuuaagagugugucuuuaaauguuuccagaaacauaaaguaccauuaaaaaaaucagauuaaacuccuccucauauacuuauuaguuauuaggugggucugaggugugaacaaaggccccaccgugagaggucucuuguaacacacuacagugugugcuuguaacaacagugcugacguucuuggcacagauuacuuggagugauaaagcuguauguagcuuagcuucagaucucuagaaguucuugccaagcuugucugauugcccuuaggcagcagggagcccucucuagacuauggccccggguaucccucguucaugguguaugaggucccuaaaggucuugaaaaugaucuggugaggugcuagguguagacagcucuccuccccacccaucucaaacgagcccucaguacggaaggaggaaggucagagcguucugggcuuuuguucuuuuuagcagacagcugaggagcuggagagauggcugagaggugaagagccuugccgcucucucagaacccacagugggcagcucacagcagccuguaacuccagcuccgugggauccgauguccucucuaguccugcacacacagaaacagaaacagaaagaccuuugggagccagugcugcgggggugcaacagcuuucccugugguugccuucccgggguagcuugaugaccauugcuuaccccccaggccugcaccugaccagacggaguuauuacuaaaacugccauccacacuauuugccacuugucaggaauuccuguucuuguuuguuuauugugugagaccagggaugggacccaaguauucuaccccuucaguuccagccaaacacagcugugugccaagccaagcaaggacuguggccauuuauuaguaguacagucggcaacuccaaagcacaacaccucuucuagcguuaguggauuucuuaggaaugugguaugauggguaaauaaauaugauuguacuucuuguguagauaguucacaguuacucgugcaguuuugguuauuuuagugaugaguacaugaggucuuauucuacucuucccugccaccuuucauuuaugucuuuucuagggucugucuugaaauucccucacaagcagacaggaagagucaucuggugguguguuccaggggcugcuguagugcagcaugucugggcugcucaugcuguggaacaauuaaauaaaccaucacaguggauuuuaguaaacaguauugugccucaguagcaaacaauggugcaaauauuuuauauuuauuccucuggugacuguuuccaggaauucuacagauaccaguguccagggauguucauagucuuuuauguaaaauagcauagucuuggcccagauuucuuugagugaugcgucuguagcuuagcugugcccguugucuuccugagcuuuugaaauuggccuaggugacauaauacuaaguuuaguauuauuuaguauuuaguaggugcaaguguagccccacauugcuuagaaaguaugugcucagugcagcauuuuccuccagaucuauucagccugcagauaaagaguagaaggccaacugcaaauuuauucuaaaguaacaaugaguacuggaaaaugcaauuuagcacugcccagugugcacaggcccuagacuuagcacuguccagcacucacaggcccuggggucagcacuguccagcacucacaggcccuggggucaaugccauccagcaugcacaggcccuggggucagcacuguccaguacguacaguaugcacaggcccugggaucagcacuguccaguacauacaguaugcacaggcccuggggccagcacuguccaguacguacaggcccuggggucagcacugucuaguacguacaggcccuggggucagcacugucuaguacguacaggcccuggggucagcacuguccaguacguacaggcccuggggucagcacugucuaguaugcacaggcccuggggucaaugcuguccagcaugcacaggcccugggaucagccuggaaccccauaaaaacaaagggaaagucaguaagcuguuaucccaaugcauccugggaccacacucuccuccucacauuuaugcaguccucaccuuuccaucugagcugucuccucggucccacugagccgcucuguaucaugcuagauucauuuaucaucuuaaaauucugcgaagcugaagucaguaaugguccgcuuuaaucacugugacagcauaccugagauaaucaaguuaguaggcgaagggcucauuuugaaccacaguuucagagguuucugugcauuguuacuuugaacuacggcaggcagcacaauguaucauggguaguagggaaaauucccaucauaguguggcaugauagcugagaagcaagcagaaagcggaaggaccaugggccccaccgucuccuugagggcaucuguuaguggccuuaguuucaucaggcccagcucuuaaagguucccccaccuucagacggugcuguggccuagagcaaaccuucaguaccugggacuccgaacugaagccugcucuccaaucuggucucauugcuuagcauuucuuuugagaugucugcauguggcaguggcagucugaucauuucuaacucccaagcagcauuccauugugacuacuucacaucggguuuaaccuucacuuguagaagaaacuggcaugauuccaccaguagaagcaauggcaguugaucucugauugggaaguuauugaauucgcuagugaauaucugagcuaccagcauuacacacacccuuaaacuauuagugccacuaaacuauuaguuccacuauuagugauaacagacucugauuuucacccugugguuugugcugggaauugaaccuagaaccucuugugaguuguacaaguagucuauuggucucuauccccaaccacucuucguuuuuaaauuuuuauuuauuuuauauaugugaguacacuguugcugucuucagacacaccagaagagggcaucagaucccauuacagaugguuaugagucaccaugugguugcugggaauugaacucaggaccucuggaagagcagacagugucuuaaccacugagucaucucuccagucacuuuucauuuuuuuaauuugagauggucuuauuaaagguuaaccaaacuagucuugaacucacccuguagucaagacagccugaacuuggaguuuguccugccucagccuccuaacccuaaguaaaggccugaccuugacuguccuccccaaguguguugccccgcauccuguaucugcugacccccaccccgagcagcaucuuucaaagccuggcacuuacugcaugguuguggaggugccugaggaagaggcacacgucugucucaugcuugcugcccugugcucuccgcaucccugaaccagggaaaacauucuuggguagaaguguguaaagccucgcagaacuggcgccccguggcguuaggguucacguccauggaagaugugagagcuccauuacuaagaugcuaacucucgguggucuuuuguaauugucagacauagcgcgaagagauugcuguuuuucaucugcuucccacauacauucuugcuagaguagaagcaaagaucacugagaggagcccaccugguaucagugcugugaggcugauggggauggaccacagccugaaagcaguguucugcagucaccugaucuccuccaguagcaugaguaugugccuuaaaauacuuaaaaugcuugcuucaaaguuucaggaccacugaccagggcagaugucuuuuaucaaguugcauucuucauguaaauauuauaaucuuuuaauuagaagucuuaaggacacugcccuuuucauggaaaaccacaacccugaaacuacuuuuacuuggcugugccaguuguagcgugcuugaagcuucucgagauuuggaaucugccugcucuuagaauaguguggcuugcgucguugguaaagugcaucauggguuucucuuguucacaggcacauguacugaauaacgucuaaaaacuguacagguugucagaacaucuuguuuacauaguugcuccccucuccuccagcaaugcuuuuaaaauuaaguaauaauaauuuaaaagugaggggcuggagagauggcuagcaguuaagugcucuuguugcucuuccagaggaccugaguuuggcucaccaugcccaugucuaccaacacguagccccuguaacucuagcuccgagaugucagacgccuccucagacucucaggcauccacacacauuggcaugcauucacacacacagacauaaacaauaauacaccuuuuuuaaaauuagagaagcgaggcccuuucuucuauacaacguuuccucaugacccauauuuagcuucuaguuacuagucuguuucuuaaucuauuuuauuuuuugcacuuccaugguguacauaauuggauaugcguguucgaguacaugugggaacaugugcagguguguguggaagccugaaugguuguucucuacugagguagguccacugaacuacaaaguagacucuggcuaguccugcuagcugacuggccccagggauccgccuccucuucugccucugccuccuaggcucuagguuuccaggcagcccugaagcuuuguucuuagaugggugcucaggauccaaacucuggucuucaagcuuguguggcaagugcuucagccacugcgccacaucugcugcccagugugugucguuuccgagcguuuccgagcauacgugcucucuuguauagauacgcuuguauaugcugcuuuuacuuauaucaccgugcagcuuccacuucuaguccagugccauguuaaggucucugcuuuaggcaugugacugucaaaguggacccuacuaucuucccuggccauguucacguuguccugagauuacagucggcagaaccagagcaagugagcugccgcuggcaguguugaaagcaggaggacugugagagugugggcugugccccugcuggccagccauccuccuguaaacagugacagcaggaggaggggucgaaacccuugcaugcuacaccaagaacaucucuguucuuccuuggaguuuaucagaugagugcucauuugguuugacuuuaaaauuuugugucauggaaacaccuauguauuccauuguuugcaauaaagguaggcauaacuucaauagguuuuucuuuuuuuuaaaaaaaaaaaaacaacuuagaucuaagaagggauuuaaaauuaaaaacugaaguuugcuguuauauaaacuuuuaugaaaauagaauucuuaguuacuaauaagaacaggauucugaaauguguaggugcuaaauuuuauaaaacauguuuuaccucuuuauuugcugaguuguguuucaagaucccgagugggcgucagaacucucaaauagugucagagcacugugugagcgcagggagugugugcagugacccgccauccagucauagagcuggauuuuacuuuuuccuagauaugcauaccuauaauaagguucaauuugacacacuaauuacaauauggaaaaauagaauaauuguaccaguguacaauaaugaagauugccugaugcaucauucauuauuucuggaguguugcauuuaauauuuucugaccauaguugaccaguuguaacugacgcugcauaaagucacuguguuggugacacugcugucguuuuuauuuccauguuggugaagcucucugauugauaugaauggcuuuuccaauguacuuuccaguuucucuagcuggagcaagugagcaaguggagguggccugaggaagugaucuaauagcuugaugacaaagcagcagacccagacuuuaaaucaagaagcagaagauccuggaccuauuuagagaagugguucuuaaagauacacuauuaauuuuuaaauuauguauauggagauacaaaaggcuggacauauuggaugcccuggagcuagaguacagguggguuugggucacuaguaaaguguguuggaccaucucuucagcccacacagaagucguuuuguuuuauguuugaguguuugccuguguguauguauguguagauaucacauguauuccuggugcccagggagucagaagaggaagcuagauucccugggacugaaguuacagaugguugugagcugcagugugggugcugggaacuaaagcuggcuccccuggaagagcagcacuucacugagccuucuccauccugauccuguagugccucuguuguuguugugcauaaucuauaggaagaagaaccgguguacauuaucugcaguguuucuggaccacaggaaauccucccuguauaguucuaugauggcucucuccuaguugcagggaucgguggaggaagggcguugcucgagggaagaaggucaguguggaccgagcuuuugccguguucacgugugauggaugguaggcuguggguuggauuaccucauuagugcagcuaacagaagagcacucugugcugcacugucggccuugagaacacucuuccugcucaccgccagcuucugauugagaguggcugacaauuguggggggugggcggguguaacacucggaaaugaccacgcccagacccucaugcaaccaaauaagcgccccuacccacagagccauuucucccgccucagucuguugucuucaucauccaggaagcaucaccuuugcacaagaugccagcuuuguuacucugcacgucccacauagcguagucagguccuuaaaugacuuaacuucacucccuacucuccacucauuuucagaacauauugcuuauauuuuuaguccaucuuuuuuuuaguuguaaaaauuagacaucauuauuauuguuuucuguaguuaucaguauugauuauauuuacccaagauugcuaauuuuuguugaaauuucuuuuauuuuaaauuuuccuucugagucuuuuuuaugagauauauauucuagaauucauguuaagcaucauuuggugguaaacucaaauucuacuagaaaagacuaguuuugucuuauuucaugaguacaguuuuugcugagaauguaauucuagguagauguaauuuuuguuaaugcacagugucauucagcaguccaagugagugugugugugugugugugugugaaugugugugagugugugccugugugcuugagugugugugugugagugagugugugauuguauguguguguuggcacauauauggaggucagaggaccacucuggaagucauucagucuuucgucuguaggaguuccagguucaagcucagauccacaggcaucuuaggcggcaggcaucucuaccuguguagcaucccucuagucccuuauuuagguguuuguaauggcaggacuuuuuaaucuuaucuaacaugcuuccaagagacacgucuucagcgauuccuguuuguuuguuuguuuguuuguuuuaagugguccuagaauucgaauuuagggccuuauucacaccaugcaagaaugcuacguacggagcuacaguccccgccugcaggagugguugucacacacacuggaaucagaacaccacuuggccacagauacuguugucucuguaauaggaagcugggauuugauaacucgaucccuuauccucuccuagccuugguaccacuuaaguuuuauccucauuauuaguugacacuuaggaucuggcaguuagcagggacuggagagauggcugagcagugaagagcacugacugcucuuccagagaccugaguuugauucccagcacccauacuugauggcacacaaccaccuguaacuccaauuccagggcaucuggaggcaaaccuuuggccucugcagacacauacauaaaaauaaauuuaaaagcaagauucaugaucaugcaggguugucauggguuguuuggauagaaaacuucuauuuuuuuuaaguguuguugauaugacucaauuccauuuugaauuccagaauucaaagaaagucuuugaacuugaucaugccugcuggcuuguuucgucauccgcagaugauuuuccaggacuacauccaaucauuaucugcuaacugcauuuuuuuaaaguugcuucgaugaucucuguuuucucucuuuuugaagaucauaugucuuagaaacuuugaucuuuaauuaccuaguuucaagaagugaagagccaaagagccauugcaaucaacucuagaaaagagaggcugugaaagaggcauggcaugacacagggcagaaaggccucagggaucaaggcaguuuggagauguguucuuuucugaaaucuguuuccugugcaccucuccucucuugucugagauuguuucuucagaacccuuccccccugccccugccccaccaccuucccaguccugccagcuguacuauacuggccuagccugauggcaucgucacacggagucacuagguuacuuggggugcuucucagcauuuccagugacaugcuugcauuaaaaaaaaaaaaaaaaaaaaaaaaacaaaaaaaccuuuauuagccuuauguggcuauuaaaaucuaaaccagagggacuagauagauggcucagcaguuaagagcacuggcugcucuuccagagguccugaguuaaauucccagcaaccacaugguggcucacaaucauuuguaaugggauccaaugcccuuuuuugaugugucugaggacaacuacagugaguguacucauauaaauaagauaaaaaaaaaaaaccuuuuuaaaaaaaaaaaucuaaaguagaauaccguagcaucuuucugcugaugugguagaacacugaugagagcccagaggaaaccuaaacauagcugccuguaguacucauggguuagaagacagccuguaaaagauauuccagccaaauuaaucaggagauuaaauguacuuuacauuaaaaaaucagugcguguauguguauaaaaaagcugauuuaaaaauugucaugggaagcaaaacacuuacuauaaagaauucugaaaaaguuaaaggaaucaaaacuaggcuaugugacauuaguaagggucaccacaaagcaaaggacccacauagugugcgguaugaaacugcacauggagagaccagcugcucacaagggcaguaauguggaggaagacugucuuuuuaauaagcagaguugggauaguucaacaaaagugagcucaaaugugucauaagauaaauguaauuagagcugcaaaacucaaagccagcugcagaaguaagaugcaggaggagaccuucggauaagggcuuaagcaguaaggucuuggaugacaccagaagcacaguccacuaaaggacauucgacaaggugugcugcuccuuagcuugcuggaccugccacagcagaguagcauaggccagggggacaggguccucugccagaaugcuggcgggguugguucccagcuugcugagagcuggcugccuucucacuguguuuucaugggccuuagaccuuagagucccuuccucugucugaaaaggugucaauuauauuaauuagaacugacccgaacagucucguuuaaccuuaguuauguguuuaaacuacucgucuccaaauauggccauuuucuaagguacuaugagugaggaguggguggggguacagaaguuaguucaaacuguaucuagaauauauagagaacacucagaugucagugagaaaauaacuugguuaaaacaugggcaaaggacuagaagacagacccuuuagcaaaggauggcagaugggggcuuaaauagguauucagugucaucggcaauuaugaaaaugcaaacugaaggcuccgugagacguggcugcaucuguuagccaucuauuaugaugacugaugcaaagaaaggcaucugaauccucacuugcugcugggcaugcgcaguggucccuugcugcugggcaugcgcagugguccccucacgcuagaaauagugugucaguuucuuagaagcuaaacauguaccuucuguggcugagcucgccccacaccuucguuuuuguguaaccugcguacaguauaggcgcucuggucauauuugccgaaaguugaaagcagcccugauggccuucagacugugggugcugcauauuugaggccccgaguucaguccuugggucuagagggguguguauguauguguacacucaagaaaacaacaaaaacacgacuuacucaugucaggaaguacucugacauggguaaacagacagaauguaaauucuagcagaaaggaaugaacuacuggugugugcaagagguaggucgagagacugcauccugagugauuuauauggcuuuccaauaaaacaggccuguaguggcacccagggaggguaauuucucuaguggguuuugaggcaguggagcuuugccguggccugauggucacgauagcaacgauguauauuuuaaagcuauauucuaccuaccacaauucauguuacugucugauuuuaaaaaucuaaaaccccuagucuuaaauguuuauugcauauguacauauaauuggaaaguucaguuuuucauguuauuagcuuacaauugaacauagguagcacagcguucuucuauuagaccaugaagaugcaacaucagugcuauggggcagcaaaagguaugaucucugucucagcuauuuauuaguucugccauuguauugagaaagcagccuuugacaguauuuaaauaagugagcaugacuguguacuaauaaaacuuuauuuauaaaaacacacauucuuacuuauccuuagagaaucuggcucuacugaguccuuuguuuaugcuaauucaagguuuucaaguagaaugaccuuaaaauauaccaucaaaauuaaauaaaaauuuaauucuaagaguauggaagcacauuguuagaaaugauagacaguagacaugcaggaagaacacccugagcaagccagggauauuugccacccugucauucuccugugaacuagaagguuccuuugugguggacguguaccuggugcaguuagcuguggaaaagcaacaagauacauacucauucagggugagcauggaucauccauuuccuucugacggggugugugugggccacacccaguccuuauccucccccagugcacagaauagccugguguuugcuuugugugugugugugugugugugugugugugugugugugugucuguguguguguguguguguccccgugggccuuuaagccucacuuuccucucuguguccuuuccccucaucccuucccuauguuagacacuuccugucuuucaggucucagcauggauggugucaucaucaggaagccaucagacccagaagcuaaguggagcaggugucuguggccacauccuuagaccuggcugugccucagaaguggcuugguguuagggacagguuccuggguuccacuuggaaucccuugauucagggcuaauguuuuguuuguuuguuuucuauuucagcauacuguuuuuguauaccccaccagcuggguuacuauuuggaagcuauuuagaauacguuuauuguauauguuguuuuaggaggaaucuuaggaauaaauagucucuucuaucuuguuuuugcagaguagaggggucaggaaaaggauccaguggccauugcuugcucagauccacccugcggcuuauugcaaucuuagcugucauuucacaccccauuuccauguccacagugaacauccucuucuacaggauaaguguugaaagcucuaggugcucaguacccagcaagggucaguuuuuacaacgaugguugucuaacugugguaccuggccugccccggguguuggugauuccucuugauugggcugcuuacuuaccuguauuccaaugugcagaggacgcuccucauaccugagcgugcucagcagugugaagucagcucaggaaaacaacuuuucuauacuagucuaaucugucugaaagccuccccauggcucauucagacaaaaucucaagcagaucugaaaucaagaauuuucaaugggcuggagagacggcucagcuguuaaaagcuagggucacaaucaaaaauauaagaauuuucaagagcguuuguagacugagauuauuucuaaaucuguaggauucucaucaggcccucuucaguuugagaaagauuaccuagggucugcgggaguguggggguguuaggaagugccgaagugaaaauagguuaaggggacagagucaggauaaccuaagccuagcucuuaagcuuaggaccuagugauaugaggucugggaucuaggcccaggacugggcgcugugguagaaguguggcuggugcugaggaaccacaacuuguuugguuuggccagagcauaaaguaaaacuuugggaguaacuaggcagauaggugggggccagauaauaaaggguuuuauugaaguuaaaaauacuguguuucacaacuucauauucacaugcacaagaaugaaauuggaaacucccuauggugcaacaucauacagaaaguuacuaaaaguggaucauugaccuuaauguacggguggaaaguaaagccuguuggcaaagagcucuggcaugcuagcuuucucaaccgucgagaaacacagagggacaaaacaagccacguuggacuucaucaaaauaaauacauuaaugcaucaaggagaugaaggcgggcacuaagguguagccccaagcugaugugcuugccugcuaggccagugagacgggaggggaaaugagaagagcuccuaaugggagagaaagugugcauggugugcagauuaaggucuaaacuucuggugguguuuuaaguggaugcgcuaggagugaugacgcacaccuguaacuggguucuagaggcgggugggcauccccaugggagagccaaaggaaaacacaaaguaacagaguuccaaggcuauggggaacugaagcagaauguguuaguugagauaguacaagacacuagagcugcuuuggaaaacaauuuggcagcucuucaaacaacuuuuccauucuagugauccaucuucaaagucaugggccuggaauauuauacagcccagcauuuuuuaguacauuuaaggucuguauuugagagaauuagaaacagguuuacccagacauuuauaugguuucauauauaguaguaaguaguauuuauaacacacgaauaugaaaagaacccauguguuauguguacuguucuugucacucugagcaaacaccugaaaagaagcaccuugaggggaagagggaagcuuuauuuuggcucccgguuagauggggcgugaauccucacggcugcgaauggcugcgaagggagcuccaucguguuggaaguguggaccugcgaauccucuuggcaugccucagaacagcagggaugcucagccggcuucccccuccccugagucugggcuggggccucagcccaugggaugaugccggcuacagucgccgguggucuucuuccucacuuauaaucucugcaagcacagauaugcccagaaacguguuuccucagggacccuaggccaguugaguugacacugaggauuaacuaccuccuucuguauccuucagcgaugaguagaaagcccgacuguauuucucugcaacgugauaguauuugugaauaagaacauucugaguagcaggagcacuaaccagugaccccguguugcucaguuccauuuagugaaacauccauacuacucaagaccccagggacgggagagugggaaugaucgcugugggcuuaggggcuugcuuuuguuuuggugcuguggugaaauauucuaaaauucagcagugauggugcuccacuaacuaaucuaugaaguggccgcagugagguccucagugaaagggaaacugcuguggaguccucugagggcugucaacaaacagcaagguguaaugcucauggcaggccacuucagugucugcuuuuaagaaguaugaaaauucuauugcaauacugacuuugguuuuuuuuuuuuaaaguucauacaugcuaauaucuuggaauguuagccuugcucauuugaaaacuaaauugcuugagcugaaucaaaacugauaaauccagaauaaauauuugagauauuauugacuuaauccugaaauaagugauuuuuuuuuuuaaagauaggguuuugcuacauagucuugauuggcauugcacucucguacugccucggcaucuuaguuacuaaaaucccaugucugcagcuaccagugugccacacaaucauaaugcauucaaaacuccaugguuucugaugagaaaaggcucugaaauagaaguccccugacuuccuuuggaccucuaccccgcccucacagaguauuaccaaguaagauacacugaguugcacugcagaaagcaggaggagggggagcucuuaagccgccuggcuccggccacuggaaagagagcaccagaaguuaauuauucaucccagagagacugggguuuggaacugauaccuuauagcaaguuuuugacagaccuuuugaauuaauaagucaaagaguagugacagacccucugaaagcauagugacuaguggcuuauuucaccugcucacuaggaguuuacugucaugauuucucagcugaauauggcuaaugagagcucugaguaaaucagcucuuagccaaguauuuugagugcagcagccauuuugaaaggacauuugugacuuuguccaugaagagugugcccuccuguggccucugggaacaaauuuucagcucugaucaaucagcuucacguugugaugucacacaguggagucaccauaccucuuuucaguaaacaagugagacuuuugaacaggucugauuagagauucacugagucaggaaguagcauccgguuuuauuuucgaugcccaguguuucccccaggucaccaugucccuguuugcagaugcuccacagugacauuccagguucauuguuuaugugaugucucauccuggagaaaggaacagaauuuacucagugcuguugggggguuugucacacuuaaaagaaaggaacuuuggcuagaaguacucagaucuguuuuccauugucuccauaugggcaucgugaguauuuguuagugaugaagauuauaaguugaagaauuuuuaaaaacuuuuuuauauguauauuugccuuauguuuguguuguaugugccuggugcccaugggggccaggagagggcauugaauccccuggaauaggaaugguggagagccgucaugagggugcuggaaaagcauccggugcuuuuaaccgcuucaccaucuccuucagcccuaaagauaagauuuuuaaaugaguuuucccugcauuuuuuaaauuuuuaacuuucuauagggaauauauuaguuacuuuccuacugcuuuguuaaaacacugugauguaaggaacuuagagaagaaaguguuuauuggauuggcuuuuccagagcguuggaguucaugaggagggagcgaaggcaugggguagaaacagcugagagaccgugagcaggaggcacugagggcacuggagaugaccggaggcuuugaaaccucagccucccccacccaugacacauucuccaacaaggucauuccucgucacccuucccagacagccaacuggggaccaaguauucaaacaacuuaggcuuacaguggggugggaaucacacucagauaccacaaaaagaaucuuuuggauuuaaaaaaaaaauuaaggcagagucucacuuuguaaccuuggcugaccuggaacuaacuuuguaaaccaggcuagccuugaacucgugucaaccgacacaccugccucucccucucaucaaaugaagugcuaggauuaaaggucugugccaccacgaugacucuaaaaaaguaguguguggcauauguauaauguguguuugugcauguuuguguguguugaggucagaaguuggcaucagugucaccuaucaacugccaacauacuuucuggagcagagaucauccggaugcugggaugacaggcauguguagccauacucgauaccugugcccugcuuuucuguggcugccgaggacuuagacucagacccuauugccuguucagcaagcacauuaccacgggaaccuucucccggcccugggagagucuuaagugcauauuuuuaguaagagcuuaacuuuuuuuucugcuuucuuguguacuucccuaguuugcuuacguguguuaguggagggaaggaguauauuuguuggugugugaaugcugcauaugcacgccuuuguguauggggacucaggugugugcagguguugagaggacauguaugcagauguguucagagacccaaguuugacggcuggaggcaucuucagugcucucaucuuacacgucgaggcagggucccuaacugaguccagagcuagcugcuccugcugucucuguagccagcuugcuguggggguucccugccugggccuccagagagcuggguuuuacaugaaucuugggaagcugaauuccauucugacccccaacuucagcacaacaaguguuuuacccgugagcccccuccccagucccucugcugguauuuuaaugcccugguacucccauguuaauugucagauuuuccccaucuauuacuaagggaggacugcagcuaaaucuaauccuggccauaugauaagaucuuccuauaaucgugggauugcuuauguuuuucccuuuagacugauauaaaaauuaauuaaauguaaacacuaaaauacuuugaaaauucuuauccaguuuuauagcaucuuaaauuguuaaagauuuacugccauuuuuuuaaaaucaaguucauagauauuuucuacuuagauaaacaguuguaaacacucauagucuaauaucugauugauuuuugaggcagaaggcaggguuguguagcucaagauggucucuaauuuugaacagucuuccugacucuuccuaagugcuaggauuggcaggcaugcccucauacccagcuuaugaauuggcuagcuucugucuguccaucccucccuuuuuagauuaaagaugucauauagcccaggcuauccuucaauuucuguaguaacugaggauuaucuugaacuucggauuuuccugucuccaccaguggauuauagugcugugguuaaagaugugugccaucaugccugguuuuacuaaguuggggguagaacucagggcuucaggcugccgugcaaguauuccaccaauugagccaaauccccagcuccaugaaucgauuuuuaaauuaauuuuauuuuucaugaguggcuuauuuugaauacauugauuuuauuggcaacauguggauuugaagugacauaagggggcugcuuucauaguuagauucuaauuaaagauuucaggccaauccccucuguaguucucccagccuuugcaugaagagcucuguaguguaaugcuuggaggaauucacuaggaagucuggagaagacuuccuggcuuugagucccagugcuuccacguagccagugguaugaccaagcaggcuuuucacuucguuuuucuuauuugcaacacggaacaggacugguuuuuaccuuacagguccuguaagaaucaagugaguaucaagccacuuagaacagugcccaguuaguguggcaguaaguuuacacuuagugcugggauucauuaugaaggacuuggugcuggcuggcuguaaauuagauuguaaauuuaauuauaauguaaauuagauacuuuaaaaauauuuaugauugaaaauaaacaauaaacugauaagcuuauuauagcuuuuuuuuucaugaucuuuccucuucuucuuuuaggcacggaaugucaacacuggagaauuagcagcaauuaaagugauaaaauuggaaccagguaaauuauuugaaauuugauguuuuuuauugcuagaaagucauuguauaucauagaguaauuuuuuuauaguucauuuuuaaaaaauggucuuuguaguucagguugaucuuaaacuauugaucuucauaccccagcauccuacguccugcaauuguaggcaugccuggcuaaugcuuauuuugauguuugauuaccauucgcugguuugcucagugucucuccuuccuucuuccucucugagcccagcaugggcuuugcucagguuuuccuagagaaaugguugguagcucugggauggagaguagguccgcaggggaugugacaucagaacuccccagacuaacuguggcaaguuuauacuagcuuacuuauuuccagaugacauugcucuguuaugagaggcaagugugguccagugggaaagaccggccuacauuugggaagcuguagucuggguguuuguguccuguccucuugcucuguguccugaguuucucaacagaccucaccagcucuuagcaccugugugucauuauaucuaaauaguccuuccgacuugaucagcccauuauaaagccucucagagcugucugcucuacucuguucuccuuuguguuccccuaaaaccuccaucuuccugagccuacugcucucucauauccuccucugaaccaccucgcucucuccuugcuacaguaagcaagccaucacgcugauggguagaugcagcccccaguacuuuagguuuuagcuucagggggaacagaaaucuauucagagacacagagacuuucuuuuuuuuuuuuuuuuuuagggaugggccagcuuuucucugaaugaccaauaauauucuagaugcuucaggcugaaauauaaaguaacauucugagcugcaaaaccagaccaccuucuguuagaguugcccuacccuugacuuagcucauugguaaauuccuuagaaguaccauuaagauggaacuuggaggauguguugcuugcuuguguaaaccacaggaaaauaccaugagcacagaacacauuuucaguuagaugcaguuacugauucccuauacuguaauuaccuuccaauaucgccaguaggaauuguuuguuucucuacuauucaguuuguaagaccgauguuugauguuggugaaauccggacaacaguggaggaucuggcacguucaccagaccuuuuauuuuucaucagugaguagaaguuacuuggugaucuggccaggagucccaagucaccaggacuuaacgucauucucccacauaggcugccugucuucacagacuucuacgacucugagggaaugagccugcuaagguuguacccucgcucuuucauauuuccacauuuuaauaaaacauuuucucagcucugagcuaaaguccuggcacagaaucuacucaguauaucuuaaaaucuccuuaaaaaucaaacuagaaacuuagaaagcugucaugcacucaguuguuuucugauauguguacugggugacuugugauuuauuuauuggucuucaacauugcuguguauuagaagaugcgcaguuacagaaagacaaggaagccguuccuuucuacuacuccccugucguuguuccugucuuggggaauguguacuucucucugaguuuggcugggcaguugaaaucacagacucugaaagcagcucuuucccuacugggcaggacuuggucccauucccuaugguuuaaggauuucuguuucucaucucuaaaggagauaguaauagucgcuucauuuucagaucuguuaugggaguuaagcagggcaugucuaaaguaaaguacuucaguagagccuggcauucugcacugaguacggacuguaaggaaaagguugcuauugccacugugcugaaguucccaaagugugaccagccuuguuuuguccauuccugguuacccuccaagcacacacacacacacacacacacacacacacacacacacaccacaccacaccacaccacaccacaccaguuuguguugaaucagaucugaagcaucaaaucaucucuaaaaauaugucaguguauaaagggaauaaaaagugaaaagugacaaaacccuugugucuacuacuggugggagugugagacagugcugccacucuggaaaacauugaguucuguggguuuuuguuacugugguugguuuguuuguguuuguuuuggagauagggucucacuauguagcccuggcuguccuggaacucacuguguagaccaggccacccuugaacucagauauccgccugccucuaccuccaaggugcuggaguuaaagacuugugccauugugucugcuguaguucuuucuuuaaaagugccuguagauuugccacagugacugggcagucacgcugucauuucuagccccacagcuugcacacgagcgucaguagucauaguaccccuguucuggagucaccgugacccuggccugugacccuggccugugacccgcugcuguggagugcagagaugggagggucccuggggcugccugcucuucacagccuuguccacugagagacccugucucaagggaauaaggccaagaguaaaaaucagaaaaggcaauguccuccucuggccucuguauauaugcaugggcuugcacuugguuacacacaggcauguguauaucacauaugaaauuucuuuaaagugcucaauauauaaccaagagacaacuaacaauauuaauaaguuucuuacuaauaaaguccccauauuggaaauaguugauaugucuuaacugucauuuauaucugugucucuuuuugucuuuuuuuucugcaguuuuuuuuuuaauaagcuagauauucuguccuauaauuugucaucaggaugcacugugcugauuugccccucuguguuaaauaccauguugggaauucuuagcugugaaaacugaagaaucaggcuuugcuuggugugggaaagggucugucuucuugggugguguaguacccacgccuuuucagaauucugguggucgaucuccuuuauaaaaauaaaauuuaacucugcaacagucaaaugcaauguguuauagacuuuaagaauuuguacuuugauuuaguuauuuccuuuuuucuucuuuuuuaauagcugguaaccauuuugaaacuaaagcuaagugaaaacuugagauacuuuggcaacauuguuuacaugugagguuaguugaaagugucucacugugacuucuaauuuccuuuucucaaguguuuuguuuuuugcuuaacuauaagucuguccuuuuuuggacuuaaauugcaaaacccauuuuuuuguaaugaaaguaggaaaauagaauuaaagcagagguagaaauuaaagcuauucaucauucugacuuguaaauccauugucaacuuuauuuucucuagauuuuuuugauauuuacauagacauacucauacauacacgugauuauguuuacagugcacuaagcagauugugaguccuggucaaaggucaaagguaggcaagaccguacuguagaucagcguaaugugcuguuuuccucccagccccaaguucccuggauagcaacucagacucaaaauauauccacaaaugccuaggccauauacauagcuaggccuuuccccugacuagcuaauaauuuaagauaacccgucugucuguauuaauccacauugugccgcacagcugguuacccguccucagcucgggugcuaugcuucugugucuucacaucugucccaguaccgccucccgccugccucuaucccggaagucuuucugccugccucccgggugucccaccuucuagucuacccuucccuguaggccaugggcuuuuuaauugacagguuagacauccauacaauacauggguauucucucuacaggucagauguuagcaugaugcauguaaugagaucucuguaguggucuugcagaaguggcucacaaggguggucaguacugugagcaaucucucuacugcaagcaucaggcuggguagggggaaaggcaacaucacacucaguagcaggaauaaguucugugagaaaagacggcgauuucugguauuuucccuguacaucuauguuaauuuuuacugcaguucugggaaucaggccacgggccuuguucauugcuaaguaagaauucugucacugguccucagccuggcuccauugcuaacuguguucucaggcuugaaguggucuugccuaucacagauaccaaacauguauauuuuuauggauaugauaauguaucaugaguauuuuucuguuccuauuucuaaacugcuaucucuucuuucuuuuucuuuuuuuauccacaucuaugucuugggacugccugagauuggaguuacaaaugguugguagcagcacaucagccccugagucccuagagagcagcagggcucagugguaacacagagcuggcuugcuaguccuuaacgagccacuagggauucugucugcuuguuuguuuuugugggguuuauuguuuuuguuguuuuguuugagggaggguguguuuguuuucuugucugagacaaggucucgauauguagagcaggcuggccuggaacucauagagcucugccugcuuguggcaccugaaugcuggcauuaaaggccugcacaccacaccuggcuacaagacacacucuguuuugucaucaguuuuagaacugacugauggcagucuuacuaggaacauguauauuagggauaucauagucagaaagguugaccuuaauguuuuuaggauuucuuuuuccuuuuuuaaaaaaguuguuuguuuguuuguuuguuuauguacacuguagcugucuucagacauaccagaagagggcaucagauaccauuauagaugguugugagccaccauuugguuccugggaguugaacgcaggacuucuggaagagcagucaguguucuuaccacuccaagcccaagauuucuuuuucuuaggccuuugugaaaaucauaguauauuuauuacugagcuaaaauuguucuccuauugguaauuaccauuccuuuggggcuagugguuggcuauuuauucuaucuuuuggcuuuguauucugugaaaaauuauugcugucagucauuugauuaguauuuguucauugucuagccaaugccagacauaauagcugaggcaaaugagccugacccucgagaagcuuagauuugauuaacacugacacaaacuauggaauguauaaauacguaagcucguuucaugagccaaagugagaugucacgguugaaagugacugaggacuacuucagccaguaucacagugucaggagacugcucaaagcugaugacacuggcuugagauuugaaugguaacagucacaggauaaucuuggggaagacuaugccggguagucgacugcaagcaaggcuagugcucugaaguaagagcaggcaccaaaaugaagaguagagacagcugccaugacuccaucagugugaaccaauucccauuggaaugaaaugagcuuccaaauuaggacuggaucauagaugucccaaggacugugauaaagaggacccuauuuaucuuuuagagggcagucugccuggggaaccggacuguagagccaauaacugggauugacacuguauguuuugcaugucugagcaugccuguguugacuaaacaguggccaugcaucugcaguuccagaaaucaggcuagugguacaguuucaagauccuuaggauauaacuaguucuuaaagcaagauaugaaugauaauguuacccaggaagaagauaaugauagaggagaaagggcuggcguuggaccccaagguuaaauucuaauguuagaggucuucuagagaaggagaacucagcaaggaaagcuugagcaugagcaccaaagucauccagcuacuauacaacguggaaauauucugucagacccuagaaaaagucuuggaggcauguggggaugaaaacuggcaugaugcuaagaggugugugcaucacagugagaacugugggaggugugugcaucacagugagaacugugggaggugugugcaucacagugagaacugugggaggugugugcaucacagugagaacugugggaggugugugcaucacagugagaacugugggaggugugugcaucacagugagaacugugggaggugugugcaucacagugagaacugugggaggugugugcaucacagugagaacugugggaggugugugcaucacagugaguacugugggaggugugugcaucacagugagaacugugggaggugugugcaucacagugagaacugugggaggugugugcaucacagugagaacugugggaggugugugcaucacagugagaacugugggaggugugugcaucacagugagaacugugggaggugugugcaucagugagaacugugggaggugugugcaucacagugaguacugcuaagaggugugugcaccauagugagaacugugggaggugugugcaucacagugagaacugugggaggugugugcaucacagugagaacugugggaggugugugcaucacagugagaacugugggaggugugugcaucacagugagaacugugggaggugugugcaucacagugagaacugugggaggugugugcaucacagugaguacugcuaagagguaugugcaucgcaaugcacugcaggcugaacaucuguucagggagguucagugggugggaggagcugugugggaggaugaggggaaaugaggggcaguaaagucuucucucaaggccuccucugaaaaggagcaggcaagaccauucgcuagagggacuuguaaauuaugguggauucuucuagggugcacacccauagcuagaagggaagagaguaugaugcuuaugcaucuagguugggguaacugaagaagugaguucuggucaaaguggggcuguuucuuuuugaacccauaagauguaguuaccagcccagaaugagaccugcaguauguguuggauccagugacagaaaugaacaugugaaacaguauggagaaugggaauugggguuuuuuuguuuguuucucucuucccccccacauacauggcuguauauauggauaucuguaugaauuucuaugaauguauguacacuaucugacacugauauguggccaguagaaaaucagauguggaaauaaauacauaagauuaguauguagcuguuccucacauacaaguguggagaacuuagcucuaaaugucauuguguugugcuguguguguguacauuuauguaugucuaugcuaauacucuucccaccuccaaugagcacacacacacacacaggcgcacacacaauggucagagagaaaggugcuuucucucugagugauaagugacaagcacuagccgggcgugguggcacacaccuuuaaucccagcacucaggaggcagaggcaggcggauuucugaguucaaggccagccuggucuacagagugaguuccaggacagccagggcuacacagagaaacccugucucgaaaaacaaaacaaaacaaaacaaaacaaaacaaaacaaaacaaaacaaacaaacaaaaaagugccaagcacugcgcugggccugcagucuggccuugagcacguggcuggguuguagaauggaguuuugagguuuguaugguuaguuccuaagaaguuggagaguuugguugaccuucauuuuucccuguauguagugaauuguuucaauaacaccgucugcuguaaauuggugacaguuucauuggcuuugcuuaagauuuuccugguuuuagggcugaaaguacugaauugcaaagaucagcccuuagccguuauuuguuugauagcagcuguuuuguugcacacauguguggaucagaagaauaugaaagcaagacauaugaauauauuaugccaacuauaaaugccaagaauuuuaaaaaugcuacaaauacugaguguuggauuaauacccuuucugguuaguauuggaguuuucgauaacaaaagcaugcacugucuugucgcaggucauugaggagcauaauaaguccauauucuuagcauuaaaacccuuucacauuaaaaagaagagcauggggcuggagagguggcucagcggggaagagcacugacuguucuuccaaagguccugaguucaaaucccaacaaccacaugguggcucacaaccauccuccauaaugagaucugaugccuucuuuugucuucuuuuugaagacagcuacaguguacuuauaauaauauaaguacauauaauaauaaauaaaccuuaaaaaaaagaaaauuaauguaugucuauuucuuuaugggcuggagagaugguggcucagugguuaagagcacugacugcuuuccagaggcccugaguucaaaucccagcaaccacauggugauucacaaccaaccaucuguaaugggauccgaugcccucuacuggugugucugaagacuguaguguacucauauaaauaacaaaaagaaaucuuuuuuaaaaaggacaaagaaagauacuuauuuaaaaaaaaauaaaaauaaaaaaauaagaagagaguggugccgcagguuucaguagacugucauuacuaugagggugaccuugguuuucacaggguccccagcgucuccuaggcacucaguaaauacuugcuaaauaaucaaguuagugaggaagguauagagaugagcauggaagacagagaugaguuaguguaagccauggcauuuguaacauuuauuuaaacuuaauuugugccagccacuguacuaagugagguacaugcauugacucauuuaauuguuauguuguuaucgcuauuucuuauuguuacagaaguuacugaaguacuuuggccgaguaaugaagaguuaggguuuugaauccuagaaguccagguccacgacuggggcucuuuaacauucucugggguccgcaguuguuacagaggacugggguucacuuaccagaucccacuuaguugcucaucgucaucuacaguuguaguugcaaagggacgauggcuaaccgccuuggccuccacagacaccaggaacaaaccauagaacacaugcagauugaaaugaaacuuaaaagcaccaugugcuuuaugacugauggcacaacagccauguccaucguaacuucauaguccaaaagagaggaccuuaccuuugguugcagcccagugcguggcuuuguucuaagcuugucaaaacacugcuuuguuuggacuucaccucagcuccacuuuuguccaaacaguguuauccuguaauaacgguuuugugcgcacuugcugagauagucucagugguuccuccacuuucccucguuggcagugagugcaucagugagcccaguucuguugagauuaaagguccgugucuuugcucuuagauuugcuuaggcuagaacacugccaacucuugagacccaguuugaacaaauauaaagaugggucaagauaacugcuuccauugaggcuggcgagcggcguagagcucagugcucguacacuugggccuuacgcucagaaccugauaagggguguucuuucugcuacaggccuucugaaucuuccuucuuuagugacuuagucagucuuuaaaauugcauguaacuacuugucaucuauagcaccaauuacugaaguaggauuaaguacagacagauacaugacuaauuagcuaucagcuauaggggaaagucuccccuauagaaugagaacauuuaucccuuuccaacacagugaaagauacugacagugaugagugggggcauuaaugggggagggguuaggguuuuuuuuuuuuuuuuaauuuuccugugagagcagcacgcauuaaacugugguacaguacuuaaaagugauaggauucuggaaagaccucaucuacuuauuuuuccacagugguauucuaugagcauuucuucccugucauuuaguucucuaucucuacagguugugaagcauuccacguccuuauguuucaucauagaaggacaagucuuuagggaaaggaccuacuugccaccuguguacuugaguagaucccuggccaccacuuguuugcccugcacugccuugaguuuauugucauuauaaguacaguugucaagacaucauuuaugauaacacuauucaaaggaugugcuguugccuagcaacucuacugucuuagaccauguuauaaacuccaggcagacaguauuggacagaugagguauuucccccugaugcuuagaaguaaaguaacucaggguguucuauuuuaucugcacuuuguuccucuuccacuucugaucaguggaucauuacuuauuagcaucuuauuuucuuuuaaagauuuauuuauuauauauauaugaguacacugucacugucuucagacacaccagaagagggcaucagaucccauuacaggugguugugagccaccaugugguugcugggaauugaacucaggaccucuggaaaaacaaucagugcucuuaaccacagagccaucucuccugcagcccuuuauuuuuaaugugacaacuuugggacuaaaaaaaaaaaaaaaacuugucuguuuucuacaguccauguuuaaacuugugagucuguaggacccucccauaguauaguauauagccugauaccuccccucuuaacaacuuuaggcauaaaauaggcuuguugcuauaagaagaauauuauacaacagaguuugugaucuuguaugauugaaguuuguacucucugaacauccauucuccaucccaccccuccuguagucuucaguagugacuauucuguuuucuauuagauugucuauguuaaauuccauauguacguuagaauuauguagaacuuuucuuugugucacuagcuuugcauuuagcauauuagccuucaguuccagucauguuggagccauugacauaaaacauaguucucaucuuaaaaggauuagacgauaguuuauucuggagccaucuguagugaccauggcucaggaacacaaauggagguuaccccaguuuccaacauggaagcaguuuuauagaacaaagaaauucauaaaucaagacaaguuuaaaauauuuuagcauuggugaguacaccaaagaggaggauacaacaggaucgggagcaauucuauaggucgaagaugcuaucuauucuauaggucuaagauccuaucuauucuauagguuuaagaggcuaucuacucuuuuauaggucuaaaaugcuaucuagucuauaggucuaagaucauaucuauucuauaggucuaucugaugacauuccuggcuuuuuggcagaagcuaguggucugcuaaguugguagauucugaaagguauuuauuaccacaggauguuaguucugauauagaauauggcagugauguucagaacuaggacaagauaaggcaauuauccucuaauucuauaaaauuccaaucucuccacaguacugaauggccauuugguccaucagucucugcgcacagacuccuuccaguaguuuuucauucacauccagacauagcuucuuuucaggaauuuucacuaacaaggcacaugccagggucuccuuuuuauuuuaugacugcaugauacuuugguguguguguguguguguguguguguguguguguguguguguguguguguaauguuguguaugugucgcaucucccucgccauuuauuuggcagcugauauuaggaugguugcuaccucguaguuacugugaaggcuacugcagugaagaggaggcugcgcaugugcucagcgcauguuccccauucuucugaguauucccuaaaaagcaggacugcuguguccuauggaucuaauguggggaaaccuuagaauuguuuuccagagugcugcagggagccuaccggagaugaccucagacacaauuuauagcaauugaaaaucuuuauuccaggcagcuuggacuucacucagguguucggguccucaaaaaaaaaaaaaaaaaggccaaaaagcguguccgggcaucucgcucggcugcuucugagggccuucgcagaagcugguaguuugcagaggcuaagauaagugguuagcaggagggggcucugcacaggcaguuuagcagaagcuaccucagcuggggcaucuugaccuccaguuccuagagaguuugguaauucucugugcaggagccucugcacugucuugcccugucacauucccauugguucuauagcaaugagucauguucuagcggggaucggggaccaguagcuuaacugaguuuauucucugugauguaguuggccaugcaguuggggaugcagggucccaugguuagcccagucagaguaagaaucaacccuuaggcucguauuggcagugaggugaggucagccaagacugauggcuauucaugccaguuuaagcggccacacucccuggugaggaaagcauucccuguggugggcaggcacuccccuuguaaacuuuguauacuuugugaacuguaaacuuuuuaaacuaucaagacgcacacauggcucucugugugugugugugugugugugugugugugugugugugucccaaaaccccuagaccucccuaauagcuuuaacugcuguuuccagccccaaggcaugagaguacccaagucccacccuacaggaaaaaaucccaccaauccccaaauuggccucaacaucaggccaacauaaucccucuaaucccaaaccacacuggaaagcuccacccaccccaacccccacccccacccccuacaaagaagccugauauaacccuguguucugccuaguucucugcugcuuaaauggagcacaggcagccauaaaccuugugugagguuuguugucugaugugaccuuaugguauccuuggcucccagcuaccaggauaccuuuucaucccagcuauagcacguaaaauggggaccaaguaaauagagacuaauaccaaacaccuaagccaaauaccugaguguagucccacccagcuggaaugaaggcuuucaguugacuauaaacuguguccgagugaucucucuugugggcuccccuuaccccauagcagcuguacaguuucauauguuuaccaaccacgcccaagggguccaauuucuugauauuuuuagcuuauuauuuguaauuccaaacauuaaaaaaugauaagugaaaacuauauauuuuuagaucacauaagauguuugacuucuguacaucuuaugaagauuacaugaccccuucacucuugauuccuuuuuaauggaguuauuuguuuguuugcuuccuguauuuuagacaguaaccccuuaccaggcagguagacuacagaucuuuuccucuuagcagcuggauugucugccaguguuugccuccacaggcuaggaugcccuuucuguccuugcuucacacagagguugaaugugaccuagucucacuguugguuguuguuguuguuguuuguguuuugggucuuguuccugauaucauuugcuaagaccaguguuacaaguguuuuuccuuguuuuuccuaggaacuugauaguuucuggucuugcauuuaaguuuuaagacuuuucugagucauuuuugucucuauccaugcagagugcuguuucauuuuuggcauguggauauccaguucucucagaaccauuugcuguaaagacugucguuucccucuuguguaacguuggcaucccuaugaaagagccuuugauuagauguguggguuuuuucccccuagcugccccguugguuugugugucaguccugauuuucuaaaggcaaauccgcuuucuugccuuuccagcuucuggagcaacauccaaacucuugcuccaccuccagauccuguggugugcuaccugcuccaguuguccuguugucuccagugugacucaccuggauggucaggaugcucucccaucuuagggucauugcuuguauuguaccugcaagccccuuugucaugcaacauucaccaguuucugggacaaaaauccccagggacuaucacugaauuuucauauauuaacuauaguuaacauuuauugacuacuucagguauacuguauucugagaaccucauaugacuuuuuucuccuaauucucuuuuuaaagauuuauuuauuacuauaaauaaguacauuguagcugucuucagacacaccagaagagggugucagaucucauuacagaugagauaucauuacaugauggugaggcaccaugugguugcugggaauugaacucaggaccuucggaagaacaaucaguguucuuaaccacuaagccaucucuccagcccccuuuccccuaauucucgauucauucauauauacucuacuugucaacuugccuguuuaucucagaguuuuuggggaggggugcaccuucugaauguaaauucaauuaauagcuaaaaauguuaugcaaaacuaguguagaauugaaaagcauuuuagaaggcuaucugauuuaacuauguacucuuugguaucacaguuaaguguauuaggaauuuuuuccuuguucauguaucuuuggacuuucauacaaacuuugaagaaagucuucugagucagcuauucaacuccuuuggguuacuaauguauuaaucuguauuuucuuucuuccuaccuaaauuuacucauuccaguuaccucuagaaagugaauguauggacgcuuuuuuuggauuuugaaauguaggaguuaacuuguuacucacaauugacuuggaggaaaggaaaucuauaguuggaucaauagcacuuccuaggaaacauugcugaaagcuuaaagccacugauagaaaaggaagaguaaauggcucgguauagaagccauggcaguuguuacuaaaaccuaacccuggugcugguguucaacugauaugaggaaucgcaugcacucagaggucagaugcugaggacauggaaaugaguuaggccugguccuguccuagagggcuguguccuggugaaaauggaaacaggugugauguauguggagaugacugcacaggaagcuuguuauaguuaguagugaagagaaggccuugcugaggaggcucuaugacccgggaggccuggucuugcacagguauaugugcaucguagcagaggaggcaaggcucacuugucuucgguuauuccauaaguaccaucccugcacaggucaauauucuucugugaugaccacuaaugacucuuaggcuaccccggaaagagagcuucagcucugcugacuagcucagccuugaccguguauagcucuuccguuugaccgcagucaguaauagucgaggacagguaaaaaagcaguggacagacccugcaaaguaugucacguauccauggaacucgguuccagucccauaguuaugacuguuauucaguguccucuuggggucccauagagugugaaaggaacuuaaggagacucagucauguguaguuuugagacuucccucuccuccuuccagggacuugagguuuugcacacaagcuaaauuaaggucuugagaacucugucuuccccacuacuucuuccauuguaauuaggacucugguggggugcgguugagucggggguuggcaugguuccugacuaggcuacuucaggucucagcugcauuuacaauaggaagacgccacagccagaaaagucaggacuucuuacucugacaacuccaugcuucagaucugaacagucgcuaauugagcugucugugguuguaauacuacaaauugaguugcuuuggcuucguggugagcacucacuccccuuuguuccuuucuacugugucucugguucacagccccucgcugcacuucugugucucccugacaaguuacucuuugaacaucccacccugugauggcacccuaagguugccagguuuuauuuugaagaauuuggccaagcagaggguagggcagaugacugaccaauagccuggccggguguagauggaaugucuuuccuagccugacaccguugggaaaggccaaguggagaugcuuacguacaggacucaccuuaacucacgcugugugggccuuccagugcugcagagcucacacacuugcuggccaauggucuuucucuaacuuuaaaaaggaucacgucuuuauggugaauuucuauuuuaaugauucucuugccucuuccuuuccagcuauacacaggugugugccaccacaaccagccaaauguuguuuaguaacagggggaagcaauggguauuccuagugaagaccauuuuuguaauacauauuuccuauaacaaugcccuaaggugugcuguauuagcaggaaguguucguauggaaauuacccugcccgccauuuugaagguaguaacccauucaucccugugagguuauuuuacugagcaggacauuagcacagcgcuaaguacuuugugagaacagacucagggcccaggagucgcaucuguacuucuuucucaccaagguacagggcuccucaagccggggcugaaaugguuguuagaaguaauaccauuaaggcauugguugugcuggauauaaaguucauuagcugugccauaguuaauuguaaguauaauuacuuucacguguuuuaaaguaaaugagcauuuuaccuauugacuauccaacaugcuugcuuuguguccuaggagaagacuuugcgguuguacagcaagaaaucauuaugaugaaagacugcaaacacccaaacauuguugcuuauuuuggaagcuaucucagguacacuguucauuucccuuuugaaaaacaguagugguuccagcaccuaacaauaaaauugacucgcgccaugcagugauuccugauucuugcuuagaagacagaaucuuucacacgugaccuauuaugguaauucuguaacagugucaucagcaugugacuugggaauucugggugugguuucauugaggaagcugccucuacauacaccagcugcugccccuuucucuuaggcuuaaaagaauucagucaggagcaucucuuccccgagaauuuuuucuuaauguuuuguuuauuuguuuuuaguguuuuguacuucuggccucuuucuuuugauucauuuuguucaaaagacuaggaacuauaauuauuuccaugacaggcuuuuccagguuccaaagugagccucuggcuauguucuuagcuccugugcugucuuggcaagagcaggccagguucugugcuguggaagaucccccagaccugccuggcuccucucacuucugugacaccaugaccucauugcuucuuaaaguccucuaccaggaagagcagagaguguuuuccgauguuacugggggaggccagaguaccuguuacaggcucuguucucacaugacccacaccuguuacaggcucuguucucacaugacccacaugcagagcacugcugagcagaagagagagaggagccuggaguucugucccugaauccucaguuuauguaacaaaccagaccagcccuucuccucacuguaguugugagaagcaggguagguuagauggcgaugggaaaggaacaggagugggucagugcucaguccugcaugcauucuuaacuuuagucagagugaugguacuuuuaacagggaguggcucaguagcagcccaggaagucugucucagcaccuguccaucuggugggcucagcagggcaguuacugugggcuugagaagccgucuccuaaaauccguuaaguuuaugguacucagugauugauuccagauacaggaaaaagcgccacuccaaaacgccucuuuugccuguugcuuccuagggcaggcuggucuuguaaggagagcaguugugcuucccugggacaugggucuuaaauccuguuugucaagcaguguacaacauacgaagccaaagcuacuuauucgauacccuucaugugguaaaacuaucguauguugaguggaaaggucagaauccuggcuuccaucaguaguuaacaugugaguuauggcagauuuuuuagucacuuaguguccccauuuccuccucaguuacauggaggugacaacaccuguggaauggguaccgauaagaacagguggcauggaaagugugacauucacugaauguuaacgccgcugccagcacuguccucagaccauaucagugccucggugaucauuucaaccccuugagcaucgagccuuaguacauguuauguccagcuuacaaacaaggugcuuggaaaggucuagcaccaaguuugcuucuguuuuauuccuauccaaauguaaagauuauagugaauucugccccacccuggaccaaauuuuaaauaaaguuagggucauuuuaaaaaauagaacuguguuccuuuagugcuguggggauguaacgugaggaugcugcuuuagacaggugacaguuccaccacuggcauugcuaaugacgacgaaaggacgaccugaaagcacacagaagaguaaaaaagcaacagcccuuccuuccuuucuguagucuuuauuccugauuaaguauggacuuggaccaaagaggagccauggaauccuaagaauuagguuuguauuguguucaagcuggaaaggacagagagaucuugucaugcagcccacucuuucagagaugagaaaucaggacguaauagaauccuuucuucuugaggcucaguugcuuguuccuggcaggauguaagccuggcucugccuguucccucacugaggccucuuuggcccacaguacuuacuacccagcuccagaacuccaaaugcagccagcucauuuuauaaaggucaagggaagggguuugggguuugaugcacccccccgcucccuaauauugucacggguucuuuugguguugcuauuacugugcauuauaacaguauuugacaaacaggugcagaagugaggugugcuuuaacgaccugccccgagggaucaggagcagcccaccagucuucuuaguagaugcguagugaauauuuaaggucuagaacccacuuuauagcaggcugucuacacucacuucaugaggagguccugacugaguucccauagugcugaguacucgauguucucaacaagaugaagcauuggugugaaguccaacaagguccacacaggcuaagcuuuccucuggugacuuagauuaacuaauagcaugcugcauguuuaaugcauauuuucugaauauuuguguuucucuuuaaaaaaaacaccaaagacuuauccuuuaaccccauuagagccaaggauaauuuaacucccagguccuucuaacauuuuuuuagacagaaaaagacuaaaguugucacuguuagucuacaguuaccuuugaagcguaccuuugauuuugaaacuuacuagauaccgaagaguggagaaggcaauagaguucuuuguguagauccuucccucgccuguccccagugugaacacagccgcacgguaucagugagaucaggccccgagcgucagacugaugccuuggcacgccuuccacuucauuugggucucaucgguuuucugcuuguguguucagauugcaagggcauugggacuuuggagaacucgaggcuguacugagggaugcuagaguaaacggaucgcuuucuagucccuagggagagcacgcugggugggacaccugcccuuaugcuuuugagcaucuauuuaaaaaugaaucaggauuucaaauuugccugagugaauuagcccauaugaaaauaucuagugcucguugaccuuuguaguugcacacuggugacuuaggaugaaguugaaucacuuuguggaugcaguggugcagggauugcuggaccgaggccucucccagggggacgcagcugagugugcucuuccagcagcaggaccacacuuuuguuuuccuguguuugugaacaauguauaaaccacacaaagcuuauuguuguuaaaucugugggaugugggaagaugaaaaaauauguuuuaggaauaagacuuugagaucaauguaacaguuguuagaacauuguuucccuauaaauucuuauaaacaucagccuggagauuaaaauaguggcacacauuuacuuuuauuuuuuuuauauuuauuuauuuauuuuugaguaaggaaauuuuacaaaauaagagaaggcuucuaaacauuuauugaggcaggacaucaauacuggaucauuuaacauugaucuugugguuacuuuuauuuuaauuuagaugccuagccacaaagacccauauaauuuguugaccugagucaaaugggcccauuggcucagccccaguccuguugaacagaugguucagcggugaccugcugcacugagaguuaucaucacaauggagacauuugcgagcagauggagucauuuuucuaagacauucugacuauucaagcuuuauuuauuuuuauaauaauggauuuuaaccaaauggaguguuauaaauguuaagcauuuuuagcaucuuuaaguaguaucagcauauaugguccauauuuuuucuuugccuguauaaacuagaaagucacugcauaaaguaaauuaacacuguauuuaaguaagaugaaacagagaauguggucuuuuaaguggaagacaguggcagugaauuggaaagacagcagacaacuggucuccaguucauuucucugcuguggagaauuguuuucauacuggauagggcaggaaaagcauuacugcaauggagcugcagcauaugacaggugaguaggugguuacaaggcagcucgacgccuucagugaaucuaagcuuuagauuuacguaagcucacccugaacauugggcagacgugauugucauccacuguccguagauguccuuucucaaauagaggggacauugaagaugagagauaaucaaugauuaacuuacaaaagggagaaagacgacuucuaaaaacuacagucaaaucaaaugucagcuuuuuccucagcaaacgucaugaauaaauuauugauugugucaucagugagcacuuaaaaguggcagccaaccuggccuuuguggaaagcaaagccaaaucagcccuucucguugggauguuuuuauucuuacaaaagaaaagguaaugacuucacauuuuaaaguuuacauugaguucuuggaauaauuuaaagugauuuaaaugacuguaaguuauaauauaagugaagaucagccugcagauagagacaucuuuguuagauauugauccaacaaagaauugauaaucagaauauaucuggaacuccaggaauggcaggauaacgcaguuggcuugcaaucacaaugacuccagcccuugagacggacaaaaaauaccaggccuguuagcuaacuuauaauuucagcgauaaggauucagaggcaggagaaucgcuggggcuuucuagucuaauuggaagcucaaggucaaugagagacccugucucaaaagacguugaccuuauccccaaggcuugcacccauguuuguccucuggucuucacauacuuguucaacguaccugcauuaauaaaggaaauggaauaugguguuucauugacgcagauagguguuggguuccauggagaauuuaaaacauguuaguguagugacuucuaguuggaagugcuccucucacuuuuuuuaauuuuuaaaucuuauuuuauuauuuaacaugcuugaguguuuugccuguauguauguauguauguguaccacauagguguccaaugcccucagaggucauagauccccuggggcuggaauuauagacaguugugaccugauacaugggugcugggaauugaaccuaugcucucaauuaggaacaagcgcuuuuaaccauugagccaguugccuucugcauuuugaauaagagcauagucaacuaugcucuuaaaacauggcuacugagcagcaguugauauuucuguggguauauauauuuauugauauguacuguaucagaaacaacagaaggaauauauacauuagccauggugcuagucuacccauuucauucauaaggcacaaggguaaacugucagucuuaagugguuucugaucucuuuggggcuuuacuuucuuacuaucagccuaucugauguuuccauccuggcagcucaugagguugcuguaugccacauggucuaucguacauaaccaagccaaugcuuaggucugccuaacccacccaccccugcugguauguuuacuggugcauagcgagccagaaacuccuuagcccagccuagggaauaaaagaucucguggggcuugcuugggcauggcuagaaugacccuacccccagaguuggugacagguggccaggugcuuacauaaugcacucugagagaaaacuguucccuggaguguuacaguucaguaagacagguacccucagacgaucuuuggugaaauaacucaucacuuuauucccuguggacaagaaccuuauaaacauuuuugggguggggugggaucuaguagaucuucccauuggcucagccugagaaguuaggaacccccauuugcauggggaaggacuugagauguugucucuacaugacugauugucaugguccuccuagugggguguuguggucacaagcuccaggauagaaaccugacugggagcuaguucagacucuugccguucuuaauuaugaguuuuauugggguucugagcuuuugguacagcuuuaccaguuuugccugguggcagggucugcugccccacacaccaccauauuugacucccuauucacaccgacagcuuugcuuuauaaugcacuguucauguagcaucagaauagugcuugguuuuaauuuucaaagagauguugauaaacuaaaaauuauccaaguacugaggggcccauacccaagaauugcuuuacagugugaccccagccuauucuagcuccaucugugguaauugucucuucaggcagcauguguuuuauuagccagucucucaaauauggugucuucuuuccaguuucauucuuuugccgaggcccaucucugucuuucccuggugaauuccuauuugaacgacaagacccaauuuaaauguugucuucuuacaaauccuuucuugauuugccaagacauuuucaucccagaugucucauagcacauaauccaaauucagcaagcuuuuucuuuauaaauuagaugccuguaacuauuacuaacuaaaaaauauaaauguauauuauuauuuguauaacuacuauuuaguuauaaaaauuauaauuaaaaauauaaauguauauuauuuguauaaauuacuaaguuucccuguugugcuggcuaguuuuaugucaguuugacagaagcuagagucacuugagaguagggaaucucgauugaggaaauaaccucuauaggauuaggcuauaggcaagccuguaggguacuuuguuaauuagugauuaaugugggaagggaagaccuguggccucuacaucagcuccuaccuccagucccugccuguuugaacuccuguccugacuuccuucagugaugaacagugaugugagauagaagccaaacaaacccuuuccuccccaaguugcuuugggcgcgguguuucaucacagugaugguagccaguugugauaagacaguugugauauuccaugauacaugcacaaagcuugcguaggcccugcccauccucacuguucccccucccgcucaucucuggaucucucaccuucccuagcagccccuacuguaauuucaaaugcuuuaguuucugcaugggagaaaauacgugauacuugccugucaagaacccauguaaugaaacuggaggcuuugugagugguaugaccucugucacagcuacucaaaucugcugucuugauaugaggacagcuuacacaguauguaagugaacaaguauaacuggauucugaugaacuuuaugacgcuaagugucccaccauugucacauguuagauauguucuccugcucucccccagccauuuauuuauuguuucaggacaauggacuagauuugggucagggaccauauuuuccuagccucuuaucuaauugguuuguuauuucauucagucauacauucguucacccuuagaacaguuagaguuuaccaaauccagagacucccuaucccaucucugccccagacaacuguacaacuuugcuaacuauuucuucugucauugcaugauuaugccaucuugggcugugagugagaaauacugaaugagcaacaguuuuauagacucuggacauguuauucuggaguauucauuggaggguaacaucuacaucuguuuguugguuaagagugcugucaagcugggcagugauggcacaccuuuuaaucucaacacuugguaggcagguacaggcacaucucugaguucaaggccaagcuggucuacagagugaguucuaggacagccaaggcuauacagaaaacuccugucucaaaacaacaaacaaaaagagugcuaucaaagugacauguuugggauggauuggcauuuucugugcuaaaucuggguaaauggaugaagggugaaacaggaaguuuuuaacuaaagggagguuccuuuugaguaugccuaaagacagcuuuauauuccauaaaugguauguuuuaaguagugaaccuaggguuggauuacagcagugaaaugaaucauuuaaucagcgacaaguugcuuucuaagaagauagcaugcugcauuuguguagcuuuucaguaucauagcucaucggauacuaucaggaagcauuuucaucugaagacauaaugcaugacuugucuuuucacaggcgagauaaacuuuggauuugcauggaauucuguggagguggcucuuuacaggacauauaucauggugaguccagaguugcuguauauacaugaauucuagaggaacauauacugaagccauagcaaaugcacacacaggaaagaacuagauguguaguucugugcauccagagacuggucuaugacagccguacuuugguuuagugagugaagucauuaaguauauagcaaacaaaaguaaaagaacagguagcaaguagcagauaaauagaagcuucaaguagaccgcacagcaucaaaucacgacuuuacagcauccaacagaaacaccuuggguagccuaacgacggagcaaagacagcaccaucaaccuggagacuuaaccaacaccaugcagaaacugaccagggaaacugcagucggcuggaaguuucaguugaacuuugucuucguggagcuuuccucccaugggcauuuguaugugggagaggaacagcaguggccucuguugaagaugcaucaccuuccagcucuucucgggugcaguguguuuaaccccuuacucuugcuggguuucucucuccccauuaaagagcuggggccagcccaagccaggaggugaucuaucagugcaguuugcauuacaacuaugauaagaauaauuaagguuuguauauugcuguagggaaaugucugugauugugaaggggcagguuucagaaucgcaugugugcugaguuaguuuuugcacauuuguauguaguacauguaaaucuacacugguuuaacuuccaggcuuuugacuuagcaauggaguagaaggcuuauacacucagugcauaccauaugccagauuuugaauuugaacuuuuaccaggcuauccauguuuaguuaucauauaugcacuguugcucauauuauuagacaauaguagcaggcuucagaucccacugagcaacaaaacccugaaauaaaaacugauacuuuauggugucuauggcuguuuagcugugauguuguauguugacauaugaaguucauuuuugaucuaaaauauugucagcguaaaauggauuuauccagaacaugacccacaguaaguugaagauuguguauuauauaaaaugucuguauaaaaucagcuuacagauuagaggcuaaacuuuuuaucuaugaauaucagaucagcaagguauaaaauaaaaauauaaucauguuaguuguucaguuguuuauaaacaugacaggcacuguucuaaacacuggagauacaacagucagcaugucacguuuagaaagaauuauaauaaaaucucggccuuuuuggcauugaguugaguugaauuguuuaggaauguugagucuauucuuaaugggauuuauaaacuuggucacuuacuggaaaacauguugcuuaacccugcuaacagucaucuuuuacuucucuuacaguaacuggaccccuuucagaacugcagauugcauauguuagcagagaaacucuacaggcgagucaaaccuaaacuaguauucuuuacuaaauguuuacuuacugcauauuacuguuaagagacaagauaucuagguugauaaauguaguuugaaagcuuuaacgcgguuuucuuccuuuccuuaaguguauuugguuucuguggugcugggguugagccccuggccucacacaugcugcauaaguguuuguacuaacuuacaucugguccuuagugcaucuaaggacuguuacagauacaagcugcuuuuacaauuaaauacuacuaaguguaaagauuguaguauagccuagaauucaagcacuaugggucuguauaguccucuaaaugacaaagaagggcuuggucaguaacucaucucugguccucuguaucgcuucacuauacugagcugacucuugcuaccugguuuucuguagcuugaaugaagagugacuacuauucagugugcugugugauaaaucuugcugauuuuucuauuuuuauuuugaaacucuagggauuguauuaccuucacaguaaaggaaaaaugcaccgagauauaaagguauacauucuaauuuuguccuguuuuucucucuuaaauacccuguuuaucacuuguaaauucucuagauuaaucacggagcagacgguuucacuacauuuuuagaguagcauuguugagucagggucacauacacuaaagccuaccuuuccaaagugugggguuucaauagguuaguuuggaguugcucauuugguuuugguuuggagguguuuugagacauggugucauagaccaggcuguccucagacucacuauguagcugagacuauaccugaauuccuucucccuuugucucugucuccugagagcuggaauuauaauucaugagcacuaccgcaccuggcuggauuagggugguaauaggucuuuuaaagcucguuuguaacuguucaucaaauacaaaugacauccauagcauccauaagcucacagugaauugugugcuuacaguaucuucuacuaagcuugucacuccucaggaaaugugucucacauggugauguaagauccuguuagcaauguaccuaggaggcugagguaaacccugacaccuucugugcucuccucucuggcucuuggaagagagcagugugcucuggacaagcugggauuagcucagucaggauucuuggugguguuucuagcgacacucuucagcucuucaaucaaaaugguuguucuuuuauuuauuuuucccucccuuuauuuccuuauucaauucucucccucucuuauuuucucaaguuuuucuagcauaaagccuauuaaccuuguaaggggggaggugauucauguugcuuuccuaguuccugaugcaagcccuggccucuguccucagagaaccgccuguaaacccacacacuacuguccccugggauguaagcagacucgcagaacugccuuagguauuuucuguaagccacuucaaaggcaaaggaaaggguuuguacuucaaagguaaaugagccgucuguggaggucaggguagccgaaugggacugggaaggacugguagguuuugucagaaguaaagaguggcacgcucuccaaacugaaagaagaguaugaacagaaauacgaagugaaggaugaggccauuuuggagaauauaauauuuguauuauuaggaaagguuucauaggugauaggauugucuggguaauuuuguccucuguuguacaaggacucgugccagccuuuaguucgaguaaauucuggccaucugcauagccuaucuccacccuugucuaagccuccucccucaugcuguuucaccuacaucucucugguagccuucuuccugcucucacugcuuuuggucuugagugcuucuauaguuaccguuguguuugacaaacacaguggccuuucaaagucaccccauguugcuccccugcuuaucaaucagcuccauugauuuccuguaguggucacugagaaaugcaggugcuggcaccacggccagcaagguucugcauaccccagccccugcacucguucucugagcuugccucccaugcgucgacuugcucaguaugucucagccacacugaauuuuuuguugcuggaaguuuuuuaaggucuuuucugguucuaggucuuuguguuugaugucccuucucccuagaguguccuuguccuggauuucaguguggcuguccauccuuacuucauugggaccucagcuuucagaggacuuccuuugcaugcucugucuucagguccugccugacuuugaaucuuuuguugggccagggauaaucauuuguuucuucuuucucaccuacauacaccaacaaccuguucaccacugcaccagaaccuaaguggcuggcggcagucagucgccucucagagagaggggugaguagagggaagagcagauaggucaggagcugugguguguaugcgcagugauggaaguuguaacuuauaagaaucauccugacaguggggagacaacauaguagaagucugccuagggaaaaggugaugcuaaaagcccugauguggcccuguagaauuucucccuuucccaugaucccauaggucagugguguuaugugugggugcagcucauugcauggauggcauucuugguguuuagaauucuccuucguuucccuucuacucugcugcuagucuuucucuuguuagagguagggauuccaagaacuuuuccccacauuguaaucacacuagaccuuggauuaaagagcugucuacuuuggcuuacucacauaaaaguugugugggagcaguuauggacccacagcuagugacugaggugauagcugacuuagacucuugacaaagaaagccauuagaguagaaagccucgccucagagaagggcagucacaugcaagcccuggcgaguuccagaaaaaaagcuuuuaaaguauaaucagagccauugaagggcugauuuaaaauaacauucuaauguagcaauggugugccaucagccaggaagugucauuuacgaaauguguuagcagucauauuguguuagcaaggagcccuuuaaaagguagcacaugggugacgugaccuaaagaguggacagcaguguuuccuacaauuauguaacguuuuaauugaacacuuuuuuuuuauauuuaaguauuacuaagucuaagguugugguuauuuaauauguauuaaauauuauuuguuucaccuaauaaaaugucuguuucccacucaacugaaauguucucauuuugaagggcgcuaacauucuccuaacggauaauggucacgugaaacuagguaaguuaaucaaaauuccaucacacuuacacgcacaggucuuuccuaaaauguaguuggcuuggguuugguuuuguuucccaggaguacaagucccagguccuagcucauccauccccagggaucucgacauacuuguuuuucaguacagauuuuauugcugagccagccucucucugacuuuucuuacccuaaggaagcauaagcuuacuacauaauaaacagauuuuugcaaagaaaucaugaaauaauaugcauugguaacucuuucaccucuaaacccagagauugggcuucuaguagaaaaucuguauaaaauugaaauguggaccaaaaaaauuaaaaauguagaaacuccaaaaauccuacaucauguuuucagcuuuaaaaagcaaucaugcuauuauugauaugaguauauuuuagaugcuaacuguugcuuuacgucaaacaguaacuugcaagguaugauuaaaacaaagugcaaaaccaguaaugacuuagcaugaguuuaaacagaacaaguauucaauaaaguaacuuuaauaacuggugacaagaaaguaaugacauaugcaacaauuauuuugaacuauuuaggacaaaccaaauuucagacuauucauuuguuuuauaaaaaugauaguagugcgcuggauguuagcucagugggagccguugcccagaauguaccaggcucuggguuuguccccagcugcacgguacagacagacagacaaauaaaacugcuuuaaacuacggccuacugucaggcuaaucagauugaaaauauguaucucaucauugacauucgagauaguuuuccuccgcagccugccagugagagaagcaggaaggguucagugcuggcccucggaggccugcuuacugagcaguuucuaugagcaccugcguccacagcagcguucuauaccuuccuucucuuagaagguuuagaaggcuuaaaugcacuagaaaguauuggaucugagcguacucaaggaagaguaccaagucucacuaguggcuucagagugugccgcagaguguggggaugcuguguugugugucuuuucaggauagauagguuuaccaguguccacugaagucugcaggugucagucugucuggcagagagugaguagacuauaugguuacuuaaaggucccuucuaguaagacuccuugaaauacaggagaaagagaaauuaaaauaucagugucaguuucaauuuuccuaaggccguuauuuuuuuaaucacaauuauuucauuuuaaccuuuauuguuguuugaauuguaugaguuacaugggaauccacuuggcuaugcuacauacuacuucgugauauuuuaauaguccaucaaaguuagaaacuguaacauguuugagauuguuccauauuugugaaauugauaaaaauaaguauuggaaguuacuuuugguauuaucuuaaaugauuuuuuuucucucauucuuuuaauagcugauuuuggaguuucugcacagauaacagcuacaauugccaaacggaaguccuucauuggaacgccauauugguaauuuuauuuaacucaaauuuuuaacuuaaaauuuuuuuauuaaucugucauuauuauaugcaguguuucuuuuuuuaaaaaaaugucagaaaucuuaugcuuaggacaaaagggaaucaucaagcuuagugauucaagcauguguucuuauggauaacuugucaaaaaauaucccacacacuggcuuucauaaaacagaaaaggcuauaaaguuugauacaguuguuagcuuccugauacuuaacacacauuucaauauauguuuuuauaucuaucuuuuucuauauccauauucuaauuauuauauuauucacaguuuucaaaaacuuugcagguuuuggaguuaccgggaauugaacguagggccucagucauucuaaguaaacagucuccuccaaugucuuugcagcccugauugacugugguaaaaagcaggucucugggcauguggagucuacgccaagccucaguucaauucuuuaccuucuuucuggaagucugauccacagacuuuccuuucuggccauaccugucuucuagguaguuuuuccugucacagaaaaaccauccuagcauucauuguuuaugccuucauuuuggccacugugugcugguggccucacuggcugcaugguaggcaggagcagcgcugcuuuggguuuaaugcccuggagucuugaccacaccuucagcucagggcuacccuccccagacaucucuagucugacuccucaguacacaacggugcuacugggguuuuguguuguucuaagcagggagcaugauaaauaucauuucuuauacaauuuuuuaaaggcaacuagagcuaaaacagcucugucuuuugcuggccauuauuuguagacuuuguuguaagaguugaagauuccagcucauucauuugucuugcaguugucuuguucuugcaguguucuugcugaaucaguuaguagucugccaucacucuucacuguuuuccugaguccucuuguuuuuaaauugcuuauaucuucucuuaaucuccuguaagacaucccauuccuccucacauugcccaauucuguaagaugugccuguaugauuuucuaugccuguaaagccugccaaguuacuagugcuguaugugcgugcgcacacaggaacuuaacugcaugcccggccagcacucuacaauugagcuacauggccgugcuuugcuuccgggugugaucccugggagcuccuuucuuauauucuaagucuucuucuuugaccugcuuugaauuauguuuuagucucuuuccguaaaugguguauggguguaagagcuuuaggacuuuguauuucuggcuucacauuugacuggguuuaaagcgcuagguuagaauauuugaggcauuuguccgugggcuucugugaugccaugugaagccaucaugauguaauguagugcaccccuccucccauggugacaccucauauuuucauauuccgugaugguuccugguguuuccauauccuagauauuguguuugguuuugaccuucauucguucaugcuugucauuugguguuuauuucagagacgaacaccuuucccauucuagacgguccuccugggagguauuucucugguguugacaugguugucucucugcugcauuucuuccugcucucucugggaugucuaaagucaugccucaggccacuugaaucaacccacaaguuuucucuuuuucucccacuucauuuuuuuggaaguuuguuuuuguuuguuuuucuuugagguuggauuucauuaugaagaucuggcuguccugaaacugacugaaaccaggcuggccuugaacucacagagaucugccugccucagcuucccaaguauugggauaaaaggcaugacccacuccaaacuaacucucccacuuaaagaaaauaugcuauguucaagauuaaggugaaucucugcgaguccaaggcuagccugguggucugucuacagagcaaauugcaggucugccaguguuucagaguugagagagacaaaaaaaaaaaacccucauguuucugugggaauuucucagcauuuuagguucauacuugcacgauggaggcuuccaucgaaaguuuaaaaaucauuguauguuaguucauaccaaagagcaagaugcuauaagccaguucuagaacuggggaugguauauaucccuacagucccaguuugggggagacugaggcaggagacucauuggagccugagagguugaggacagccuggagcgaauugagccugucucagaauaugaaagcaaagcagacucacaucacaguguacgguaaaggcgagguaugggccuggugguuaauguucccaaaguggacaggcaguguucuguucacagaccugcacaauuccugagugaucccgucauauuccuacuugugcugugcauacaaggacugauuucuggggcucagacggugacagcaggagucugggauuaauuauugacacuucaaugccuuuccuauccucagccagccucaaccugauuuuguuaguuuguaacucuacagcauguggguggagucucugaggcuaaucagcugugaguucucaucgucugccuccuuggauucccucaucuugcugugugauuucauacucccuuuuagucucuguaucucuagguaaggugugucuccuaggaccucaaaggguauguguguauguuucuccuuauucugcuuuucacuuaugguuugcucuuagagaaggaagagcuaggauuugaagacaaugcauuacucuuuccaaguacucucuguccagugugucuuuaagcaucuagaagaacacccacgucucaggagucucaccugauucugugcacaugccuggcuacuguuugcgcaugaggacugaucuuuccauucggcuguaaaguggugaauaccuuagagcuuguggagcugugcuuaggcgagguuggguaacaguccuucucugucucugucuagcacaaugccuuucccaccuuuaucuaagaauacagaaucucccuugcaaagugauuaagaauuagucaggaaagccugcugaggcaggagaacugagaguuagugguaagugugcccuuggacaucuccuguguggugguggagcuggcccuuacucagcagccuuugguggagggccaaggccuucccucccuuugagcuggucacacuuuccaguguacaguucugugauggaugaacaucaagauaaaacagaccgccgccaucgggaacauuuucuguucccgcccucccucuggggacuccuguggcucugcugccccuuccccagacguccugguccugcguauggggucccagcuuguggagcugucacaguucuuugugacacuugugcucuugccuuuguugaaggcauuugguugucuuuauaaacuugucuugaacaguuuucuaaaacucacuuucauuuuggucauagcuuagucuucuuaccuuuguaauaaggguguucguuggauucauugugugugugugugugugugugugugugugugugugugugugugugugugcacgugcccgcgcaguagccagcacaccugacacauggcucguaggugagcgggcacaggugacuuaguggaaggagaagcaccacccgcacuuuggcugcugugacacuggcuggcaggcugugcugggagagggcugugcucucugaggucaggggcugagugcugcccgcccucuaggcuccccucuccuguagccauggucaagcugccuguaguuaagccccagcacucuuuacauuacuguccuugccaugauuugaauuuccaggagggagauuuugagaucaaauugcuuuuaagagcaaguguuuugaaaguugccgguuuuuuaguuuuauuguaacugagccgacuccccugcggucgugcguguguaaggcguccacucgaugcucuuuggaacuggaagaguuccauguuuaucucaguuguuuccaaaacugguuugggauuucaaaguuuguguauuugaaaacugaucauuuaaacaagucauuagacuuaaacaguagcaaaguuaaaaggaauuaaaacguuaucaaauuuguaauuucucucugaacaaaauauuuuuaaaaagaggcacgcguuuugauaacuuuuccauuauuguaauguaaacuuuuuaauuaaaagcauucaaaagcuuauaguaaauauaaacuaaaugcaaaaugugaaaauucuuggugccccaagaaauggugacugagagcaguggcuaggcugcaggguagagcuauaggcaucggaugaaacaguuacgaccauugguuacaaagguucucuccuuuauggaauuuuggggaagucuuccagaugagaacaacucugggucagacacugucauccugguaacuuuucauaaacuuuguaguguagccaacugaugaagccgucacuggggaggcugaggcgucuuccaggagacaucaagaauuugaggaaagugggucuguuaaauaugguagaucuauuuucagacaucaaaggacuaaacagaauucaauguagcuguuagugagucugugccucugguaaggugcgcacaggaaagcacacuaaacacgagguuuguguguccuggcuuauuuccugcaggauggccccagaagucgcggcuguugagaggaaaggcggguacaaucaacugugugaccucugggcggugggcaucacugccaucgagcuggcggagcuccagccacccauguuugaccuucacccgaugaggucagugugccuacggcaagcccacgcugacuaaagcuuauuuaguguguggugggucggcuuuacccuugcugggagucuauaggaauguguuccuuccuguccugagaaugaaugggagguguuaacucugugcaaaacguuuuauguguuuuucagggcauuguuucuaaugacaaaaagcaauuuccagccuccuaaacuaaaagauaaguugaagugguaaguaacuguuuauugacuuucauagcaaugugagcaaaacggaaguuaaaaugcaggaguuuaauuucauccuuucuuaggucaaauaguuuccaucauuuugugaagauggcucuuaccaaaaauccaaagaaaagacccaaugcagaaaagcuguuacagguauuguuuuacccugaaacauucauuuucuuucacaaggucagauguuuaaccaaugucuaaaguguucuguguguuuucuagcaucccuuugucacacagccucugacacggucuuuggcaaucgaguugcuggacaaagugaauaauccagaccauuccacauaccacgauuuugaugaugaugacccagagguaggaauuguuuucacuaacuaguacacguaacucugugugugugugcgugugugugcgugugugugugugugugagugugugugagaauaaaagaaucaucuuuuugaucuagcuuaaacaaacuauuauuuugugagggugaccaauucuucguccugggaagucauauuggucacuugaugacauuuguggaagaaggcaaaggcaagcugauuuaauacauauaaagucacuaguuaguucagaguggccauguaggcauuuaauacauauaaagucacuagucacuucagaguggccauguaggcauuuaauacauauaaagucacuaguuaguucagaguggucauguaggcauuuaauacauauaaagucacuagucacuucagaguggccauguaggcauuuaaugcauauaaagucacuagucacuucagaguggccauguaggcugcuuagucaucagaugagaagcaacgcaugcccuagccuuccugaaagaacccguguaccagacuucauaagauacugggaguuggcuaagauagaauugauguguuagcaacuaaaaccaugauucucuccuguggaaauaaaaacaagccagcauguaugcagauauaaaguuacccugacaugacaggaacacugguauuaguggaaacccaucucugucagcuuaagaaagcugugugccugaucccaacucaguauauguggcacagccaaguucucuuccugccuucagucugacugcaaggaacucacaauggugaguugugacuugaaaggccauggaaggaaaagaauucucuaaacagguagaugucagauuguccucggggacagccuuugucaauucacccuuguccuaggucaccauguucauacacuaauaauaggcucucucuucuuaauaaguuuugaaagggaguuggaaguaugaaaguuaagugugaaguauauuugaucuaauacuugggagaaaauugguuucaguuauuuuguguaauuuuaggaaacuuggcuuuauacauuuaauuaguccuacauaugcaggguagagaggcuguagccucuaggccaggguuggguacaugcuuguaaucccagcacuuggggcuuggaggugcugaagaggaagacuguaaguucaaggacccuagaccauguaagcugaaaucccgcagucuuaauaaucaugggaauacuugaguuuuccaugagauuuuaaauuuuugucaaaacauuaacucuuaguaucaauuauauauauauauauauauauauauauauauauauauauauauauauauauauggaaauagauaauauuauguaguauuuaagaauaauaggaaguaaagcuaguauuuguguauuuuauuuucauuuugaaaaauaauguagaccacucagcauccagcagucugcugagcaguagcuacccagucucaccuuguccugugacuucaugacacagagcaacaaugcuuugaugccauaguccuuucugcgucuccuuucuagucacagucauguugggauccugugguuuauauagcaguuggugagcugaaaauuagggaugggguuguucuuugugcaguuacagcuagcauacuguaggaaccaaagucugagccacauuguaaggagcugguaucauuaagagcacggucacugggaagucaugcaugccaacccugcagggcaaggaccauugcuuacugcagugcagggcauuuguauuaauguccuagcucagccuacuuguaacucagcaugucuguuuugaacuguguccaaaggcacaggcacuaugcaggaggaauauucuaaguguaccaugcagcagcaaaggugggggguguggcacuucacuucaugauauagauguuuucugcagccgugcauagaccucuuuaauugagacaagucuccacguauguuccaggcugccuugaucucccaggcaagccucaagccugcaguccuucugcuuuggccuccugaacaacugggaugacaaggcugugccaccagccucgacucggauccuauuuaguuugccuuacugaguccaauaagaacuugagcuuaguguuaaugaauuacauuuucuucuaagagcugucuccagcagugagagccucaaggggagccuuucccguacaggaaacuugcuaggcguuguuaucaccugagauggaugcuacauccucuucagguggaggauggagcugcugaggguuucaaacauggucucgugaaccccuccguuugugagacccccgugauuucuguaagugcaggggcuuaucccuaggaugcuuuucuuaggggcaguggcuuagguuacccucaguccuuagcuuggucucaguucuaacagaagggaagaacagaggaaaacugagucaaagggaggaaauaugucuccugacaaacagauugucacgcugcuucagcaucacuuccugcguugcucucuugcucacuugguggaaacggcugcagcagauuuucuuuaaucacagguuuccccuccaccacagagaaagcuggucgcagccuuuaaacaaccauuggauuauggaacuguucaguuuugaauguuaguuuauguuuggcccagugaacauuauugggaagcuacuauggaugacauacauucccuagucuuuaaaaggucugucugaggaguaagaaaagagagcagccaacucucuauuaaggaaaccagaaacagucuauuagagaccucagagacauuuccugugagagaccucagagaugguguuucagaaaaacugacacuguugggcacagugugauuugagggaggcguaggaaaggaaccuaagauuaaaaaccucaggaccugggguugggauuuagcucagugguagagugcuugcccagcaagcacaaggcccuggguuugguccucaguucugaagacaaaauaacaaaaaaagccucaggaccauucuucuaaugauguguauguaugcaugucugugcccagaggugucagguccccuuggggcuggaguuacaggcgguuguuagccacccaauaugggugccaggaauggaauucccauaucuaaaugcuugaguucuguguuuaaauacucuuuauccuugaauaauauccaugaacaaugauugcaaucaaggccagcuuauaagugguuaagaagacauagugugaacuaacccgauggcccugaggguaaagcacuugcugcucaaaccugagucccaucccagaacccgccugggagaccugacucccagacaugcaucauacaugcacauacucacaugcacgcaaugauaacaguaagccucaccaccaccaucaucaucaucauuuuuaaagaagauaacuguacauguuuguucuuccauuugcugaguuccuaugacaguggguuuuuuuuuuacauuaaauaacagcauauaguaguacaucauauaaguauauuuaaaauaaacuuuuaaaggaagcuuaaagauuaauguaauggggggaggguauuuacuauuauugcccaugaccuaguuuguuuuucacugcugugacaaaacagugaccaaaaccaacaugagggggaaagggauuauuuggcuuacagucacacucaugguugaucacugagacaagccaaggcaggaacucaagaagagcagaaaccuggcagcagaagcugaagcggacaccauggaggaacauuugcuuacugucuugcucuuccuggcuuucuuacacugcuuucuuguaccacccagaaacaccugcacagaggugacacugcccacauagacuaagcacucccauguuaauuguauuuuaaaaaaaaaaaaaugccccauaaacuuaacuacuggucagucugauggaagcauugcuccuagcuuguaucacguugaccaaaaacuagccaggacuuuucugaacgggagggagggagggaaggagggagaaaagauauuuuguggauuccuagaaccuaaaggagaguauuauugggguagacaccaacaauuaugguugugguaagauguaugugccuugcuauguuuuaaaaggcaguaccugaaaguuaaacuuaaugaugucaucgcgccagaauucacuugucuuggaucaagaugaucuaagauggguuagcuugcacucucccuaaaacuccagacaucaguggauuugacuuagugacacauggucuguuggugccggacguugcuaguaagugagcauaagcagauauggauaauucaugaagggacuugcuaaugguccgaccuuuuucuagaaacagacuguagugggaauugaccaugaaccauaguuagccaauccuucagcuaacaggagugacugggaccaccauuacuugcuuuguagcaggucuugucagacugaguugcuugugagcagccguagcaugagagcagaagucugacauuauucuuggccucuuccuuuaaguugccaauagcacccuugugaaaucagaaauguccaguaaugucauaugucucuuuauguacaaaauuucccucuggucacaaaacauuuugccaagcaugguggcacuuguguauaaucccagcauuaauaggaucacaaguucaaagucaguguuugcuacauaaugaaauccuauauguguauauaaauaaacaaacaaacuggcuuauguuaacuuuauagugcuuauauugucugucuuuccuucauucaguaaaaacuucauuuuuauuuggguucauauuuuaaagggccuguguuuugcauuuguuauguaauaauagucaaauaauaauaauagucauagaaccuaugaauaauaauaacuugaaccaauaugagaugacuugugaaggguaagauuuuguauaauuuucaagaaguaauuuuuuaaaaugucugccaagcaugguugugcagaucuguaaucugagcaauuggcagacaaaaauaagaugaaagguucaacacuaggcaccagcuacauagaaaguuuguggcuauucugagcuacauuuaaucuuaaaaugaaauaguugggcaugguuacgcacauauguaaugccgacuuucgaggcagaggcaaaggagcaaggcagccagccuugguagauacugugaaugagaagacgggguuggugagacagcacgguggucaggguaagagcuccugccuccacacacaucccaugacaggagcguccgcacacauagcaagcaggcaaauaaguaaauaaauaugauugcuuuaaagaaagcaagaaauaguuuauuuaacaauaguuaauacauauuauaaguuauguauuuucauucuccaggucucuuaaaaaguaaaaaacaauaacuucuguccuaaugcaugaaaaguauuauuuaaagagaaaauuggaaguuacucguuguuuauuucaaugccauuuggaugguucuccaccauugcuuuugugaacuguuuccuccuguaguuacugacuugccacagcagguuucuguggcugguccauguuacauguuacauguuacauguuacauguuacauggauugagaaccaucaugcuggaaaggucaaguuuaagugcuguuccuuguuugagaaugugugccuguggccucuguuccccagcagcuggccuuccucagacucagaacucgugcugccugcugccugccugccccaucucuuccuuguugcuuuagagcagcuugugcccagugugacccccuccgcuuucacuucaggagccgugucacgacaguucuuucucucagcaaucucuuucugugugcacuauugugggggaggcucucuugcacaaccgucagucaguacgugggaguggaagaugccauugaggcuuugggccgucucuguucuccaugcugggaauaguaaggccucaggacugccucucuucaucuaaucaaguaauaccgggaagcugauuccagacaugcuggagagucauucccagaggguuuccuuacgccauaaguuuuauucuuuugcuacuuugagccuucagcagcucucacacugggguauacagaguaagcuuucaaaagcagcaucuaugaacaaccccuuuaaaaucacaccauccuuauugacuuaucuuuugcuaguggaaaugauaauggcguaucuaaaguccagagagacuaagauggaaugaagaccaugcuuuuaaugaacguggggggugggacgguucugagagagaaaagcuagaguugacagaaacgugaaugauagauaucauugugaacagucuuacuucagucagucuaguucauaugaaaaaaugaaacaugucauuaucuccugucaucugcaagugaauguguacuuaaugucauuucaaaauucuguaagccaaagcauaagcuguaaaauccaccugaggcccagcuagauggacggauggcucagugggcacucacuugucccccacggacagccugcguuccaucccugggaccugcauggugggaggagagaaccggcucuccuaggcuggccucugaccuccacaccagugugcgccuccggcccguuauuaugagacgcugugcagaucuucauagcuaugccuuuuauuuucccuucauucuuucauuucaaggaagucucacaaaacuauccaggcugaccuucaucaccuggggucaaucuuucugccucagcccccacccccagacuagcuggaacuauagguguccccccacugcucuggcuucucugccuggguauaacuuguucauucuuauaaaauggacugugcaugucuauggugcugcaaauaaacagaacauggcuuaauucuauauuucacucaaucacaggagcauguucuaccagaauaaaaaagcaauuugcuuuaacuggauaacuuaacauauucuuauuugugccuucauaguuggacugauacugcgauuaacauuuuaaaugaaacguugcuuuaauuuucauuuuugucaaacauuucauuuauccuugcauaauuuuguagauagaacugugacuuaagauuaucaaguauugggcuggugagauggcucaguggguaagagcacccgacugcucuuccaaaggucaggaguucaaaucccagcaaccacaugguggcucacaaccaucuguaacgagaucugacgcccucuucuggagugucugaagacagcuacaguguacuuaacauauaauaaauaaauaaauauuacccaaaaaagauuaucaaguauuacauaucaauaguuuugguuuuguuuuuuuuaagccucuuguugccguaccacauagaauuccuucaacgaguagaaaugugagagaagaaaaaacacgcucagagauaaacugugaguacagacucuuuaccaucuguaagucagugaccaaaaugagauuuuaaacuguaguuuaguuagaauuacuaucuuuuuaauuuuuaagguauguaaacacaguuauauguaaaguuuaaugaggacuauauggauucucucgaucccucuggaacuuuggguaacaagaauuaaacgugucacacuugaaggaaaaguaaggcgucagccuagggaagguggauggcaucaugggaaugcuccuuugcugcugcuaaauccuuguaaguggccuagagaccuuguuaagugcagccugugggucaguagagagggcuagagcguccucugacacucugugugugcaugcgccugugcuaaggggccacucugggugugagcuuuagaaagaaaucugcaaaccagcugugaaaccaccugggacuuaaaagucguuucucaggcuucacccauccagaaccugcuugaagggcuggucuuggcccuggauaaggagauaccuguagccuagcuuuucugaggcuucuagguguacucuuuauggguagggacagauaaaauuaucauauucuucaaguguagagggaaccacuggauccaagccuccacuuucagucauuuggcuuugaagucugacucacuguuuucuugaauguuuaaggugugucuuacuugggguuucuauuguugugauaaaauaccacggugugauuguuucaggugugucuuaaugggagcuucuauuguugugcuaaaauaccauggcugggaauguuucaggugugucuuacuugggguuucuauugcugugcuaaaacacuaugacaaaaagcaacuuggagaggaaaggguuuguuuuuauuucaucuuuguaggccaucauuuaagaaaggcacuugacaagaccuccagguagggcaaaagcugaugcagaggccauggagguauacugcuuacuggcuugcuccucagggcuugcucagccuggcuuucuuguggaacccaggaccauucucucagggugguaccacucacugugagguaggcccccucaucaaucaucaauccagaaaaucuccacaugcuugcccacaagccagucugguggggcauuuucuuaauuaagguucccucccaccagaugacucuagcuuguucaaguugacaaaauaaaauuguguaggguguuuuaugauuauguaugaaguuugccauacagaaguguuccaugauguuaccuauaccgagaggcauuggaacaaugauuaggguaauuucuccuuccuauguuauguuuccagcugccugguuuuucuucguaugaccaguucuuaacuaaacgguguucagacaacaguguagaaaggcuguauguugccuuugguuuuaggaagcccccgcugccuugagcuaaaugucuucuaucaccuuuccagacucuucauagccucacauuauaggauuggcauugauuuguuaguggcuuuggggaggguuagcugucuuggagaaacuaagaauguuuccccuggauaauaagauggaaauuggggcuagugagauggcucagcgguuaagagcacugacugcucuuccaaagguccugaguucaaaucccagcaaccacaugguggcucacagccaucuguaaugagaucugaugcccucuucuggugugucugaagacagccacaguguacuuauauuaaaaauaaaucuaaaaaaaaaaaaaaaagacggaaacuuacagagaauggcuuguguaaguacaaggaagugguagagaaaaacagaugcgccugauagacggguauaagcagagacuuggcauuaaaaagugcaggcaguguuguauacgggauggucaucagucauuuaaacaggagcuggaagagaccggcagaggcaugucucagcaucauagcagaagagcacugucagcguugggugugaagaaugaaucucuguggagacucugcucuccugggaauauauuccacuccaucgaguacagggccagagagggcugcuggguauuuuuaauaccuugcugagagucauuugcaaucuuugauguaagauugugcaugagccguaauagaggguccauucuugagcagucuacuccuccagagaaucuuuugccaucugcuccauuaacaacugccagugcacacuaguuaguacucagauacacucuucacacagagccagugcacacuaguuaguacucagauacacucuucacacagagccagugcacacuaguuaguacucagauacacucuucacacagagccagugcacacuaguuaguacucagauacacucuucacacagagccagugcacacuaguuaguacucagauacacucuucacacagagccagugcacacuaguuaguacugauacacucuucacacagagccagugcacacuaguuaguacucagauacacucuucacacagagccagugcacacuaguuaguacucagauacacucuucacacagagccagugcacacuaguuaguacucagauacacucuucacacagagccagugcacacuaguuaguacucagauacgcucuucacacagagccagugcacacuaguuaguacucagauacgcucuucacacagagccagugcacacuaguuaguacugauacacucuucacacagagccagugcacacuaguuaguacucagauacgcucuucacacagagccagugcacacuaguuaguacucagauacgcucuucacacagagccagugcacacuaguuaguacucagauacgcucuucacacagagccagugcacacuaguuaguacucagauacacucuucacacagagccagugcacacuaguuaguacucagauacacucuucacacagagccagugcacacuaguuaguacucagauacacucuucacacagagccaggaugcagagaacuguuucucugcacuuuaaaacccaugccuucuauugucaaagauucaagucucuugguuuaguuguuacuagaaaaguugaaaagauguauuuuuuguuuucuauaucuggguguugaccugaauguacgugagccaugugcaugcagugcccugcagugggggggaaaggaaccagcguguuccucaacuagccccugacaggccacagggcucccgccaggcgaucucacuugugucucucacccuacaacucucugccccauggggucucagggcuccugccaggacaucucucuggugcuccccacccccccccccaguuccucucacuaccaccacaccccauggacauccaucucaacaccuaauuacccgguagaauuaaacucuuuaagcuuuuaguuaaccaaucagauuuauguaucaacaaaaucacaauuuacaaggugccaauacaauaauuucagagccaauugaauaugauaaaagcuuuaucccaauauuucuaaccuugugaaaucauaucuacuuguggcugguaauugccacgcgaguuaacauggguuaacauccgcagccaucuuccuuccugcuccccucugagcacucugucucucugcaacucuuagccccgccuccauuaccccuguccaaucacagaccuccucugcacuaauguaauaggacagggaaaauccugcaacagugcccauggaggccagaagagggcauccgaucccccuggaacugucauuaacagauggucauaagccacccugugggagcuaggaaccaaacccagguccacuggaagaggaaacucugcucuuaaugacuaagccaucuuuccugcccuauuauuuacacuuuauauguaaaguuaaaaucaaauuuuuuaguaauuauguuauagaccaguucuuucccucacuuuaguugacaaugauaccugguuugggccaacuuucuuaauaguuagcugugguaucuuuuuuccuuuuguuuuucucagacagggccuugcuguuagccuagguuggccuugagcccucuauauaacccaugaugggauugagucuucugccuuagucaccucagaaaucuuuacacuugugacucauuucaucuccguggucuuugacacuucacccugacuauaaaagcagagagcucuaacguaauggugguaaaccacugugugcaguagaacaucagagacuaaagguucuguacuguaaaacauucauugucucacagaggccgugaaggucagaagucuagaucagcauuucucguaguuacuggucuucuauugcugagaaggacaccaggaccaugguaaaucuuagaaaagaaagccuggaccuggggccugcuuacugucucaguugcuguucuguugcugugaggagacaucaugaccaaggcaacuuuuauaaaagacagcauuucauugggggcuugcuuacaguuucagaggaucagccguuauccucagggcaggaagcauuggcaguauguguggugcuggagcaguaacugagaugacauccuguuccguaggcagagugagagugggccuggugugggcuuucagagcccauccccagugacacacuuccucccacaaggcuacaccuccuaaucccucucaaauaguuccauucccugaugaguaagcauucaaauauaugagccuaugggagccauuuguauucaaaucccacauuuacagagggucaguuccuuaugaucgugguggggagcaguaacugaggucuacauccugauccacaggccacgagaaccugagccuugcauggacuuuggaaaccugaaagccccucccagugacacaccuacuccaucaaggccacaugccuaauccuaauuuuuucaaaccuuuccacuuaccugugacuaagaauucaaauauaugagccuauggggaccauucuuauucaaaccaccacauuccaaaguaucuucugagacucaagggaagcagauuacacacuuccaacauaaaaugcacagacuacaccuuaccauaucaaaaggagaaaagggaucauagugagggaauacugggccagagcaagacugaagcccaaaaggacaaacaugcaucucauguuucauguccaaccacccuucagaucuccaacgucuuucagcuuauugacugacuucucucucucgagcugguuccaugcccgggcuggcuucagcuuuccuugucagauaucccaaaauucuggcaucucaaacacaauccagaguucaucuucacagcuucagaaaaguccucucuaggcaugcaugcauggacgcccccauacacacuuggucucaagggcuuuccuuagccacagcuagagauuccacaaccccuuucuugucucccugacucuaaagcuagaaccauguggcugaagcuuccaagcuuugcuguuugcuggggcuccaacaaggacacacccacucuaacaucuaagccacaccuuguaacucaaauaguuucacuccuggugacuaaguauugggaguuaguuuucuucaaaccaccacaguguggcagaguguuucagacuaagggccucuggugacagagcugucaggauguucccggcaacuauggccauggaaggcuuggcuaguaggcuagaugguuucguccacacucacuuauauuacugcuagcuaaaggcccucgccuuagggcagcucacaaaggaguuuccuccaaacuagaugauccaacagaaagacagaaccuuaccaugaaggucagccauuaggucugccauguuugcuuugucaucuccacaaacucugaucugguauaagagaauuacaugggaauuacuggggccaucucgcaugugauucacacaccuauuggcaccagcugaugucuaccuggccagauaccaaguucaaaaaucucuuaugcuggacuacagcacaugagcaaguuauguucugauuuuaacuugccauuuugcuugguuuuuuuuuuucuuuuuacaguagaaaauaacuaauaagcaaaggauacaacucgguacagaauaauugcccgugaugaucaaggcccugguucaacccccacuacugcaugcauagauuaaaauaucacaccaauuaauauuuacaggaaguuccuguguucaaggcuagccuacgcuaaaauaguaagacccugucucaaaaauacaaggaaggaaauaucccauguccugauauaaccucuuuuucuucucaguuggccagguaaaauuugauccgcccuuaaggaaggagacagagccacaucacgaacuuguaagugccauggucuuggaacguuagccucugaacauagaucuuaaauuugccuuugucauacauugguacggacuagcuaggacugaauauuuucauauuuggaagaaaaaaugguaacucuaaauacugaauaaauaaaucuguguugcugaaaaugaguauuuuuaaaaugacuugaagagauaaguuuuaucacucugauugacuguuuuaaaugcuggcuuuuuaccuuuguuugaauuuguguuugguuuugaggcgcuucuuuuguauccacuagggaaagugccauggccucuaaaaaucccagcauguagagcacuaacacucaggcagagcaggcauggaaguaauagaacacuuggcagugugcaaaggcucgugaggcuccaaugggguuccugugugcugcuguuuaacugcagugcucugguccagucuuggagacagagugcucugcaaauauuugagacauuaauuaauauuuuauggaagaauaaagaugagauuuuaaaaugauuuuaauaaaauugcuuugccaaggucacaaauuauuaguaugauggguuuuccuuucccauuugauaaauuagaagaaaauaaugguuaauacauacugugggaguuuucuuaugaaguuuaaaugcauauuuucaccacuugacuggcacaaaggaagauaucagcuugucuucugauuucauuguacuagccugaaggaagggaauguuaaaaucuuaaaaugaucauaguuuuacauuaaagccugccauuccuguagaaggaugcggaagauuaggaacuacaagucgucgugauguuugugaaugcuaacuguguguuguuaaggcaguguguagagugggucuguccuaacuuagugacugugcucucuagcaguuggugagauguugcuugugugcaagccaccugcuaucauuugauuugcauuugccguaauaaaaugauguuagcaggacccagcucccuugugaaaguuuuccuugugcauuguggcugucuaauugucaauaaccuggguuucuuggucucugcuaaacagcccgacagugaugguuuuuucgacaguucagaagaaauauacuacacugcaagaucuaaucugguauuucucaucuucugauuuucuugucagcacuguuguagucuuaacucucuuuagcucagacauugugacuaguucuauuguuuuauaaacuaaagcuugucaauuagcaagcuuccauauacuaaaagauauagaaaccuuuucccauuacaagucagaucuacucaaauguaaaauugcagcaguaaacaauuuuuucuuuuaugaaaaaaaauuaguauuuaaauuucuuaccaaauauaaagguuuuuuuucuuuuagaaacacuauuucccuauaaaauauguccaauuuuagugauauaucuuguuucaaugaaugauaaaccauauauauauauguauauauauauauaugcauucauauauaucuugauguuuuauauauaauagcauuauauguuauauguuuuauauuaauauauuuuguauauauuauauauauugcaugcaucauauguaauuugaauaaguaauuuaucccuaaguuaacgguagaguaagaugaaaauuugaauuuguuagcauuauacacugucuacuuuucucucagggaugcugucaucccuaaaguuauacauaguaagacuaucuuuccauuucauaggaaaucuucaccuaguaaacaugagauagcuagugcucccuaaaauacuaaguaguucuuuccaucuuuccagucacaugacuggccggaaccccguuaccccaacauuuacucccagagucugcuguuuugccucuccaaugggauuuucuuucucuuccucuccaucuugauaggauaucucuuuaaguucugguuagucuaaauauuuauauaagcacugaaauccacaucuuauuuauaaaacaaaagauuuagacaucauucuuuugcugagagaaguucuaucucauuagauaaagcaauacuuagauauaaauuauuaguugugcaaaaaccauaagcucucuuaccaaaauauggccaacugucaacugcugaccaguggagcagacacagugggugucauggaggucaggaagcuugucuuggaccaauguggccuaauuggcugguaucagugucauacaagauccauuguggacucucaaggaaggaaagagauagcugugccugugugucaugggagucagugucacagaccacacuuauaagagguaguugaaaaacaucugaaauuaagacccugugaacacuucugcuagaaaugagagauaacuaaaagaguuggagcugacuccucaaagaggaaaugauggcguugugaaguuccauguguugccuacaguuagugucuggggguaggggcagugcagcugggucugguggcucaugucuauaauuucaguacuugggaggcuaagacagaaagguggcggcgaguuccucagccugaacuacauagugaauccuagggcgucccgaaccucagaaucagagccuguagugaagaauguaaaaccuggcugucauacagaggcagcguuagaggucgggaggaggccgugaaaaagccaagugggugaacagugugacuccaacgcaggaagcacgggucaacaaaggcuucuuaaagcaagaggagcgaagggccaggugagaggaauccacggcaaagagggauuucugaucaauauuucuucagaauuagauaugcagauuagaaugacauucggugacugucacaaaggaaacaggccacagacucagaaguugaagccagcccuacuauuuacuaauacccucaugcagaaugggugacaguaagagcagaaauaucagacauuagaauaaaacauacuugaccauguggaaccagucccaaaccugacugagcuacccgcauccugccuccuuucccuagaugugcugaggccccugcuccauccuugucuuggagucaggagcauccuaugaugcaggggaagacgcaugacagagaagggcacuggggccuguaaccuccagcuguggaagaaggacagaugagacacuguuagauucugcaguauagagucagcuguaagaacccguuccuagugauaacaaaaaaaaccuaccauuuaaguugacaguuuuacaugucauguguuauuuuaaacacuaaguaugguauuuucaucagcaauguagaauauguaucuaacagaggcccagugauuacaucaccuucugaugucaccaucaucuuggcaccugccucagucucccauguguuaagauuguagguguguuccacugcguccagcuaaagccccauguuaauugucaggagaggacagaaagaagaauaaugcacucaccuugagggagucucucuaaggaucaacaugaaggucauguucuucagaucugugcccucagccuuagccagucagcggcaucacucaucaaaccacaucuaacucagccacuucugacuccaaagggauucgcuuugcauucucucugauuuggucccaguuuaucuccacacauagucauccauauuaaaaaggauuuauauuaaccauuuuuacuccugccauaauuuucucauuuucauuaugaagaaaaaaauauucccuccugcucuuuuucucgucugucugucugucugucucaguguccaguggucucagaccugugacuuccugcuguuuucucaucugguauagauagacugcagucuuccaaagugacaaaacauaaagaaacuacauacuuguugaguauguaauguccuuccuuuccaguguuucacagugagcucuuuguucuuucuuagaucuuaccauuuucuuagaauugucacccuagauuuagaauacucuccccugccccucagugaaagaacccugugagaucagaacguuucaccauaaaguugcuuauacccuuggguggcuuucuuggauuguucuuugagucccaaguugaaccuuucugagcuuacuguauguuuucaguacauuguuccugcuuuagcauugugguauaauuaaacauuaucauuuauuaauuguuuaaugcugcuaaauuuuuugauguuugcauguucaagugcauucugauuaauuugucuaagagccagaggaugccgucaucuugguuauguugagugcuuucugaacauaaucuugguagcauuuuucuaauguagaauggcuucuaaauacuaucuuaaacuuuguagugcaugauguggggggaggggaauaccguguugaggguggaggucagaagacaaccuuuaagcauuauuucuccucccuugccaccaugguagccuuuguguuuuagcuuugcuugcuggacugcucaucagacuuggugauuacauacuccacaauuuacauacugcauuggccugagugcacauacgucuaugcuugguuuuuuuauuacauuaucccuuuaguuauuuuaauuccugggcuugauagauuuucauuuucugguuauuacugucaccugcucucgauugucaucucucagcuaaguggccauuccuguacaucaacagaagccauaucccucugcacacaugcauacuugugaagcuguuguuuaguaaaaguuuauuagauuguacugacugaagccaccaccucucugcuugguuaucugucccugaagacaaguuuaaaccuagaagugcccauagagaagaguacacuauuggcugaauucuagugcauaaaguuuaaagucgugaccacuaaaagucaaagugaugcaauuuuugcaagcuugucacgugguacugugguccuauuagaauaugucacaacuuaaaggggacaguccuuuuccucuagaauuccauuugauaccacuaugacgaucaacuaaucuuuuccacuuaugauguguuauccuugcugucacuaguaagaacaguuacuguaugcacgucugagccuaaacauugaaagggacaaaguuugagccuuguacacaucagucuuuucauuuucacugauauguuuuuggaaaggccuugaaguuucaaaguacaguguguuguguggaauuguguaauacuagacuuaacagauuccagacuugagaugucugugguccugcauaucuguacacugggaaaguauuucucuguuuccaggaagugacacaggugacaucugugauugucacucagagcacagucugugugucaggugcuggguuacagauuugccuuuuuugugucuaaggaguucauggccuggcuguuuuaagagacuuguaggcagauuaaaauucagagugcaugcuacagaagaucuggguaacuguggcaacauaagagcugucucugacucugggagguucuuccaagguucuuccucugugagcccugccugcugcguuuucauagaagauccuuuuaguggucauuggaguacagcggcuucuuuaaaagaggggaaaggcagcuugguucuuacaugguugguggauaguacauuuuccucaagaagguguuugaguagagccuguauauugcucauucuucugaauuuuaauucuuagcucucuccagugugcacuauucagucaaaauguuuuuguaggcaaggaauucucaauauucauuuaaacuucacuguuuuaaccuuaaaggucuuccuaaaaccuccuuuagugcagugucugggcuuguacuaguucacugcauaccucacuucugcaguagugcccagcuuuaugucuuuaaaacauuaauuaaucacuugcaugaagaagcaauagaaauaugugaauguguauauauacacacggccauucuagaugccacacacaagucaagccaagauggguuuuguugauuauucuguuuguuuguuuguuuguuuguuuugcuucauuguagcuugacaaugcuuuauuugagccuuuuucuuucuacaagcuaauuuuuacaaauacuaauuacaauagauagcaacagccauaaauaaaacuuuuagaugucuuuuggaaaaauucccagaaaaauauucaaauaaucaagauaucauaucuuauauuguuggaaaugccaccuugucuuccuuuuaagaguauagagcaauacagauuuauuuggggcuuggggauuuucuuuuuaaaaagauaauguauauuagcguauagugauugcggccugcugugcuaagucuucugcuuccugccgcuaggaucugcaacuagaguacggacaaggacaccaaagccauugcuucuuagguggcaacaaguaaguaaaguucuuuugaaacuuaaauucuaaguaauugucuucaauauuauauuuuauauuuaauauuuaagguaguaaauuuuauugagccaguauaugucgugcagcgugcccuugaccuucccauagucuuccccuggucaguaguugucaucugggaagaucagccuaaacagcccaacaguccauauuggccuaaccugcagcucguucuuguugcagucaccccagcugugaugaaucuguaucucagcggcugauuucuuucuagaguggaccugcuuacccucugcaaaacuugcuugaugcaucucucagauaagcuggccacuaagagcagcuaaaauuuuuuaaaaucauucaccugcuuagaaauccauguuuuaacuuuagcugugcuggucuuuuaaagaacacuaguaaaauaaaauaaaaugcuaguaaaauaaauaaaaguagacaugcauucaugaaagcuauuucaugagaaaaguagauuaagacaccaugauggugagagcaugauauaguuaguuuacagacuugugugaguucgucauaugccaggguuaagaauccagaacugcccauccuuaauuccugauuccauagaugaauuuucauucuauaagccaaucuguaagggaguauuugaauuaccaaaguauucuggggauauauauauauauauauacacacaaaauuagaacucaaaauuucaaucuauugauuacacuagagagcugagacaucuauugccauacuucaaauuaagaaacaaugauuacugacagacaccuuaguuuaauguaaaccaugucuuucucuucuauaaucugaacacuucauuuuuuuuaaccuaacuacacuuucuaguauaaagggcuuuuaaugaaaagcuaaagaaguaugcuaauuuuguuuaaguuuguuagauauaaaagauuaggaauuugucauuauuuauuagccuaccuuucuucuuuaaucuuuugcauuguuuguuuauucguguauauauuuugagguaaggucucauuauguagcccugacuggccucagacuuacagagcuccuccugccucugccucugccucugccucugccucugccucugccucugccucugccucucgaaugcugaaguuaaaagauaugcaccauccacuagacucugucuuucuuaaccuggaagauaagucuaaaacccccugguggaagauguaguuuuaccugagcaauagauaauugucacuaauuaauuauucugauuuugguagacaacaaagaauaaauuaugugucacugugucauagugauguuaaaaauugagugauguuuuucuaaugauaccguuggcuuuuaaggacuccguugcaaccaaauuuucauguaccugaagacgcugaauauuuugacuauaugucgcucacccuuucauuuaaaauuaaugugcuugaaaaguaauauagucacaaaugcuuuucuauauuucccagcuccaguugucugauuuuuuccuaauguuagaccuuuucuuaguauguauagcuacuuuagccagguaaauguuaauaauuugcccacccuucauuuuuugaugaauuggaucccugcuuaaggaacuguauucuauauaacgagucauuggcaagguagguuggccaaagucuuagcucuggcuguuuccugugucguugugcacauacaugugauaugugcacauacaugugauaugagcacauacaugugauaugugcacauacaugugauaugagcacagaugcagcacuucucuuacuguauaauaagucuccuuuauucuucagcgaggcagcacuggacuaaaacucaggauuuccugcuuucucuauaggugaagguuggcagauuccauuaauggguuucugccuaguucguaucccacaggaaccuuuggauuagauuuguugcauggccuuugcuuuccauaacaaaacccaacuaacaccuuuucuuuugaauucugguaucucugggacugguucuucugaccuucuguuauuuuuuuaaccaaagcaguuauuuuuaaaaggaagcuaaacugcgucugguuuucucuguaguguagagcauaguuguaaggauaacuaacugucccuggauaggaguaaagcaugagucagucagaccacggcucccauggcagccaacugcagaggcagaaaugaguagccacugugaacuaucuaguacccauggggcuuagugggcacuuacuguuuuuacguguaaguagcuacuuaguaauugucaauuaugcuaggaaguagauaaacuguuguuuaauuuuagagaaauaccgagcuucuugcuuuuacauacagucagggaagugcauacacaaguuguuuugagucagccuggccgcugugugagccuaguagcuugccgcauggcucccuuugcuaauuuagaugugcugcgugcuugacgguggcuucagacuuucccaccucaguuucccuccuugucacugaaaucuguguucauacauugugccaauuuagaaauuuucaugagauuuuuuccaucauuucaauauagucauucaguucuauuaccaaaaaccccuucccagccaagugcaagugggugugagaagguggcucuguucuuguguagccuggagccacuuguucuccagcgcucucugcugugggagugcaauggcucacucagcagacugagcugcaucucaucuucucaguugucaagccacaaaagucggccacguguccucuaugcaacuuuacaggcucuauaacuuguuagcaaaauaccuucauucauagaaagacaugagaaagcaaugccgaugcagggcuuccuguaggacucucacugcagaagcagagugugggagaugggguguggcucccccugcugugcacagagccacagugcauccccaguaccacacccacacaaaacccaaaaaugugcuguuaccccagcacucagagaguggaggcagguggaucacaauccaaggccaucuucagcuacacagcaagucugaggccagcuugggccagagaaaauaucacacacacacacacacacacacacacacacacaaagccaaaugccauguggaucccguugguucugguaacaggaaguaaaacuauauguaaacucucuuccuaauuaguuucaaauauuaaugccuaaaaaaagcugucacaugcuuaggaaauguaguuuuuacuuguuuguuuaugaaaggcuuguucacuauauagcccaggcuaaugacaugaucagaggcuaaugacaugaucagaggcguuugcugccacugcuggcuuaucuucugagaggauacaaaagcccaccaucccccagagacuguguuaacuugggaaagccacacacuucucaaaucuugggccccuuuguaccaucaccaugcuaaggccuucuuguugcugguauaguauuuuaggauggaaaaguaaacaaaaggguuuccaaauauauuuauuuauuuauuuauuuauuuauaaauagugauacaucuucaucuuuaauaaaguacauguuuuauacaguuuuuuaaaaagucuugcccuagccgagcacugguggugcauaccuuuaaucccagcacucgggaggcagaggcagguagauuucugaguucaaggccagccuggucagugaguuccaggacagccagggcuacacagagaaacccugucucgaaaaacaaaacaaaacaacaaaaaaaguauugcucuaagggaccagcucaaaugucuccucucucugacacaguacccaugucugugucacuccaguuacacccgugcagucuagcaaacugcuggggcaauaacaggcaguauucuuauggaaagagcuacuuuuuccucugagaaaauaauaauaguaaggagguggcauuguuuucuuuuuucauauuuucuuuacuuucugcaagauggcuggauuuucaugucugcuacuucauuuaaucuguuaugucauauagcauauaguuucuagaaaaccaugggagaaaugagaguagaaaaaguuauguauucugcaaacaguagggccuagcaggcccucccguaggcgacaggcuucucccacuguaauuugggcgagcgcuucccggagguguccuuaagaaugcaggggagcagugcuuggugugcccaggccucucaagugcuuuccacagccaccugucacugcgggcacuuccccuacugcugcaauucccacuugcauaccaggaacuaaagugugccugcucacauugaaauaccaaggcguguggugacagcaggacucggcagccagccggcuuugucuuccuuugccaugccgcugcagccauaagcuccuguggcuuacggcccugggagagcaucacagucaacacgacauucaaauaugacacgucaguuguucuuucuugcucugguacuuggaauugauuaauuguuuuuugugucauuuaccauuuccgauucauaacuugucauuugaaaacucaucaggcuggccugcucaauaaacuugauagcuaagcauucuacucacugucuacaguagacagcuaacaaugccuuugggauuucgugguaugauaacuguaagaaaagcgauuuagagguacaaccucacaagcuuuaagaagaguccauuucuccuaggaauugcagcagccuggagaaggcuuugcguuucagcacaugcacaguggauagguagugugcuuccugaauugcuguguccaagaacaccccagucccucacauucuugaaaauaaaagccuuuuaaaacuuagcuccuuagagugaaagccucacagcuggucugacccagccuuagucucccaaaagugugaauguguuugcccaugcaccaccagagagcagccgugaggugagcgaguguccuccgggaaagcaggcugcuccugcacucauuuguucacagcacaugcaugcgggcuucugcagagagccgacugcugaguccauucugcaggauugccugagagcaugagucuaccaaaguaugucagccuccuuacuuuaagaaagagaacuauaauuucaaaugccagguguacuauuccagguaggaugugaguccuagaaaucccugcucugcccugcagcugccuugucaauucugucguggcuuuucaugcugagcugucuccuguuugaauuagucauucucaguccauauuagaauguguuucuuuuuuauuugacaaagacaguagcaaccaaaaauggagguaucucauuaaaauagaagcuuugugacacaggaguggucaguauggugaccauauucaggaaacugauggguaaacagcaguaacagaagccacacacucugcuccgguuuccucaucgcgcuccuucugucugucuuuuuaggagucuucugaagucuguugaagaggaauuacaucagcgguaauuacaacuuuuaauuaagcuugaaguacuuuaugucagagaugagauaaaccauuuccccuugucugucacgugugguuuguuaguuuuaguuguuagucuguccuauaaagaugcaggcguaaaguccugucgugcaguggcccucuccugcaucacugcgacugcugcaaggcccacgucuaaccaugcuccacucucucuagaggacauguggcacacuuagaagaugacgaaggcgacgaugacgacucuaagcaguaagcucuuguuugacugggguuguaguucuagcagcucaguaauaguuuuacaucaggaacgugcuguguagguuggaccacauucucugugcuguugcuuuuccauuccacuuggcauaaucagcuucagauugggguaacaaccugagugggcuagacagaaacuuaguucaggacuaagcucuauauaccacaucacguagggaauucucucaucaauguguuaauuuaaggcgguaaaagucagucugcaaugcuaauugaagauauaguagugggaaagaaaagucaucaacaaauaccauuuguaauuguaguuuagacuguuauuucucucaucacugugaucuaaacaccaguaaggaaagaggucugcugcggcucauaguuucagagaauaugguuggucauagugagggagggcaugguggcuggagcagccuguucuguaucaguaggggcuugcagcuuugaauucccaugugguacuaaccaggaagcagagaugggacuggagagaagauccaguuaggcuacguuuagcagccuccaccacccaagcaucaugucccagagucuacagccuccccaggccuggucagcagcuagggguuaaguaaggcccagcaugagccacuggagaaagguccacguagaaccuugucagucagugucaguaacugcucucauuagugccuuacugauuucaucugauguguuugaaauaaaagaaaugcuuuggauauaacuuuuuaaagagagaacacguuuacagaaguucauuggaagggauaaggcucugugugaauugguucugguuaauaacgaaagacaaugcagcccaacaguagacagcagcaccaggcuggcaggcacacagcagaguucccgugauccgcauccagucaccuugucucugugggcuucagaaaaacguugugcuuggucacccuuuguuucugaaacggauucuaaauuauagugaaucuuagccuuauugagauucugcugccugucacuucauagaauauaugaauacacaaaugcacacacacacacacacacacacacagaguuucauuaaagaugugucauaucuauuaguagcaaaaaugaaagguuaguauuaucaccaugacggauccagaauugagugucagacaggccucuggguaugccugugguagguuaucuugauuggcuuaacuggucugaggagaccaucuaacugggggaugagaggacucuggacuguaaaauggagagaggaggugaacguagcugagcucugacugaacuccagggugagcagcaguuucagguucacaguuugcuucccugcugugauggaaggcaccuugagcaguuggcuuuguuagaacgcagucauuguaguaggagagaccacgacucugcugugugcaguguauguauacucuuaccauccccagccaauggcugccuagacccccgucuaccuucugauggaaauaaaagggaguuguggccaucuuuccauuuggaucucuuacagcauugaaaaccaagaaaaugcacaucuccccacuuguaaauagguagaauucaauagaauuuggacauuuuacaaaauacucugaagaagaaaaaaaaaaacccucaugaacccagaaaacauuauuugucucugaaggcuuuucuuuuuugucuuugaaaaauaauuguauuuaauaauuuauuuaucaaaugcagaguucugacuuuauauuuucuguguuuucaguucaaccaugaaagcaaaagucccgccuccucugccaccaaagguagacacgccuacuugccuugagcucuugugugugagugugugcgugugagagugugugcacgcucucccaccagugcggucucgguuacuauagcuggcuuuuauuucccggccacaaagaaaaugaagaguugacauuauuaccuaagaacauaauuuuacuuuugccuuuuuaaaaaugauaacuuggugcucauuuaaguaacacauuuucaauguuuauacuuugaaauaaucucuaucuagauugguguuauuuccaccuagcuggaaaucuuacauuuuauuuucauaagauuuuuuucuugaaaaaaaucuauaaacuuaccauugauugaucgcugagaguagacaaaggauaaacuaccaucacagacauuugauuuucagaaaauaauuguaaaugaaaaauacaaaaauaagacagcagcuuuggaagacaacuaaaugacaaaaccccucucuuccucggcugcacuggggguugagccugcggcccuucugcguguuaggcacaugcucugccuaacaguccucaugaguaguaaagucaccccaacauacagggugcacacacacagcguaggugcagccucuaaggauaaaugagcgggacaauagcagcgcagcacauuuaccuuacaguuuauagucagagcaaguuuuaguuaugaguuguauuguaguuugagucagagccuugccaaucuggcuucuaacuguuuuauuuucauuguauuacugagaacaucucaguucugcacuugcuugugaagauugcuuugguuggcaccuucagggcacacuuggaagaauguauaaauucugcaaaccuuagcuaugggaggaaucuccccugccucacagaaguuucccaggcauccugucuuacugagcuagugugcgccaauacaugagcacugcaguuccuuccuuccguucucccuaaucugaaagaucacacuuuaacauaagcauguaaggggcagucuagagguuagcuucaguacuuaaaagagaugcuguuaaguugucaaucagaaagguaaggaugcuuucacuagggaaggcucugaaccacuaauagaagggaguacaagcaguucgucaccccauccacgcugcacaacucaacacgcuuuagcgcacacuuuaggauaauguuuaaguaauaagcuaucugaguuuuaauacccuuaacacuccucuagugaacauaguuugaaaguugcucauacauaauaauauuuacuucaggaaagcaaucuuauauuuaaucacugauuuccuuuucuauguuauuucagccuaaauccaucuucauaccacaggauacacauucugcugaggacgguaaucaaggaacaaucaagagaugucccucaucagggagcccggcaaagccaucccacguuccaccuagaccaccuccgcccagguuaccgccacagaagccugcuguuuuaggugaggguggaggacagagugucugucacaggcuguguucuauaagaagggaaggguccuguccaagcgaagacugacugaaagccuucgugggaggagcuaucgagggcaguggcguuagacaugcuuccugcuuccugcuuccuucuuccugcuucugcuucacugugcuuuccgugacagugcuuucucuugugccucagccugggacaguuaccccucuuagguucaugugugugugugcgucauauguaugccugaugccaguagaggccagaggaggucaucagaucugguggaacuggaauugacaggugugagcagccauacaugugcugagaugugaaccuggguccuccgcaagagcagcaagugcucugacccacugagccgucuccacagcccuuaccccaguagucuucccacuuuugagacugcuguagguuguauuucaucacuagcuacaguagcuaaguugaaaucaggcuuugaacaaacaacuuguaguguaggcuacuuucacuuuaggaaagauaaagcuguuuuucuuugacuccuuaauuuucauuaaucauuuuuagaaaaaugauugguauuuauagauauugucuauaaauuaguaguagaagguuccgucuaauaacugaaaguuuccucuguuguccagggaaacuuuuugaaagagcuguuaccucuucuugauaacuauuuguaauauggauuguccauuccuuaaaaguaauuaugaauuugcuauuuuucucuuuuuaaugaaauaaauguuaacucagauaagagcugaguuuaaguuuacccaauauaccaaaaacagguugaacgggaagaacauagaacacuugagggguggauguucuuagugggagaugccacguucagaaugaaccgcuuuccgaucuaauaauuguccuaauggaaucuuucauuuaaaaucauccuuucacaauauucuaaaaccuauuuuauugaaggaaauggagugaacuccuuccagcuaaauggugagcgagacggaucauuauaucagcagcagagugagcaaagaggcacaaaccuuucaagaaaggagaagaaggacgucccgguaagugcugcugucugcacacuguguguguuuacauuguguucucucugcugugcagcaagagucacacugagaaggacugacagcagagcggcuguguagucaguccauaauuacucuguugguauuucagucuauacugaugguagugauaguguuuuauuugaaucguggguguuccauugcuauaggaaauaaacagucaccuagagaaggggugugcaucgcaggguuuggggagcagugaguugacucugggaagaaugugggaaaauuaaaaauagcuauguuuuauuuucugaugauauucugcuuguguauuuuauucaaagaaauuaguuugaaauacaguauuuucuugccgaauaacagcaaaaaaaucauaaaucuauauuccuuuucuagaaaccaauuaguaauggucuucccccaacaccuaaagugcauguaaguacucaguaacaaauaacugauuuuucaaacuaaauacagugagaauuguuucaguguaugucuuagauugugucugccugcuccccaccccaccccacccccagcaccaacaugguaacaggcaccaucacagucgcacucagcuuuuccucauauuuaaaaagaaaacuuguguguguguguguguguguguguguguguguguguguguguguguguacuucugucacaguacauuuaugguagucacagaacuacuuuuuggaaugagucuucucccaccaugugggauguaagaauaaaacucaggucacacuuagaggccuuagugccuuugccugcugagcugucuaccuauccucagauugcuccuuuuuuuuaaaagagucuguauauuuugauuuugaaguauguguggauuuuaaaucaacccugcauuuuuuuuaaagauuuauuuauuacauguaaguacacuguagcugucuucagacacaccagaagagggcgucagaucucguuacaggugguugugagccaccaugugguugcugggauuugaacucuggaccuucggaagagcagucgggugcucuuacccacugagccaucucaccagcccccucaacccugcauuuuuucaguuuacaguaugaaagucaagaugauuuuuuauuguugcugaggguuuuugguggaggugguggguuuuuguuuguuuuggucuuugguuugugguggugguuguugauuugguuggggagauuguuuuguuuugggggguugucuuguuuguuuuugagagagagucucucuguguagcccugacuguccuagaacuccuucuguagaccaggcuggccucaacuaacaacaaagaccugccugccucugccucccaagugcuagaauuaaagcaagcccggccucaaagauggcauuuuuaucauaacaccagacauuuccuuuguggagauuauuauuuucuucuuaccuaagaacauuauguuguuuugauagagggugcugauucuuacuggcaagauauuuauuacacagaacugauuauuagaaaugaauuauuuauugugaaaugacauaggaaauaugagauuuuuuucucucuagaaaaauuauuguuguaccaggaaacuuugugugugacuaucaaaaaguuugaguguccagaaaaagcuaguuggcugacuaucugacacauuuaucucuguaaauuugaagugaucuuaauuuuaguguacccucgggucucccauauaguuagaccuuccauguuauguuagggaccguugccugucacuguuauguugaccaguccuuauuuuuuucagaugggagcguguuuuucaaagguuuuuaauggaugucccuugaaaauccacugugccacauccuggauaaacccagacacgagagguaucacugcagcuccuucugggguuguguuuuguuuuguuugguuugguuugguuugguuuuuucguguucguugguguuuugcuuauuguucugugugggggugucggacccccuagaacuggaguuauagacagaugugagcugcuguuugggugcugggaacugaaugcagggccacugggagagcagcgacaguauuuuuaaacauaguuuauugaaggaaauggagcucuugauugcugagcuaucucuccagccccaguucccugguuucuagcugcccuucagugaagcucugaauuucauuugacucauuuucuuccugucuuucucuaagaguuuugcuguuuucuguaaauuuaagguaaauauauuuaucuuuacucuccuuguaguuugauguagcaguuagcugcucauuggaauugccugucagucacggugucaggccucccuuacuuucugcagaaaugguuccucugcccagugugcuuacccucacauucaugacugaaagacuuggccacuagauauccagagccuaucgacuguuuuagaagaacacuaagcuguaaaggggucguauucagaguaauuaggagcugagcaagggccugguguucucugugcacaccuccucccagcagcucccuuuagcuguguggcacacccauagaguccucgccacacaugcuuacgugggugugcauaagaagauguauguauucuucuaaaaguccaaguuccguacuuugauuugacacugagauucgcugcuccacaggcagcugaugcucaagcacuuugguguaaacccacugcugucugaccacagccuaugccagcaccaauccucaccaaccuaaacccaaccaaccagcaccaagccuaaaacaacccugcacagcuuaugaguucucauauguucuaaguuauucuuagcauacuguagcucagccagagaucaagauggauuccuuuuauaucuuaaaagcaaucagauagaaugcuggcuacauuucucuuaucaccuagaagauguagccucacagauacacaggguuuuuuuuaaauuuuuuauauauuuuuaugugcauuggugguuuugcuuguauguaugucugugugaggauguuggaucccuuggaacuggaguuacagacaggugugagcugccaugugggugcugggaauugaacaaugaucagguccuaguuugguuugguagguuuggguuuguuuuaaaccaacucuuuagcccaagcuggcucaaaccuccuaucuggucacuuaugaucacgaauuucugguccacuugugcuguggaccuccgaaguguugugauuacaugccugugccaucaugucuagucuguguggugcuggaucaaacccagggccucuccugugaccuccguccucaccaccuguuucauuuaauuuguuccucugccuucaaguccuagauccuguguuuuaaugauguuagugcuuaaaguaauggccaaaaauauaguagacucugagucaccauucuauugcugugaagagacacuaugaccacaacaauucuuauaaaagaaagcaccuaauuagaagcuaacuuacaguuucagaaguuuagaucauuaccauggugaggagcaugucagcacgcagggcacuggagcagucgcugagaacugcauccugaucuacaggccaggagagucuguaguccuguagucuaccucuccagugguggcuuccuucaacacggccacgccuccuaauccuucuaaucccuucaaaccauccucaccccggugaccacgcauugaaguauccgagccuauggagaccauucuaauucagaucaccacagaugaaaaauaauuuuuaauuugaguuaguucuuagcuuucauguuguguuacuugcaugguccucucuuuagaggacuuuagaaaaagucccugcagacucuggcagugagucuagcagcccacuccuccaaccucccgggcacugccuccucacugcucugagaauaacauuuguguauaacuuagguuaugagggucuaauuccacuuuguaguaaaaauuuaaaaaucacaaucuuuuucaaggguaacacauuauugaauuuuaguugguguaaaccuuuaaaguaucuuguuuauugaagucaauuaaugaaaucucuguuauuucagaccaguacuugauauuuggcgcugaagagggcauuuauacccuuaaucucaaugaacuucaugaaacaucaauggaacagguaggcuauuaucuauauuucucucuuguuguuuaaguagauauuagaaauaaauuucaguuaugauuggcacuucuuuuuuuguaaaacauccauggagcauccauuugcuacauacugaagaaggccacagucuccuuuccuacccuuaggaagcuuacacuauagugaaagacugcagcacucacucuuggucacucucuaaaguugagaguggaauguaggccacagaggcaaguguugcggcucccaaaggaaaggcuccccuacagaagugucacagcucugcuguggcaaagggagguuuuccccagcgaaaguucugcucagagaggcauccuggcaaucaggagccaaggaagaccacagcacagcaaaccucacccaagagauuaguugugaggagaaaacccaggagagagagagcagggaacugaacagaagacccggcuuguauaggauucgagggugggagugggauccccaggggguccuuggauuggggggguuaugugaccugguuuugaaguucagggauugguagguuucuguggcaagcucagaggcuuguggguuuucuugacccuuuguccuccaagcagaaccuccugugagagguguaaacaguacgucgggauggaccuuaagugacagcggacaagagggaugaggauggagcugugaaauuguguggcaucuggagaacagugauuggacaguuuggagucuagaauaguaacaauagauugccaaaccccagagcuuucuauacccagcugauggucagaacuguguuuuagaaauauauguuuguggaauagugggagaugaugagacuguacucaaagggugaagauguguuaaguucauacagagggcucagagguuaagagcacuugcuacacaguugugaacacuagaguccagaucugcacacccacauuaacaagccagaaaccucucaaauaccugugauugcagccccaagggaucucuuccagcuucugugcacacagccaaaugcccacacuuauacaugcacauacacuuaaacagacacaugacacacaaaaacauaacacauuaauuaauaaaauacuuuuuuaaagguucaaggcuugggauaagagcacuugcugauguugcagagggccugggauugguuccaagcacagucaugguggcucacaaucaucuguaauucuaguuccauggaaaacagugcccucuucuggccuccccaggcacugggcuugcaaguggcauacauacacgcaugcaagcugauucuccuagacauaacauuuguuaaauaauuuaaauaaaaggauuguugccacgccccuuccauccauggucaaucccugaaacccucauagaggugaaaggagagaacugacuuaacaaacgaaguugucuugucuucugacuuccaugggauguguaccauauacacgcaacacacacgcaccgcacacacgcgcacauacacacacacacacacguacacacacacuguauggcagcaaauauauuuaagaagaaaaaauacagagauggaaacauuuuggacacaggagcaguaagcaauaugcagaacuuguaguagugcuguugauaguaaugaagauccacguacagcuaaugugaagucauaauaaugaagauccacgaacagcuaaugugaagucagggccuucacugguggagucuugccuggcauguacagggccuuggguucaaaccucagugcugccaaaaaaggagaugcugggccaagcacagugcuuacacacauuguuuccucucuucagaagucucugagagguacaugcuacuuauaauuuucuuuucuuuuuugaggggucgugaccaaauuccuaagguacauccuaggcagggacugaccacugaacuauaccccaaaacuguuacauaaguaugggugucuuugcugugugcgcaucugcucuaugggugccuggugcccacagaggccagggaagggugucggauccccuggacuggagguacaggugguucucaguucccgugugggaguuaagaauccugcccaggcccuccucaagagaagccagugcuccuaaccacugagccaccccuucagcccuacauacuccaucuuccagauaagaauacaauauuaaaauuauauguuuuauuaaaaauaaaauaagaagaaggcaauaaaaaauacaaaaguaaguuaacugaagucacauaguauucaggaaaguagagaucuaggcaaaauauugaaugugcccuucuuaacugcuauguucuuuuauaaaacugaauauuuuaccuagaaccuaacucacucacuaaaggaagcauugaugaucuagaaaaccuuuaguacuuuucaagccauaaaugccagccauugcccugugcugaccacuaugaaaggcguugugcuuuuuuccuggcacucuauacaagugcauugacaauuauaaaacacaguccuggguuugauacuaacaaaguacuaaguuugugcuuguguaaaaauuacccagaucaacacugaugaaauagccagccuccugcugcuguccucuagaagucauagcccauccugccguguguccucaaggcagucagucaacccccacugugguuacagcucuuuaaugaaaagcauaaagaagagaugugagugagaccugaauuugagacauaguuggcuauagguucagggucugacuucacaacgagggacagaagggauuuucguguuucaugaaugugcauccccaguaagaaagccucugcuuucuuuuguuuauuugaaucuuauugauaaagauguuuccuuguuucucccuucuauuauuacauuuuguuaugacucgguguguuaauaaaguagucuccugagagucucagcuguuucaucaucucuccauucuucccauucccuacccucaucccaguccaucugggaaagacccauaggaauagcagagcaagcccagcaaacaagcugcuuacaucaggauagaguugccagccagugguuaggugcagaguuuggcccacauucagaacugcuuugccgggugugaguaaggucugggcacuggcauuucuaacacugacccgggugcugcugaggcugcuggcccuggagccacgcugcugagcacuggugcuugugggugaaacgucuccaucagaccugcuauugucugucuuuaaaguacguugauugguuuuccuuugcucuaauacucaaacauuaggcuuccuaagcugucccccauuucucacacacugcauggacagauggguucuuacauuuccucucaacucagcuuuugcaguuugcaagucuucgucauggucccucucacucagccuuucuccugugcagaccuagcugucagugucucuuguucuucuacaccauguuccuuuuuguucuacauuauauaucugcauguacuugauaaguacauuucaagaagagugcauaggaaagaguuagucauuuaaccccaggaccaaaauaaagggauggauguuauuuaaaaugcuuuuauucucuuugggguuauauggcuccucauuacagacuauguuggaaguguacuucuguugauguaguugugaacuggccucuggacauucagcuuacauaguuccuguauacuucuuuguguagcuguuccuucuguaacuuuguguauuuuugucagcuguucccccgcagguguacguggcuguaugugaugaacaauugccugcugucagucucggguaaguccugcuucugucauccuagugcaccuuguugcuggugacugcucucaugugcugcuuaucccuucacaggcaaagccucucagcuuuacucccacaacuuaccggggcuuuucgauuaugcaagacagaugcagaagcuuccaguagccaucccagcacacaagcuccccgaccgaauacugcccagguacagugcgucugucccuagaggucacaugccuacacaggcacuuagucaagagaccaccggugaggguuugggcugauagaaaguuuucauuaaaaguugccuaauguauucuaacaggaccuuauucaucauauuuuuguucuagaauuguuuuaaucuguuuucugauuacauaaacauuuucuaccucaacuuuuguuucugucuuuucugcaaaaauaaaacuaauuuuucauguaauuauacauuagcuauacugccuuugcucuuagcaugcuuugucaacuuacauaaaguggauuuuuucaaagcacaguuucuaagccuagaaaaucaaacugauuuguugaauuaauguuguuuugcauauggagauaaugagagaugaggaguuuugcuuuuguacuuugggcauuuuugaucaugcugagugcucacguuuauuguacuagcgguccucaucugcugaccaagcagccugugaagucagaugagaaugcagcagucuuccuuccuucucaggguaggcuggagagccaaugccgaaaaccccuagcuuucagggaccugaagaucuguuguuaacugcuacguuuauagcaucaucaauuugaagauuuuuuuuucauuuguguccacacacaagcgugcgugcgugugugugugugugugugcacacgugcgugugucuacagacucccugagagcacauuuggcaauaauggaacucaccuauacugagguuccugagguagagguuagaguuggaaggcaagaaaagguccugucaguggccacaguaacaagacaacuuuacguuuuuuucuuuuaagauugauuuuuaguuaugaguguuguguguguaccuguguggguauaugcaccugagugcagguagcugcagaggccagaagagggcgacagauccuguggcgcuagaguuacagguagcuaugauggaucugacaugggugcuaggauuggaacucacauccucuggaagagaguacauguucuuaauugcugagcagcagccaacaaggcagcuuuucacacagcugaagccaucacaugugugggaagacccucucccagcuuccagucucuccccacuucugucacugguccuccaguaaagcagaguuacugaugcugcucacugaaugcugucuguaaccugacagacuaggguuaugccaugaagacugcagcuacugcuguguauauauguaguuauauuauauauaaaauauuauauauuauauauaauaagcuacauauaguguauauauacuauauauacauauguguauauauguauauaguauauauauaguuuaucggcucugcauuuaaaaaaaaaauccuacgguuguauucuucugaauucaaaauacuucauuguuuuguuuuguuuuuaacuaaaaauuuaauucauuuggaauugaugggcaccuaacaaaggaaucaaauauauuuuaacuuuuuaaauauuugugugugugugugugugugugugugugugugugugugucgggcuugguaguaaauaccucucuuuacccauugaaccauuuugccauccuccuuauuucuacuuuaauauggacuuaacagcacuaauguuuaccucaugcuuuccccacuggucuguggcagcaucuuugugaugagcacuuugcuugccugugucuuauuauauucuucuccauuuacauuuaggaaauuugcuguaucagcaaagauuccugaaaccaaauggugccagaagugcugcguggguaaguagaccccagugccguguggcuuuccugcguggcagaguguaaggagccccucgaggcucacggucuauagggggauagauaguugauggcucugauaaguggagagagacagugggguaacuuugaucacaggaaauaagcacaccaugcucaccacgccucuacuuaggucaugauaguaagguuguaaugauagcagugucccugugcacagaccucgaguauauugcucuuccaccuuauaacaacucguuuucuguuuacaccuaacaacaacaaaaaagcccaaaguguucuguaacuuccugcuguugucagagggaaucuagcacaccggguacccugcaggucugugggaaacacgcuaaacacgggcaggcgggcagcugagaagggagggcaccugggcugggccugccgaggauucccugugaguagcuggagaagacacugagcagggugacauaacuaugcagggaaugaaucccaaugaauggcagcuguguaagcugaguaccgacacucgccuuagcuggaugcaggcagcagagagauggcgcacgcguccaucugagcauacagguugguagcugaggacuacugcggacgugaaccauauucacuguaccacaaaugcaagccgagcucaccagacaggagcaguacagagccaagaagaggaugacaucagagacugaggcugggcggaaagcucagcagaaaucagagcagcuggcugggacagacgggucucagggcugcuucggaccugcugccgugaguggcagcuaaccaaggacuuggcccugugugaggaucaggacuuucuucuuccuugggcccgcuuuacgaucugggcuucucuguuggcuuugcccggguagcauugucccucuaugccucugccucauagcucuuuaaaacccaggugaaguuaggggauuuugccaucuuccuuuccaugguuuucagaaaccuccuuauuccuauguauuuacauuagauuuuaaauguaagaaaaguucaaacacuugaggcaguucaauuuuauuauuugcaaguuguauuauaaaaucuuauuagugccuguaauauuuucuagugauuauaaaagggauauaauaaaaaagagauaagcaaauacuuuauuuuuagaagccaaaaauauaaccuccguacauugcugucaaaagcacucuguaaccaccugaguuugcauaucacaucauuugacaacuucucaccagagucaccuuggcccuuuccuucaggaugguguggccuugggugccacuguacacaugaccccugauggugaacaacagucucauacgugcauguaaacaaaagcuuuuuuuuuugggggggggggucgagacaggguaucucuguguagccuuggcuguccuggaacuuacucuguagaccaggcuggccucgaacucagaaauccaccugccucugccucccaagugcugggauuaaacaaaagccuuuaagugcugggacacucucacuauuuucuaaagcagucuuucucauucacuauaauauccgauuauuaagaaauggcagccugcuuuugauuuuuuguagucucuauuuuuggaccauaauaacuauuauuguacagauuuuguauucuaagaaggcugauguuuccucuuuuugccuuuucagugagaaauccuuacacgggccauaaguaccugugcggggcgcuucagaccagcauuguucuauuagaauggguugagccaaugcagaaauuuauguuaauuaagguaaguauucaugacaucuguaguacaaacccuuuguuagccuugcucuuauuuccgccaacucucaaguguguguagacuggaaguuaugcgguggcugcauggagguucugaaagaacccagggauggcagugggggacuggagcgagcucccuggcucccgugaccuucgggagacuggguuuuguuuaagcgucucuucgaucuuucaaggaggaucuaggucugauuuugcuuuccugcaauccuagcacuugaggggaagaaggcaaaaggaucuagaguacaugagaccccagcucaaaaaaaaaaaaaaaaaaucacuacacaaaaaugcuuuacuccaaagccugaaggaaaguagcccuguugauaccucguggaaugcagccuacuuauggcaaaauccauuuuuucucagcuucuccuuuaucuugccgagugugaaaaguaugccuuuccccggguggcgcgaacaucuguacaguugaguuucccagucuccuccugccuuucuuccuugagcuccacccugacuguucccuccauucuugacgucuauauagugaaaacggcuccugugaugucagucagccacgcgcauugaaaggauaguuaagcuucagcaugagcgcccucugcaggccguuuccuguuacaggaccugugcagggugucuggggugugcuucagcgaguaagaugcuugaggcccugagugugaauuaccacuuccccucgccccugccaaggaaaagcagggcacagccacgugcaacugugucuguccccagcacugggagagucaggagagggucaccacucacacacacaacacacacauacaacacacaaacacacgcaggagggaaugugugcuccuagaugcaguaagccacagguuaucccucuguggcuucucuuuccuaaguggacagcacuggagaaccuggccugacugaugacugaggccuagggccagcuuucugcgacaggagucagugcacaccccgcucucauccaggagggucccaugccccuuuccugacauucuugaauguuccuugcucuuugugcuucaugacuccugugcacuguucauuuuguuuguggauuuggauuuauuuagcuuucuuggcuucuauagugugacugcuuauuaggugcauucaaauauauucccuugcuuucuguauccuuucauccucuugguggcauguuggacaguguuugcaucauuaggccacauuuuuaucauaaacaagaugaaauuaaaggucuccccagcaacuauguucuuacucuaaagaaaacucagcgcuguuugcuggaguaagucagaugugaggaccacucucuaaaucaggaccccaugcugcugugacuuuugcacucagccuaaucauuagaggaagccaaauguacacggagacaaaaccuguugaauucuuacaugcucagagaaaagaaagaaagaaaaagaaaaaggggaaggggaaggaaaggaaaugaaagaaagacccagaaauauucugccgaagucuucauugaucuuaacuucaucugaaagauucuuuaaguucuuuaaauugccugaucaugaauaugaaacguugggcugaagauggcucagccauuaagagcuccauugaauccaacaccucugccuccucaggcacauaauuaaaaauuaaauuuuuuggaagaauaugguagguugggucugaagaaauagaucagugguuaggagcacuaguuauucuuccuuaggacccauguucaauucccagcaccucuagccaucugucuuagggcucucuagagucacaggacuuauagaaugucucuccccacauugaggggauuuacugugaugaccugcacguuccagcggaagguaaguaccugagggccaccacucuuggaucugggacuugcuuugucccaggcugaccuugaacucagagaucuccuugucucuguuuccugggauuaaggguguguacuuccuugcuuggcccuaaguuuuuauggccacugugccucaagaucuccaugccaagauccaggucagaaacuugugucuuccacccucaagaucuggaucaugggugugcccuccaauucuggacuguaguucauuccagauauagucaaguugacaaccaggaauagccauuacaccaucuuuaacuucaauucuagaucugacacccucuuuuggccucugcaggcaccaggcaugcauuuaguauacagauuuauaugcaggcaaaacacccauauacauaaaauuagauuuuaaaaauuuguuaaagaaaugacagguuugaccaagcauagggacacaugccaauaucauuccaacacuuggaaggcugaguggcugagucaccaguucagggcuagccuuggcuacauggagaguuuaaagcaagucugagcaccuuagcaagaucauguggaagaggaaagagguuuuacuuaaaaucugugcccuaaguagagggugauuuccuagagaggugcaguaaggagagacgugucucggguagaaacacuccuuugaucccuggggaggagccugggguggcuugugcacaggugugcauaauaauggagaacugugccuucuggccaccaaggucuuugugucuucaaacuagucauuaugcaagcccauuucaccuguuuuccuuggccuggaugaguugccagauuaaaagacaaacccuguuuaaucacuuuguuaaguacuaacaauaaccacuuggcaaauacaaccuauuuauaaaagcaacaaaauauaaacuugagagaauguguguguaagaccaauuuuuuaucuuuccacuucacaugugugugggugugugucccuaagugugacaguucaucuucugguaacuucacaugugugugugggugugugucccuaagugugacaguucaucuucugguaacuucacaugugugugugugugucccuaagugugacaguucaucuucugguaacuucacaugugugugugugucccuaagugugacaguucaucuucugguaacuucacaugugugugugugugugucccuaagugugacaguucaucuucugguaacuucacaugugugugugggugugugucccuaagugugacaguucaucuucugguaacuucacaugugugugugugugugugugucccuaagugugacaguucaucuucugguaacuucacaugugugugugugugucccuaagugugacaguucaucuucugguaacaguaagaauuaggaucagaaaguaugguuccguguagucuucucacgggcagcguugauuucaguggcugcauagcucgucuuuccuuuccuuucucuuguuuuauguuuuguguguucuguguuuuaucccuguggcugcugacagccaguuggauguuucugaguucuucucacuuugauguagccuccugugagugcccacccucggucuguagauuaacucagguauaauggagucauguguucaacauugcuggcagcgaagugaaccagaguggcuguugugaugucuguucccaccaucccuugcuuggcucucucaccacuccuccucagccauucugguguuuuguuccuggcuauuaaugaaauucaucuuuucuuuucucuucucuucuuuucuuuucucuucuuuuuuuuuuuuuuuuuuuuuuuuuuuuuuuuuuuuuuuuguucacgugagagaggcuuauuauggggcaagggggcaaaggagaugacggagaugaagggagaaaagaaagaaaaaagaggaaguucauguuuucuauuuccagaucuccaaacugagaauguauuuguuuuguuuuuuuuuauagcaacaugaaaaauaauuuaaaguuauauaaaaaaaaaugucauugcaucagaguuccuaugcugaugaagugacuugagcuaggaggcagauuucuuuaggguguuguauucauguuuaaaaggcagugugugcugguggaugucgcugccuguccuccauguuggcugcagugugugcugguggguguugcugccuguccuccauuuuggcucgucuggaaaggaaagcaggugacuggaacggaagaacugagaugggagaccggggacuggcacaggagcuggauuacacaggcccggccuggcacucggcuccuggacuucauuguccagcucucaagagacaaggcuagcaagauuccuuccaagcacuaaaauacaaaacugugucauuuuaauguaacauuaauaaagauacuuggaacuugagauuuaccugcacagcucuaagguccuggagccagaagcagucuugagagcagaagccucuccugccucuggggcggcucaggccucacugcugcuccccuugggcaguguggccuuagucccucugcucagccuaucugucucucuccagcacauagaguuuccuaugccguguccacuccggauguuugagaugcugguggucccugagcaggaguacccucuggucuguguuggcgucagcagagggcgagacuucaaccaagugguucgguuugagacggucaaucccaauucuaccucgucgugguuuacagagucagguuugugauuucuauguaauuguuaauaacaaugccagagguugaugcaaaagcagugugugcuccauauguccuagcaagaaaagcagucuuaagugauguggcaggaaauaucaaaaaccaagaaccggcucauucucgcguuuugggaaugaggacagcauauggguaagauguagcugcuagaguuucccacuaucauggcugaucugcauuuugucucaugguuucaaacacugucagacaccaaggcagagaaggccuccuggaacagagcaguucccaggauugggggcacgagaugagcccccauugaggccaagucagaccagaugugaaguaggugccaagccauuaccuucaaagcccaggcccuauugaugagcuuccaucagggagucccuugcuuccgaaggacccacagcuucucagaauagcaccaccaaccagcugggagcaagaaugaaacaugagggccagcaagaaugcucgguggguaaaagugcuugcugcccagccugauagccagaguuuugucccagagacccacauagcagaacacugacuccugcaaguugucccuggccuccacaccaccacacuguaacucucaugcacacauacaaguaaagcauuuaaaagacaugagccuauugaagacauuuuagauccaggccauaacuguacauauuuauuaaaugccucuuguaggaaaacgugucuugccauaaaauaaggagcuaccaguguggucuucugauuuugaggauuguauuacucgaagucacacacuuuagguagcuguuuauuucacaggccacaacaugucuaaguaagcucugguugcugcuggugcugcugguguggcuggguaguaggaugcguacuuagugcacaguaugcacaaaacccaguguguggggcugcagagauggcacagcccugaggaacacacacugcucuugcaguguguucccuaucacccaugugacacagcucacaacuacguguaacuccaauuccaagggauccaguacuuucuucuggccuccaagggaaccuacauucauuuauacaggguuccacacauacaugcauaauuaaaaauaaaauauuaaaaagcaugcgugcguacagagagaguacgugugucagaaguucacuuccaaacucgcucucucuuccucccucagauacgaaaccacacuccuccuggugaucuuacuggaaauagcuguauaaugugaccaacugagucauggcuccccaaagccacuuaauaguuuaauacaugagcaaauauucuuaacauuuugauagugauuccuguuucuuuuguacuuauuuuuagaguuuuacagaauucaguuguuuggugcuacuauuuauauaaagggcaagucuuucugaaaugcauauuaaugaguauuuacagcugccggggucagaugugguggcacacaccaagaauuccaccacuucagaggcugagucagaaagaugugauuucugggcuagccuuggcuacuucacaaggaccuuguuuuaauuuuuaaaaaaaacagacauuucauaacauugguauuuucaagcauuuguauauaaguuuaagugguauagauuuaauuuuuuccuuguuauuuaacuccaguuacccugucuguaucaucaguuaauuuuaucacuuuaaucucugucacuuuaguaaggauaucaauauaaguggucauugauugaguaguuagugcaggccacugcuucccaaaugugagcuuacaucagagcacuccuaggcucuggauccuaaguguuuccuuugguccacccacagucaauguuagugaugcugaaaagguggucaccauacuuuaagagcauauguauuagaguggagagauggcucagugguuaagagaacuggcagcuauccagaggaccugaguucuauucauggcauccacauggcagcucacuguaacuccaguuccagggacucucacggcuuccucaaguaccaggcagggaagugguguacaggcauacagacauaugugcagauaaaacaccuauaacacauaaauaguaauuuucuuucaauucauguguacacaaaucucagacugauaggaaagaugccuucagagggaagccacaguagaccauaguguggguggcuccuguagcugugcucuugcacuugauauugcuaaugaaacuuaagugauuuaaaguuaagauacuuacuuaauuaccauuucugaaguauuugugagaaccugugaaaauaauucuuauauaauuauuucucaaauauuaaauauauguugucaaguuagugaacagacacuuccuuuauagcaacuaacccuaauuaccuuauaaguguuggguccauauaguuuucuuacagaaauuugauuuuacuuugaaacuuguauuguacuguagcaaaauaauagaaagaaaacuuuaguuuugugguaaauagaucagauugaacucucacacuuaaaaaacaugagcuuccaguaucuuaucuuuaguuuuuaaacaaccuaucgauggugaaaagccccuuuuacguuuuucucuuuaaaaaugcuguagagccaaguguggugguacguaccuguaaucccagcacuucggaaguggaggcaggaagaucaggaguucgagaccaaucugagcuacauagugaguucgaggccagccuggacuucaugagaccucccacacaacacacucauauacuugaauauacacacacggacaccuacgggauguuuuguuaugcaguagagaaugcacacuucauaugggaaaugugaaacuguuuucuagcaagacauguuaggcaugaguuugugggaagucuaugaaacuaugaauagcaaaaagaguaagcaaaggcacaauggcucacaaguguaacccagcacucaggagguggaagcaggaaauuguuggaaguuaagaccagcccaagcuacaugauaaguuccaagccagccuggccugaagagugacaccugucagagaaguggcuggggauggggguggggcugaggaggaggaagagggacggggcacagaagacagagagcauaucuuccuccucaaaagaugacagacgcuuucaccacacaucggaagccgggguauuacagcacacugaaccugagcaggccuccucacagacacuguugaaggcaagcucuuugcagugguacgaggcuucucuguggcuuucccaaagucucucacauuaucauucacugucugccuggugagacggcgcgacacaccugcuucccagcuucaucugacuuaacagggaaagguugcugucaguccaucuccacagugccgugguucucuaaagcauaauuuuaaacacacucuaauuguuaaaagaaaggccucauuuccugaccagaccuuaaaacagcuccuuccaagaaacuucacaauggcuuauugaaggauuuccauaaauacagaaaucucucucucugaggucaggagauaagauauaggggaugauuugggcuuuuaacuucuauuaccccaaaucucuuacacucuaauuaacucgagagaguauuagccaggugccaguguuccuuaagacaauucagucuuggggauggcucagugggugcccugccgccaugcaagcauggagacaaguuuggaucccuggugccuacauggugugcaucugaccugaguguugaggaaccaucagggcagucauggggacugguuggccagaaaguuucagguucagugagagacccugucucaaaaaaauggaaaaugauggaagacacccaaaguugaccucuggccuacacacagagccaaagcaagcauaacacacauguaucauauacauauacacauacacauacauauacaucccacagacacauuaugaguuucugaaaaaaaugcuucaaauuuuuaacuuacauauaguuaaaaaguaauuaguuuaacucuucaguucuuugauuuaauccacacugaucacaugagccaacauuuacuuacaucuggugauguucaaagcacagcccagauggucugaguuuaagaucagaaauuggccagaacuguaacuuacaaggcaggacuccucguuucaacuguaaauguaaauaucguucucauuagcaguauaacugaagggccagcucugcuguacccguuguccaugucaucgucagaacacgagcaucccagugcagcucagcaagagauguccacccacuccaaaugcagcagcccacaguuccuuuguuuguuguuguuuaagaaaaaauauaucguaaguauuguagauuucuguaacuuuauccaacuguauuuuuuguguguguuguagaugccccgcagacaagcgucacucaugugacccagcuggagagagacaccauccuugugugcuuggauuguaagucucuguuugugggugucugcugaaaagauugcucuucucuuacucgugagugacuucuguuuuucucuagguuguauaaaaauagucaaucuccaaggaagguugaaauccagcaggaaauugucaucagaacucaccuucgauuuccagauagaguccauaggugaggcauuguuuuuuauuucuuugcaucaugaacuguuuaaaaaguauuuaugugauaguuccugacauuguaaaucuauacuacuguuaaagacguuuuaauuuggauauaauaacuaagcuucuucuuacaaguucuuugugugucgcagucagaugcaccgugaguguccccauccuugcaagagggcaaucucggaauuuacauuuuccccagaacccuauaggcuguucccuguaagcauuuaggauguggcccuuauaucucuggcugugcuguugccauugcugcucagaaaguucagccaggaguagugaugcaucccuguggccccagaacucagggggcugagguaggaagauugugaguucauggccaaccugugccacauagcaauuucuaguccagccucagaagccuacaugacccugugucaaaagaaaagaaaaguugcuuguugccauuuucucaugaaccuuauguucucuggugggguuucugacagugucuuaguuagggcuccauugcuauaaagaaacaccaugaugaccaaggcaacucuuauaaagggcaacauacuuggggcuggcuuacagguucagagguucaguacauuaucaucauggugggaaccauggcagcauccagacagacaugggacuggagaagcugagaguuuuaugucuuguucugaaggcagacagagaagacuacuuucuuccaggcagcuaggauaaggaucucaagcccaccccuacagugacauacuucuuccaaaaaggccacagcuccuaauaaugccauuugcugggcauuuucaaagcaucacaggcaggaucaguaaagugcugagauagcaaugaagcguggugcugagggaaacgaagccaaauguacuuuacaugcacaagcauugaguuuggggguugagguuuuuguguauuuuaccaaugaaguuuuuuuuuuuaauguacauucacuggcagagaguaaggccaggagcaaacuguguuugucaauacaagcauaaacagaaaggggaacaggacagggggaagggcuagcacagaaccaccugugaauggaaacuuagggguugugugugcaugagaaaacgaggcuagcacuguuaauuuucuuuaggaaacaaucaaauuuauuccucacaguuacacuguaucaaaaauauaaauauaaaacugaugucuggacaugagccuucuagucucuaucagugucccggagcugaggcugucccacagcccuccaaaucccgccuggagagagcuagucuccaaggagugcugucacuucuaaguucacagauaagaccacaaauuuuguuccaauaacuugccaaagaggaaucuaccaggagcccacagggcacaggaauguugaaacagccagggagagaauccuuccagauccaaucagugcccuggagcuaccccagugacacagcucucuacucccaaauccugcccagacagaacuaaucuccaaggagugcugauauaccuaagaucaaaggcucacagacccacaggagggacaaucaccagucagagauagcaagaccagcuaacaccagagagaaccacauggcaaaggguaagugaaagaacauaaacaacagaaaccaagacuauguggcaucaucagaacccaguugucccaccauagcaaguccuagauaccccaauacaccagaaaagcaagauucagauuuaaaaucacaucucaugaugaugauagaggauuuuaagaaggacauaaauaacuuccguaaagaaauacaggagaacacaaguaaacagcuugaagugcuuaaaaaggaaacacaaaaaucccuuaaagaauuacaggaaaacacacccaaacaggugaaggaauugaacaaaaccauccaggaucuaaagauggaaauagaaaugauaaagaaaugacaaagggagacaacccuggagauagaaaaccuagcaaagaaaucaggagucauagaugcaagcaucaucaacauauuacaagagauagaagaaagaaucucagguguagaagauagcauagaaaacauugcuauaacagucaaagaaaaugcaaaaagcuccuaacccaaaacauccagaaaauccaggaaacgagaagaccaaaccuaaggauaauacguauagaagagagugaagauucccaacuuaaagcuccaguaaauaucuucaacaaaauuauagaagaaaacuuuccaaaccuaaagaaagagauguccgugaacauacaagaagccuaccgaacuccaaauaggcugaaccagagaagaaauuccucccaacacauaauagucaagacaccaaauagacaaaacaaaaagaauauuaaaagcaguaagggaaaaaggucaaguaacauauaaaggcagaccuaucagaauuacaccagacuucucaacagagacuaugaaagccagaagauccugggcagaugucauacagacccuaagagaacaaaagugucagcccaggcgacuauacccagcaaaacuuucaauuaacauagauguaggaaccaagauauuccaugaaaaaaacaaauuuacacaacauuuuuccagaaauccaacccuacaaaggauaacagaaaacuccaacacgagagaaacugcccccuagaaaaagcaagaaaauaaucuuucaacaaacccaaaaagagauaggcauacaaacauaauuccaccuucuaacuacaaaaauaacaggaagccaacagucacuuuuuuccuuaauaucucuuaacaucaauggacucaauuccacaauaaaaagacauagacgaacagacuggauguguaaacaggacccagcauuuugcugcauacaggaaacgcaccucaaugacaaagacagacacuaccucagaauaaaaggcuggaaaauuuuuuuccaggcaaaugcuuccaagaaacaagcuggaguagccauucuaauauuaaguaaaauugacuuuuaaccagaaguuaucaaaaaagauaagaacacuucauacucaucaaaggaaaagucuacgaagaagaacucucaauuuugaacaucuaugcuccaaaugcaagggcacucacauucauaaaagaaacauuacuaaagcucaaagcacacauuguaccucacacaauaauaaugggagacuuccacaccccacucucaucaauggacagaucauggaaacagauacuaaacagagacauagugaaacuaauagagguuuugaaccaaauggauuuaacagauaucuauagaacauuucauccuaaaacaaaagaauauaucaucuucucagcaacucacgguaccuucuccaaaauugaccuauaacuguucacaaaacaggccucaacacauagaagaagauugaaauaaucccaugcccccuaucagaucaccacggacuaaggcuggucuuuaauagcaauaaaaacaacagaaagcacacauacacauggaagcugaacaaugcucuacucaaugauaaucugguuaaggaagaaauagacuuuuuagaauuuaauaaaaaugaaggcacaauacccaaacuuaugggacguggugaaagcagugcuaagaggauaacucauaucucugagugccucaaaaaagaaacaggagagagcauacacuagcaucuuagcagcacacccaaaagcucuagaacaaaaagaagcaaauacauccaagaggaguagacagcaggaaauaauuaaacucagcugaaaucaaccagguagaaacaaaaaaaaaaucuauauaaagaaucagcaaagcaggagcugguucuuugagaaaaucaccaagauagauaaacccuuagccagacuaaccggagggcacagagccaggauuuaaauuaacaaaauuagaaaggaaaagggagacauaacaacagaaaccaaggaaauuuuaaaaaucaucagauccugcuauuaaagccuguacucaacaaaacuggaaaaucuggaugaaauggacaauuuucuagauaaauaccagguaccaaaguuaaaucaggaucagauaaaccaucuaaacagucccuuaaccccuaaagaaauagaagcagccauuuaaagucucccaaccaaaaaaagcccaggaccagauagguuuaaugcauaauuauaucagaccuucaaagaagaccuaauaccaauacucuucaaacuauuccacaaaauagaaacagaaaggggagagaggaggauguuuuucagaggggagaccagaaaagggucuuuacauuugaaauguaaauaaagaaaauauucaagaaaaaaaagaaaaugaaauaacaaaaagagcaauuaauuuuauauacauucauaacuugcacacgugcuuuauuaauuuauuaaaagaaauuuucaaucuuuaaaaauagagucaugccugauauauaaaggacacauguaggugaauguuaaaaaaaaauaaaaauaggaacagaaggaccacuacccaauuuguucuaugaagucacaauuacacuuauaccaaacacucaaagacccaacaaagaaagagaacuugggaccaauuucccuuaugaguaucaaugcaaaaguacucaauaaaauucuagcaaacccaauccaagaacacaucaaaacauucauucaccacgaucaaguagacuucaucccaggaugcagagauaguucaauauacagaaauccaucaaaguaauccacuacauaaacaaacucaaaggaaaagaccacaugaacauuucauuagaugcugagaaagcauuugacaaaauucagcaucucuucauguuaaaagucauggaaagaucaggaauucaaaauuccaacucaauucuucauagaguuagaaagagcaauucucaaauucauuuggaauaacaaaaaaaccaggauagugaaaacaaugaaagaacaucugggggauagugauaaaaacugcaugguguuuguacagugacaggcagguagaucaaugaauagaauugaagauccagaaaugagcccacacaucuuagaucacuugaucuuugacaaaggagcuuaaaaaaaaaauguaggugaagguuaaaaaaauuaaaaauaggaacagaaggaacacuacccaauuuuuuucuaguggaaaaaagagaacacuuucaacaaauggugcugguucaacugguggucagcauguagaagaaugcaaacugaccgauuaucuccuuguacaaagcucaaauccaaguggaucaaggaccuuugcauaaaaccagauacacugaaucuaauagaagagaaaguggggaagauccuugaacacauggguacaggggaagauuuccugaacagaacacccauggcuuaugcccuaagauaaagaaucaacgaaaggcaaaggacacugucaauaggacaaaauagcaaccaacagauuaggaaaagaucuuuaccaauccuacauccgauagauggcuaauaaccaauauauacaaaaaacucaagaaguuagacuucagaaaaccaaauacccuauuaaaaaaugggguacagaucuaaacaauucucaacugaggaacaucaaaugguugagaagcaccuaaagaaauguucaacauccuuagucaucagggaaaugcaaaccaaaacaacacugagauuccaccucacaucagucagaaugacuaagaucaaaaacucagaugagagcagaugcuggcguggauguggagaaagaggaacacuccuccauugcuggagggauugcaagcugguacaaccacucuggaaaucaguuuggugguuccucagaaaauuggacauaguacuaccugaggacccagcuauaccacuccuaggcauauauacagaagaagcuccaacauguaauaaggacacaugcucuaauauguucauagcagccuuauuuauaaauauccaggagcuggaaagaacccaaaugucuuucaacagagggauacagaaaauaugauacauuuacacaauggaguacuacucagcuauuaaaaacgauaaauucaggaaauucuuaggcaaaugguuagaccuagaaaauaucauccugagugagguaacccagucacaaaagaacacacaugguaugcgcucacugauaaguggauauuagcccaaaagcucggaauacccaagauacaauuaacaaaccauaugaagcucaagaagaaggaagaccaaaauguggaugcuucaguccuucuuaaaagggggaacaaggagcuagagagauggcuuagcgguuaagagcacugacugcucuuccaaagguauggaauucaaaucccagcaaccacaugauggcucacaaccauccauaacaagaucugacucucucuucucgagugucugaagacagcuacaauguacuuacauauaaugaauaaauaaaucuguuuuuaaaaaagggggggggacaaaauacucaaaggagguagagggugggagggacuucagcggaagaaaggggggcauggucagguaugggaggagacggggaugauauacagaggucaggaauaugaacagaauguguagcagugggggauggggaacugggguagccaccagccagucccagaugccaggaaagcaagaggcucccaggacccaacagggaugagaguagcugaaaugcucaacaaaggggagggagaaccuauacagaccauauccaaaggucagacaaagcccccaguugggguauggggccaccuacucaucuccaaauuuuuaacccagaauggcuccugucuaaaggaaauacggugacaaaguguggaacugagacugaaggaaaggccauccagagacugccccaccugaggauccaucccauauaaagacagcaaaccuagacacuauugcacaugccaagaagugcugacaggaggcuguuauagcugucuccugagagccagagccugacaaauacagaggcagaugcucacauuggacuaagcauaggaaccccaauggaggaguuagagaaaggacugaaggagcugaagggguuugcaaccacauaggcagaacaacaaccaguacucccagaauucccacggacuaaaccaccaaccaaagaauacacauggcuccagcuguguauguagcagaagaugaucuugucuggcaucaaugggaagagaagcucuagguccuguacauggcuccagcuguguauguagcagaagaugaucuugucuggcaucaaugggaagagaagcucuagguccugugaaggcucuaugccucaguguaggagaaugccagggcagggaggugggagugggugggugggaaggggggcacccuuauagaagcagggggaugggauauggggguucuggaggggaaacugggaagggggauaacauuugaaauguaaauacauaaaauaccaauaaaaauaacugaaaucggccuuauuuaugcuucugcccugugucccacuguuuuucuaaugccaugucuuacaaaauauuguacggguuuucggaaauauccacaagaaugucuguugugccaucauuucuaguaaggaaaaguugaaauaauuguucaugaucguaaauggaugacaguuggaaccuucaacauaaagcuucccugauggugugggacuaauuaacguaaacucaucugagagugauaagcgcagaaugauuacagugcugucccagagaggcggguggaccacagugaggucgggguuggguugagagauccagcuguuuucuuugucugaagcaaaagcaaaugaaguauuuaaucugguaauuggaaggagugugcgugcguguggcuucucugcuguugucugugcacuucugugugcucauauggcuuuauuuuuuuagucacuuuaagaaaacaagcuucagucauuuuuuuccuaucaaaaagaugaauguaccauguaucugaaguguuuucaauucagagguaaaggcgccguaucaguaugcaauacugagauuauccacggaaccuuucuuugcugugcaggggagguagggaugaugggacgcuugccucugaacuucuguacuuacaguaacugagcucuucuugucugccaguuugucuacaagacagugugcuagcguucuggaaacacgggaugcaagguagaagcuuuagaucuaaugagguaagucaucuuuugaagcgugcucauuaugcagucauaugaagccaggcguggucucuugugccuguuguccuaauguuagaaagcccaggcaggaagaucauucgaacuuaagaacucagguccagccuaagcaacacggugacaccauagugacaccuauguuaaauagaaggcacaaaaucuguucaaagcaauucuuucaacacuauagcuuucuggugauccuguaaguguguugcgugcagugguaaggucagcccucucuauaggcucgagcagagguucucagcuuucugaugcugcgcccuuuacugcagcuccuccugcuuuggugaccuccagccauaaaauuauuuaacugcuaccucagaacugcagauguacuacuguuaugaaucauaauauaaauaucugugcuuuccaguggucuuaagcgaccccugugaaagcagcccaccaguugagaaccaguguucuugagccuucucaagccaacagacuucaguccauaccucccaugcuucuauauaacugcccuaggacuccaaacaagagccucugacacuacuaaauaagucaguggccuucuccgcuucccggaccugggaagcccugucuugcacuuaacagcagugacauccucacacagcaaguagcaggcuugccuccugguucugcugucuucuuuaaugagccgugauuuuuggucccuuugucugagcccuuccucggguacagaaauuacacguggcauacuuaauucagcucagcauuucugcuggcagugccuuagcguaagcaagaggaaugguugacccgaaaauguuauuggcagggaaaaccaucaaacgcuuccccgggguucccaagccaaucucaguacccugagaagguuagacuagaagagggcucaggagcaagaggaaguuacuuggaggccuuuucuaaacugcacggugagguacucgauguaccuccugaccuccacauccuucuaacuagcaaggcccugccuccccuguagguacagagccgccauugcugaaauaaaggaguuuccuucaccaguucggcaucgcgugagaggugacagaacacuaguguuucuagaacagcucauuauagaguuucgauggaauaaguauuucaacaucaaguugaguguuucaaguuucagccucgcuauugcuagaggcauaauuugggcuauguuggguuuuauaagccaucaacacugaguuccacaaacaaaggagacuuguuuguggucucaaucuuuauugcucagugguuaguaguugguugaguugguuggucacacugaggauacauucugucagaaaguggugcugaggagagcaggaaagaagugggaaggacgcguguucaucgagagcauggcccagacauuagacuugcaggaguacugggaggccaauccugcccaggcuacaggaaccagagcuguucuugccugaacuguucuuccagugcgcaucuugccugaaaucucagcucacaauccaaacgcugugcuggccucuaaguguuuccugccauaccacauagcaaccgcucaaggcacaaaaccagauuugaguggcuggauggugucuguggucuugccacucacauuaauguaaaugacaggacauuuugaaugaaaaaaauaauaauuuugugcuuuucauuaaaauuuucucuggaagucuauacuagcaaauaauuucccuucaccaguauuugaggauuccaaauucgccacauuuucccugaacuaacaaacugaugugauugcaaacuuacaacacagaaugaugaagggcaggccuucauccugcaaauugugggaguucagagugggccugggucuuugcuguaauguugcccaugaacuguccaaacaaaaguuuguaucucuggagucagguguggugccacagacauauaauccacucaagagaccgagucagaaggacccagagcucagggcuagccuaggcuauaaagcaagacucuggcucaaaagaagagaagaauuuuaaauuugagucauuuuuaauuugaguaauuuuuuaaaauugcguuuuaacuaaacagguaacacaagaaauuucagauaacacaagaaucuucagacuccuuggaucugacagguaugaaguugggcuucacaaaaugucugguacugaaugggcuccuaacccaguguaaggcugcuuacuuuuuuggaagaauugaaauuucugcauguucaacacuugcuuguuuuuuaacuauugaaaauuagucuuccauguaauggaacccauaguucugacagugcuguuaguuauacuguugauagcaacguacagcagaagacaggcaugcuggaugucagcaaacacaacucagcagucuaauagucuuuauuauuauuaucauuauuacuauuauuuuauucugaauuaccuuuauguugguaaacagacuguuuuaggauuaauaggaccaagcccacccccuccccacauuacuccuguagaauugguuucuccuuagcccuugcccuucacacccucaaguccuagaagaauacugauguagagguaggcagugggcaccucccagggcuggagucagagugacuggggguagauucugcccauaagagcagugcuuagaguagugucuaaaagaagccaugguuggcugcuugguuuguuugggguuuuuuugcugauguuaguuuucauaaauaaauaacuuuguucuguuauguguuucuuauuaccuuuaggguugugguuuuggaaagucggccaacugauaacccaacagcaaauagcaauuuauacaucuuggcgggucacgaaaacagcuacugagacacgguguucuugacagugaccuguggagacagugaccacagcugcugcaacguuaguggaggagugaagcuaugcagacccugcaggaaccuagauucuguuucuuauaauuuauuguggcaugagacagaugggagaacauuuuguuuuaagugguauggauauauuuagcauauugaaccacacaagugcuuaauucauuguuauguaaucuuuguacauauaagcaguauuuuucugugaaacuucauauugcugaaggcauacacuaagaauuuauguagauaauguacuuuuaugagauguaaaagugucuuaucuguacagauguaaauguugaugaaaaugcaacugggguuaauauuuuaagaauucuuuaguauauucuuggguguggucauauuacaaaaugggaugcuggcaaugaaccaagacauuaacacuauuguauuuuuauuauauauaauuuaguaauauggacauaaauccuguaacuuuuaaaaugguaacgagcuguaaucauuuuauaaucuuguuuuuaauuuuaaugcacgugcacugguguuucuccugcacagaguauugacaugugauguguugucacagagagccugugacacccaccgugaauacaacaucuuuuuuacauguauuuggauuguuuucuaugugaaacaaaccaguuaaccaccuguuguaguaacugaucuuuuuauauuuaaggagaauuguguaagauaagcuugucugugcuuaggauacaccuucgcaaaaacuuaaaucauggaauggcgguaccacgguagaacacugcagcugucgccaggguuacagugcgcauaagagcaacucgcauugcugaggaguccgcacuagacauuucacagucacacugaagagcugucacauuccagagugagcugaucagguuucucgugggcuuuuacuucuguuggcauuaguuuaucacuuccauauuucuuuagauuuugaguauuaauacauggccaaaauaauuuaguuacuaccucauacaaacauuauaaugguuacuacagaucacaagaaguuaguuugguuaaaaucauuguugauugguuuuuuccaauggaguguaucugucuuaucaagauagauaccaaguuguagcaaagugcacaccucugacucucuuugguauauguucauauguucuuuauauuuugaugugaguauauauacacuaagaacaagcuaaauugugauuuaugcuucauuuauuuuaacugauaaugguuuuaaauacguuccugauuguacauacuguaaaauaaacauguuuuuuaacaugcugu

SEQ ID NO: 8759 - RNA, 576 nt, Mus musculus
agcagcggccgcagccaucuuccaguaacucgccaaaaugacgaacacaaagggaaagaggagaggcacccaguacauguucucuaggccuuuuaggaaacauggcguuguuccuuuggccacauacaugcgaaucuacaagaagggugauauuguagacaucaagggaaugggcacuguucaaaaaggaaugccccauaagugcuaccacagcaaaaccggaagagucuacaaugucacccagcaugccgugggcaucauugucaacaagcagguuaagggaaaaauucuggccaagaggaucaauguguggauugagcacaucaagcacucaaaaagcagagacagcuuccugaagcgggugaaggagaacaaccagaagagaaaggaagccaaagagaagggcaccuggguacagcugaagcgccagccugcgccacccagagaagcacacuuugugaggacuaacagaaaagagccugagcuguuggagcccauuccauacgaauucauggccuaauguacacaaagaaauaaaauaccagcaccaggggaaaaaaaaaaaaaaagcugacc

SEQ ID NO: 8760 - RNA, 1618 nt, Mus musculus
agggaaggaggggugcugaggugaggaccaaggugcgagguuugaaguagggagcagacggcgucuggaugagccuuugccagagacuguuggaaacccuggucggcuucuaaggccgccccaaaggauuucucaaagcaggcaacccagucgcggcuuugccugcagacuuugcgcuuccucuccgcgcguggggcaccccacgugccgugcgcuccgaaggcggccgcgcaccaagcucuccccacccccugcucccugagggaugccaugggccaacggacucgcccuagucccccaucuuucccagccuugggguccuaagaaggcgccuacaccgcucucacgaugccuccgguggagucggguagcagucuggagagaauuuucuuucacuggcaagaccagaaugucuuauugccucgaucuugcauucuccuuuucaugcuaucucgauguccacuccuucccuccccguagcacccccgugcgacugcggcaccggccuucaaaugcagaggcaggguuaaggcuugguggagugggguucgacuuggcaggcauuauuuuaaacagcaguuuacacauccgacaccggcaacccagcccgucaaaggcaagaaacaggugaguuauauauaagggagacggcguuagaugcaaaacaaacccuggaaauaaaaaugaauagggaggguggaggggugagaugggcuccugugaccauggaguaccuggggaaggguuuugcuuucccccuccacuuuccuaauuuuguaggacugccccgugcccgcuagaggucaccauaaggagucauuugcucugcuucucggauagauguuagugaaaacagccgccugcaaauuugaguucucuuucugacaaagucacccugggugguucuuagagaaugaaaaucuccauaagcuguuuaucccuagacuuggaucauuuuuuuuuaagcacuuaaugugauuaaaagcucaaaaacaagaguuauuuaucugcuaaguagcuacuaagcaaggaaaacauccugaaggaagugaauucaauacggaauggaaggaggugcuggcagaaggagccagggacuccgggggagcaaaugccagaugugaaagauuagcgacuguaaagaaagcuaaugcauuugucuggcuggaacaacgggaguucuaagaccuguguccaugccgggcuaucugcaaugggaucccugaagcuuuaauaacagaaguggcuagaugaaagccuuaguuuaggaagacgcucugccccguggguuauucuaaggaaaaggcucuuucagcaagccaggaauagaagcccuaaccucgugucaguaaaaaugaaagccaguuaugagaaacccagcccaguaucuagcaggucuuaguaauggauaggacacagugaccagaggaauaaauaaauaaauaaauaaauaaauaaauaaaagcaggugagaaccagcuaccagccuggcuucacaccagcaagagccaauucaccagcaaguuguuaaaaauauucuaaaagcaacaagcaacagaacagccauuguguuggugauuugaacauuacuauauuuauuuccuguguucucuaugca

SEQ ID NO: 8761 - RNA, 1278 nt, Mus musculus
cagagccucagagccucacagcaggguauuucugcuuguguucaagucccaggcaggcucaacugucugggaaggaacacagagccuuuguggggaaagaguagucagccuucagcacuccagguagucuugaggcaccuuccuggugagacagucuaguagucugaggaacagcuuguccaaauuacagagguggagcccugaggugccuccaagaggcacaggguugcccaccuuucaucagagcuuccagggcaagcuaugggguucccacagugggccuggcgucuagccugucucuacacuacuggucacccguucucccuccaccucagguacuugaugccuuugcuguaacauugaacagucaguacugggcucugaaggcgccagaagcuagaaagagcagacaccuagacaagaguaacuuuucgucuccucucuguccuuguucuucauguuccauaccaguccaacccagguagacaccagaaccccuccucuuguccaccgaugaguccaggaauggucacacguagggacucugagagggagggaggccagagacaaccuugccugcucuaacagacaucgugccaagaguacucugcugucagaacagggugagacacagggagcccagaaagcagacccaagaucuuccagccaggauuugagcagaaggaacuuugguggcugucgcaggccagaccguugcuauuguccuuaucuggggcuccugauucuuacaacacgucaucaacggccucuggagucaaggggccccguuguuccuccccaaguagaccguuaugguucugcuguuaggggaggcggggaggggguugucugcuuaauuaaucauuuugggccacccugggaaacucauuaaacuaccucaggcugggagccggaacacugcccucaaagucagauagaaguuucuaguuuguuauauugggauuuugggguuucuuuauucuuuccauucauauguacauguggguaggaaagggugugugugugucaauugugcccuuguaucuaccauucucauaugugugugugugugugugugugugucuuuguuuccuagauucagcaaggaacuuccccugauucuucuuaauuaccagcagugaagacauucaagacgccggagagcagaggucaaaccccaccuguuuuccuugcacuucauuuucuggcaguucccacaauaguguagauaaguuaaagauuaaggcaaucuuuucuaauuaaaguaauuaaaaagcg

SEQ ID NO: 8762 - RNA, 1065 nt, Mus musculus
cugaggguucagguguucucuuuuguuuggagaucaggaaaggcauucuucuuucuguaguaugacuuguaaaaucauauuugcauguguagcuccucccuacugccccuagaucaaguaagcacaucuaugaaaugacagaagauaaaagauagugacauuggggauuuggguccugguagucacgggcuguuuucuucuggacuucaucuacuuguauguugcuguuguagugacugaagucgccauggggucagugugugugugugugugugugccugugcaugucuguguauacauguguguguuuauuuccuuugugcuaggccacugcauugagaaaccucugcuccaaauaaaaccccucucuaacccaagugaguguacaccucauugccaacagagucaucugagugggaaaucagucgcaggcuggacucauucuauucccaaagaaugggagagcugacaggccaggcccugaagucacccgggaauccugugcaggguguuugcugagauucuccaggccucguggcugcuccaagaccagaccuagauccaaguagugaagucugagagagcaccuccugacagugcucccuuuagagugugacacugccucugcccauuucuugcccccagcauaaagugcccauagcuuuuaaccuuaaucccccuccaccccccaaugagccaaaugacauugaaccaagguggcuuuuccccuuuaagggaacacagagccuuucucacucccucuuggaaccaggcagaaaaaucuccuggugggcaggauuacccgagguuacucaguuuucccaaaaacaggccugaaggcuugugucuaaagcgaguuuuugugugagccuuucccagugauuuaugacagaugugguagccuagcucgcccucuuccuucccuuccuggaccaguagcuuccuguuaccuucauuucggccccuaagauuuccagggacacaguuuccaaagacgaggagccucgguucagauggcucuggcuuggugagagccuagcacauccuuugggcuggaucuguucu

SEQ ID NO: 8763 - RNA, 11218 nt, Mus musculus
cguugagcaaucacugaugucucuggaaacacauggcugacaaccaauggagucaggauuugaacccagcagucagcagcuuuccccaacuccugacaggcccugcucuacaaccugacaaagcagcucccacaaccugccguagagugugcugaccgagauacaagcggagauccaggacacuggggcucaugauccuagccccuucccuucccgaggagacugcuaagcccaucaacagucucucgguccccucaucuacaacauccaaaugggcuggcauuagaugaggcccugauuguugcuuacacaaguucugcugggccgugaggccaccacagaccccacaugugacccaaucuguacaagaaaagcuggacaaguguacgagggaagguaagcauucauagagucugcuccaaagggagccaugggaccaagagaacuagggucacaccucucucuaccucuuuacaacaacacacauacacacauauacacauucucucucucucucucucucucucucucucucucucucucucucucucuuucucucucucucucugaaggccacagcuccugcuccucuggcccacucugaacucccagccuaaacccugcccuucccaccauacacuuccuugagugaacacuaucagagucucuuuccuggaucucagauaugaauucccauucagaaugcgaguaccccaggaacaggggaucuauugucuacguccaucuuucuggaagccccaacacaggcugcuccccauagcaggccuuuaaaccacccugaaaugaaugggguuagauuuaggggcuuuaucaauacaacuucaauauuugguuuuuauggaggaagaaaaggagccggcguuaugagggcguggcugcagauuuggaggcaaauguacgcaaaaccacugugcaaugauaugcagaugugcgugcuggauuugugcaaagggguccugugacuucacaacucugguucuggcagacuuugcccucugaagggcucugugcccgcuagagacuuuauaaucucauguggcaaugacagagauggcugccacacagcauccuggugccaguagaaaccauuccucugugaagccucucccacccgcccagggccaaggagcugagacagaggccugcccugauugaggguuugggccuagucggagccggggacuuccuggguucuggagaaaacucuuggacaaagcaaagacguaggcuguuuuuagguuuucugagugccccguaaccuucugcuguaacuccagcugccagcccuacucuagcugcccaucaguccugugccccaagcagguagcggacccuaguucccaggagacacaggaacuuccccacauugauagcugccaugugugggcacccugucuggccagguacuucaacagguuacauuauuuaacccucagcacaucuaggcaguacugauaagauucccauuuaauuacgauuaauuaacuuaauuaguuaauuaaugaagguauagaggccaaggccacucaacacggugggacugggauccaaguuuaagucuggcggguccagugacucacauccuuauaauuccaaggacucaaaaggcugaggcagagaacugucauguuggacuacauagcaauauccaggccaaccagagcuguagagugagauccugucucaaaaaacaaagcagggggcuggugcuauggcucugcagguaaaagcacuugccaccaaaccugacagccugaguuuaauucccaagacccaggagagaaugagucuucucagauucuccucugggcucuacauguauuuuauaccuaauaguacuugcacacacaccacacacacaccacacacacacacacacacacacacacacacacacauguuauuuuaaaccauaccaaaucugucauacuucaaaaauggccgucuuaacuucuauuaccuguccucacacaguccuucaaaagcugcugaauacccagcuccaauggcggucaccggggagagauccaaguucaaguccagugcagugacugaaguccccuccauguaaggucaguugacagccauugaaacggacccauccucuucacuaaaugcuaucugccacucaagccauggggucucaugccuuugggacaagcuguugcuuucugugcccuccuauacuaaaauacaaguccuacuggcaaaagaaggagacccaagucagcagaggguuccuggugccuacagacagcaagguaugaaaaaaggaggugagcuuagccagcaaauggagccaucaaauucagcaguguugugaccugaaaugaugacacuagggacaaugaccuuccccggggcacuucaugcacuuuccaaucagucacagcaagagaccacauggauauuaguuauucuauagcagcaguggguggguaguccuaagguauggacaaaaaccaggauuauuguuccacuuugcugccaaggaaacuaagguccaaagagaucauaaguaguccagaccuaagggugggucaggaugaaaacagcugaguuauagaugaugauuaugucuucaaagucaugcuagguaggagaaggggaaagcaagaccaggagccaagaggaaagccugggggaaggggcggggggagcuggagagauggcucagcggguaagagcauugacuguucuuccgaagguccugaguucaaaucccagcagccacuugguagcucauaaccaccauaaugagaucuacccucuucuggagugucugaagacagcuacaguguacuuauuuauaauaauaaauauuuuuuuuuuuuuuuuugguuuuucaagacaaggcuucucuguguagcccuggcuguccuggaacucacuuuguagaccaggcuggccucgaacucagaaaucugccugccucugccucccaagugcugggauuaaaggcgugcgccccccaccauccagcuaauaaauaaaucuaaaaaaaaaaaaaauggaaagcccaggcuccugggaaucuucaaggggcuuugcagagcagcccauaaaugggguucccauagcagcaggugggcaccaagaggccaggcuggacagggcuggcaccaacccuaguaggggaggaggugccagcucucagccgccagccggccugccagcuggggaaccuuaauuagaauuccucagcccuccaacccauuuccuuccuggcauacaggacagcuaauggcuucuaccgccugcugccaggaugagcuaggccggggcuggcugcuccagguugaacuggggggugggggugaccucaaacaagcccagaaucauuccucuccacugccuuggauuagggagcaaccccuaaugugaccuaauguguccucaagucaauagcccaccugccugccucucugcccauccccacagggcccgguaguuguugggugcggauagacagacacaggcugcgggaagcauuagugauuaaugggugaugaaaaccagacuccagcaggaugggggugggaacagagaagcagagagaggcugucuguuucacacuuggcucagcuuugagcccguaacuggggguggggccacagcugagggcaaggccuggcccuggccuccaaguuccagccugaauagaagacuguggcuaucaaacagcaucagcucagacucggccuugggggacucugggaguuugcucuuaacacccucggaccugcagcuaccuuuaaaccucccccuccuuacccuuaagucccucagguaaaagaagagcagucaccccacaccccaucccuucaucuuccucacaagggacaagaagcuccccucaaccucccucaacaugacaaccaccauggcuuacacacaacccuaaacacugucccugggaccuacugagcccagccuucaccuuguaaacucuggaaaguuuaaaguggauuccccgccgaagagagacuguggcagcaaaaaacuacaucuaagacccccccagggaugaauauagacaguugaaacuacagaaacccaggcaagagcagggccguuacauggguguucguaggcccagcagauaggccuuuggggaucccuaaagccuuaccuuucucuccuauaccuaggaaugucacauugggcaccuguccccgugccuaggggaacacugccagcccuguguaacccucuauacucuuaagugucuuccagggcucucccaccaacccccucccaagggccuugggaucucauaggaaaaccuaaaagaaggaaccagcuagauagaagaaguggauuuagaaaggacgagaacgaaggcacguccugauugaagacuuuugcuucugacugaaggccugccucucaggagauagagauuuauuuucuucucguuaaaaaaaaaaaucgccgggcagugguggugcacaccuuuaaucccagcacuugggaggcagaggcaggaggauuucugaguucgaggccagccuggucuacaaagugaguuccaggacagccagggcuacacagagaaacccugucucgaaaaaacaaacaaacaaacaaauccccuggauggugguacagaccccauaaaucccaacccuggggagccugagggaggaagcauaccaacgggcuagccugggcuacuuagcaaaagaaaggcccgugugaugaggucagagggugaggaaagccuuccucucacauguuuguugacucgagugucucucuggagauaccgaggccauccacccuccucccccagaggaaaccagcagagggagaugccaagccaaaccucgucuuucugagucuccacgcugcuaggggcugggagagaaaaacuacucaccaucugggaaguguuagagaguucuagagagggucugaagugggaaugagaaaaccuuuguucgggucuuuuaaucaguaaagcagaaacagaaacaaaaacagaaacagaaacagaaacagaaauucaugacaaauaauucuggauccccaggagacaccugaucaugugcccagcaguuuguuaaggaggcaagcgcaugauuuauuauuauuguuguugcuguuauuauucuuauuucuucaucguguguguguguguguguguguguguguguguguguggcgaagggcggggcgagauccacagauuuguguggaggucagaggaugacuugagugagccaguucuccucccaccauguacauuccagggauugaacuccgaguuguuggguuuggcagaaggugagcgccuuuucccucugaguaucucccuggcccaagcucaggguuuuaaacaucacccauuccugcccaaucagagaacucuuugagccagggugggggaggggugaacuuuacugagcuuuggaucacaguuccugucucuugccuucacagagcccagacuugucaucugagggaaagagggaggcugagggaggucacuccccuucugguuucugcucacagcccagcucuuccccagggagguaacugggcuggaguaccgugcacccuguacgcuguggucugggaguagcugaggguggugguaguggugaguucuuaaaaaagagaaugugagaugcugaagucccccaccuuggggcaggggacaagacacucuugacuagagccagugugugauacaaaaaaugcuagagcuagcugggcugaggccagagccccagccagauaccugcaaguugucacugucccaccugcccccugggagucccugagccuccaggacccuucuaggagagugcaaaugugggagaaugagcucuuccugucgauauagacuaaauuaccuacaagugagccacuucaaaccccuguguuauucacagcccugcagauccucaguccagguggggcugguggcucagauggcagaacaaucaaagauucagcugccuggcgugguuuaaagaaacugaaccaaucugcacuuggcuguggcagaaaucagcuccuucagugagaggacagaaggucacagcuuccugcugguugccaccucucugagggucauuccuccauguggaccccucugucuucauaucacuaucagauucuguguuggcagccagugacaaccuguccugcugucagauggagaucucugcuuccaacggggugguaggguaagacuugccauccuuccagaggcucacagcuguaaccuuaacuacgucuucagaaucccuuuugcccuccagugucccuaugugagcuauaggucugacaucucaucuuguucugggaacagggauauuucaggaauccuaguuagaauucugccuccuaacagggaaccagagugcugucauggccgcagugcuagaccaagacugugagcagacuggcuucccuucaccggcccaugaacucagagaacaggguaggccuuugagcucuucucugaccagccucugggcuuucuaugacccgagaagaaaccccgcuucugcacucgagaacuuugacuccugcgcaucacaucuuccuuucagaguuguagcccugccaucccccaagcuccugacugggcucugccuguccuuugcacuccccagacaccuugcagcuacgugccuucucagccauccacuugccuacucccuucccacugcuagugucuggcguguaccagccuucggccuuaaccugcucucucccuuauccuagugggcaccagccaggccacgugucccaggcacugcgggugacgucugggauggagucuguuuuggacccugcucuauucccaacaguuggcucagcgccacgaguguagcgggcauucuaagaaacuuauuguguggugucucuggguuuuaucuguggggugguccccuguccugaacuugacagucucaccacuguccuuucagcguggaaagucuguguccuucucucagacugagaacaaaguaagacugaaugugcgguccgaugggaugaacaguccccacugugcaucucaugaacacggacaccacccaugccacacccuguguucuucuuggcuugugccuaggagggcuagagccacagccugcaucaucccccugacauaccugggacaccuacagcugaccucuaugacucuacucugcuggccuuucucuugccaacccugaauucucugaggccugcguucucuccccagugacccacccacuuccucuugggagaccagccgagaacagugaggcuugaagaacauuuuaaucccagccccaaagagaaaaugacuacaagcucuggaaugcagagccugcugcuuccugcagggccuucugaaugaaacacacguaacccacagaggcagugagacaagaggcuacggagagaugccacccggacuccaagcaggccgaugagcacagcaagcaagcucuugacuugggccuaagccccagugcucuguuagccacccuucucgcucagcuucgaggaaccaaacccagacaccaagcacauacagauuacuguugcucccuguucccagcaccugaguggguggggaagaggagaagacaucccccacauaccauccucaaagagcacugcagaucccccucucuguuacccccagagcaggucaccaugcugcaacucagcuagcucacaccauuucaagcaaaacaccaacgugcuucgacugucuccgggaaaaguggagauacacacuggucuugaugguucagcuccgugaccuuguuaggugcgugccccaucugcauaagcacagaaaguccccuggggccuccucuuacgggcaucuccaucccuuugaguaaccacacguacagaucucucuuguggucagucaguuagcuuugccuggcuuugaacgcuacucucacgggauugugaguaguacguguauguguucccgugccugacuccugcugcugccuaccucagaccugccucugggcuuuccaugaccugagugaggauccugccuccgcaugggacuuugccucccguucaccuugacuuccuucuaggacugcagccacaacauccccaggucccugccugugccugaguuccugucgcauauccuuggcacgguaagucuaugugaccuuguggcccuggacacuuuccuacugcuuuccaauugcagacuuacuaacaguccucuggcaucuacuguugccacagauguagaugagguccacgucuuguccauuugauagcaaacucauuugauugaugagggaguuaguuaaaccagcaguucauuaucauauaaugaggguaugggcugaucaucucaggagcacuaggucuuggaggagaaggucugggaagaagagacuuguucaucuaguuagaauacucacuaaauggauccuauaaaccaagcucugccuucggcgguuauggggaggggguauugugggagcuuuggaaguugguucuuaacguucaccuuguuuaaggugggucucucuuuuguuucuccugugccgcauacucuagaguagcugccauuggauaguucuccagucucugucucccaucuggcuguagaagagcugagauuacagaugugugcagcaagcacuuuuacccacugagccaugacccaagcccaacacuuguuucuuaauaaucuacaauuuuauggcaaagcauacuuaggccagcaagaugguucaguggguaggagcauaaacagacaaaccugacaaccuuaguuuaauccccuaaccccaaaggugacaagagagaaugaauucccaagaguuguauauauauuuauuauauaaacacacauacacacacacaaguauauacacacacauauaugcacacagauauacacacacacauacauguauauagacauacauauacacauacauacaugcauacacauucauacauacauauacauauaaacauacacauauauauacauauacacacagugacacauauauguacacauauacauaugcagauauacauacaagcacguacauacacauacauacacacauauacacacauacauacauauauacacacagacacauacuuacacacauagauauaaacacaugcauauacacauacauguacauauauacauacacacauauaugcacauacauacaaacauacauacucauacacauacagaugaacacacauacacaugcuaacuaaguuuuuaaaaagcacacuaaguucaaugucuuaaaauuagccacaaacaggcauuaccucucguggcuuccuacauggccgaggacuucuauaaaucucacugugggcagggcaugucucucauggcauuguaggcagacagcagucgcagauaucuagaagcuuggcccagccuaaguuuggccugcuccugggugaaagguuucugggacucccucucuccacagaaucuuaaggccccuguccucacucaggaggccuucccagucuccucucucuguggauuccuccaggagaagaauuagacuccccaugcuucaaaggugucacugggacagcccuccugcgcacuuucugcuggguaaugugagucccaagcccaaaccgauggagagcuggggaaaaaguguggguguggacuaguuagugucuuuuuuuuacucucccaccuuuuuucuccuuuugguuuucugaaacagggucuuguguagcccaggcuauacagucaaggcuggccuagaacuccugaccuuccugccucuaucucccagguacugggauuauagauguguacagcauccucaaucucuacuuucuugaagcugcugcuugcuauguagcccaggcuagcuccaagauucccaaggacuccaaggacuuggguaauggguguguggcacuacucacauccuccaagugccuucuuagagugcacguauacuagacacuguuucccacggucucuccaacagagcagccacaguauuuuguggcaggguuucauguagccagacuugcuucaaacucagaggcauccuccugccuucguguuaugugaugauaauaucuggcauuuacagguauuaguccuaacaucuagaucugagguuuacacaaaucguaucauuuagcucuggguuuuauuuuugacccagagccuuuucuuauuuugagcauauuuuuccauuuguggaggcugaaaaugagaaacagauucauuuccaagccccacaaguccuuggcucugcuauaauuucuauaaauuuuauuugaaaguuagcuucauuuucaaugaauuauuccccauccugucacgugcaacuugauaguccaacggacacuuccaaagugcaucuuaaagucucuuuagccuaguugggcaugguacacacucauaaugccaaguacucaggaggcugaguuagccaggucaagaguucaaggccaacaaaacccggucaaaacaaaaucuccuuagcccaaaccauuaacuccucaguuuuuuuuaugacccaagucacuucacacaacaauucuguuaaacuuucuucuauuaucuaaaaauugucccccauuuucccucccccacaacuuccaauggcauuucccucacuucccuuuaaccccuugccaguaggcuccuagaagaccaucagguuuccaaugguaacaauaggccuucaaagcccugagaaccacugccuacaucccaccccuaaagucauaauuagauuuuauuauggcagcaggucugccuccagguaucagaguaucugggccagcuugucuauugugcccuccccaccauccccaaacagggguguaggacaaugacaaucauuucuuuuguguacggauuugggugacugggguggccuggugguucucccucaggggcaagagaggcugcaggguuuucuuuguucacauaucgggggcuccaccaaggauggguggcucaggcuggguggccguggcuaucaggugucuaagauucuggcuuucuccuguggcaguugaagacucccagcgugauuauccuaacagaagccaccggaagauauacgagcuuuuccaugaagucacugugucagaagucacuaugucacuugcuacauuuagagaacuucugguguacccacauccccauccaaguagaaaaaagagaaca

SEQ ID NO: 8764 - RNA, 841 nt, Mus musculus
caugggagaacggaccgaccgcaccuaggagacccaguucucucuccuccagagccccccagagggaucggggcagccaggagccagggugggcaggacgcagggucucuuuugcgggcuacagggugcugaaagcgucgagguuucugucgggccccgauacguucgagcuguggaaaugggaacggcacgugccuacacuggcuccuaggagaacuuaaauggacuugcuugcccaggcuagagcccuacccggcaggcccuccacaacaccaagaagaacgggucuguaguuaaagucaaggaccccgaggaguguuggggaaacuugccuaggcccacugugaccuuaccaaaucuauaagauggcuccguggauaaaggugcuugcuuuuaaaccuggagaccuccacucgaucccugugacccuuauuaaccauggaagcagagaccuccacguaugugcaccaccccucaagcauguucccuaccccacgguaacgauaaacaacguuauuuuuaaagugaagcgguaggcuggacaucuaucugcauuuuccuguucuucaagcccucuggaagcucucugaaagccgccgcaaaaguggcucagcgcuccgccccaguucaugggugagaagacaaucuucagaagugacaggccacggucacagagcagggcugcuuggacccugggcaugcugguugugcgcaaagcggagcagaagaaagaaaaagcugcuagagauugagacacuggccuuccucaagccuaaacccucccugacuucaaagcccuggaccaaggcucguauuaaaacccugaccucuccuuguacug

SEQ ID NO: 8765 - RNA, 477 nt, Mus musculus
acagccuuucauacuugggccuggcagaauggcucccgcaaagaaggguggcgagaagaagaagggcuguucugccaucaacgagguggugacccgagaauacaccaucaacauucacaagcgcauccauggagugggcuucaagaagcaugcuccucgggcacucaaagaaauucggaaguuugccaugaaggaaauggggacaccagaugugcgcauugacaccaggcucaauaaagccgucugggccaagggaauaaggaacguuccauaucgcauccaaguacgcuugcagaaaacguaaugaggaugaggauuccccaaacaagcucuacacgcugguaacuuacgugccuguuaccacauucaaaaaucuacagacggucaauguggaugagaacuaaccugcucaugucaaauaacguugcagaacugcaaaaaaaaaaaaaaaaaaaaaaaaaagaaaaaaagaauggc

SEQ ID NO: 8766 - RNA, 17314 nt, Mus musculus
gucugucaugccggguuuuugacacuuuugguaaaaucccgagggucugaauuagcuuccuuuggguuuaagcuccacccccuuuuccuuacagaccaugcuuauauaaugcaacgcgaaggcgguacaggcauauuugcgaaaugugguuaggucaaaugcgcuucugugugaagagcgaggccugcaaccacuguaaggaagcgucugucugcuugucugucugcucaccgcuugcaggagagaggggauauggggcgcuccguggugaggcugucgccaagggcaggaaauacuccauucaguucccaagucaagcuggcccugcggcgggugcucccucagacacucugagggucugcuaagcugugcagugccacagcggcacauuuccuccacccagccagcuugguccagcugguuucucuagaguuuaaguauucugguccuuuucugccuuuccuaacucuucuuacuuucuuucucuuuacuuuguuguuguuguugguggugguggugguggugguguguguaugugugagagugaguguguguguguguguguguguguguguguguguguguguuuugacagugucacuauaaccaggcuacccuugaacuugugguaaccccccugccucugccuggguuacagccauaugccuggcuccucuuuuuguuuguuuguuuguuuguuuguuuguuuguuugaguucaccucucuucucucuucagucaauauucucacugucaccucucucugcgaugucccuccaugcugcugugcuuucuuccuuugcagaacagcaugccuaggcaccuaggugaggggaguuucagaacagguaauucugcucuacucccaauaggagucccguucagcugaggguguuuauaguguguccugucuucucuaaaucucuagcugucugcugugauuuguagggaggcccucuggaaguggauacaucuaagagaaguggucucugggggcccagacagaagggcaagugacuacaggguggaguuaccauuuuuggguuggcuccuaugucacugggugucugaaguuuccuucaauaaccucugucuucaugacuaugccacaguuguguucuuuaaaugaaugggccauacuucugcagccucucucauguauaaacuuuuggugagucacugcccuucacauagagcagacugugagcuagcagugugugggugcuaaugguguuuaacacaagugcaauucuaucauggucugagucuggauagcucugugggaggaagauuuuaagauuggguagguuugugugugcauccaugcagguuuggaguacaagcauccuggagagagugcccgcagggaggaaagaugcuugcauuuguguuugagaacugguauaaacucuauaagggguagaggagaaagaccggccguguguuggguaggaaagaucuguggguguugggaaauuguucugguagcaggugugugugugugugugugugugugugugugugugugugugcaugugugugcuauauuuauacagaaauggcuaguagcaagguaugcauacaacauguggcuagguauauuuguauaaguguguaugugucugugugugucugugugugugguauguggucuagcuucugucagccuggcucugccuccccccuccugccgaguccugccugacacugcagagcucaaucagccacugcaugaauacacucgaauggaaaguugugcucagcugaccggagaaauuggagcggggcuaguacugcuaccuccucccagacucucucacacccccccaccccucaggccagacagccaucccagccggcuggcugggaccaggaaggcucaguucagcucagcuggggcccggaaagagacccgccagugggaggcggcagugggaggcaaggggcacaugccugaggcccugcccuguagcucaauggcucugguagguagggagacucagccccaguguccagggaggauuuugaaaagccucagagguggcagccaguacuccaggugacagccacacaauggucugggcaguacagaaaggucaggguagugcgcaaaggaagacaaggaguacaagagucugagacaccccuugcccugggggaacuagagcauggccacugccccacaggccugauacuaggcuacaggguuagugaccccugcaaggcacuggguucaaaaugugccaggcaguuccauuccacuuuugaagaaguacauaggugucugugacaaacuagcagugggcuggcagaggcuggagucacuccccugccuccacagucucucccacuugaccugucuaggucuaugcuggucuucccaguccugcguuggaaccagcucuggagucaacauugggguuacuggucccacuaagcucaguuccagccuucccuaaccaggcucacaugcgugccuccagucccacuguagaucagcaucccugccuggcaccguggcggcuucugugccauuucucugaagucaguuguguaucucaccagggauaaucaacuucugggcagccaauuuuggcaggauucagagggcaggaagaagggcugaccgggagcucugggguggggcuaggaagggagguggguuaggaggugaagaagucagaggagcagguuggucugucuuuccucccgguggggagggguuaggagcagggucuuggacacagauuuucacagcuucacaauccacucuucuccuuggguuuccgaugcaaauucuagacaaccauuguuugccucugagggaugcagagaagagaauuggauguuacuccucaaacgguguguacccuuagguauauaaaguccuggcacugggaaagcucccaaccuaaugcauuagaaggggaggcaagaagcccccaguccacagagaaguggucucaacccucugaugaggaguugcgguguggcccugugacucagaggcccucggaggcccacacucucagcuccaggggcaauuggguuuguuuccaggaggcuggacagaguuucagcauagcuccuucuccgggcagcuaugcccagccaucccaugcgacuugacugcuuuggccauagaugggggcuagaaagaaaauggacaggcacuagguaaaagagagaucuggccagaaaaggguucccuuuccuucuggucucugaaaauauccccugugacaacaccaauaucaagggaccggaugaggggagaaagucaaaagguccagccaacccauuuuagccaaugagcaucuguugugaguguguacacacacacacacacacacacacacacacacacaccauuucuuagaggggcaggaagauuccuagggauagggacuuggcagucacauuuguggacagacuagggugacuuagauguccccaagcagacugaaccucccagggcacauuuuuccugcacacaacagccugcagguguauuggagucgcugaaauuucuguagauucucaggccaagcauacagacuguaucuaagcuaggcaacaugaauaaaaacccacacugggcacauaccaaugacauaugugugcauuuauaucaaacacacacauaauacauccuuuuguaugcagaacuugaugaaauggugaccacccaacuuucagaacugcacacaaacacacacacacacucgcgcgcgcgcacacacacacacacacacacacacacacacgugugccacucaaacacacaggagaucuguagauaaaguuagaaaaugccguacugguauuguuggcagaccuauguagagauauaggagugguugacagggaccacagacugucaauaaccccaauaagaaucccacccgcucaggcaaaggcuguuggaggaguccaguagcuguuuucuucaguggaggaagaggcaauggguggacccaaacuugcuuuuucugcaguccaugaugauagaaagaagugugacucaaguuuuccccuuuguucucacacaaaaaggucccuguuccugaugucacuggucuaguaugcuccagaaaucacuguagcaacgauagccccuuccuuccaccccccucaccccccuccguuuugguuuauucccugcucugggaccauccacauuguuuauaccaaggcagccauuucuuuggguugaaaggcccaaguucugggucaaguaugugaagagcaggugacagaauggagguccaagccugguggcuuuagauggccuuuuuccauauuccuggcguugucagaaaugugggcugcacagagcugcuucuacgggcagugggcacacacagagauucugacacugugugccaggccagcuggggaggucggcuggaugcccuacuucuaagaagagacccccuauggaacccuccaccuccuguaagcgcaugcgcucuugugcaccuaagacaccuccaggccagucagacccucuacccagggcggcucgcguaaaaccccugguguuguugggaauaaagacaaaagggaaacggaagucgaaauuaguuuggaagcggucgcuaaauuucagacugguuucuuuuuaauccccccuagcuuugaaauuggacuuuucaagugaaggcaaguuuucugaaaucaccucuuuggccccuucucaagcgcgcaggccgccuuggcccagagcagcagaaccacuuccucccagccagcucuccucgggaguugugcggccacagccggccaggaaagcuuggggccagcagaggaacguggucagcaagggguaguuuuuuguuuuguuacugguuuuccuuuaccaugcaaacgaaccaaaaauccuucagaaacuaagggacuccaggugaucccaaaagacaaggacauuuuuuuuucagacacauagauccagaaucuuaagacaggugacucggucggacaaggaugccaaugaaggugggagggagagcaaccgcauuucaggcccugaagucagaaaacugccuccuucucccacccacucccgacccuuguucaucugggcccuaguuaaccacuuuacaucuccuccaaaaaagagagagagauuaaaaaaaauacaaggaaaauagaauugcagcugugcuuaggacggucgcuuggguuagggagccuuaggguuucuccuuuuuaaaaagcaggcaacuagaaggcuaccaaacauuccaagggcucacaagcgccgcgagaugcagcaaauccaggguacagcacuccggggaggauucaggccugacaucuugucauggaagaaacuaguuguaacccccuacccucaugcccccuuugccuuucccucgggauccuguuugggcucccuuuccccaagcaaguguuuguuuccaguuuuccacucacauuuggcauccuucccccuccccggcucuggcucuggcggccagcgaguuagagagagcaagcgggaagcugggcuguuacagcacccgggagcuguuugccagggcggacacaaacaccagucucugggagugauaagaaaauggagaauacuguauuugcuuuagaaaguuuuuacauauagauaaacacgcaguuaagauaacaguaaaagcgcucuacaggagugaauggggccuccaaagcggcuaggaaaaacuugaauagcuuuugcauaagaauacuacggucucacucucugcuuucacuagcgacagggucccucucucucuuucucucucucuaacccuggccaccucgccaaaccucgaucgccaagucgacgccgagaauccccaaaaggaaagaggugagugggagggaaggagggaggagagagagaagggagaggagaaaaaagcagggaucauauacaagcaauuucuacacauauauuacaaacugggaaaaugaccgaucauuaagauauacauaauucauauaaaauuuugaaauaaaaauaaaaaucuguuacagucauaacuauucuuuuuccacauuuauaaccaguacccacacaggcagugacagaguggagagaaaaaggugcuuacgaagaaaaugauugucggcugaacaaaaacagaggauugcauuuuguuugaccaauacuuggacuuaaaaacagagagagagagagagagagagagagagagagagagagagagagagagagagagagggccaaaggagaaaagagcaacagaagguagaaacauuugcuauuucucucgaggaguuuuuuccuaucuuucuuuccuuuuuuuuuuuuaaacaacaaauucaaaacggagaggucagauuuuuuucuuuuugucugcuuuuugucgucuugucgcagcggcgguggugguguuuuuuuuuuguuuuuguuuuuguuuuuuuguauagucucuuuaaaucauuuuaaacuagagagaauauuuucccagauacaaauaaaucgucaugcagguggggugccggguccgugggaaccaaaaggagaagccgugcuuguccuagaaaguauacaauugucaccucuuuuaugcuuucugcccgcaacaucagcguuugugacugucuguuggcgucgcgguccuuugggguggccgugguaguaggugguggugggguuguugaugguuugagguuaauuuauuuuucuuguuuuuuuuuaaauauauuuuuggcuggggugggaguguguauggacuuguguguguaucugucuguguauccugauuucgguuuguucuagggauggaguagaagaagaggaagaggagcaggguuacgaagaggaggggaagguggaaggggaggagggggaggaguagggcggccuuggcuaucauacaucacauuccgagucgcuggagguuaccgagaggaucgaagugccgguguccgcgcgcuccgucaggcuggacacacugguggucgggcuggccgccguggacggugacucugcugagccgugcguggggcagccgggcucggccagcgagcgcaucccgcucggcccgauggccugaugcuggagccugcggggaacaagagagccaugcccgcccugacucgguggcccgccacccugcuccccucgcucauaccgcggggagccuggcccgacuggacccgcacuccccuacaacagcggccucccgcguggcgugccccuagccacagccuucaacggggcucuguguucuuacaggcucccagcugcccccugaguaccgcagagacuuccuaacucaaguccgagcucccgguuucccagcccagggaagcguuccagauggaaggaaggccucagaugaagggcagacucccaaaccagccuccugcagagaccugggcaggcagcaaaggacccugagccgggaccagcagacaguggggaagagcuucgcuuucuucugcagccuccgaggcucaaauaacugaacccggagaaccagauauuccacagaagcucaggccacggccuucccaagcacacaccccagaacuguagggguucuccucagagcacccaucgcuuuccuuucuggaucucuacgcagagggcgcaggacacggggaagagaaaagagggaaguuggaagcuaaaagaugggggggggggggggagaaaaggguagaaagagaagacaggagggaaggacaggcugugucucuuuucugggugacgaagcaguugucugaaccuagugucucccuucuuggaagccuuucacuggucaugggcgcuccccccaucugacgaaauguggccuccacaggcagagaugagagggacguggauucaggccugggccaccuaaaccggcacacacucuaagucuccagccaccagcaacugucagcagccguugccccugcucccaggccuguaccagagcuucugcucaaccccccuucuuuccucuccuuucccuuuggacuaaucgucucuccguccucuccuuuuucuuuuuacuuucucacaauugagcuuuaaagauccaccagaaccaaacaacuuugugagucuguaaccaacuugccugccaugacugcaccugcgauuuugcuucccgaauaaguggaccaaaacaaguggaugcuccugaacugaggcgauagggagacuugaagcucucacuccuaccaccacccccucaaacccaugaacacacuaacacuccaggccucuucacuccaggccugccucuccuguccagugccagcucaagggauggaggccaccggccuucucuuuguggcaggaacccuggccuccuuuccccucuuugacuccuauggacgccucuaaaccaagcccccccccuuuugcggugcacagaaauaaucagauagcaaguaguauuuuccuuuccuuccagucuucuagcuggugccagggcugaagagacccgcgagggguuuaaggccccuagggacaggcacggaggguugaggacaccaggggcaugcucacacagcgcuggcucugauaaaaaaagcccuucuugagcaaagcaguauauaaacccacagccaguuguucccuguuccagggcaaccagaaacuuuucucuaacuguccagagagcaccgguaucuccagaacuggaucagccgccucuaccauuccccgacagccugaguuuccacccguuuccauuuuucuagcccggagccugugguggccuggccgcgguccccgccacugaccuguucuuggccgccgcugcgcggucgcgcugucgccgguucuuaaaccaguugccuacuugugugggggugaggccgguggccugcgccaguucgcguuucuugcugggguugggguagggauccugcagguaccacucccgcagcaggcuccgaguccgcuccuugaagcaaugggucuucugcucgccaucccagauggugcgcggcagagggaacuucuugcgcacgcgguacuuguccaccgggccgagcgggcggccgcgcagcuucucggccuccugguagugcgccucgagccacauggcuugcagcuugccgugagacuccuuagugaacuugugguucuccaggaugugguacaggucgcggaaguugccgguguggaaggcgacgacagcgcgcgcgcgcaggaucgacucguguuuguugauggccucgcacgccccgggggccacgggcagcgaccagaggaagcggcccagccgcucgaugucgcccgucuccuccagcgucucgcagacgcuggccaccugcuccggcgagaaguugagggugggcaacuggaacauggacaacucuuccgggggggcccuggagccgccgccgccgcugccgccgccugcuccgccagcaccgccgccucccgcacgguucccgccgccgccuccucccgcgccgccgccgccgccgcucgcaccgcucccgccgccgcuacucgccagaaguagggagcaguggugagaaucggcgaaguuuggcaacaagaagugggaggaauagagaucuaggggggagcggaauaccauggacugaccugagaggagaggaaaaaauucagggagaggaagagagaggggaggaagaggaggagaggggcgaugaggaccaggaggagggagaggagaggggggaggaggagauggaaaggaggggggagcagaaggagaaggagggggaggaggaaggacguaagggacacccacaccccacacacauccacauacacacacacccgcgcagccacauagagagggaggaaggagagcggcccggugcgcgcgcgcagagagagagagagagagagagagagagagagagagagagagagagagagagagagagagcgcgagcccgaggcagagagagggagagggagagaggagagcgagagccaaccacggccgagucaagauucagcgauuccacagcaaucgcccuaaugacaacagccucauaauaucuccccuaaauccacagugagugcagcauugaaacauuuuguuucgcuuuucuauuggucuguggcgugucguuguggcguugccacggcaaccacugccaaucacugucagcccugccaaucaauacugagaacguaaggacgguuuuaccacuuagccggagggggggggggugagggagaagagggcgaaacagaauuaaaaaaaaucuuugcaacucuuaauauccucucucucucucucucucucucucucucucucucucucucucucuuucucucuccucuuccuccuccucuugcucaaagaaguuuugaucaaaaauucgaaaaggaauaggaguagaguaguugaaugcagcgagcuauucguuacacggaguguuugggguuaggaagagacuccagccucaggagcaccaggcagccuuagaugaggcuggggaucaggugaccuggcaagguuugcacaugguaucucagccaccuccuucugucuaugugaccacuggucaggaagaaagaggagagaugacgaggcucacugcauagucaccguagcaagcugcugggggagccuagaucugggagacagaauaugguacauagggaguugaagccagggcuaagauuaacaagcaggaggcuaugaggcuuuccuggccagucagugcccuuggacuacauuucccaacucuuuccacaccauugcacaguucugcucccagccaagcauuggugaaguuuuccaucacuaugcauuuuauaacaguggagacauuacacuuucucugucuucaaaaucaacuccacucuuuguucccccaccccccagacuucagcugucucccacagugguagacuagcaacaggaggccagaaaccuagggacucuggaccuaggggaggaugcccacuuuuccuaccauggguacaaccccugucaugcccaacaucccccaaaagauacagaaacuuuagaggccacccugaguaagcgcccaaggccugaaagcucauaauguaaauaacuacaauacauaauuaaagccaaaauucuccauacauaaagcaauaucauaacccugaaacagacuccccuuguccaaagaacucagagugucuuuccugccugcggcuaccacagccucugggccaggcccgggcauuuauuuauucuuagguauguugcuugugagaaguuguaaucugcaucuugaggccggccucccuuugugaggcuucuguaacuauggaagugugauuuacgcagauuuguccgggucagagacaucuuucccuacgcacuguguauauuuagacaggauucggacugguguuaaaaaguguauauguugaauggauucacacacaguagcuaacaaugcccacauugucggcccauguacaacgcguauugaaacgcagcgcccagacuucaacuaaucugcccucaauaaagcugaaauaauuauccuaagcugccuuuccagaagaaaaaucauugaggaauucaaaacuuuuuuuaaaaagaucuuuucuacauuccgaugcagaucugggggcgcggcgccggguacacaccacucaggagagcucaaugagggagaaguggaaaaaaagaaguugugggagaauuuaaacgugaacccaacuggaggcuggagccaaaauggucgcaggcccuaaaucucaagcucggaucuuucuuaggccuugauccgacagugccagguuuuaaagggccgaggagugcaaacucgguuugagggugacaccgaauguuuggguuaggcuaggggacuauacuggcucuuuagcagggggcagcucaggggccuaaacucgcugaccagggcagaauaauguucacccuaaaagguagauccgucgagccccacuuuuggcggucucucucucucuccaaacaucuucaucugcaccaggagugcuuuuccgcucaacugcaaggcucugggcggucgcucuuugcgggcccagaaagagcccaaagguugggacacaaaaacagacacuucaucuuuucuuccggaccccuuucucuuguagggggaaggauuauagacugaaaggugggagggagaaggggcaggaggaggaagcagggggaggaaggaaugaaaagggggaggggaguggguauugugccgcguguggagggggagaauuccuacggguggguuuccgaauauuguguucaacuuuuugaaagcagcucgugaccccgaaacugcaucccccggagccggggacccaggcgccaggcgggcgggugaacccggccagucccucccaauccccgcaaccccccgccuccgagugggggggauccaggccuggagggaggcugggcaggugccgagggcugugccgacagcgcugaaaucgaaaacccucgccacucaugaagaacugaggcaaaaggaucacagaugcugcucggggccagcccuauacucccuccagugccuggucuccgguggacccgcggggcucugcaguucucuggcggccgcgccuuguaagcgcuaagccgggaggagggcgcaggcagggcgcacagcucugagcgcgacccuacccggcucgggcccgcagcaaccccgacuguccgagagccucuccccaagcaaggcucugcgccgcccucugagcccaccuccuggccacaacgcugccugcgcuucuccagcccaggccggaagcccuaugcugccucccgaagccgguaaguugagaguccugaaagcugagcagggaggcggggcgggugguuccugaugcguuuuguaggacuggaucccgccgaggcuccgcagggucuugaucuaaaagguuugggugugugcauuuuuggagagggugucugugaaccucuggagucuccccaaaaucccauucgcugagcauuggugagaggagcuggugcaaaggacccaggcugcuuugcucccugaucugggguggguaaagcgagggcucggaauggagcccagggcacuuccagagugggugggaugcugagcaccgccugcacuccgauacucucagagccacaaaacccuaggggauuggcuuguagggccucuagaucucuucucucucucucucucucucucucucucucucucucucucucucuccucucagacucaaggacuggggacuugguggaucuauggcauugguacccacagaggucaccugcacagauaaaucugucgccacccuucaacccuggccuaccggaucugcggggagaaaugcagcauuugaauuggggaguguucaguccugcucugcggggcauuuauuuacaaauaucagcugcaacccagccuugauaacgucucauacagucagaggacuuugcgggaagcacacuuccuccuuguuuggggcuacagggaaagcccaggaaagcgagucccagaaggccugggacagcuacacccaguucacccaugcucaacccggaacagccgacccaaacggucaggaagguuuguccugggggcaacgccucuuccgggcucuaggacauuggaagacagagagauugcuggguagcggguggucugggccuccccgcaagcugcaaacgaaggagcuuggagcagaccgccagggagggcgcaggggagcgcaguacucaggcggagaggccccgaagcccuucagggacuccgauuacuuuccuuugaacaacaacaacaacaacaacaaaaacaacaacaacaacugcucccucccccuuauauccccucccuuuuuuagccuccgggcaccaggcuuccacguaauuguccuucuggacaguaaacacagcucaguugccucaacuuuccuggugcauaaaaguucccggcgugaggggaaauuugaauauuugaucagccccuuugagugacccucauuagccuggcgcccugcuaaggccccaccauugcaaaaaagcugcugggcccggcauuuguacgccuuguuagcgcugcuuaaugaagccgccccgacggcucaaaggcggccucuggggccggcagcgcgcaccucucggcaccccgcucugccuaaugagccccgccgcccgcuaaaggcccuuccaccccccacauccucaaacaagagggguuuggcuccgucuaggaccugaacaccucccaccaccgggcccaggagggugggcacaaacccagucuagcuggcuacacggugaucuagccccuggagaaagaagccagcuacuuggaguaugcaagcuaaaaaugguugugugagugggaaaguagggaaguggauuuuacagccacuaggucuagcucacccguggguaccacgaacuuucccccacagggccagcuguaaaucaauuaaccagcccagcuccuuaaaggugcaucuggacuaguguuagaacgucagaagggcugguacacaggggagggucagcuuuccacuccccccucaaauuccuuugcucuggucuccccaggaggccuggcacuucuccccagguggccucacacuuucuggaaggucaaccuuccaggcaacuagaacucuaggccuguauuugagaaaggaugggcagguucaguucacaccccucggagaaugacuuccaguuucacacaaucccaucccuggucucucuuccauugcguuuauagccauggagaggucugaagaaguuagcccaggaaagaccacgcuccuuaggcaagacugggaccccaaaaaaaccuggacgagagggggaaaauccuaggaaaagggaguggagacagccacccacuaggacaagcaucuacuccuucucuccucuucuugggccaaggaacacagcuaacuaguuaauauaagaaaccauuagaaacugcacuucacuccucaggaagaguugacaucucucacugcccucucgccuccauuguucuuucuccuggacaguuggaacucaagguccccuuucacucccuucuugaguaccccuagcacuugcuggguugguggagcagggaacucucgguucuccacucaggacuuucuggaagcccaucuucguaugcucaccagcccacccuccuacgcuggucagagugagauugcuaaccucaagaccccauucaaugccagcuuucaacuacugcugaagaccaauguagguccuggaauagaagaacugcagaguguaagucuauuugaccggccccuccucccuucccuccuuccauucggcuccacucccgagcccagcccccuuuccauucaaugacccccuaaacuaaacccaagcauaaacuccaggaucaucucugagccggaccacaguagugcccaggucacgauccguucuaagggcaaaagcagcggcagaaaagucaggggcgggugcucuaggagagagggagaccugaaacggaggguaggauucaguuccgagcccaccggcugcugaggggaggaggcgaaaggaggggguugggaguccacgggcauugggucggggcagcagggacuucaggcgacggcguggggggcuagauccggaggagaggggagggguggcgggggucggaggagcacgcagggcggagggguguggggcucuuuaagagccacacggcuagcaggagaggcgugcggcccugugcugguagcgcacugaccccgaaggggauuuagcgggaagggagcgaccggguucugggggcuuuguccgggggcgcccagaaaggccgaggcacaagaauaagaagcggcugcagcgugaaaggcugcgaggagcggcggcgcugcugcucuugacuucugagcagggcuuagaaggccugccccggcuuaaguugaacugagggugcugaguccugagcgccgaguucaggagcccugaguccuggccucuaggcugaggaggcgugggauaggggcggacgcuggaguagugggucuucuugcgacaacccccucuuggaucuuacagccuugcuacccuagcgcaagguuguuagccuagcuugccgcgucuggcauagccaaagaaauuuacuuucccagcuuggcuuuugcuuuuguguguccaccucgagcagauccggagcuggccgaccccagacugauucucaacagguggcuggguaagucuguuuaaagaauuccguguaaaucaacagcuccuccccgaccccuucccuuuccccucccucuuucccccuaggcggguccgaguucucugggcuccucccgccaacgguggcucggguguugggggcgggguggcaggguacuugcacccuaccaugggggcuuucuggcuugggguuccagguuaguagaucccuugugacgccucacccgguaccccggaguuccaaucaccaaugauuacucucagcuucuggcacugagccucugcgucccaagaggggggaaggagacagcgcgcagcagaaccucaagauuugaaccugcaggaaaggggucgagggaccccuggaucagaggucuugguguaggggucacagaggaaaaagagcucuccauccucuuugugggagacgcgagagacugcuuggagggaugcgcgccaguggcacaaagccgggcagaggaguggggagugguucugcaaccgaggguaguggugaggugggggaggagguagaggaggccaaaagaggagggaggggaaccaaagaaaggcaaaggcaagagauccggggcguccgagagaaaaguccaaaaaugucccuaaugcgcgcauagagcagacgcgcgcucgggggcgcacaaucucaauucucucucucucucucucucucucucucucucucucucucucucucucucucucucucucucccucucguccuacacagguagugccccccacccuguguuggucgugcgggacccaucgcacacagagaagccaccuuaccccucaccucaccccgucggccaaagacugaccacccgcgcccgaguguggggaggggugggaauuccggaucacacacacacacacacacacacacacacaccaggguaggggaacagggaagaucuuaccugcagaaagguaagagaagccgggagcguguagcagcggcggauaaauauucauuaggaaguguaaguccuuucaaagggcuccgcgcgcgcgcucuagcuccugucucucuuucucucccucccucuguccuccaggaaggcuuccccuccucuagcuaucucaacgcccccccccccuuccugcgaaauaccggguggauccuaggcuagcuaaccuguugggaagccuga

SEQ ID NO: 8767 - RNA, 5367 nt, Mus musculus
ucucuccagcaaaguaauugugcagaagugugggcuaugacaucaccaagcagucuggccaagugggcugacacaggagaauucuguuuggaauucuccagacagacuuucagacaauagcugcgaguucugcacaccucaacucagaggaagagcaaaccaguuccagggagcagggaccccaagggcccaaggauacgccugagauugggauuucucuucagaucggagguugggggagugggcuugguuuaggcccaaguggaggaauccuccaggagucuuuccaagguuguauauguuccccuugaacuccaagaggguacaaagguauagccucuggaaccagaacugguuauguucauccaaccgucugagucgugggcaaagaaauucuugauaaaaauuucgagagaagagucuuucugaguuuaugaacaaaacagaaagugucgguuuuaucggaaaggaaaagucccccuaggagcccaaaucugccuccaccccuccaucccuaucugcccagggcugcuacccuugaagucccgcccaguuauugcuacugcgaaucaauacugagaaaagccuuaacugucuccucacugcgucuugucugcuuuggauuugucuggaccggcauggacuuauugggcaaaagggggcuaaaaccccaggccgaaaacaauacuguagacuuauuuacagcuagaggggcaaucgaagggagucccugggcugccggugggagucagugcacccacuuuagcaaggacaacacaggcgugccgcugaccguccacucucuuuuuccuccacuguaucugguguagguugccgaacucagagaccuuuccgccaccguuagccucugggaacauaggucucagccacugcuacugguccugagacucagcccacaguaucauuuccaguucuagugacuucgaccaugcugaggagucaaaacgucccaauuucccuuccagacuccacaaguccaaacucauuuaguaccucugcacgcacgcguucucgccuuccacaagcccagagguguguguugggggugggggugggggggaagucaggcgcggggcuggggguggggcgcuccgggagguggcuauggggaagcggaagucugagagcucugccgagaaaagggacugaggucucacgggaggagguuucagaguuuucaguccuaugccuucaccuugccggagacacacugagaaaaggucgcuccagguuuccaguacucugcccgguacccagaccuucccacccggaguauucagucccuguaagggaaaucagacgucgguacacgcgagaccaccgggccucggggcauauauccauauauuuaugguuucuaauuuuauuauaaaauaaaagcagaaauaucucccgacgaacauucacaugagggcguaaaauggaacaggcaagucugcggcugcggaggcacucugggcugggagcacggaggucacagucccaggaggaagagaagaaccagcgagguggggaagagggagagagagagagagagagagagagagagagagagagagagagagagagagagagagagagagagagagaaaugagaauucaggugcuucuggggugcagccuuucuugcucauuuguuagucagaagcuggcaccuuaggcucacacugagaggagggagaugucuuugaggaccgaagacccagaaugucuaccuccguucacaucacgucggacucuuagaaaguugagaaaggaacucaaauagaugacaccagaaggaagaaagacuggggauacaaugugagaaaugagagagagagagagagagagagagagagagagagagagagagagagagagagagauauuuauaaaggagggaaagagaaaacguaaagcggggagagagaaaaaaaugaaauaaacucgaaaggaaaguagaggaaagaaaaaggagagagaaaggagaagagauuuuuuaaaaaucgggguggugguggcuuauaauuuauucccuugccuaguucaagacucggucucuggccuccaaaggaucucaaaagcaacuuguugaaaaugaauccccaaaggauaccgagcagaccauuguccacuuugucccgccgccgguucugccgcuccagcguggcagggcagucuuccaguacgcggcacagacuccagaaucuaucgcccucccacaccgcuucaucaagcacggaaagcaagcgcccggaggcgaacagagcucuaggagcccagguccacaagguuggccgacaugggguugaguauggaguccugcaggcuguggugaugcugcaguggguccgcgccgccuccaccgggcacugguacggguacugcgcucgggcccggaggguggcccaggcugugcagggaaggcagcccagggggcggcggcgggcugagcaacagagcgggacuggacgacgaguggucuggaguccccgacggcgucuucucauccucggaacugccuagcaccgacuugccacugccauugagcgaggaagccagcggguuguggcugcuggaauuggaguucucgcuguucucccugcaagcgcaggaggaaaggagcggggucagggggaaccagggccacucugcgcugacccucaggaugccagcaccuggggccccgcugcgguugcuaaaggguguuugcuguuucuaccauucccacacuugacuucuuguucuuaauugcguucucaaacccucaacacuaguuuucgcuugucccucucccuguaucagcccauguccuuaaugucaugacuaccuuuccuguucccaguauuuccuguccugucucccaccccauuccuuaagagagcugcggcaccaaaguggggagccuggaguugggagaagugagggaaaauaccguacaaacgagcuuugcuggguagaaguggggaauagaagcuucagauacagcgagcccaggcugaggggcccacuucgacuugggugagcacaggccuaguuucccuuugccuuucucugcgcgagggaaaccccucccuacugagacuaugaucccuaauuccaagcugagcaggagcucauuugacugggcagaaagauggggcuuugagaauggaggacuccuuuucccuaggggagaagguagaaggaagggcagggugcugagagcuggcucagaucguaggcagaaacaaggaggcacaaucuguagcucucaccuggggccuagucaggaaccccagcccuuauggagccugacagaggagaacccaucgcagaugaauccaccucuugccugcuuuugcggacagucccugaccagauauggguauuugaaauccuggguaaaaccuauuaguggauuccuaacggccauucuuucagauuucuugggguggggggugggggaaugagcaagacaucaucgccauucaaagucaaacuuggggauuucaaauacccagguccagucugcagcuugcucuucugccccuacuguucgauacccugacccuggauccuucaaacgguguucaacacauccacaucaccuaacccaggugucuuguuuugcuguuccccaaggagaaauccguucccauaauccguuucucuccgaucucgauccccuaguuuccuuguccagauuuaagcccaaagcggguuacagacaguuacaggggugucuguagcuuagguuaguuuggaaagucuuagauuccgauagaaaagaaagcucccagucuuucggcagaucccaguuuaccucgcacacccgacuugcccaucaaagagagcagaaccuaaggagagcgaggucuucaagggucuggcaaguucaggaaaggcaggcuggauugccuucucuuccucagcagacauuucccccggaggccuuacaucuuuggguccuuucuacgcgggauaacucccaacucucuugugcccagcucuuaugcccagacaaggaauaggucuaccuugcauagauauugcagucauuacccagauaauacuagggagauuccaaccccugcccugaccccuaaaaaucucuuugaccuggaggugacguccuaaacccccugauccccgacgcccuugguuguucgaagaucaggcccuaagccuacgcuuaccucgcagggaauucaggcccacagcccugcccucucugaaacucgccguuuuuccaguuuaguccacaagcgacugaggaauuaguuacugaacuuacgcaccgcuuugcccgcuuuagacaaauuccgggucgcucagccuccagaaaagaccuaagcgcuguuuugagccagccugagcugcggccgagcuugguacccgggguccgggugcgauuuaguccuguccaggagcuccccauccucccgcacccguuucucccaggaccagggaagccggcgcagaugcucacuuacucguaccuuuccuuggccucggccgcccugucgcgcugccgccgguucuugaaccaguugcugacuugcgugguggugaggccgguggccucggccagcucgcgcuucucucguggcgacggguagggguugugagcguaccacucgcgcagcacgcugcggcucuucuccuugaagcaguagcuggucuccucgccgucccagauggagcggggcagcgggaacuugcgccgcacgcgguacuugcccacggcgcccagcggccggccgcgcagcuucuccgccucgauguagugcgccuugagccacaacugcugcagcuuggcgugguugugcggcgagaacugguggcucuccaggauuuuguagagcucgcggaaguugccccgguggaaggccaccacggccuuggccuugagcacgcuuucauucuuguggaggugcucgcaggcgggcagcgaccacaggaagcgacccagccgcucgauguugccgcccugcugcagcaccucgcacacgcacgccacuugcuccugcgugaagccgaaggugggcagcauggacaugguggcggcugcgcgcccgcccgcccgcgcgcgcccucaccgcgcuucgcggccccgcaugggcgccuccccgccggccccggccggccgacaggcgggcggggcccccuggccaggcgccggcucccgagcgacuccugagucacaacgauccguccucgcucccgccgccggccccgcgcagcuccgcgcccccgccgcccgcgcgccucgcccgcgcccaagcccggaggccgcccggggcgccgcuccgcaugcuccgcgcccgcccgccgcucgcucgccggcuccucgcucguucgcucucccucccgucuagcucg

SEQ ID NO: 8768 - RNA, 5367 nt, Mus musculus
cgagcuagacgggagggagagcgaacgagcgaggagccggcgagcgagcggcgggcgggcgcggagcaugcggagcggcgccccgggcggccuccgggcuugggcgcgggcgaggcgcgcgggcggcgggggcgcggagcugcgcggggccggcggcgggagcgaggacggaucguugugacucaggagucgcucgggagccggcgccuggccagggggccccgcccgccugucggccggccggggccggcggggaggcgcccaugcggggccgcgaagcgcggugagggcgcgcgcgggcgggcgggcgcgcagccgccaccauguccaugcugcccaccuucggcuucacgcaggagcaaguggcgugcgugugcgaggugcugcagcagggcggcaacaucgagcggcugggucgcuuccuguggucgcugcccgccugcgagcaccuccacaagaaugaaagcgugcucaaggccaaggccgugguggccuuccaccggggcaacuuccgcgagcucuacaaaauccuggagagccaccaguucucgccgcacaaccacgccaagcugcagcaguuguggcucaaggcgcacuacaucgaggcggagaagcugcgcggccggccgcugggcgccgugggcaaguaccgcgugcggcgcaaguucccgcugccccgcuccaucugggacggcgaggagaccagcuacugcuucaaggagaagagccgcagcgugcugcgcgagugguacgcucacaaccccuacccgucgccacgagagaagcgcgagcuggccgaggccaccggccucaccaccacgcaagucagcaacugguucaagaaccggcggcagcgcgacagggcggccgaggccaaggaaagguacgaguaagugagcaucugcgccggcuucccugguccugggagaaacgggugcgggaggauggggagcuccuggacaggacuaaaucgcacccggaccccggguaccaagcucggccgcagcucaggcuggcucaaaacagcgcuuaggucuuuucuggaggcugagcgacccggaauuugucuaaagcgggcaaagcggugcguaaguucaguaacuaauuccucagucgcuuguggacuaaacuggaaaaacggcgaguuucagagagggcagggcugugggccugaauucccugcgagguaagcguaggcuuagggccugaucuucgaacaaccaagggcgucggggaucaggggguuuaggacgucaccuccaggucaaagagauuuuuaggggucagggcagggguuggaaucucccuaguauuaucuggguaaugacugcaauaucuaugcaagguagaccuauuccuugucugggcauaagagcugggcacaagagaguugggaguuaucccgcguagaaaggacccaaagauguaaggccuccgggggaaaugucugcugaggaagagaaggcaauccagccugccuuuccugaacuugccagacccuugaagaccucgcucuccuuagguucugcucucuuugaugggcaagucgggugugcgagguaaacugggaucugccgaaagacugggagcuuucuuuucuaucggaaucuaagacuuuccaaacuaaccuaagcuacagacaccccuguaacugucuguaacccgcuuugggcuuaaaucuggacaaggaaacuaggggaucgagaucggagagaaacggauuaugggaacggauuucuccuuggggaacagcaaaacaagacaccuggguuaggugauguggauguguugaacaccguuugaaggauccagggucaggguaucgaacaguaggggcagaagagcaagcugcagacuggaccuggguauuugaaauccccaaguuugacuuugaauggcgaugaugucuugcucauucccccaccccccaccccaagaaaucugaaagaauggccguuaggaauccacuaauagguuuuacccaggauuucaaauacccauaucuggucagggacuguccgcaaaagcaggcaagagguggauucaucugcgauggguucuccucugucaggcuccauaagggcugggguuccugacuaggccccaggugagagcuacagauugugccuccuuguuucugccuacgaucugagccagcucucagcacccugcccuuccuucuaccuucuccccuagggaaaaggaguccuccauucucaaagccccaucuuucugcccagucaaaugagcuccugcucagcuuggaauuagggaucauagucucaguagggagggguuucccucgcgcagagaaaggcaaagggaaacuaggccugugcucacccaagucgaagugggccccucagccugggcucgcuguaucugaagcuucuauuccccacuucuacccagcaaagcucguuuguacgguauuuucccucacuucucccaacuccaggcuccccacuuuggugccgcagcucucuuaaggaauggggugggagacaggacaggaaauacugggaacaggaaagguagucaugacauuaaggacaugggcugauacagggagagggacaagcgaaaacuaguguugaggguuugagaacgcaauuaagaacaagaagucaagugugggaaugguagaaacagcaaacacccuuuagcaaccgcagcggggccccaggugcuggcauccugagggucagcgcagaguggcccugguucccccugaccccgcuccuuuccuccugcgcuugcagggagaacagcgagaacuccaauuccagcagccacaacccgcuggcuuccucgcucaauggcaguggcaagucggugcuaggcaguuccgaggaugagaagacgccgucggggacuccagaccacucgucguccagucccgcucuguugcucagcccgccgccgcccccugggcugccuucccugcacagccugggccacccuccgggcccgagcgcaguacccguaccagugcccgguggaggcggcgcggacccacugcagcaucaccacagccugcaggacuccauacucaaccccaugucggccaaccuuguggaccugggcuccuagagcucuguucgccuccgggcgcuugcuuuccgugcuugaugaagcggugugggagggcgauagauucuggagucugugccgcguacuggaagacugcccugccacgcuggagcggcagaaccggcggcgggacaaaguggacaauggucugcucgguauccuuuggggauucauuuucaacaaguugcuuuugagauccuuuggaggccagagaccgagucuugaacuaggcaagggaauaaauuauaagccaccaccaccccgauuuuuaaaaaaucucuucuccuuucucucuccuuuuucuuuccucuacuuuccuuucgaguuuauuucauuuuuuucucucuccccgcuuuacguuuucucuuucccuccuuuauaaauaucucucucucucucucucucucucucucucucucucucucucucucucucucucucauuucucacauuguauccccagucuuucuuccuucuggugucaucuauuugaguuccuuucucaacuuucuaagaguccgacgugaugugaacggagguagacauucugggucuucgguccucaaagacaucucccuccucucagugugagccuaaggugccagcuucugacuaacaaaugagcaagaaaggcugcaccccagaagcaccugaauucucauuucucucucucucucucucucucucucucucucucucucucucucucucucucucucucucucucucucucccucuuccccaccucgcugguucuucucuuccuccugggacugugaccuccgugcucccagcccagagugccuccgcagccgcagacuugccuguuccauuuuacgcccucaugugaauguucgucgggagauauuucugcuuuuauuuuauaauaaaauuagaaaccauaaauauauggauauaugccccgaggcccgguggucucgcguguaccgacgucugauuucccuuacagggacugaauacuccgggugggaaggucuggguaccgggcagaguacuggaaaccuggagcgaccuuuucucagugugucuccggcaaggugaaggcauaggacugaaaacucugaaaccuccucccgugagaccucagucccuuuucucggcagagcucucagacuuccgcuuccccauagccaccucccggagcgccccacccccagccccgcgccugacuucccccccacccccacccccaacacacaccucugggcuuguggaaggcgagaacgcgugcgugcagagguacuaaaugaguuuggacuuguggagucuggaagggaaauugggacguuuugacuccucagcauggucgaagucacuagaacuggaaaugauacugugggcugagucucaggaccaguagcaguggcugagaccuauguucccagaggcuaacgguggcggaaaggucucugaguucggcaaccuacaccagauacaguggaggaaaaagagaguggacggucagcggcacgccuguguuguccuugcuaaagugggugcacugacucccaccggcagcccagggacucccuucgauugccccucuagcuguaaauaagucuacaguauuguuuucggccugggguuuuagcccccuuuugcccaauaaguccaugccgguccagacaaauccaaagcagacaagacgcagugaggagacaguuaaggcuuuucucaguauugauucgcaguagcaauaacugggcgggacuucaaggguagcagcccugggcagauagggauggagggguggaggcagauuugggcuccuagggggacuuuuccuuuccgauaaaaccgacacuuucuguuuuguucauaaacucagaaagacucuucucucgaaauuuuuaucaagaauuucuuugcccacgacucagacgguuggaugaacauaaccaguucugguuccagaggcuauaccuuuguacccucuuggaguucaaggggaacauauacaaccuuggaaagacuccuggaggauuccuccacuugggccuaaaccaagcccacucccccaaccuccgaucugaagagaaaucccaaucucaggcguauccuugggcccuuggggucccugcucccuggaacugguuugcucuuccucugaguugaggugugcagaacucgcagcuauugucugaaagucugucuggagaauuccaaacagaauucuccugugucagcccacuuggccagacugcuuggugaugucauagcccacacuucugcacaauuacuuugcuggagaga

SEQ ID NO: 8769 - RNA, 174519 nt, Mus musculus
aaugcugaacgcugcgaugcuggagcacaagaccauaagguacugugaguuugaaggaagaagggacggacagcaugcccuggccucuggugacaaggaaaggcccucgguuaaaguggagguagaaaacgaaccuggacaagaggcuggaagaguuucugguggacagauuucacacgaaccucaugagacuugaaaaugaguguuaacucagcgugguaaaacuacaaaggggcuuaugagagaucuuaugagagaugauaaacagaguauggguggcaugaaauaggaaagcuggcaggguaacuacagggagaagggaauuaggaaagcgacagauacacaagcagaguguagugaaugccacagggauaggaaggugccgugacagaccuauugcugcgcguuuuaauaaaaaaagucaguuuuuucuuuuaaaauuuuuguuacauuuauuuaauauauguuggagucagacgauagcacucaguagccaguucuuuucuucuuccaugugggucucuaacuguuggggucaggauccaggacaagugucuuuaccuacugcucauccugaaaaguagguuaauuuaagggggggauggguaauccaaugagcuggcuagguguuuguuuguuuguuuuugauucgaguuagaaccaucaaggaagaguagaaugaccaguaagggaacgcagcuguugagaauaccuagugguucuguggagagcuagcagcacccaugucuagaugaaugagccucauagacuuguaaacgcuugaggcuucucucugaccagguuugccuccguuaucuaagcagcuauccgcccuguacucaguaccugccugggaucugugccucugagaacaucuugcuguccuaugggcgagaacugaugcaguauuggcuuugaacuuuccacugcaucccggccugugcgcgcugaaauugaagaaagugaacugcacaucuggauuccucucuccaccucuggauggugugggccagcccccuuguaggccugcuacuacaguagacugaaucccuacucaugagaaaaccucuucccuaagggagcugcuuuguccagacauuuggucccagcaaaguaacuaauauagaguuaacuccccauucauaagggauuauccaggugagagaaacuugguucaauacugcuauguagaagugguaccuaggaggguggucagaauuaaauaaaacaucagcauggaucccccuauugaauggugguauguuaaacauuuuucuuuccucuuuuacuugaguaugugcauguagauaugugcaaaaaguuaaggcuaacgucggguacuuuuuuccuaccucaauauauuuugucuuuagaagagaccagaggacacggggacucacauucacucacacacacacacacacacacacacacacacacacacacacacgcucgcagguuuucugucucuugucuggugaggucccguauccccucaaaccuugacucagccaacaagaaggcaaugcuuccacagccugugauguucugugaugccacaccacuggccagcaagcucccugaaucagggacugugugccacuuuccuugguauaucacuggggucuucagcacacaguaggcucccauaaacacuggauaagacgaaaggaugaaaagaaaguguccucagugugugcuuggucgaugucgcccacagggacuccucagcacugucaccuaguuaauccaaugacuggcuugaagugucugucccuccagcacauauccaguuuggaugcucagggacuaugcucuggggauccugaguaaaacuacacgucucuucaugggcuucaguauagucaagcguagacuguacagaaugacaacaguguggaauuauggguaggaacaguacauggcacaaguaauucccaggaaaugcccucccuagggaacauuuuguucuuaaucccuuugucaccagcugacagcagccucuuccccugggaugacucauggaacacaaagggauuuuccuugggcccagaaucacaauaagaagagccacacgcccaggucugggugagcccacacuccgcguguccccgcaagaacacugaaggcugcaggggaaaaagucaaggaaccuguauaauaguggggauuaaaacaagggaacugucauggcuugcuaacuguccugugucacugaggcuaaacacccauacacacagagcaaaggagugaaagguguaauuaaaauaguauaucaaauugaucgguuuuaaaauauuggacaagccuugucuucacagaacuaaacucuacaacuccacuugguaaaaagauauuauuaauuuuuauauauuucuguaucuaauuuaccacuauuuuauggauuuuuuuugcaucaauauuuuuccaucaacgcuccugaaugguuauggguauaguuuugcugauuggucagugcuuuaccuacugugguuuucaaacguaagcauuuagugguugaaagguuuggcgggcggcugcuuuaguuauauguuucauuugguucuaauauauuuuuaaaauaucccuugacauauuuucucugaucaauggaugauuuacaaaugagagagagagagaggcagacagacagauagacagacagagacagagacagauagggacagagagacagagagagagagagauccaaguuuggagggagagagucccagauauauuucuguuauugaucaguaugguaauauaauauauuuuauauauuuuaaauauaaguugaggauuacuuuauaauccaggauagaguuugguuuguuaaugguuccaaggacacuugaaaacacugcagacugagcugguagaauggcucaguugguaagggugccugugccagaccugauggccagaauuugauccugggaaccaacaugguggaaggggaggacugaccccauaugagggaagaggagaucugaccccacaugaggggaggggaggacuaacccuaaaugagagaaggggaggacugaccgcacaugagggaaggggaggacuggcucgcacaugagggaaggggaggacugacccuacaugagggaaggggaggacugacccuacaugagggaaggggaggacugacugcacaugguggaaggggaagacuggccccacaugguggaaggggaggacugacucccacaguuuuauauuauuucagguauucugucagagcgacgggaaguuuguggauacaaugccgggacccucacugugagcuuuugggucuccaucagaagaagaccacaugcggcagacugaugcugucugaugaaucugcucaggcaacucgugcagcuggaaaaucugcgaaaggcaggaaggaaucuggggacaaaaaaauuaaugccuguugcacaagcaucaugcacuagauucccacguuaaauaaagaagaaaaaucucacuugaacccauaaggacguccuagaauggugguucucagccuguggggugcaaccccuugaggcagaauaaacguuucacaagacucacauaucagauauuccacauaaccgauauuuacauuacaauuuauaacaacagaaaaauuauagcuauaaaguaacaacaaaauaauuucauggucacugcaacauaaggaacuguuuuaaaaggccauagcauuaagaggguugagaacaacuguccuagaacaaguaguaauagaauacgugugaacaaaggccaagggggggacaucacacccauaaucacacaguuggagagcaauggaagcaggguugaggucaucucuuugacucaauggacagguuuucuacauuaggaguugcuaccuucuguaggaauccagaaaagucuuuagaacagugucaaagaauggaugagaaacauugguuuaugcuucggcugcucuuugccuguggacaguagaugcacaucagaagcccuggauugcgacagccagucucagagggaugaugugggucaggacagucgaggaagcgaugccccucugagggucucagagccacccuucauggggcucacugacagcuuuugcugcuuggucccucugggacuacuggucacuccuaagaaagagggaauuaaccuuucuaaaggguggggcuuguuacugcccagguuuggugacuggcauggguaugagccaaagcuaccuaggcaaagggucuugcuuuugacucugucuagccuacaugcccuaggccccagcccacacucucugguccacaaaacaagaggauccuaggaaagccauauccauucuguuuauacugggccaggaagucuuagguguacauuaagugggaagaaagccagagucccccucccuccagcccuuccaaaaaaaaccuuucaaagagcagcagauuagcuuuuuauuuauuuuuauuuuuuauuuuauuuuauuuuuaagauuuauuuaugaguacacugucacuuucuucaaacacccaaggagaggacaucagagcccauuacagaugguugugaaccaucauggggcugcggggaauugaauucaggaccucuggaagagcaguuaguaccacuuacccaucucuccagcccagcagagagaauaucacaggaccauaguguuuaaaucccccaaguuuccugagaaucaucacccauuucucuuauaucccacaguuuggggaaauggugcuuuuuccuaaccaacuccuaucuucuucaggcaguaauuguccuuuaccuagaaaggaaacuauccaacuauccaauuuucggaucaagcaaacugguacuuguuccuugaguuaaugaacaagguugagaagaggaaaugaaaaggcucggauugggaaaggguuccgagucugccugugaaggccggcucccucuucggcucccucuucagcacuucgcuugcucugauuagcuuggaggcuaaucaaggcuccucugguugccccccacacucaugugcucaccuacagcucaaguucaugaugcuguuucucuuagaacagggauaggagccaaguuccaagucccugucugagcagucaccagcugugugagcugagugaaccacuuaaggucuccgagugccaguguuuucauccaaccagagagcaaaccuucauugccaccuacuuacacggcagcgcccagccacagaggcugcugaaggcacugaggacucuaaagaccggugcagacguaaacaacagcucugugaaaaaaaagucaucccuccaagaugacacagcugucaucccauuguccagaacucaacacugggcagagauccuaaaugucaguuguuuguaguuuaauguagagagaucguuaguuacauuucaagugaaagcucaucugucaucuacuccgaaaugcagguaaaguguccuaaaacuucauuccaaacagguggaaaaaaaaaucccuucauauauccugaaggagccuuucacucccccacgggcuucuucucgcccccacccucaacccccagugacccugccgagcgccacgaaguuucuuucagggcucaucugugaauucucccucaggaugccccuuucacgggggucaguuaugacugcuagacaaugacucugaaaugaggcucugaauauucuuccucuagcauuugccugcuaggucacacagcaggucugcccuucagagucuacaagucucuuguacacaaacuggaacccucaucccagacaagacaccucaagugcacaccucaccaucuuuauuaccuuucuauugcugugauaagauaucauggucccagaacaguagcugagagcuuggaucuuuuuccauaagcaccaggcagagagggccaacuggaaauggugagaguuuuugaaaccucaaagcugggcccccagagacacacuuccuccaacaaggccacgccuccuaauccuucccaaacaguucugccaccagaaaccauucucauucaaaccagcacaaccaaacaacaggguuuccaauuccagugcccaccugaugaucuuugggacacauugaaguuuguuaaggucccuucaagugucuguguguuagucuucuguugcugugaaauaaauuccucaaaccuauggggcuuaaaccugucagcguauaucauauaguucccaaacucagaaacccaggaauggcuuaacuggguggcucugcucugugucauaaaucuggugaggucccaaaaguuaguggauggugccuaaccccaauucaucacuuucaucaaaauagcauugccaacaccaacaaacccagaaccuuccagauucaacuugacuugucagauuagcaucaaauguaauugguagaaaacuacuuaagaaccaacguauaggugggugugguagccgauauccauaaccccaaugcucaugacuaugacgggagaguuaccaugaguuugaggccauccugggcuacauaguaaguuccuaguuagccugagcuacagaaugaagucccaucucaaaacaaaacaacaauaacaacaaacaaacaaacaaaaagauaaauguuccuuauuuuaauuaaaucaauuuauuuauuuuaaagacaggguuucgcuguguagccccggcuguccuggaacucauucugucgaccaggcuggccuagaacucagagauauauaccuacaccugccucccaagggcuagaauuaaaggcauguggcaccacugucuggugcaagcuccucauuuuaaagaggggagagggaggagauggagggggagaggggacguggugggggaaaaaaggagggggagaaagggagggggagggagaaggagggggagggggagaacagccuaagguaaguaaguguuguccgcaauggacccuugucauagcuuguucuccucugcugcuaagagagaagaugaaggcaugggcagugagcacucaucccugcagcccucugacaccugcccccaccuaguggugacaacauuuucuggcaaaccucuucugauucuucuuuaaauuuauuuuuguuuuauguguuugaguguuuugcauauaucacacgcgugccugguacccaaagaagccagaugagagugucagguuccuuggaacugggguuacagaugguugugagcugcccugugggugcugggagucaaaccuggguccucuggaagagcagcaagugcucauaacugcugaaccaucucucuagucccuguucugauucuucuaaucacacauuuuuuaauuagaaaaaaaaaagcagugauguccaguggucuucagccuuccuaaugcugcgacccuuuaauacauuccucagguugugauaaccccaaccauaaaauuauuuuuauugccacuuuguaacuguaauuuugcuacugcuaugaauuguaauguaaaucucuguguuuuucaguggucuuagccccguaaaaggguuguucaaccccaaaggcgucaugacccacagguugagaaaugcuguaaaccuuguguaugggauuugucuguguuuuguauaagcuacacggaugaaaauauuucccucuuuucuucuuccugauuccaugaacaaaauuuccaacugugauuucuaucacuccaggcauuugcuuuagagcuauggucaacugugauuucuaucaccccaggcauuugcuuuagagcugugguuuguaucuguuuagacucugaaucagaaucaccuauaaacuguguagcuauuauuuuggucuuuuuuuuuuuucccugucaaacuugaguccgucuuccugaucuuagauucuuccauuugcagaucuuuauccuuaaaggaaagaaaagcuaacuaaggauuauugugcuuuuacccccacgugcaguugcaucuacugucuuuaccaaaaggcuuccuauuucagccuucacucccgcccuuuaaccuugacugacuacacaggcauccuaucccagccuuugcucccucccuuuaacuuugacugauuacacaggcauccuaucccagccuuuauucccgcccuuuaacuuuaacugauuacacaggcauccuaucccagccuuugcucccucccuuuaacuuugacugauuaaacaggcauccuaucccagccuuuacucccgcccuuuaacuuugacugauuacacaggcuuccuaucccagccuuugcucccucccuuuaacuuugacuacccucgugcucugcugggaauaguccucaacuagaaaaggauaaaaugucuucagcaauaauauggaacaugcucaaaauauauuguugacacaaguauggucuggaaccacaauauuggaagaaaagaauauacagcauauuucauuaauuacaguaugcacauauuuucacaaucuuuauguuucugauaucagaaguauuguauaauauacagcaccucauaauuuauuugguagggcuuuaaaagagaaauuuccuuuguggaaauauggucaugguacauacugcaguaaauggaauugugggcuuaauagauauguacugcuggaaacuauacauagcauuuucucuggaaagaaucucaaggacaaagauagaucggagacuacaaguacguauaagaauauagauaaggaacuccagagccgacagaauuucuauugcacguucuuuuauaucuugcacuucaaauuaagcuagccauacuaauaaauacaacauuuuaauaauagacucuaauuuauaaaggacaacuggacacaagucuuuggaccccacugcuuugcuaagauuuguucagguuuccacucauucuuuuucgagacaggguuucucugugcagcccuggcuguccuggaacucacuuuguagaccaggcuggccucgaacucagaaauccgccugccucugccucccgagugcugcgauuaaaggcgugcgccaccacgcccagcuuguuuccacucauucuuaaugaaggccagucaacacaggaaggcuaggacugugccaacauguauaauguccuucauccaaaguccaguauggcagcuggucagagacuaacuccaacugaccucauccucccccaaacaccacugugguaguuugaauauacucagcuuaagggaaguggcacuauuaggagguguggccuuguuggauaagauggucuugcuggagggagugaguugaugugugggcaggcuuggaggcuccuaugcucaggcuccgcccacuauggaaaagacccuccuccugggugccugcagauaacagucuccuacuggcugccuuaagucaagauguagaacuuuuggcuccuccugcaccaugucugccuggaugcuaccaugcuucccuccaugaugauaauggacugaaccucugaaauuguaagccaggcccaguuaaguguuuuccuuuagcguggucaucgugucucuucacagcagugaaacccuaagacaaccagucuccugagaaugcuaaccagauccuuucucaguacaguugagcucgacaacuuugucccacugccuucuuuacccugaaguugugccacaaggcaaggaauaguaauccguuguucugcuucgauuagauuccuguuuccagaagagcccuuaagcaucauccagggagagggugugaggaagaacacaaccccgaacuggugucaacuugcuagcaugucacgcuaucaugauugcucaaacgugaugaggugaccacaggcagugaccagaagacucagccaugucacugagacaccacugcugauccaugccuguugaugguauuuauacaagcaaauagccauccccaaagccauuuugaagguuaugugcacacauaggucguauuaaagugggaaaaaguuaaucucaguaaaccugagaaguaaguauaguugaggucgggccucaagcaguaaaaccagugacuacaggggaggggagggauucacaaggccaugguuuuccaauucaauagagauggaauccaagucaauggugguugggugugagugaggguagcauccagggcaauuugcaucaauuccuguuggcuuuuuugguucacucuuauuagcuggccagggcaaacuaaaucgaacuuuaaggcucaagaguaacacgaacaaccucuuugguuuauucagcugcaguauagacaaaauuucuagacuuggaacaggccuaauuucacauaaaguuacucuuuaacuugauugguaauuuaggacugggaaugugauguuggucacacaugcaugauggggccuuagguucaguccuuagcacugaaaaugaaacaagagguugcuaucuuaacauguaacaagucccagguuccuauagcuagcuucaacauuaaagcauaggaauuugucccaaucuacagaaaauggagcuuucuguagggggauggucugguguucuuuguauucaaaugcuaaauucuguaccccaagaucugacugcuucgagucaagcaaaucuucaugcauaccagcuuuuguuguguuaagcguauuuaauaaagaugccugcagccuggaugggcagaagagaggggccagagcaaagguuccaugaaaggaagaggagaggaggagaaaaaagaaguugccaugggguaggcgaucgauggugagugcauggccuguuggagcaggaguggcccaugcagaagcugccaagugauaucucaggaucacugacagggaaguagggaaaauagcacagaggguugagaucugcccagcucuaaugcuugaagguuuauuauaaauacaaagguuuuugugucuuuuauuugggaacuauauguucuaaguaguauguuaaccacagagcaauauuaaccacaacaguuuucuuguuuaaauacuagacuauaaauacugcuccuaccuuugcuugcucuuucauuucaaucuguacaguauaucacuugaagcagucuuccauuauuaugauuuauaguggucuugucucuccagagaaacagagccgauaugauugacacacagagaagcuaugauaugacugauacauaggcagguagauaggcaggcagggccuaucuaucauaggcauugguucacacaauuauggaggcuguccugcaccaguccaucuacaaucuagacaacuggggaagcugaaagcguggcucacucuaaauacaaaggccccagcauuuaaccugagaaacuggagaacaagagguucuaagccccagaauuccaaggguagauucuccggaguccagcaucugagggcaggauaaaagggcuguuccagcuacagagcucagaguauccccuucccuucaccuuuuuguucuguucaggcccucaaacaacuggacaacacucagccacaucauauggagaucccccuucgucuaauacguucaaaugucaguguccuugggacaggcacagaucgauaaagccuuuccauccggugggugacgguuaacucagucagguugauaaucuaaaaccaaucaucauucuaagugauugacacuaaggacaaaguuguuggcuuacauuuuuaaaagaauaguagguuuuaaaagaggcccugucuucugcgugucaggagcuucacacaugacaugaacugcaacccagaauuggagggcacaccugugauccagaccuugaggcuggaagacacaaguuucugaccuggaucuuggcauggagaucuugaggcauaguggccaugaaaagcuuaggcccaggcaagguaguacacgucuuuaauccuaggagacuaagacaaggagagcucugaguucaaggucagccugggacagaggagagcucugaguucaaggucagccugggacagagcagguuccagauccagguaugguggcacacaccgucaucugggcuacacuuucugcuggagguguagaaggacauuggaagaaggaaaaccucuuugacuacuugaguacuugucagcacagcugcuggaaucuacuucuaccgaagacgagcucaaacaacuagccguguggugcugagcaaccacuagauucuuggacuucccauccauaguggcccauugugguuuaguuggacuacagacugcaagucaucacaauaaaauuccuuaauauauagaggcauucuauaaguucugucccucuagcgaacccugaauaacacagaucuuuuuguguguauguauggguggacauauguguaggucagaggacaacuuuaagaaguugguuuucucuucccaccauguggagucuagcauucagacuuagugacaagcgcuuugacucacagagcugucuuguuggccaauucgugggcucugaucugugaaauuaugucagagggaaucuuauauagcccagguuggccuccaacucacuauuuagauaaggauguaccucuaucccccaagcugggauuauaggaucuguucugcuugauagaugaaauucuaaucuagacucacaagucuuguuucucuaguuuaaaaccuuauucuuauguuguuucugugaguuucguggggcugauaaaaaugauagcaaggaaagagauaaguaauuuuuaauuuccucugggaacugauuuagagauguaaauggaaagaauuucuggagaaugauuuauagauuuaaaaacuggaaugauugggggaagggggaagguaggauucagguuaucacagcggguuuaagauuugacuuuuccaaacucagaaagcagcaugggaguuuucugcgguuugggguauccaauuugauuuucuauucacuaugagcugacugugcaacagcuuaggcauuugaugugaccaaaagagacaaaacaaaaaguaaacaaaaaccugucuccuuguggacaaggguuauuuaagccuaauuuaaucaaaagguagaggcuauuuuugggucagaagacaacuuucugggaguugguucucuuuacacgggcucccgggguccaaccugguuuaucaucuugacaaguaugagugcuuuaucagcucugaacaaggaaaacccagcacugcauguaaaggaaacugugccuaggcucguuuaccaggauugugcucacugcacuuuucgggacucugaauaugagauggggcaagguuucugauucuccgggagagcugcauuuucucgaguuaaugacccagugacuauuauuuucaguguucuggguaucuuaacaguuggagaugggacccagggaaacccgguucaaaggcaaaaagcaauuugcauaaaucuucuuggaaguaucuaagaggccucggcuuccaaauggaucugcuuggcagucuaucaaacugccugagacuggaggaagaggcugaugacucuagcuaaugucucucguuaaguaagguucccaugggaugaauaaggacuuagccaaggcggaaaacuucagacacuuucacagcgugguaggguggagggagaaagaaaaagaaaagggacgagcuagguuuuguggccuaaaaauacaacgcagcgggggcaacguggcgaacucagacugagcugggcuacagaguaagucuuuuucaaaaaacaaaacaacaaaaaacaauccaaaacacaaaaugaaaggaugggugaaaaggguguaaaguaguccaagagaggucugucagaaaaguggaaauauagaggcggacgcauauuugccaaaucucugccccuccccuaggguagcgacaaacacaaauucccuguggaccagaggagcagucucucuccucgccgccccgcccccgcccccgcccccgcccccgcccccgccccgcccccgccccgcccccgccccuggaccgcaccggcucaagccccgccucgcccuggccccuguccuaccccgccccgccccgccccgguaguguggcuccaguaaaguaaggcgggacuuccggcguuugaaaaacuuccggcgggaaccggaagauuccucagcagaacucucuucuccagauucgccaagcccgaaggugagcuuuguguccaccguagcggcaaugcuuccgggccggccguuuucgcuuuucggccgcgguauuuaugagugcucgugugggaaagaauuuuuuuuaaaugaagauuuucugucuuuuagcaccagcggucugucacacagucuacacuguacauucucagcacugucaccauagcgcguccucugaaccggcugguagcgcgcauggcaggcgugagaaagccagggccacuuuguuuguuuguuuguuuguuuguuuucaccccgaagaaucggagcugagggaggaaucgcugucagucguggcgcgccgggaucacgcgccuuccucagaggugcccugggcacagaggaggcgaccgagccauggagggaaaggaugacugagaacucugagcaacuuuccucagucuuccuucccacguggcagcuugacguucuccugugcccagggaggcgcagggcggcgcaggacgagccuugguacccguggcucucaguuguaggacuuugccucacaccucuaucguuggagcaaaccguuccaucccauggagucucaagauucucauucauaaaaacacagcaggguucucucguagcgaaggcuagcugcuguccuccugcuagauggcuuguuguucuuuguuuuguuuuaucucuugagggucuguggacaugugaagcaucuuuuuuaaaauccccucagggaaacauuuagaugccuuaagaguugucucuuuuuuucuccaagaacaguggcucuccacuguggguugaacaauaauccuuucacuggggucgaauaucagauacccuacauaucagauauuuacgauucacagcaguagcaaaauuacaguuaugaagcagcagcgaaaauaauuaugugguuggggucaucacaacgugaggaauuguuuuaaagagacucagcauuaggaagguugagaacuacuacccuagaaguuuaaaugcuguuucccccuuuuaaauauuggugcgcaccaguauuuuuguggguugggugcaucuuaacaugugggcuaggucaccuagaaagauccuuuugugacagaguauacccaaccccagaucccucaaccuugguccuaaaaauuuuagcacucacuuuucuuguccacguguccuuucuuuucauucauuuuuuguucuguuugucugucuguccuuucuuccuuccuaacuuuaaaaaaaaauggagacugaaggauaaauugacuugaucucaaaugcuugggacuuacuuaauaacauguuaauguuuucacuguggguuuugagucauggcuagggacaguugcauguucuacucuuguucaaugcacugaagacaacccgccuuugcuuucuguagaacuuuccaacuggcuuuuuuguaguuuaaaucuuucuuagaacauggguuugcucccaaggaaggccugugguuaaaucacuucagaggagcagcuaguugucucucuuccguuuacagagugaaggcaaguuuuccccugaccugguuugaauuagcacugugucaaacaccaacuucuuauuuauuuacuuaauuaucuauacauaggaucuuacuauguagaccgaccuggcuggaacucuuagagauccuccugccucugccucccuaaugcuaggguuaaagaaaggugugccacauuuccuauucagcccuuuuuuuuuacauuuuauuuuuauaauggcaaacuguucauaugaagucauauuuuccuguucucauaaccuguccuguccugucugcugcuaagagacuguucugcuggccuuuuguuuccuucuccacacagucucccucaguuuugcacucacaggacagagauacugggacaucaggcuccucuuugugacaacugcuuaaguauuucugugaaguauuaccuccuuuuauaaguguguuagagccaagguuuacaauauuccucugguccagagacuuguucugaacaugcuagucuaaugcauuuuuuauuguuuugacauucucuagguaauaaauguuaucaguuuaguagacuuacuuuuuuguuauauuaugugauuccucuugucauuugucuuauauuuuuuaacugcugagccuuugacuaugguaaauauuuuuaguggcauaguggcuaaucauugauauugcgagaggaugucugcuuugcuuuaggaguauagauuauuccuaagucacuaaguugauuggcauuugauugacuccuaacuuugugaagacacuuuaauguuaugaaaagauguggaagagagaaaauuucuuauauuugagaaauaguacaacagauaucuuuauaaucuguugacuggcaggaucacuauaaaauaauacuugcagaauacuccauccuuuaauucuaaagcagacuuauugcccuggaagggcuugucuuuuucaagagauggucucagcgucauaagguauuugcacauuggaaggccacuggguucucuucugaccagcagguuauauccuguggggagccaguguuugggcuugugaaugagccauauauuuuucuccccucuauggcauuucugacagcagagcuuuggaguauuaguuuuaaauggacgaaaugauaaaccuacucaugucaugcggacucugauuuguguuccguuuuuccccagaugcccucauugcgcaaaagagugaaaauacaggccgagaaugcagaacccaaagaugaaugcucuuucuucucugaguuguaagcauauuaguguaauauguuguugggggaauggugacuauuuuaagaguaauguggucugucccguagacacuuaagucauuugggucgaagacauguguguucuuguccuugcucuauguaacaacucucuguuauaauugugccaugauccaagagagagaaagcagcuaucagguuauguaauguuuacccuguacaggugaaagagggcaagcuguuguuuacacugcuuuggagcagagcucuuucuuuuuuaugauauuuuucaugugcauugguguuuugucugaauaucuguguaaguguguuggauccugaggaacuugaguuacagaugguugugagcugucaugugggugcugggaauugaacccaggucccggaagagcagcuaguguucuuaacugcugagcuaucucuacagccccuaguuguagcuccuaacccauuuagcauugcuacuguguauagggucaccuuuuguuuugggagcugccugaugcuuuauaggacauuuaguggcaucuguggccucuacuaaauguggcaacaguucuugauaugacaaccaaaaaugucuuuagauaaugccaaaugucucagaggcucaaaaucauccucugcuauagaauaccauauuacauaugccucugacauuuacugagaaaacaagugauuaauguuaggccauaauaguaauauaagauaaaaugaaagcaggucagggguuagggagcauacuguauggccgugguagaggggcauuuuggaaagaacagucaugguguucuuuggauauaccaagagauccauuugagauuugcuaguugcuguaguuuggauaguugucccgaaaagauuauuacuaggguaguuauuuggagguggugggauguuacagaguugggggcuagucuaaagcucuuaggucacugcaggcaagcucuuccaagagaauuguagcgccuuggccugucuucucuuuguuccugccucaagaugugaauguguuucaguauagauuccugccuuugccaccuucuuacugucuucaucagaggcucaagccaauggggcuaccugauuuuggaacugaaccucuaagauaaauaagccauuuaauaaguuaaauuaugucaguuuaugucaguguagugacacaaagcucacaaauaagaacuuagauuagguuacaaauaagaaagcagcaaacacacagacccugaggcagcagugaauugugucuggggaguagcaagaacagcauggccagauugugacaggaaauaagacuguaauuggugggaucuuagacucuaugaggaagcguuaggacuucauuagaagugaguugggaagccacuggagugcuguggacagcgaccugaucugaccugaucuggcuuauauuuguaaagcaucuuuauggguucuugguguguaacagacucaagugugagggugaagcagggagguugguguaggggugagaacggugagaacuagucccguuuggauagacucuugaagguagaauggaaaggacguggugguuacgggcuuucuguagaccagaggaauagacaggagcauuagaaccaagaggucuguuuuguuguuggcaaguugguggugauugcuagacaucuagcugaacacagaucugcaaggggaaagaacaucugcagauguaaaauugagacuuagaggauaaggcauaaacuagagaguccugaggacuaagacucuggagaugucaacauuucgagguuggggagagaggagagggucaaaaggacugaagagaggcauaaggaaggugugcuuuguaggacgauugccaggcacuccugcgcucuucugggaagggggggaugaguguugauagcugccuugagccacuuccugugugacaagugauuuugacaaaaauccuuguucaauugauaaaggaggagacccuaaguuucucugucuuccccuugccuuuuccuuuuuccuccuccccuucuuucuuccuucuuccuucuuccucuuuuucuuucccucuucuccccuuuccuuuauucucuuucuucccccuuccuccucugugcaugugcuuaugugugcgugcgugcaugcuuguccguauguagaguagggguaaacauagucagaacuuguaauccuccugcccucagacucccaaguacuccauggaauauccgguagaacacagguuuuagguuaugguucccuuuggauccacuguuuuagugauuuuugauugauuuuguuuugcuuagucucaggcugcuuacgagcucugagaagaacuuuuugauggugucagugguuugucccgccaucauuauguuuuccuggaacauaauuuagcugagaagucauccagucugguucuugccugucagcagaacugagagcucagacagcuucacugacucagcucagguccuuuucccacguacugaccuccuuaggggagagaaagagagacccagauggccuggagggcugcgcuuccucugcucuugaaguaaguucgcuucuuggucagaaaggcaguguagguuuucagucuauucuggugcauaggucuaugugaaaggaaaaggaggucaauaaaauaguugagggucuuggugcuggcuugguuuuuaugcagugugggguguuuaaaaaacucuuucucaguccuuucauugguuugaauaacuuaguacauuugaaauggauuugguuggcauuuaggaacguaaaugcuuuuuacuguuaagaucgaaaggcucacaguggugugacgugacccaguaaguuacuuaagaugaugauggauuuucuguguucugacaguauguauuaugcucgucaggucagagaaggagaguagaccugugaagaguguguuguaggaagaagguacuucucuggguucccgaucaccuguucaauucuuagcacuaauuguuuauauucuguggucauaucacuccuuuuuauauugcacauuuccagcuaucauuuaugaagcauguuuuuguuuuuaccuuugucgucugguuucauuucuccuggaaguucuucugucgauccacuucuaggucaucuggcucugaagaagauaacaaggaagacagcauuugggaaccucagaagaaaguucccagaaaucguagacagccugcuuccaagggauccaaacggaagcaggggcccagggcgaagaagagcucccaacagguggaugacgaaucaaaagauguggcuguuaaggaggaguugguaggugguguugcucucuagauguggggaacacccaguguuuuucacaugggagggacgguuucuuucuccuuacacugagugggacagaacauguaaaugacacaaacuucagggcacugguaucucuggucacagucucaggaauacuugacuacugcagcaacuguuucuucagccacuucuguucucuucucuaaggaggugggcuaaguguggaaguggugguuuggaugguggugucagcaaauaucugaguguauuguuauccaagcagcacacucaguauuucccccugaagaucucacgggauggguacggccacugggagugcuguaguuaacauccugauuuuagagauaggaaagcugaggcagggaguguuaagugacucuccuggaacacagauagugaguggugggacugggcuucuaagucagcaguucaaaagccauuauaccucucgggguacuuuuaugcuugccagagugaugugucuacacagagugcugguuuaauaaugaauccuuagaaacaagcaccacuugaagcuuggagcagcacuuuucuucuuggaggggcagcacuuuucuucuuggaggcugaaguaggaaauuaaauaguuagaaacuugcuugaugaguaugggcugagaauaggaauuagacagaucaaugugggcuuauugauugccuccuguggucuuggcuauggucaucacagugacacuugcagguuguaaugguguggaguaagauagucugcagcagucaucucccagcaggcucucugguuccugcggcugaaacauucagagucuauuuguugauuuuuccuuugccuuauuauagguagaagaaggcugaucaugcuuggucuuuugugcauuccuuuucuuucucuuagacagcuuccuuuaagauggacacauucuuuaguuaugccaguucauuugauuagguugugaauuguagaccuugccauuguaucuuccugucucugcuuggauccaucauguuuugaacagguguacugcucagaggguguuacuguguguuucauguacacacguggcagcuggcauugggcuagaagaguccuuacuguggcucucaguguucauccucagucauucuggagaaaucccugagagaaguuuaauuuugacugagacauuguugggagcuguguuugugccgccugugucacuugagggauggacaagccagccugugacugcaaacuucucaagggcagcucuuugcauuguugccacuaucuugaaugccaagaugaccaucagguaaagugacauugacagagcagagauugcuuccuggguaccugugucggcuccugagcagcuuccucucaaagaaaaggaugccauggugccauacaccuguuauccuagcacuugggaagcugaggcaggagaauugcucugaguucaaaguuagucugggcuccacagugaguucuaggaagcuagggcuauagcaugagacccuaucucaaaaagcggaacaaaagaaagccucaugcauuuggcugcuguugcucuguguccaguccucugccuccugucugagcagggaggaguauagucuucugaauuucacaagcauguagaugcguuucuucucccucugauugguuggugugguuuuuauuauauuuguuuaccaauuucugaguuuauuuauauuuuuaagucaggucucauguagcacaggcuggcuguguaacugaggguaagcuuggcuuuccagcccacucgccuccaccuuccagguucugggauuacaggcgugaguuaccaugccuggucuucaugaggcgugggaucagaccaggauuuugcaucugcuccggcaagcacacucucuggcuugugcugcaucuccagcgguggcugcagcuuacucuugguuuucuggcacauguagauacaucauuuacuuuguuuugugaaauuaaacuuuauuuauaaguuguccacaugcaguuguaagaaacaccaggagggacucuagguacucuuuaucuaguuuucuccagugguaagauuggagugucucauguaaguauaaugaccaggauauuaccauugguaaaauccucuguucacuuagagugcucuggcuuuccauguguuauguguguguuuguauuuagcacugugcaguuuuauuacccguguggguuuguguaaccuucacaaggaccucuuacauugcccuggcacaucuacaucaucaugcuccuuuacccacucaucuccgaccccccgaccccccucccccggcccgacccucccccccccccaagcucccugugugccuuggaugguuauguaaaugugcuccuauaguguguaacuuugggauggggcugucucaacuuaacgugguuccuuugagauucauuuaaguuguugcauguguugauaauuuguucuuuuucacuucagagcagcauaccagggcuucuaauuuugaaauucucaugcuuucucuuuguggcuuuauagaacagcccgguggcuauuguugaugcagauuuggaagagaaaagccacaaguugcagacgacaaagacucuuaaaacugcagcaaaaaagcaaaaaaaaccaguuccgagggccaaaaaaagguugaaaguugaugaggaaaccagccaggccagccccuuggaggguggaggcaguaauguggagacccccucaacaagcgccuguggaaaugugugcaagaaggaggagagcgaggacagcuucacguuugggcaguccccgguaaagaggaucaggacugagucauguccucaggggaggccggccaggguucccgacggugucagcgacauuaaagaggagguagaaaugaacugggacguaguacaggugaguacagccucgugucaccugugugcuuugaguccuggagugucgaguucacugugcucaccagggggcgugcuggcaguuuggaauuuuccguuugccagugauuucuggaaucaagcuuugacaucuguuucuuuucuuggcuauacuauuuguaguuuggcuuaucaucaucagcucuuuucugcuggugugagcugucccaucaguuaagaaaggugguuguuucuguauaucacaguguagauauuucacaccaacagauggggcccuuaaaggcucacugcuacauuuuaauuuugagugcggauuguuuucuccauacaugauuaggucauuggcuauucgugcaucaaguauauuaggaauaagacccaggaauguuucgaagacaaauucuuuaagaauuauaacuugaucucucccagcuuuccauuccugucccucugccuacccaccuuuauagcugcauggggugugacagaggagacuagcaggcuggagacuagcaggcuggagacuagcaggcuggccaugagcaucgagccuuaacuucgugugcuccaacacauucugggccauuucaggcuacacccgggugacuuucugaccuaccuguccucuccuuugcuauaaauugcugcuguagagcccaggacuucuggggguucuaagacugggacucugugauaucuuuguuguucagagggccuuguuuuaggccgugcugcuuuuucuguuaccuagagcuugucaccaguaguuuuugaguuguuauguuucuucucuuuggcacgcuaaagaaucuagaaugcugucuuauagcgcucucuuguuuguuuuuuauuuuguuuuuuuuuuuuaagcagagagucauugagaaacaguuuaaauuguagugagaguucuagaauuuugguuucuuuaaaaaacauagagcuaccagguguggggauguagggcugcuuccuacucucugcaacagcugacugauuugccucaugcucuagccaaggcgugauuuuugcuagcuguagauaguuucugcaaucaugugacauuuggaauucugggaacuuuucagagaguauauaaaugauagagcccugauaagugaaguuggggucgguuggucuagggugguugguugugauuuguuaguagccaugcucaaagaagaaacaaaaggaaagaaaauagauacagggaucucuuucucucucucucccucucucccucucucucugccccucuguacuucuuucucucucaucacuagugauaggaggugagaaaaaggaugauaaaaagaacccacacgguucaaagaccagucacaguaaacagcuaucugucuuccuuugcuucauuccuucaggucuaggaggcgcugcuuucacagaucaggcaggccacagaccgcccacacucuucagauucucuuuaaccuucacccuuggcucagagcuccagggugggcaugcgucagcucccuugccuugcccuuuauuagugcugcgacacuaagguggcuccaccucuggcugcuggcuguauacaggaggaauagaggaguuucaaaguuugaaacccucugagcuuccagacaucauccguuuuucauagugcagggcugccuucucugggcauuuugcuuuaugcuuuguccccuacucuuugucauggacaaaaagaggaauauagcccaacccuagaauuuuucuccagauuacaagggauacaagggaaaaaaaaaccuuucuuuuuaaaaauaauguuacauuuguuuaguagaguguguguguguguguguguguguguguguguguguguaugagggcagggggaggggaguucugugagagucgugugagucagcuaccuaaaacaguguccuucaggguugagcuuuugaugagaucaugugucuuuaagguaguauggcaagagacagcugugaagaauguaaaguuaugaaucuuggugaagacugggcucagaguuguuuguuuacaggucuguaaaugcugaaagguaauaaucuuugccguuuauuuaugaacuaggcuccagaucacacguuaguauuuauauuuauuauuauggcacauuugaagaaguaacuggguaauauaaaaaauuaguuauagucagcaaaguagacagaagcauucuuguuuucauaauaggagcauaauaggauccuauaggcuggcuccuucccauggcccugcuagccccugccuuggucuucuggucuucuguugagguuagcuuuucaggggucucaucaucugugugaagagggcaaacugcaacugcauagccuaugcuuguuuacacuuuaccaugaacauaguuuguguguaauuccugaccagcagcugaggaugcucuucagcggaagcaauguauccauuuucaucugucucccagacugugaauuuaugguugcuaugggaaguuugucuugguuaaagccccugaugucccacguaaguuuguuaguaaaaacugaaaagcaagcagcacagucaguugggauuaaaccgugcugaaguugugauugcugugauaugguuucuuauuuuaagggugagccugggcaggugcaguggcuuugugggucuaaguaaccuuuccuaaauuagggagaaaagcaagcagagccuuuuuguuagcucuuccccuuuguuucgagagacaguaagagacgacguaggugaaacagcuaagcccaggaaggcagaagucggaacgaaguggaaagggagccagugucugagcuggcagccucacugccgcucugcacuaaguguagauguagccuguuugcucugggagacaugaacuagauuaaaauguuuuuaauuuauuuuuuaguuauuauaaccuaguugguagaguuguuagaggcuuuaagccaucagcaaacuuugauguguuacagauauaugugcaauugcccaggauguucagaaguguaacuagacagcuucugggcugugaacaacagcauccccuucauaccucuuucaguccucccuuuccucuucucucaccucuuuucugauuucuggcaguguauauuguccccacuuaugucuuuacauaagcauuuuacgugacauagugacauaaucaauucuuugggccaggugguagacagagucagcaacuuuucagaaaggagcugcuuagguggcuggcuugggguugauucugacagaacagaaaauucucuucaauuuauuagcgagucauugaacuugagguuagcucuuuuaaaagugcagauguugcugggugauuaaagcggcaguggauuugcugaugcccagauguuuucuuucucacugagcagaggggaguuuccccucuaagagaucacugggacacuggggacaagaaggcgucuuucuggauguuucuaacagcuagagggcagugugcagacacucuguccugccuguguucaggagagaggagacaguuuaaguacuuuguacuuuugccugauaaaucuuuugcuuugcuuagaaauugcauuuuugaagagguaauacggcuagugggacuuggggcaguguacuucuugagcucaaguguucguguguagaaaaugagaauauuaguuucuaucucacauaauuuuuuuuaaaagauuuauuuauuuauuauauguaaguacacuguagcugucuucagacacaccagaagagggcgucagaucuuguuacggaugguugugagccaccaugugguugcugggacuugaacacuggaccuuuggaagagcagucggguacucuuacccacugagccaucucaccagcccuaucucacauaauuuaaaugagucaaugcuaaaucauaaaucacaaagcaguaguucucuacaaaguaaaagucaacauuaaaauuguuauggcauuucucccuagggccccucccucccucucugugcaguucuuucuuucuuucccuuaguaaaugcaugucugcuuuacugaagucaaugaauucccuuaaguaaagggaacacuguagaguaaagacugagucucccgcucugccuuuccauguucucuaggguugcucgcugcuguucugcuggguuugccccguuucucuaagacaggauaggcagguguuagauguuagguggggccugauagagugcauucucaucagggcuguagcugcugcuuaugcugcugcucugaggauguagacugaacugcugguguaacccacagagcucaugcacucucgaggugcagcguguaccaguugaugcagcagcagcacuggagcagcgggaggucagauuuugacugacuucuuucccaguuagcuuucuggaaagagaguugguauuuauuuauugauugauuaucugugcugccgagacuuacacccagggccuuguguauacucagcagacacuuuaccucugagcugcuccucaucccugggaccuguaaaacauguccugauuaucacugcgcuagcaugaccuaagcuucagagaguacgugaggaaguccagauuagcaaggaaagaugcauagacuggggcaguaugccuagggguuuggguuuuguuucuuuguuuguuuuuuguuuuuuucaagacaggguuucuuuauguagcccuggcuguccuggaacucacucuuguagaccaggcuggccucgaacucagaaauccgccugccucugccucccaagugcuggauuuaaaggugugcgccaucacgccuggcuugccuaggguuuuggaaaaagacauagaaagaaaggaaaaguuaugcuuucagaacuggaaaaaugcuuagcagggaaggucugcaaguuaguccaucagggucggggcuuucaagagggguaaguauguugucuuacuaaggagaucauuauuccuccaucucuucccauguuuucagguguuccagcuuuccuagggauuuggggggcagauuccugccagaugauugacagggccaguugaguuagcuucccucagaagaagaacaguaacagaaguauggucuaaucuuuggagcagaugaaaauauccuaucucccagggccagagguauucuguucuuuuagccaggaggccuaaggagggaaaguuguaugccagguaaauggaagguggcuccaauaccagcccucaauugcuuccaauacugcuaacuuuuauuuaugacuaacagaguuuggauuccaggugucauggcauauuagcgaugguuuugaccaauuaaauuacaugaucuaguauacauuuugaaaggaauauucauagugcuccuuauggaaauaggaauagaugagauuggagcaucugcaaggaggauagcuaaaggccucagugguguaggcuagaacgaggcuugcuguggggaugggagaauggaagagaguaaagacauauuuuguaauuggaguagaucagacuugagaauuggagguggauggcuuuuuuaguuugaguuacuauuugaauagguaaugcaugaggagaguggaggaugaguuugacaggaaccucacuuuacaaaugcaggguugagauaaccauuaguugucugggagacuguccuaaauaauugucugugggucuggugguaauguggagaagagccaagccuggagagaguuuagccauuuacugcaucuguuguuuugaaacaauucuaucugauauuuuggcccaauuuucuuaaucaguugaugaugauaauuuucgauaggauauuauuucauagcccaggcuggcuucagacucaugguaguccuccuguuucagccuucaaaguguugggauuauaggcaucaguauuuugaaucauguaucuuucuuugcagguuuuaucugagagaacuaauauugaaccuuggguuugugccaacaucauacgccucuuuaaugaugacaacacaauccccuucauuguacgcuaucgaaaagagcucauuaauaaccuugaugcugauuucuuaagagaaguucgucaaacccuagaugagcuacgguaagaaaccugagcggggauggaugucauguaggaaacaagcugugggcucuugacaugaaacaaagacacgaaugaguggcuguuugcauaguucuggugcuuugugucuuuucauugcugucaucugagugccguccucuucugccagagagagucaggucugucugcuauauuaggguauggccuccuucugcuacaugcuuaacuugaccauguaucuauaggucuugaccaucuuuuuuuuuuuuuuuuuuucauugaaauaguuagauauaauggcagaaucaggacugccaacaguaaacuaaaaauguuggucuaagucuuccacagcuugcauaagcuuguauaacauuguccucuugcugcucaauaguccccagauggagaguucaugccaguauagauagucuucaacauacaguggagugacuuaguuuugcaccuucaugauagucaaguccacaagcauuuaaacucuacuuugaauauuuugagguuuuguuuugguuuuuguuuguuuuuuguuauuuugagacaggguuucucuguguagcccuggcuguccuggaacucacuuuguagaccaggcuggccucgaacucagaaaucugccugccucugccucccgagugcugggauuaaaggugugugccaccacugcccugugaauauuuuugaguuuuauuuuuugaauauuuugaguuuuuauuuuauuaugaguuugaguuuuaugggcaagcaggaugcuauacgacucuuauacugcuccuggucagccaugugaucaugaaggaaaugauaccauacuguacucucggugauuuuagcuugguuucuucucuuauugcugugauaaaugauccaacaaaagcaacuuaagggagaaagaacuuacuuugcuuucaauuccagguuauugcccauuauuguagggaaaucaaagcagcagagacuugaaguagagagccuuggauuaauguauacauacuccuccuuaauacauguaugaauguauacauaauccuccuucauguuaccuguaucagugccauugcugggcagauuuuguaaauaagaacaggugaugagauaagauggcacggaugacacagacagcaggauugcacacucauaaggaaaaauaauuguugaaagcuagaacugcugugcccgccugccccuccucuugcccagcugugcacugacucaucugcauugauuccuagaaucauguguucucuauggaacccuagaucuuugucaagagagaauaguauucagaagccagucccgugugcugagugggcuuauccugagccgccuugcugcagagucagugagugcaguagaggucagaugcuuccuggugggcaaucuuggauaucagugcucaggauggaagguaaaagaugagcugggugccuugggcuagagaguaagagggacaagucaaaagcucucaccacuuaguuugaaaggguuacuucuggccaagcccgugauaauuugggcauuaaaauaugucacagugguggauuauaaccacuaagcaaaaauaagaaaccaaagucuauggugauaggaguaaaucagugcauacgucggaagcuuauugaggaaugagcaucuuaaaggcucccuccacaaaacacgcgcuaguuacaagggaggaagugcugaugucagaaaccagugucacuuccucaaguggugauacuguucucucaguaacaggcugccccggaaucauuugccucucagugaggugcaguaagaagagcagugucacuagcuugagauccccaccaguaggccccagguuuaacuguaaggaaacauuuccugggaggccagacuugaagacaugacaaaguaacugguaggaagccuuucaaaguacugagacuuugaaaaucuaggaacaccuggagcauugcuucagccagagagacugcaucugacagcuacccaucuucuggagagaauccacagagguuguugccagcacuguuaaucaggucugugagggagaagacagugauagaucagcguuaacuacuugauccugauggcuuuauuguaguuuauagauuauucuuucuuggaaauccauacuaauguuuuuggggugaauuuacugucaaaugagucaaaaauaaaacaguuuagaguucccuuuucuuuucccugcaauguuuuuguaagugugagcuagccuugagaagaaauguuggacauagagacuguauauauuauguaaguuuuuaauuucagggauguugccaagaagguucauaguagaauccagaaaauuaagaaggaggggaaaaugucggagugcuugcugcaagccuuguugaacuguaaaacguucgaggaacuagagcaugugguaaggaacugcaucucucagugggaugccugagugcuuaugauuugcggucucuuuuuaucacugaggaagacuaagauggaaaaagcuaagccacuagccacuguuaauuaauucccuggugauuuuaucuuuuaaucaauacauauuuccuggaugccuuuuugugugugcuaggaacuuggguuugcacauaugggcauuguagucaauaguccuugcccccuaggaauuuccaguuaaggaaggaagaagaguagauuauucaagugugaagugcaggggagauggcagaacuggagaccuacacaugaaugucuucagccuguaacuaaaacaguuggcacucugguuauuuguugguuugacgucuuuguacuccaccagcaauagguagaaaacaugucuguauugaguaggugcauacuuuuaaaauuacccuccccuaaauaauauaaccuaagaagcguucacaugccacuuccauugucuuuauuguaagugaucuagagaugauuuguuuauaggaagcagugcauggguuguauggaagcaccagucuauuuucuauaagggacuugguauucacagaagccagcagccccuuauggauucuuugauaggcuuauguuagaagcuaugagacugggagaauucacuuuaggaggggauuauggacuagcaggucaguaugaccacugggaaacagcaacuuuugaaauaaaagucagaaucuggaguacauguugaaaaaaaucaucagagaacucugaggagacucuggagcugacauaaguggaucaggaggaaggagguugugacugaggugaugaauagcaguuguagcaggggguuugggcaagauccggacugaaaaucauuaucauuagggaagugcuguggaccuucaacauaauacuucagcaggcuaugugggaagagaagccagcaggccagcagguggaagaguugaggagggagggggggaggaagagggagagggagaaggaaagagaagaggaguaggaagagcaagagggagaaggagaaggagagagaagaagaagaagaagaagaagaaaaagaagaagaagaagaagaagaagaagaagaagaagaagaagaagaagaagaagaagaagaagaagaagaagaagagaaguauuguaugaaacaacuuugacuuuaacgggggcuugcuuguuugaggaccuuggaguugagaugaugaguuuuagagaugaguaaaugccaguggagaaugaacugagcacauagaaaauggugaagauaaagccguaacacaaagcaccccuguagucugauagaguucaucucugaggggacaggacaauccagagaaagaugcuuaugguauuuucaguauguccuaguccugugucccuguuuugauuuugacuuugcaaaacagacuccugugauauauucucugccuuuuuuccuagucugcuccauauaaaauggggagcaagggcacgaaagcccagagagcaaaacaguuggggcuagaaggagcagcguggacccugcuggagaacccggggcagcucaaccugcugucuuacaucaagccugauguuaaagguacuggcuuccagaagagggcagccugcugcugcucugcuuuuagaugcacaugccuccacucauuaccuacacucagccugucuucaccagugguuguacaaaugucugucaacagcagaugaagaacagaugacucgaacaaacagguccuggccaaucuccugcuuccggugacuuccccaaucucugcuguuucucuuucuucauuuacacaugucucuuaagaccuguguucacaacauguacuucccaguuccuacuugggcuuucuuaaugccaucuucaguaaauagaaggucucaggguguuuuuauuaacuuauuaaucuuuuaagauaauugauguuuuuacuuuuaaaugaaaucccucuauaccccaagguuauaaaaauucuucuauuaucuuucaaagcuuuuauuuuauuucugccuuuuaaaaacccuauaacuuagauuuucucuucaaaaagaaucucaauacuucuggcauacacaaagaacaaauuggcuucugcucuuaacacuuuuuccuauguaauaagggggcuuuuucuaaaauuugcucccaaauguauucuguccuuugugugagagagaaugagacagggcacaggagaaagguuuaaaagauuauuauucucuggagccuuacucuuuagccuggacuugaacuugcaguuuucuugccucaucuuuaagcuuauuucucaaaaaaccauugauucuuuuauguuuuaguaacuguauauauuaauauagacauugucuagauauacaagcauuauuuaaugaauuuuaaugaauuuaaugaaguuuaaugaauuuuguagucagacaacauugaccugaagucaaauuaauaugacugucauuucacacagcugccuuuucuucuuuggugguaagagcaccuguguuacucucuuaacaaaucccaguaugcuguguaacgggcuguaguccucaucugcacauuagaugcccuggcuuuguagcccauccagcuauaggucagcuccaacuuaaacccguguuucuccaucccuguuggauuuuuuugacuuucuguugauucugcaaacugggagauguacuuaucaacagcggucagucugugauaacaaaauccaugcuguguauuuaacuauggagaaauauggugcacuagacauauucuagccaguugaauuuguguuuuuaaaaaaugaguauucauaucuguaaacugcaaacuaucuguucacagacauacauuuuaauauguuugggaaaggacaguaauguaaagaguuauuugaaguuagagauggauugaaaugaauacaauccauauuugcuuaguuuuuaauacuuauuuauaguuauauguucagugauuuagagcauuuaaguuuuuauuuugauuguuauacuauggucuauucaguugcagccuuacaaaguucauuuaucuucuuucuuggcaguguucuggggacuggacccagaguccuuccugugcaugcauuuccuucagcagaucuguauugcuuuugcagaaagcauuucauauuuuaaugacagaugagccuuaguagccuugagauucacugcuggggcuggggacugugugugucugcuguggagacuagcugcagggaggugugcugccuguuguuccuuauggcugagucuuuggcuuccauuuccugucuucuuugguacaguggucuccuugguuccuagguauacuacauuccuccuacacaggucucgaugcuuguaucuccuaaaaaggucuuuccucugacaagcucauccagauacccugugauuauaucuaccccauguccccucacuccucugacaggcuuauccauauauccugugauuauaucuaccccauguccccucacuccucugggaacccucaacauggcucuccuaaaacccacugucuuagucaggguuucuauuccugcacaaacauuaugaccaagaagcaaguuggggaggaaaggguuuauucagcuuacacuuccaugcugcuguucaucaccaaaggaagucaggacuggaacucaagcaggucaggaagcaggagccauggagggauguuccuuacuagcuuuccuccucuggcuugcucagccugcucucuuauagaauccaagacagccagcccagagauggucccacccacaaggggccuuuuccccuugaucacuaauugagaaaaugccuuacaguuguaucucauggaggaauuuccucaacugaagcuccuuucucugugguaacuacagcugugucaaguugacacaaaacuagccaguacacccaccaucauuccucaugucuccuuuggguguuguuuuuuguuauuauuuuuguuuugugugugugugucucacuguguccauuacugcugccugcuggaauacugacuggccuucuugucuugagcuuguguggguaacuacaguugcagggaauucaugagugcaguggccaugacuugucccccacacagcauuucacagaacuccucuuugacuucucucucucucaugcucuuuccacaccuuucucuguucucugaagucuguggauagauaaugcagggccuacucacucucagcacuuguauuagcuaugcgucucuacgagcuuuagcccacugcaaaagauacuucucuagagggccaugguugaaagcagcacuggucuacgguguaaacauaaauccugaccaucccccuucugauggucacauguggugacacaggauacauggugguugacagcaggcuuugacacuucaggucaugugacuaacacagacccagcagguuuuuaugguuccuacagacacagcaggacuuagucuggacuucacucacuuguugauucucaucacaaauacagagaauuauggugaauuccaguuaacuguguacugugugucaggacuuuucugaacaaaagcaacuucuaggagaaagaguuuauuuuagcauacaguuccagaggcgugggaguccauccugacagagagguguggcaggagcaggcauggccucagcagcagccagcccuaagugugaagcacagagcagacugacuguagggugaggcuuugaacucccagcacuugucccaguggguggccuuucagcaaggcacucacugggcaccaagcauucaaaugccugagccuauggggggcauuucucuucugacuaccacaugcugcuuuuaaaacuuugagauguuucuucuuucucauuucccuucacuuuuugugcuuuacacauacacgugaucacuuugaauucuauuacugugggaguuuucuaaagaaguauuuucaucauucccaucauucuuccuagaaauauuuuagaaaccagacacauauauauauauuuuucuucaguagaagacauuucuugcucacuacacacuaagaauuugaccggaaugaaaaccuauucuguaccagggaugggcuuugccuggggccugggcauccccguacugaggagggagggccugagggcucugugcugugaggaggccuacgucccgagagaguauaaagagacauuggagugucagugucccucgacaggcacagcuguuacugcagagcauuuccagcucugucacuauggagaucuuauuaucggcuucucugcuuugguuuuccuucucucuugauuuuacagaaguacuuacuuugcaggcuguaguaagccugaaagagcaacuaggaguggagcuuuuucagacauguggacaucuucugguuguucuggcuagagcacgcagccaugcacuaugagaaaaggcuacccaagugacuggucauuucuuccuccugcugagacccacuaccacaaggagaggcaacucaggcagugacucucccaagcagagguuuuaaaaagcuuugucacaaucaucugugaugcuccugucaucaaagcaucugcauuuugaccaagggcagcccuuagacgaguguaauuuuaauuauaaacauucacugaguguauaagacuuucaaaugguguucuccagugugcugaggguuuccaaagucccuuuguuguagcaaacuuguacuuuuuguucaccgcuuucaguaaugguuuucauuguaagccacuuuuacuacugaguucugagccugcuguuguaaugucuccugcgaugaugcucugaggugcuuggggcgccagguguuagugcagagugaauaguuuucuuagcucgugacccaucuaguagcucauggauacauacuguagauauuuuaaaucuuuaacauaugcagguuucuauuuguaaaaguaguuugucacugaaaguuuucucagagaaauucuuuuaaaauguaaauagaauuucuauugauuucaaucccuauuucuuuaaaauagaguacuguuucaguaguuaccagaaguuauuauaacacaccaaguauuuauagcuuuauuuauuaugcccaaagaagucuguugcacuguucucgcugguuuuguaccuuuuacucauggaaacuguguucauguaaagauauacauaugacacucagagauucuguaguuaaagccuugauguaaaucagcaaaagcagaaugcagauagaacacugcagaugagagaaaugaaagagcaccaggcaggugcgcucugugagcgcaugagacgauagauaccacggccgugcuggggcagagucagggcugcaaacugccaguggggagugcuuuacauuuuacagauuuauauaaagaggauagaaaaagcuuucuauuucauguaccgucuguagaugguuucaucaagaugaaugucuaguguuaccuuugagauuuuaugggucacugagaacgugguaaugucucaugcucaaauagcaauauuaaugaaaucacuugaaagggcaaaauuuuauguuccauaaaauuacauaucuugggaaaugauugauucagacuugguucuuacagcauuuaaucuuuguaaccacaucugggagauaaagauuacuccauauuuaugggaaacugagacagggaaggcaaauaaccuguucuaggucccaggauuguuaagugguggggccaagaguugaccagaugagcccaaagcugcauuucaccauuuccuggccuguuaggaaagggcagcagcauugcuucuggacaucauuucuauggacauggaagcaagucacucccaugaugccuuucucuccuaagucuguuaauguaagaauuuaugaacuggaauuuaguuuaauauguuuaauuauaggccuuacagucaaucucacaucugcuucuggucccccucuacccuucuaaaggccuuucugagcucaacgauaucgaaacaggaguacaacauauuuuagcagacaugauugcuaaagacaaagauacgcuugacuuuauucggggcuuguaaguaacuuuucuuuuagcuuucuucuuugugggacuuaugcuauuaaguguuguuagugcuaaaccaguguuuauuuaaaauuugguuuucaggcuuuuuuuuuuuuuuguaguacaauucuuugaucaaacaacugaacccuaauauuuaaaauaguuaaagauguuuuaguuggauucuaagcagggugccuggagcucugccuucuugaccugcuuagagaagggugaccggaugauuggucugauuaccaucuaucauuucagccuccugugaggguagauacuaccugaucucagcuguuuuggaugguuuauguugauauauaaauugaucuucagaguauacgcuaguaugguugcuuguuuugagacaggauuucucuguguaguccuagaagcccuggaacguaccguguagaucaugcugucccaaacucaaaaguuucccugugcugagauuaaaggugaugggcaucauuagccaaauuugguaauagcuuaaguuauuuuuauccuuuuuauauaaauuuguaaaauguaaagcacucguaaauaaaugcuuguuucuuuuuuaauauuuguguauuugaccagguguaaacauagauacauuuguauccagucaucucuugcaaaaguauccucaaaaaaaguaaaugagaaggaaguugauaaguuucagcuuuaccagaauuucuccugcaacauaaggaccauccaccaucaccagguaagaaggcccugcaugcugacagugacaguggugacacuuuaguaagaaccuaagccaguugacuagucuguauaaaauuuguaaaauguugucauaguucccugauuucccaaauggagaacugaagucccagaagaguuacugacacuuaaaaauuuaacagagcugacagugugauagcccacaugacuugcuuuuggcugaugacauguuagacccugcuuccauugcgcuuaggugugaacacagaccguucccaagacaacaguaguccauuuuagaguagaguagguauggucucauuugguuuuaugaaccauagccauuguaugucagccuucuaauuuccucuuucagguuaucuaccuaaguauauauuuacgucuuuuacuaaauguuuucauaggcugugcacugugcagcaugagauuuaacuagcccagaagcaggagagguguuacaaaugacugucacaaagcucuggcuuucuguuugcaaaguaguugucauaaccaguuuucauuauuucuuuacauggcuaugagccauggguuagugucuuuuauuccagccuuaacaacacuaauauuucaugugaagcaggucugauagaaacaggcucccauagauuuuauucugcuucagagucauaacucauuuucuuuuaaaaacuucuuuuguaguaaaauguucacaguacaaaauguacauuguuuaccacaugcaugauauauagugauucacaguugugcaccugcuauccccaaaauaucccaaaauaugaauacuguuuuuuuuucucuuuuuuuuuauuuuuguuguuuuuguuuguugcucuuuuuuuuuuuuucuuuuuugucuuuggguucuccuucucuucccuucccuuuucuuuuucuucuucuuuuucuuuuucuuuuucuuuucuuuucuuucuuucuuccuuuuuuuuuuuuuuuuuugaggaaauuugaugccagucaaauucuguguucuaugaaugcuaaugaugucccguguuguuucauuuauucuuucuauugguuuuaugguucuuuuggguaguuuggcaagguagugguuuggauuaggagacagcaaguguucucccaacaugaaaguccucacuaaucauuuuaaaauguauuuuucucuaucuacauuuuacagcugugaagagagccuaaugaaacuuguuagaauucuuuaccuuuuguguaauaauuacuaaaaugcaacuuuaaaaaaauaugguuacauaaacaugaaacuuacccacuucucauuguaauaugacaugaagagucuucauucauuccacaaauaccucuugaguauuuaugauguguucgguuugauguauugagaugacauagccacugcccuugaagauuugaaauaauucacuauuuuuuaaaagacuuuaaauuuuuauuuuuauguguauaaauguuuuguuggugugaagguuuguauaugcuuggcccagggaguggcacuguuggaagguguagccuuguuggaguagguguggccuuguuggaguagguguggcuuuaagacccucauccuagcugccugaaggcccauagucucauagcagccuucaaaugaagauguagagcucucagcucccuccuguaccaagccugccaugcucucaccuugaugauaauggacugaaccucugaaccuguaagccagccccaauuaaauguuguccuuuauaagacuugccuuggucauggugucugaucacagcagcaaaacccuaacuaagacagucugcacauauguauaugcaccacuugccuugccuggugcccacagaggccagaggaaggcacaagauucuuugcaacuagaguuugaugguuaugagccuccaugucggugcugggacccaaacucuggucuucuguaagagcuauaagugauuucuaggccccuccccuaccacauuuccuuauuaugucuaaaguugcuuaugguaauucuuugugcacuagauuugucauaggugaugaaauagauaauuucaguaaauuuuaaaaguuuaggcacaagggagcuguauuuaccuaguuauacacuacaaauauaagauacuaaaacaguaauuuguaauacuauccgcaguugaggguugaggguguaguucugguaagggguuguagugaguauaggaggcccucgcuuucaguccucaguaacacacacacacacacagaggguauaaaauuagaugacaagaucauuucugcaaaaugaauuuuaguaaauuuauauagucaauggaacauuuuuuagauauacuguguaugugucuaugucugucugucugucugucugucuguauuucucucugugagagagagagagagagagagagagagagagagagagagagagaaagagagagagagagagaauuuaaauaguauuuuauguuacacaugucauaucugaguacuugaauuuaagaaaaauggagugauuggauuuaaacuugugauugauccaggcuucucaagccugacaaaauagagugguuuagaauguuucuuugaaaauuacuccuguguuuuaagagcuuuuuagguuugugugugccagagggguacugcuggguagcagauagcuuucuagccaucaagcaaacacaugagaaugcauggacacauucccuaaaacccacugauacacuggauuaugucaauugacuaaaagagcucaugaucaccucaucuagugugugguaguguguaggauuaugggucuuccaccugccucagcuagagcuggcucagggguucucgggccuucaacaaggcuggggcugucugguucucaggcucuugggugaccaagagccacuggaagcugagcugagaaugaaguuggggcccacaggcugaaucuagccuggggcugggaggaaaauggaaggagccucagcuagucccgugggggaguccuuggcuugucagugguagugggcuugagcuuggcuugguuaugguugggagcacagagaggccuucuaagggagacuagauggcauagacaaaggccuucucuguggcuucccaugguggauccagaugaaaggaggcaguccaugguuuuaaggcauuuauugucaugguggaaagugaaucaguaaaaucauaccccacuucucagggugagucugaaauuaaauacauuuuauaggcauaaaugccugggaaggaaagcuuauugacuaagccuuccaggccucuagguaccuuauuaaaauggagaucugucuugagccuaccugaccacaggucacauccucuacauguggaggggcuugggguguugcccuuagauaaaucuauuggggguguggcuagugacaggggcuggugccuggaaacaggcaaagcaucuaccaucccuucagggucuucuggucuuugaaccuuagcucaacuggggaccaaucuaccuuucauggucccacaguagugaacucugcuuuucgucuucuauguaacugugugagcauaugaaccucaguagauagauggacuuugugacaagaggcucuggggaagcaccgcuggucacuguugucugccagguucucugauccaccuccccuuggcuuuguucuuuugcagauuaguccuuagugagguccugacucuaccccucagccuuugcacccuuucagaagaccucacuugcacccuuguucuugucuguuggcccacugauccacuuccuaugcuguuuucagucuuuuuuccuugcuguuacucucuguaguaauauuaucuacuguauccuacuacauagcucuagcuucaguuuuugccucaagcucugauuucucguguaugaaagaaguaccuucagcucugaguuguugaguguuuuguucaggaagggcugcuaguguuauaagauguuucugagucuagugaggugaucaugagcucuuuuagucaauugacauaguucaguguaucaauggauuuuagagagugugugcaugcauucucguguguuugcuugaugauggcaguagacucccuuggagcuagagucagaggcagcugugagcugccugacauggguguugggaacccaacucuagaccuaaaagaguagcaaaugcucuuaaccccugagccgucucucuagcuucucaucuuaguuuuuaaaaauaaggccucucacagaacaugaagcugauggauuuggcuaggcuggcugaccaguaagcucuaggaugcugccagucuuugcugcccuggugcugucauuacaggcacaagccuccauccccugccucuauguaggugugggggguccuaacuuagguucucacgcuccugugguacugugguaaacacuuuucuaacugaccauuuccccagccccguuagaauuuucuuugugagaaagacguguaacuugaagaaaguauaaacaaauuguuuuuaauacauuccuuuguaaauaauaaaacaauccuguucuuggcuagagaggugcuugauuuguuucauaaauaugaacuccuuaaguuuaucauugcuuuauugacuaucggucuuugucauauguuucugucagauucuggccauuaaccgaggagagaauuugaagauccugaccgucaaagucaacauuucugauggaguaaagaacgaauucugucgaugguguauacagaacaggucugcuuauuggcuguccauaaaauuugcuuucuaaaauaccaacuaauguauaagauauauuauguuaaaaagccagugacaauauuauuuucuuuuuacauuagaaacuuaaguaugggguagagaaauugcgcagucauugauggcacuugucugaguuugaucccuaguaggagauuaccaacucccaaaaguuacauuuuacugucuaauaaguuaauauuuaaaaaaauuaguaugcuucagacauagacuuaaauagaaaaugucugugaaggggauaagagauuauuaaugaugacugucugugaggagagggcauuuacuucaguguagucaugugcuuuauaaacuggcuauugacaaaucauguauaugguugugguuuuaugauuauuauggauuugaaaaauccuuuugcuuuuuaagcacaaagcuaaaggagcaggaagagagaagguaacugcaagaaaagaaaaagaacucccgagagaguucacaguugaauggugacguagaaguuuaagcaaacccuagugggcuuuucaggaagucugaaagccuggaccccagcuccaaaaggcuuuaugcuuucuguauaauuauuauuuuuauuuuuaacuaauauuuuauuugaugauaauuuuauagaauuuauuuugauuauauccacccauuauuaucuuccuuuaguuuccccuaguguucccuacuccauuuccuucccaauuccauuacuuccuuuuucuguuauuguuauuaguaacccucugagccaaauuugugcuucuuauaugaacaugggugugggaccauucacugguguauggacagccuaccagcgacauccuuaaaggagagugacuaccucccccuuacaacaucaaccuccaguagcuucgccaagguuggggaccauccuccuuucaugcuaggguuguggcuggcuagauucugugcagugaucacagcgaugagagcugaugugcaucaaccauggcaugucuagaagucagcaucucccaguuccccggcucccagcuuuacuccucucugcccgcuuugcugcgaucuucccugauccuugagugggggugagaagucaacagaguugauucaccuguagcugagcgcucguagccacugcaacaaaguuuuucugacaaaaguuaggagcaacaccugagugaaaggcaguuuagaaggcaguuuaacaucauagcuguuuaauguaacaguauuaggcucuucuccgaaguuuguggccaccuuagucuuagauuuuugaugcagacaugaaagauuuugcuguguuguguuuuccuuuuuauuuggugcuagaaaucuuuuuauuuaccguuuugauuucuuguauuuugauuucagcuauucaguaauauguuguuuagucuuuaggagucuguauccuuucugcaguuucuauugcuguugauagguaacuugauuugauuguggucagguggaauacgguuacuucgguuuuccuguguuagagaauuggcuuugcucugcuuagcagggccaguuuuggaucauaucuacugcaguagagaguuauuuagacagaaucaaguauggaggcaagagaugaugguaguuuagacucaggagcuaauggugggaaguuguaaguacaauugaacacucugcaggggcagaauuuagacaauaucugauuaaaugacugauagauuggcugggccaaagaguugacacauuuguaugacuugaacaagcuagaagaugacacucuuuacugucacaaaauaaaaauguugcauacuauauaauuaugguaugaauggguuaacugaaaucuuguuauuaaguuaauuacacuagcaaggauugacuguguauuaaaagugauauguaggucuagcccagcaguggaacagucccucaguuggacauguguuucuuguucacaaagauagggaugaagaggacccugagcuugucagacacugugagaguccaguaauccaaguuucuguguucuuuaaauaagaacaugugugagggaaugcuuuuagcgcauccaacucaugacuuggauuguuuggcagcagguccauuuugaauuugcaguguuguggaguugaauucuagugucugaacuguauugcuguuuuucauauagaaacaaguuuaagggaaacugucuccuguagccaguuguguaaguguagagccaugaaggcuagcugaagagagcuugccauugucuuaccuaggagaaguaagaaaaacauauuucuuugccagagugaaggcuauuucucuauacaauggcucaacaaagaauuuucuugucaaaaauaugcaguuuggggcaugggucuuuucaguuauugccagucuuuccugccucgaccuuacaguauuaaaaguuuguuugucuguuuaagauuuuauuuauuuauuauauguaaguacacuguaguugucuucagaugcaccagaagagggcaucagaucucauuauagaugguugugagccaccaugugguugcugggauuugaacucaggaccucuggaagaacagucagugcucuuaacugcugagccaucucuccaguccccaguauuugaaguuuuaugauuccuguuuucauuauauacuuuauugaaugaaucucuuauagggaguauuuuguguugugaaauuugggguuagugaagacauaaagguuuuucagagguauguaccuguugugucacaagaaguuacauugaaaugcauccuauaaucaagcauauugcauugucuaaggaugccauaagggauaugacugaguuccccgagcgauuucagaaccuuacuuugcuaagugcuguaacuaggucccaggaagacaguaaaggggcagaauuguugcagaaggaguuaaaaggaguuuguacagugcuuggaauaugcauagcuguucucugcaggacugagccuggugagcugagcacguguaaacaaugugaugcguaucuauaauauaaacacacccacaguuucuucacagggagaagagcacagugcucuaagcuaccggagcaucuuauggcuuaaaaguuacgccagggggugcaguuuuaagaggacagauaauaauuucuagcuuuuuugaaaacaguggugaaacuuuggagcuuaaagggaaaccauucuaguagacaucagacauuggauguauacuuuaaaaagacaccacuccauuagacuuuuugugucuaagcacuguuuuccuggcuuaugguugucuuaugaccagaacuauguucuuccaaucagccagccuccauugugugacauaugagacccuucaugagcugggcacugccauauuuuuagucuugucuuucugaauugauguugccacuuggaugccccagcauuaugaaccuguguguauauagcuaaagcagcugcguggcucagaucuugcugcuagcucguacacugcacugcucucauccaugcuuugggugguuuauguguucaucuuuuuagauuucagggguuuuggguuuugguuuugguuuauauugaacauguguuuauuuuauuuugagacaggaucccauguaguccaggggccucacuguaacugagacugcccuugagcuaaucuucuugccucaaagcucacuuguguugagauagcaagucuauaccaccaggccucgauaaaacauuugucuccuugaaagcaguaugcugcacuugguaucacagugaccaaaacauucagcaggaacaacugaagagaggaguggcuuauugucaauccaucaggacagaaccauuucauaugauggccagggagcaguagcuagucucauagccucagacaaggauguggugagaguaggcaaggagcaugggaaggugcaaagguccugagucuaccacgugaccccuuucuccagccaggccccauuucccaaaggucccacacccugcaaaguagugugcaaaguggggaagcaaaagugcuugaugucuaaguguauugggagccuucuagguuuaauaacaugggacuugcgugucugauucuagcccacuuccuucucaccucuccugaagggaggacuguagggagugaaggagaguuggguggaaagaaggauguugcauaugucuuguuugaacuggaaaccaaaccuaucuauugcugaccuaacacccuucgggagggauucgguuauuugccuuuaugugaucuuuaaugugugucugcugagguucaugugcauccuagguuguggagaggcgcucaucucaggagcaucagcuuuauuaaaaaccguccaugcuuuguuaauggaagaaggcuuugaaaggcaagggcacacaugcugggugugaauggaaaccuggagccucugggcuggggcuguuccugauagcucaucuugucuuuuuucuuuuuccuuuccccccuccccuccccuccccuccccuccccuccucuccucuccccuucccuccucuccccuccccuaucuucuccaguaucuagcugguucuguucagcuugcuuacaugcugcugggcaggcaguguggcccaggcaggaggucaguuuccaaaacggcgccaagacgcuggagaugcucuuccuugcuuguagaauggguuaacuuugguuuuauggcuuaaagcuaaaguaacuaagacuuuuugaaaguauuucagcaggaucugcugcaguuuuguuuuaccuuguuuauuuuuaaaucuugucaaacauuuggauagcacucuccacugucccucucaucugaggguauauggggugggggcgaagagguacauaacauaacauaagccccacuguuggugacaugaacauccugaccaaugcuucucagcauaacuguaaaaggggagugugugaggguaaaguuaggagcuccaacguggcugagaacagagggagaacauaacugaaguacauuggguuuuugucauguaagauuuaagucaaaguuuacuaccaagaaaaggagaugcuagaaacaggauuugacagguucuccucuauacagucucuguugacgcuucauagacagacgagauaaggagaugggaaaagcugucacagacauaggacacuguagacugggguccaggaacaacaaaaauuaauguuucacagucuuagagguauggaaguagaagaucaaggagcacacaguuaaguccugcaugucacucugucaugccacagagaguauagggagacagcaggcucuacuguaugacuuucucuaguguggaugcucuccaaagcccuucuauagaugccucacucuagcuagagccuggggcuugcacauguggacuuggggaaggcggugcuguuaaggauguuuugcuaucuuugggaugucuuagauguuuagccuuuacuaguaacacuguggugaggacagucacagcaaauguaguuuguguacugaauucuagguccuguagugagugugaggcggggagagggggagagggaaagggagggagagggagggagaaauggagagagagagggagggagggagaaggagggaaggagagagagaggaagggggagagagacagagacccuguuucaaaaaaucaaaacaaaaacccauaaacaaaaugacaaucuccuccucaaaaucuccccuccacaugucacauaaucccuuucagacaccaagccucaggacagccccuccuuccagauaauguuauaaaggcucuaccugcucuucagcuccccucuuccagauguccuuuccugcucucugucccuucaguguuguccugaguuuuuccuucuuguagguggaggccacguggcuuugcacggccagaguugaugaagaucuuacauaauucacuggaugacuccuuuaagcgccucauuguuccucuccucuguagagaguucagguauggaucuuguuuaauuuugugugcuguuuagcauuauguacggucuucaaagaguacggaguaaaugcuuguuaauuugaaccaagccaaagaaguugaccuucaaaccaggucuucaguaugagccuugguuuuaaucuguagauuuagucucacgcauaggucaguauucuucuuaauugugauacaccuuaguccugaaugcuuaguguuuacaccgcuuccacuucuacauuguugauguuucaguuugacaaucaagccaaacaugauuuuauugauuagagaucugacuuggaaaaacaaacugagaaguuaauggagagguuacuuggaagcauuuucuggagguaauagagccaaagaaagcauagggagcuuggagaguaaggaacagggugaucuuagugcucugaggagagagagcaguuauguguguucuucucccagggggaauuucuggaugagcaacagcaagcacagaugaggaggugauugcaagaaccauaccagcaggcuccaaggaguucugugaggugcagacaugcuuaggcaaagagaaugaaagagucacacagcagcagacucucucucucucuguucucuacuguugucuugguuguuaaguugcagcgaccagcauggugucacauagucgguccuucguguguacggugggcuagcacaugcucauccucacucuuccagguugccugagaguggugcggcugcacccaucuggucagcucgcuaggacuucuagcugacugggacuuuucuauuccugccuuguaccuuugaccuuugaguuccaaguaggagugaacauuauaaagaugaggugcuucauugcuccauuucugcuguuccaugccacacugucugguuucauccuuuguggccuagauggccccuacagauacuguucuguuuggaaaucugugucgcccgugugaucugaugucucuugguuucugugcuguggcauaaacuugagggcuuuguucuuucauuuguucauuuacuugugugugugugcagguaucuguguaugugucucugugugugaguguauauacauguacauacauggugcaggugcuugugugcagaggcaggaagagggcaguaggugcccucuauccucuguaccugcgucuugugucugagcuaggcuggaugccagcaagucuuacacuugucuacgcccugcauggagcuggggugacaggcauuaucaggauacucaucuuguuaugugggugcuaggauccaaacuuuaguugccaugauuaugcaacuaacaugauuagcaagugaacucuuggggcuuauucauucuguuuugaaggggaaaauaaucuuauguaaaauuucaaugugguacuucuuuuucuuuccuugauuucuucauguugcauucagcauccagugguauuuugauauuuuguuuuauagcauguggaaugauuucauugcuacuaagcuguguggugugagauucuguaggacacaguccuuuuuucauuugcauuguggguaagcaagaacauguucuuuuuuaaaauuguccaagguaaaacagcauagcucauuucuguucauagucugcaggcauugcccagagcugggguuccuuagaaaugcuuaucugagcgguagugaagagggcagucaaagauugcuuuaccaguauuuugaagaaaaauauuuuguuucuuuauuucugaagaaauuuaucauaaggauagaaaaaauugauuucuaguguuuuuguuuguucgcuuuguuuuuauugauacuucgaaucugggcucagcuauagucacaggagccugccgucagcggacauuuuccaugggugcugaggcucugagcucagucgcuccuuuaccuggugagccaucucacugccccaagugaccuuuuaaagucccauugcaucauuucacaguagucuacuuaaaaccguuccugugagucuugaggcuauuuagaagagcuugaugacuagguggaugggcuucaucugucuccucaguguccgugucauuucuuuuucucuuagccuaugaaaucacuuucuuuuucucuggacacugugagccuucuguauuaguaaggguucucuagagucacagaacuuauggguagucucuauauagaaagggaguuuguuaaugacuuacagucuauaguccaacuccccaaaaauggucagcagcagcggugaaugaaaguccaacaaggaucuaguaauugcucaggcccaaaggcaagcagaugaagaagagggaaccuuccuucuuccaauguccuuauguaggucuccagcagaagguguggcccagauuaaaggugugugccaccaugucuggaucugggacuugcuuugucccaguugaccuugaacucagagaucuccuugccuaaaucuccugggauucauagccacuaugccucaagaucuccaugcugagauccaggccagaaaguuguaucucccugccucaaguucuggaucacgggugagccuuccaauucugaauuguaguucauuccagauauagucaaguugacaaccaggaauagccacuacaauccgccccuugucaacuugauauaaauaauaccuuauguccacaugaaacaauaacaaagucaugaauaugccugacaugauauaaauguucuucauacaaucgcauaugcauuuguaaauuuacaauggggcaaugucccuuaggaacauucuuuuaguaucucaacuuaaauaccaauugauguuaaaaagaaauuggaagaaagacaaauguguucuuaacaaaauaagacagaaacauucauauuacuuuauaaucuucauuucugcaacuggucacauggccuuagcugguauuuauaaauaccuuccucuacuacccauucuguauuuccuccacccucuggaaacaccucagcaggucuuggcucuucucuuggaggaguguugcauagcuucauuccugaugggucuguguccuuugucagccugcuuugauuaggcuguuguaguuucccauugacuuuaaucacaggacuaagagacguccuaagggaucuccugcacuccacacaucauccuuccuuaccuccauugugaagagguaauccaauuucuccaugguaaucuggaucuaucaccccuccuaacgcuuugauuccuuuucuuggccuguugguuuaaguguauuagaagcccaaaaugacugggggaagucugagcuuccaguucaauggaauuuuguuguggcuccugguaggagcacuucccccucuggaaccagcaaaaauuucccuagagggucacuaggagugauagugaguggaacuauucccuucuccaccccuugauuccuggacccauggauccuggcuaugggagaaacuguaccauauaucggacguugauucaaagcauauacugccuucugaagaacucugccccagcccucuacacugcugccaccuaauuggcacuguaacugcaucuucaaaaggccauuccaucuuucuaucagaccagcugcuucaggaugauggggaacaucauaauacccauggauuccaugauagugggcccacuguugcacuuuucugguuguuaaaugaguuucuuaucacaauacugugaaacaauacuguguggacuaccaugacgauagauaaggcauccugugaguccauggauggugguuuuggcagaagcguuaugugcaggaaaggcaaauccauaaccagaauaaauaucuacucuaguaagaacaaaacgcuguccuuuccauggaggaagugguccauuguagucgaccugccaccagguugcuggcuggccaccuugagaaauggugacauaucuggggcucaguguuggucucuguuguuggcagaucuggcauucagcagcagcuguauccaggucagccauggugaguggaaguucauguugcugagcccaagcauaaccuccaucucggccaccguggccacuuuguucaugugcccauugaccaaugacagggauggcugggggaaagaggcugacuauccacagaacgggucaucuuauccacuugauuuuugaacuccuccucagcugaagucaccuucuggugagcauuuacaugggacacaaauaucuuaacauccuuugcccauuuggagagaucuguucacauacuucuuucccagaugucuuucuuccuucaagagggaaaaauaucagggcacagucacaaucaaaauaacaaucaaacucuaaccguuuaaugucugggauccacucaaugaucuucugggcuccuccaaggguuugggucacuucucuagcucugcccuuuguagcacacaccuugucuucuaggcuccagcugccuguacucugugcugcugcuguucuuggugguuaucuaaugguauuggcaucucuaaaacacugcugucuuaugcuacaacuaggcuucaccaauagccucucauaggcuuucuucauggugccaaaccucaacuucuuugcaugaauccuuuaguccuggaccaucaauuguaccugaggcugcaccuucacuaauggccuuccauggccuuucacagugcccagccucaguugcucuucaugaccccuucaugccuuuaaaaccaguaccaccuggguggcucuuauacauuaccaaguauagcugcaacaugagguacaaccuuggcuaucucuggagcacccuacuacugguaccaacuucugaauuagucaggguucucuagagucacagaacauauggguagguagucgcuauauagugugagaguuuguugaugacuuacagucuguaguucaaguccccaauagcagcaacuaugaauggaaguccaacuaugaacagaauggaaggaucuaguaguugcuuagucccacaaggcaagcaggcaaagaagagggaaucuuccuucuuccaauguccuuauguaggucuccagcagaagguguggcccagauuaaagguaugugccaccacuccugggacaccuaugccacucuccuuaugugcagugucucauccagguuaucugucuaauguccccaccucuguuguauguccauuacauuuccugucucauucaccugagccacuccuuguguagguuccuccugaguuagcccuugucauugcuauagucugcucugucugucauucuguaccuuccaucaugguggucuucugggaaggguguggucuuucaguuuugugucucuuaaaacaaucuugauaagucuaccaaccaaugacuucacaauaaaugaaguucaaaauaaagguuuaaaaacacuuguaaugauauuacaaguaacuuguuuuggagaagucagagaauugcaaugaaauguuagagaagaugaauagacaguagcaugugcaucuucacacguaucuaguuaacccuucccagacauaaaacauauuuugaauuacuuuguuuuaaguuuucuuauggccaauggcauuuguuucuuauuuggucuaauaggaaagaaauacuucuuaugacauaauucuuuugaauuucaagagaugauacauuucuucaagguuccagcuaucuuuaagcucauuauugacuuauauuuuuauucuacaagguuuuaaaaguacacucauaacagugucuggauaaaacagagacaugguuauaugaggccugauucuguaccaacucuuaggaacuauggcguugccaaaugacaggggguaggggauguggaguggaacgcagacaaagacauugagauuacugaacuaaauaacacuggaagaggcugcugugcugccaugccuugucauucuuguuugugguuuauauuuguaaucaucugcuaggcuuuaauuugacuugcaaaucuucaaggcucuuucucgugauuguacauauuuaacuuaaaauuuguaucugauggagcaguuguagaagacagguaugaagauguagacaguuugcuuuggaauuguuugugguguuauauuucuguggugagcagaaguagacccagugugacucagggucaggauguuucaucccugaagauugacuacacaaaauaccuucuguucuuuuuucugagaagagaauuuggaugaaugaaaaucuuaaguacuuuuuguguugucccccuuccccucuauuucuaaagagccaaacugacaucagaugcagagaagcaaucaguaaugauguuuggacagaaccuccgccagcuccuuuuaacaaguccugugccaggccgcacccugaugggaguagauccuggcuacaaacauggaugcaaacuagccaucauuucuccuacuaguaaguucuucaacuuuucauaugagagcuuuuugguugauccuaaauuccacuucauagauauuguuguuuagaaauuguuuucucacggggcuguggggaugagagggcuuccuguaugucuggucagaacucucaucaugucucugauccccucucuccauuagcuaguguuagugucaggcugaacuccuggucuccucuuuccuucucuucuguuuuucuccucucuccucucccucucccgcuccccuucgcuuccuuucuuucuugacacaguuucuuguagucaggcuaccuuuggugcucuugguggcugagaacccugaacucaggauuucuucugucucuccugaaauuuggcucuguaggccuguguuagcgcaucuguguacguagugccuagcucuucaagcccaggcaaguauucuccaguugcgcucuauagaaccccuggugcugagacuugaacucauagcucuuaucaacuucaacucuuuauggugcauucugauuuuauauacauuuuaaguaucagauauuuuguagcugugaauauucaguuaguguaguuuuccugucccauguaguuagccuuccugugacuccuuuccauacuucuguguucucaguugagaaaucuucaugucugaaaaguuccaugcuacuacuuuuuucuucguuuuugagacagggucucucuguguagccccagcuacccuggaacugacucuguagaccaggcuggccugaacucacagagauccgcuaccucugccucccgagggcugugaguuaguugacaaaauguugucucaguuuuuaucugaaaaagcugcucuuguguucauuuuugaagauuauuuucauggguagauugguuaauugguaguuacuuaaagauauugucccauugguuuuaguuuuauuguuuuggcugauaacuuuuuuuuucuuccucuguaauucgucuagagacuuauagguguuccuucuggugccaaauuuucuguuuguuucaaaguuuuuaugugauauguuuaacacugugaaugugucggcaugaauuccauuucagaaggccauuauguuaauauauuucucauucuccuuucuucuuuuucaguguuuuacuuuauuuucuacugauuaguaauucuccagucuucucuaagcuguuauuaaaucugucuguuugagucucuuuauguaauuuuuuaugguuugauauguaguuauacaugauaaugcucuuugauauguaguuauacaugauaaugcucugguaagcaucuucacuuuauuuugucaucuuugcuaucucuuugcuuugcuucucugaggacaucuguuuucugucccuuggcuggguuuucaucucuggagugcugucuccccacucacgcuguccugcgcuggccugugcugcccuccuucguauugacucaggguugguacaugugcuguugaauccagacuauguuuucucuuccaucugaaaucaauucuugccauuucauucaugugguuuuaugauucugauguauauuaaccucauagguuauauaauauucuuuuuuuuuaaaaaaaucucauuuucauauaucguguucuguuuuguggguauauuaugguagacuuuuacuuucugccauaaggaaaaaaaaaugugucuacaguuugcccaucauccuuuuguuuugcuuagguuauguuucuaguauuugagaaggugaguugggucgggacaggcuucucacuguguaaagcuuacuuugucuuauguuuggugguuauuagagaugucagcuggagcuggccgaugguuuuuggcguuggcugucugcugccuucuccugugugaccuggguccuuugcuuccucuguccuugccuugcucacuuagaccugauucuugcucuuucuuugcacucuuacaguuugucuucuuuugcuucaggagucccugagggucaguuuuucaguccagaaggucacugggcagccuguagccuggugggcuccaguguuagcuccucagauugacucuugugcuccccgguaugggaacucuucccuugggccaucagcucugcccugccccucagaugcuuccuacagaagucuuugugcugugcugugcccuucccagccgcuugguauuugcuuuuggaggacuuuuuguuaccuuugucacagguacagcgcgguuuuugcuuuuuguuuuccuaguugucauuuaugcuauuaauguuucccacaugggaaggaucagcaguagcaggauuuuuccuguacccacugagacgcuugucccuuccugugucccuuacugugccacugugaugauuauaguauuuggauuuuccuuacuguuuuauuucuuuaaacaaggcuuuacucuguagccuaggcuacccuuaagcucacuauccuacuguagcuuucugaauguugggauucugugcccugcuacgaguuuuguuuagagaaugucugauugcauauauuuuaaagguaacuucaacuugaccuugguaccuucuucuguacaugcugguauguuguaucccuaguuauguagcuucuuuauuucuaguauauuuguauuuuccuuuccuuaauacuacugaaagcauuuuuucuuauaaauaguuuauuugaaacuuaauugauccuuucuguuguaguuuuuccuccucuuuuuuuuccuuaguuaguuuugaagggcugcuggcagagaacuugaggcagucuccccagagugucugcucaguccuggaucacaucacuuauuucuuaccccuuucuuucuggagguuaucccgugacucuuacuaauuuccuaucaucuuuacauauuucauucauuucucuucauugagggaucacccugaaacuucuauuucaguuagaaaauuuauuuaaaaauaaaguacuuuauguaaaauauaaugccaagauagaaaaagccugaaguucuuaaauauauagcucaaagaaauagaauaaacaaauucauauaucagcaacugaaaagaacuagaauaucauggccgagccaggucuauucagcagguagccaggcagugugagcuguggcugcugcccaugaugaggcuggcuuucugaaagccuuuucuccugaaggcgccacagcauaauguccaccuaguaauggucucguguuggaaaguggagcucuuuuacuuugaauccuuaggaagagccugaucuagugacugugcaugcaucagacuuuaguauccuauuuuacauuuagcucgugugcguguaugcauguacacuuguucauggagggcagaggagagcuugaggaggucauuuguauucuacugugugggugucaggugucaggacccaccugaggguggcaggugugggacaagcacagugacuuccugaggcagcucacagacccugagcuugcauuuuaaaagauaagccaguuacauuuucuguugcaacuuguuuaauggaaacaguagugaguucuggucugcaaaugucuuuuccgcccuuuaaggucagauccuucacacggaugugguuuacuugcacuguggacaaggcuuccgagaggccgagaagaucaagaggcuuuugcugcauuucaaguaagaaaaucaguagccuguugaguaguuaguggcucggcuaaucacaggugcuuuggaagcuccuaauuuggagugugggauuaugggaaacacccggggagaaagaaagccccugugcacagugcugggggaaugcugggaacguacacggagacuguggugggauacuuuuccucucuccgccuccugucaaguggaggagaugcugugguacugggagauccuuccuacccccuccccucccuuccauucucuccugaagaagggauauugcagucguuauuuaguuguguuuauuauaguuuggaauaagcccgagguuacuccuuuauuuugacucuuuguagaugagaagaaagcugccugacuguccuuaagaugacaguaaacuguugcucugugcucuccccucucccuuaccaaaugcagagugcuguguagucuagagcagaggagagguuguguggauacagacgagaggaagagcugugucuagcacuugugcauucugugugcuuucucugguugacuucagagugugcccgagacucauccagguucucauucuguuuucccuugaagcugcagaacaguggugaucggaaauggaacugccugccgggaaacugaagccuacuuugcugaccugauaaugaaaaauuacuuugcaccacuggaugucguuuacugguaaggacagaaggaagacuuguuucuugaaguguauaggaguuucucaggcuccuuuugggaugaguuuuccuuuccuuuuugaaaauauaugucuugugugccucccuaacugccucuggcuauuaacaauaauguugcagauugaaccugagaauuauuuaaaaaauugcuguuggaagugaugguauauaccuguaauccucgcacuggggaggugguugcaggagaauaucuacaaguugagggcagcaugagcuuacacaguaagacccugccucaaaaauauaaaaauaaaaguaguuaaaacauuuugaguuugaucuaaaugugcucauggagagcaugucuucaaugagcuuuagguauuauauaauauaaggaaaaaugaaccaugaugguauaaaaaucuggaauuauuaaacuugauggaauaaaaaugacuggucucuaaacagcuauacuuaagauaaguccuguaaaagccauuucguguuuguaguauuugagcugugaguuacuagaagugagaaggcacauggauuuguaguuuuguguuccagagacacuguagaaauguacaguuccauuguacuguagaguggcugugccugacauacaguagugugucguucacuguucauuuuccauucccucuugagaauaucaggaaacuguuguguacagguuguagucuaucccuguagcugagcagccguucaggcucuuguucuaaugcaacugucacagcgcauuagccccguaugcuugucuguuugcucagagcuauuugcuagcacuuuaccauggacuugugaagucucuaaguguugcagagaucuaaucagaacuuacagugacugcacuaggaaaaucagucuuugauuucguuugcugucacuggucaguuuaaugugggaccuuccauuugucuccaugcuuucucugucugucauucuaugugcuuucucuuauguauuuucagaaucuugccaaucugcuuuuaaaucuuuucaaaccguccuagugaagccucuaguacauuccucguccgucuggagugcuuuuuaucacgauuugcugcuuaaguuaggaugcucugugacuuacagcacaccuuccacuuauaucacagccauucaccuucuuucuagugucucuacuccuacccuugaaacacuuuguaaucucagaaacuucuccauacucugggggaaaaaaccauccaggcuuucaaaucauaacuauaaaggagagaaaauuuuaagcuggauccaagaggcagaguuuaacugggauuuagucagucacuuacauuuaaaguugaaagugcaacugaaaauguaagaguuacaugugcucuuuuaggaguuacaucugcugagccaucuguucggccucuccacuuuaucuuuugaguccaagucucaccuaaacuuggagcuagacacuggauagauuagcucgcuagcaacucacugggguuuuccuguuuccauccaaccuugcacaggguugcugccuuugcagcuguguauggcuuuuacauuaaugcuaggagucugcacacagagccccauguucagcaacaaguaccuuaucuacuguagccugcuaugaauucauucauacuuauuaacauuaagcauuaaacugguuuugaucacauaaaucuuuucagcuauugacuagacuuacaguagguugaaauaccucuuuuauaaaaugcuuggaaccagacauauuuaauauuuuagauuuuuuuuuaauuugugauacuuccauauauauaaaaacauguggcuaggacuugaacucaaacaugagucuuuuuuauguucuacauaaaccuuauacacaaagcccaaagguaauuaggcaauauuuauaaugugcuuaugcuuugaccaggaccuaucacauaaaaccauauauggaacuuuuuacuugugucaugucagcauuaaaaauuuuuagauuuugagcauuuagguuuuuauagaguuaauauuuucucaagauagauguugauuuuaucaauaaaauuaugauaugauaguguugucuaauugaauuaugaaaauagauauuuuauaugaaauauuuaauauuugguaucuuauauuuuaaacuccaauugacaagcuuuagaauaaagauugcucuaaaucacuuugucguguauguuuuggagcaucauagauacaugaagucacuccaaacguggugucuagaaauguagaacaguuugguuuguucuguggcuucauuuguuuauguuucugugcugaaaacuuuccuauacacauggauguuagcaggcagaucucaaaagaaauaagaaaacuuuucagugagcacuuuuauuaggaggaaugggaauguauugagaaguacagugugcagugcaagggaggaaaggggggugcugugggugugggugugucugggggugugguuccaacauuacauguagccucgguuacugagggacagaagcgacuagaucaugcuaggagaaaagcccggugguagacaucugggaaacggacagugaugcucauucuucuuucauuccaguguguuagcaacuuuuaauaggaagaacacauaauuuaaggaaucauaaggcuuuuuugcuugagguaaguuuauguaccuucuuccagagauuaacaauuauagggaauuggaugggccuugaaaggucaacucccuuguggaauaaauagaucuuuacuuuaaguugaaaacaugaagcuucuuuucaaaacugaaaguaaaguucauguuacugaaguggaaacuuaaaggcucuuugcaaagucgauugguugguguuuuauuagggcaaacaagugaaggaacauguuuuagcucaaguggacacacaggaaaggcuaaggcagacucaugaagggagguuuagcugaagcagacacaggugaaaggaugugaaggauucuuuacuaacaacauaugccuugguuugccuuacacugcguaguugggcuucauuugucgggacuccauagaaacacaccaaaaaacuuguggugaugugcugcaguuucuuucugcuucuguggauugguagagcgaugucugcugagauagacacaugcugaggcaagaccuguggaggacacgugaugauuggagagaguauaaacagggcucgaugaacagugauggaggcugaacuuagcuugcuuauggaccaagcuugcuggucuugucuucacugaucuuugcuucucugagagaggcacagcuuuuauaccaguagggaaaacuuaaagauaaauuugcauggauuuuauauauggcaugugauuuagugguaaauuacacauggagaaguaaaagcaaagguuguauagaggggcaagaaguacagacuccagguacacagagaugcugucucugugaucuuaagccacucacauugaaggaagguguguguauauuaauuuaucugugacuuuuagauuucuguucucacuauucuuacaugaguucucuagagcuguguuuuucauaacauagaguucaguccauugguaaaaguucaaaaacauuuuaauugagaagaacagaaaauggagcccagacaucauguccugacugcuggauuauauaugugcagacaugaucuccugacugcuggauuauauaugugcuggguuguagugugugcugggguauauaugugcuggguuguaguuugugcuggguuguagugugugcuaggguauauaugugcuggguuguaguguaugguagguuguagugugugcuagguuguagugugugcuggguuguagugugugcuggguuguagugugugcuggguuguagcgugccgugccuuugcucuucucaguggcagggucauucagguuugaggaucauugcuacaggaaaccuagcaaccuuuuaaaagcuuauaaagcuugggaauugcugagagaaaaauuggcugagcaggugagcagguuuuagaaauagaauuggggcuacuuuguaagaugacaaaagagccucguuuugaaagaaaauaggaaaauaaugcaaauagcacaagauaugugacccagacacugaggcugcaccuggacaaccaaaaccacaauucuuuccaaacuuuucugaaauuuuuaaauuaagauagaauuuucucagcaagauucuuugugucauaaaaaccuuucuaaauauuuugguuauuaacucaugucaggguuuuuauugaaauuucacuguaagaaaaagaggcuucuaguaggccaacugagaugaacuccuaaaaguagacuuuuauucaaaagagaauauaaaaguacuguuguagaaaaccaaaacuguuugggugacugguucuucaaacaagucuuagauccauuaccaugggucaggucauugcauuaagggguguauuuagaaugcuguaauuuguguguguguguguguguguguguguguguguguguguguguguaagaguuugaauuuccucugcuuaaacuaagauuggaacaaauuuucuuuuacacucaaacauuuucuucugacaucugcuaguguuuaguaucugauuuaggucuuauguagguaaucaugauguuuuauaugcaaauauuccaucauguucugaagagaguacauugauuuccagggcuuugccauuaggaaaaagaaguuaaaacuaaaagugaaagccaauuuauauguacugacugcagaccuccugcaagcgugacuuuuacaaagacauaaaaaaaagcugaaaaaguauaaguaaccaaagauguuuguuaagaggggaaaaauaguugaaaauaguucuuggagacuaaagcugaagguuaagaugcauuacccuuucuucucugagugcuaacauaacauagaaggcuuuuaauaauuuccucagaggaaagagguaaguggaucccacugcuucuagauagauucucauugccuuuggugaauggccagacaagggagaauugcucaccucuccuucaggucugggagaaaaaaaaugauuuucaggcuaaagcuaggaaugggugucgcagaagaagacaggaauguaauugaaaugggagcucucugagauaaggguacuaguuuuuacuuuaucauccugugcagaugaagcaucuccugaugcugugggugcacuuaugaugacaucagcaaagcacaguguaguugcugaggagugcugggaacuagagacagaugguugcucauggccuguuccaaagaagaaauaaaguucugaaaguagcuguuggguguguucuugucaggcaaaaugguuguaaccucuggaagucagugugcaccuagaaauuaaacacuagacuagugaacacuugaucucagccacaccccuucauagucuuucuagacccugugagugaaccagagguguggcuaugugacuuccugaggaauguugauuaaugucugcugcaagggccucagugccuuccuuacacacacacaugcacacacacacgcacgcacgcacacacaggacugguuacuauagucagauuuggaggugugcuuuucaaaucuguggacacuagaaucugcuaugaaggccuugguuuagcuacagucuugucccgugagcugucauuuggaugagugacuccuguggugugagacagggcuccauuagauucugaagggaugauuucugaggucuccuugauuucugauugugggcgauucuuuuaaauaacacgagccaucugaaccuuuuccuuuaguugaaagaaauuuacuuucuaacaaauuacgaaacuucacuguacagcccagauguauuuagcuguguaaaacccacaguguuuugaagucagcacuguuuuaugugaggcaauguggucacucuuauuucuuucucguuaauguagcuccuuccccucuuucuccguaauuacgaaggacauccuaugaugucauuuuguaucuucggcugggcucaaacuugugauccucuugccuuagccuuccuaauucugagaccacaggcaugugguacuguggcuggcaugaauuacucuuagaaaucgggauggccucaguuguuuuaugagucucagcguggucauuguaagucaggacaaggugaagugaugagguguuuccauucugcaugcucuguaguugcaggcugggaagauguaaggcccuguagaacuuuguuuccuuugaccucucaguauccucuccuuuccaacacuuggccuuaagcacugggaucuucuuaauaaggccucuugcuggaauauuugugcuauucaguuaaucuaaaaguaaauucauguuccuuuuguuaaaaggccagaaugcuuuuaaacauauguaguuaaauagacuguuucagcuaaauagagugcgaaaggggcauaaggaauacauaauaaggggagagguuuuuucaaaauaauguuuagauuugaauuuaguuugacagguuuugaucaaaauaaaauguguuuuaccaaucuuguaacccaugugcuuuugugucuccaaguccaauuuaaauaucuguaggaguugccccaacccacccuuaacuacaucccuucuuguagaucucuguuuauugacuuagauuugaacuggccuagagcccagagauggucacuuugcaucuuaagguuuuugguuacaaaucuacuuuuguugccagucccaauacagauucuugauuguuuuuguuaguuuuauuguacguucuugccaaagacacaguguaguauaacuaaagcagauguucucuuagacaagugcacaugcuggaacagaauguagaugucaauuaaacagcagacuguugagcauuaccuuaguaagugauggacuuuggaguuuuguucugauaaucuuuagguuauggaagaaauagugccuauuuugaacaguuauuaauauauuuuucucuguaguuucaauuugggcaucuacaauuuuauauucuuguaaacugacaguuuacugugauuuuaaaauaguaaagaauucauccaucucauguuuauaucugcuucuuaaagcaucuauaucagauaagcacuacuucugaccuggagauguuaguagagagcaguaguuuuaaagacuaaugcuugugaauagaugaguggacuuacuaucuuuccagugacacucacuauucuuguuagugcugggagccauacuaugggagauggagagccugccuuucaggacuuucaguagcuaucccuuaggguccaaugccaucugugcuagacucuguguuggggggacacaggcaugcagagcaccuggacagauaacauuaagucgcuuuagcccuguugguucgugguucccaugugaauucaugugagggugagugguaagucauagggaccauuuguacugugagaugugcucggagccccuucuccuucaugguuuguuguuguuguuguuccccugugcuuuccguuuuccguaaguuuuggccagcacuuugaaaaagaaguguucugcugguuagucaggaacauaucaauuauuucuuacagcuccugucugggucacagagugucacuagauucuuugcuuugcaauuuguguuagcagaauucagaaauguaacaauucuuugcuacaauccuuuucauuugcuucugugagacuuguagauucagggaccagaaacucagaguugaaaauaagagcucuuaaauccaccuuauuuguguuuuuuggcaugcuauaguuuuuuuuuuuuuuuaauucuaauguguuuuauguggcuaaaucuuuguauuaggaacuccuaacuuagugaaauaccacuuucaaguucccccacauccgcacauuucuaagguuacacccaacuuaauucccauugcuuuucuucugcuucauagcacuugcauauugaaggaacccuaacauuuggguucauauuaugauaaugagguuuccaggacguggaggauuagaggugucgcaggucuccuugcagaagaaaguucagaagcacuugcaaagcuugccugauuggcggguugagaugcuuuuauuuauucacuacucaugcagcauuaauccgcauuucaucagguaccuacagugcuguaauucuagacaugaccuuggaucuugauuuacuucagcucuguuuucuuuauuaaugugccaugaaagagguacaugaaagauagccaacaucaaagcuccuuuuaaaguaaaaugguugauaggaauucccugguauuuaacauugucugucaaauguuucagcugguuugcauccuuuuacaagcuauugcuugcugcacuaaaagaaauuuaaagcaguugucucaaguguucauggggugaggugggggugggguaguagggauggugguggcgaugguagugaugaggacugagucagagaggagagaggauaaacgagagguacgagcaugcucuuccagcuugcuucuccugcucucauuuuauguuuccugcugugccgagggcuuugagaucagagugcugcggucauucaguggagcaagcauguaccuugguuaucagaagguugaagaguggccaaaaaaccccucagacuucugugacagacuaagaaaaaggcgaugcuaguaucuuuuccagagauugucuaaacaauugagcucacagcccguuuauaauugaauacuucaugggaaacagagucugaagaaagugggauccagagaaggcuggccauguguugcuguggacuauacuucuguagauauaucguuuagaagcugagaacucuuuguggacaaaugucugagaguagaacuucuuguagcuaaguuuugaacuuuuguuuuuguuuuacaaauagugauugcuuuuuucccuaccuaagaggaaacacaucaaagcuguguacuuugaaggcucucaccaguuucccaggauuuauacccaucaucuuuacugucaacuuuccucguccaaauaguggaaaauagagauaauggccugcuuuagaaacugauauuuauuugccuucagacuuauauuuugaacauacccacauaacauugacuuguaaaagucuuuuacaaucuauuacaguaagagcucuuauuaacaguauguguuaacauauauuugcauuuaaguaaaauacuguaaagugguuauguaugauaugcuauauacauuuaaaagauuuauuuauuuuauguguugugugaguuuauauggaccaugcaugcagguggccaagaaggucagaagagggcaucagcucccaaggaagugggcuugcuuacuaggauuugugggcuuacuggagaugauacugggaccugaguaagcccucugaaagaauaguaagcuuucuuaacugcaaagccauuucuccaacuuccaaauuacuauauuuuuauauucuauaauuuucuguguacuuaucugauuauuuuuauucauaugugaugggaaaauaaauuucaacugaggccuagucuuagaaguuuauuggacuaaagacuuagcuuguagaauauaggauacucacacuugagugacaugcagcaguuuaguaauagccuuucucagaaaagcauauuauuuugacacucuguagugaucaacacaaaccgaacugccaagaucucuuuuuggggauuaugaagggggauagccuagucagugugagggugagcauaugugcaguuuauuuggggucaaacucugugaugaagaaagagagaugggagaaguacaucugacucacuugccaauaaaagcaauguagaauuuguugccaucauugccauauuccauauguggcucuuuguuuacaugucccagucuuaucuuuucugggauaagaacagugaaggcuguagagaugucucugucugauuccauugccuuacuaugcaggcugcccucaagcaugauuagauugcuuuagccuucagaguguugcacuauuaauaugugacaucaugccucacaggagguuucuggcuuauuauagucacugacagcgaaucagugcaccuuagaaagcacuuuuuucuuuuuguugcuauuuauuuaaaauucuggaguuuuguguauucuaccuuauuggggaucaacauaguuaaagcacauaaauucaucccaguauuauguauguuguuauucaaacauuccaacugcaggcuauucugauugaccagcguuauuauaaucaaggaucaggaaguguuguuuauuggcugcuugguaauaagcaauuugaacuugcagaugagccaccagcuuggcaguuaucacuaucaaaagacugacucauagaucauuggcgucguagucauuuuucuccacacuguuaucauauagcugacagaagagaauuuaagggagggaggguuauuuuaacucuuggucugaggaacgaggguccaucauggcaguugggaggcacggagguuggcguguugguaacgcagagucugcugucggguggagggagacgggugcucaugcucaccuggccuuugacuuuuccccauuguauucaguuccaauuccuuuucugcugcugcccacguucauguggugccuguccucagugacgccuucacaggcgugugcggcgaugacgcacaauccuggcaagugcacaacuaagccugcucgucguucaguugccuugauuaccuaaaauuaugacgguucuuugaagcauuuuuaacagugauuggcaugaaucugacuaugaaggaccauaaaaacguugauagaccucccucuuaaugcauuacagguuuaaauuaggcaguucuaauuuuuugaaaucacauugcugcugcucauuaaaauugcuguuuuccacuugguauguuaagucacuuucaggaauguuauuugagguguaucugacuuagaauucagauguugguucugccaaaucuuggguguucuguaaauugcaaagaggcuuuuagaauucuucaguaaggagaauacuuagggcauguuccaucccuguuugaagcauagcuucuaaguggagcguucagacuccccuuucuucaggguccuggauggcuuuucaauuggaauucacuaguuauacaagagaaagaaugacuggugucuugaucucuucuccuuuggggguucuacaccuuucaagccuuuugagaccuucuuacauauaauucucaguaggugcugcugcuuucagauguuuuacaggucagugggaaaagcaaugauuaauaucugagccaaaacuaaguguuuaagauuuauaagaauuuaacugaguacagaaagacucuacauguauuacaucuuucuuacagaucucucucucucucucucucucucacacacacacacacacacacacacacacacacacacucacacacauauucugugcugaugauuccuuuuugcaaauagaacucuguugcauguaauacucugggacuugcuuuuuccucaugcagauuauucuagggacccuuaacucaacuuuucagaucaaggacugacauuuuucucauuccugaaucuagacagggagacccaagcagaagauagagacagcaaaccugggaaugucuaagggaugcuucugaagugacucagaucuuagaucuugcagguuugaucugccuuuacucaucuucauccauguuacugccucccugcuuucucucuguuuaccuuuccuuagugagaacuggcagguuugugcguggugggaaauguacaauguaacugucuucuugauuuccauaucaugcuagaaguuugucacuuuuggcaugucagaagugaaguguuuccuuggaauuccugcacauaguugaaugugcgggaugcccugcagggucaccaguguuucacccuugcuaguguauucaggagucuucuggggagaguagauaacugccuuccuucuccuuugacuaucaaacuccaucuacucaucagcuaagcaaacacuuauugagaaccuaaaucugugccaggcucagaggacucgaagagugaguaaaccuuguccagugcccacuugacuuuaguucuauagcagugccucaguucuggcuuauugguuccaugccccgaaugcuuacccucuugagacagcauggcucugcaguucaggcugccuuccugcccuccugcauagcgugacuuguugguuagcaggcuuugugugugcucuugcacugcucccucacuacugaaaugaugugcagauaagcauuccccuccuccacacacguugucuccucugcagaccucuuuucuuccuagucuucuucgcugcgcugacauucauuacucagucauccggcucucuucuuuggaguggagacaguaaggagaccuauuuuguaggauuuuucuuuuugaguagggugugauacucaaauacuuaaaaugaguaagaugugacacccuccccccccccccaguaccauauaaacugggugugcuggucugugccugagauucaucacugaggagauggaagcaagaagacuugaaguucauagucgucuucugcuacagagcugaugucagccugagcuacuuuguacuccuauauuagaaggagucacagaaauaacagggaccauaguguuuagugaaccgugcauccagcacuuaguuuaagaugaaauaucaguccauuggaagcuccuuggucuauuuuccuucaugucuccuaucucuccuacagaccuaccucucucucucucucucucucucucuguucuaugcugaugauuccuuugcuauuuuucaugauagcuccuuuuuucaaauagaacccuguugcauguacuauaggacuuccauuuucuucuuggagauacuuuaaaaauuuuaaaauaaugcccgugucuauggaucacauggaucugugauuuguucacauuuggcgcugucuuacauaguuauacauaucuuucuauuuuaggguugauggagauuugagucacguuugauauuguuuuuuugaaggcugaaauuauuuauuuuucuaaauaauaguuuauugagauuaaaaacacacacuuuauaguucuuucauuugaaguauacaagucaauauuuguaauacauucacauacagugcaggugucaccacugucaauuuagaaaguguuugauuauccucaaaagagcaagagcaaauugcucuguauccuuugcuaucauuuccuccugauccuuccuccuccuccuccuccucccccugcuccuccccacucucagcaguuguugcuaugguguaugucugcuaaaaccacacaugucaaagcuguaguuccaguggauaggauacuucagcaaauaaauggugagagcuuuaggaguuggggccuagugggagucugcaggcaugccuuugaaggggacugugggaucccacacuucccuccuguuuccugacuuaggagcugagugcuuugcucuagcugcaggcuaugugaacaugggauauuuuaauaauguuugguaguuuuagaguauauguuuuuuacuucuuauauuaaaguuacucuuaaauacuuugcuauuuuugaugcuuauaaaugaaauauuuuaaauuuuguuuuuggauuuuuuuugcaagcacauagaaauacgauugguuuuuauaacugauuuaucuugcagccuugcugaauguaauguauauauauauauauauauauauauacauacauacauacauacauacauacacauauauguauacauacacacacauauguauguaaauacuauuccuuuggauuuccuuuuucuaaaaauuugaauuuuuuaaauuuuauauaugcauguaaguguauauguguuuaggguucauuugaaugugugugggcaccacauuguguguuguuguguggaggcuggaggaugguacugagugcuauuuucuucaucauuguugacuuuguacacugaaguuggcucucccuugaacucuagucugcauaaaucugaaucuuacucugucauuuaauuaaucuuuuaauuuaauuaauugagaagcaggugugucuguguguuuguguguguugacgaguacuuuaccuacugaguugucucaccagcuaaaacaagucguuuugcuuuuuuaaaaacucaaauuaauguguaugguugaaucaauagaauuacaaaauuuucuuuuaaaaacgacuugcuauuguacacuaugcauauguguucuagguugggaauguaugugugaaugcaggucccaagaaggccaggagaauaagguccucuggagcuacaguuccagggggucagaagccuagaacuuggugguggaaacugagcuuggguucuuuguaagaguacuguaugcuguuaaaugccuagccaucucuccagaguucccaccaaacacuagacuuguucaauauguguaaagaaaugaguaugaaugaauuaaucuugagagguaggggacaguaaaaucauacuuaaucaaauacaccuuuuguaacccuacaaugccaguguugggaccuugcaagcaucgugaaucagaaacuaucucucugugcuuuccauggcuucugccgccugucugcuuucuguucaagccuuagguggauaaagccaaaucugcuguuucuucuggagaaaauuauaaaaugguaacuauaguuuuuuaaaagcucacuuuuucuguuuguaacuuguuggcuuauuaauguaugugaaguaagucacauaggcacuuguguuuagaccuaauuauuugacuauagccaacuucuuuauauagaaaacugucagggcauuucuuaugguccaugccuuuccaaacuuugucuuuauaguccauccucaacacaaagaggcuguuuccuuguuugguuccuaagacagccugggcauguuguagaaguguaaagugaaagauuacuacuuuacgcuucccucuguuucucugcaaggggcuauggauuacggaaaugaaaggcguggccugaggcccuggaccucugccaaccucucuuuuauucucuuucccaaagcgaacaacugacugcagcaacuaccuuucuagcuccacauuacuggauaaaaccacuuugccuguuuguuuuuugagguauggucucauguuggccucuaguuugcuauguagccgaggcuauucuugaauuccuggcccucuaccuaccgccuacccccucccagccgguguugcuguuacagggcacauguggcuucaucauguucauugaaucauuuuucuuaagauuaucucaaacagcaauguucaaguaaauugaggggugauaauagugauaauugcuuagauauucaggaaacucuuugaagagucaguguggaccgagcuaauuaacaaagagguacaauagagacaagguagaguuugcauuccaagccagcuuugauaguuugcuaguuuugugucccuggguaaaugauguaaccgucaguuuuccgaguuagggacgauaacaauacuaagaggauuauucuggaagcuaaauaaauuaauccauuucaguaagucugagacacuauuaauuuaaggcaggcuguauuuauacaacuauuaaaacccugccuauuaaagugucauuguacuuucucaucaccaagagcuuuuagaaucgucuagacauaaauuuuuaucauagauuacucuuauaauaaaaauguuaaaauaagaucagccaaauuauuucugaaauucuauauguauucaaagacucacuugagagugaaguuugccuuugagucagcaggugauuucugacaaauuaaugcagggaggcugggauauagacuugcccaaagccugucgcagcagccccucuuuucucugggguagcuuucaucucuucugagggauugagcaaguuuccuugcucugaguuacccugcuauaaccuacuuguuauuuagacuggccucucaccacagcauuucucagugaaaauuuucauugaagagaaagucgaaucuuagaaaaauugaaaugaacaaguauaucacaaagcaaacacucagaaauaguagcaguuaauaaauaaaauagacgucaaaacagcuaacuauugaaaaguuagaguuaccauagcaaaucaauggcuuaaugaugacugaauggauuuaaucaaauauuuaaauaauauccaccauuacugaauguuggugggcuagagacacuccugacuucugggcccagccaaccuuucuggagagcucauugugugugagcuugagcuuuucuguggcuacaguguucguuacuagcuuuaacugcugguguuaguacuucaaacuuagcacuucuaaauacucgcuagcauguagaguuccacugaugggaggggccuuuggccauguguucacugcugugucuccagggauagagcagugucuagcacaugcuagcucacuugagcauuuaauaacuaaauauauucugcauagccagagcuuguggcuacuaggguauuuugguuugcauuuauauuuucaaaauggcuuuuccuucaaaaccacuuuguaauuucuauuaggguguauguauaugugauauuuaucauuuuaaaaacaaugcuuguuuuggugaaauucaaauguuaugccuauguacuuuauauacuacgacaaugaggauauuacuguugcuuuugaggaaauaugggccccugcagguaguuugaaaaauagauuuaauccagcaagcacuacagaaauuuaauauguaucccaagauucagaaguaauaaucauuauuauauugguggacaggauucuggauuugccucuguucugcagguguguuuguuauauaauuuaauauuagcaguuuccaucauuucuucaccauuguguuauauauaacauuuuaagaaucugugagcagcauuuauuaugcuuauuuuaugguuacuuuuccuaauauggacucuggcagagaguuaagcacaugauuuugccaaucagaauaaaaccucguauccuuaauauuuuuuugaauaacaguguacuaucuuguauuccuauuuacauaucuggaauguucauuuuguacccuuuuuuagaacaaaugauucuccauuuagucuuuuauccaauuuguauguucaauaauuuauccucaaauccuauuuuugaagugaacccaauuggcuucuaguacuuugaaaugagcucaugggagauguuuucauugggcucaaaggugagacugaaugcuuggcuaggagucuuuuuugcgggauagaaaagaugacugacuguccaguguugcugaagagaaucacaguuauucccaaggacucccuuuugaguuugucuuugggaaugguggcguuugugagaagaucaguuuaugaccugccucuuugugguuguggacgggaugauagugguggugguggugguggugguggugguggagguaguguuucuucuucauggucagcauaacuuuucuguguagagauaacuuagaaauaucacaauauuuacaugagcuuucauaucuuucuugauuguuuuuagcuuucauaucuuucuuguuuucuucacagacuuuacuugugucccacacuuaucuauuaugucaguggcaagauacaggagggaaagcccuggcuguugaugagaggcuguuauggugcagcaucacugacuucuugggagauggcaucaucuuuaguguaagcacagaccucucaacaauacagcccugagcugggaccucuccucugugccuugcuagcgggcugacaagccucuuagucuucccaggcuucauuuaucuaguuaauacaauggaaauaauaauuccugcuucucaagugugugugcaucaugucagaucuuuauguugggugauauagcaaauagcucaaagugguggccuggagcacaggauccugagucagguugauacuuguagauccuaccucugucaguaacuguguauaacccuuguagcucccugaucucugaauggcugcacuuucuucauuauauaggcuaauagucgucuuauugugaagauuuuaaaaauuagcacacauguauucuuauuagucaaugcauccuuuaguuguguaguugagucuagaaacucuuagcacuuugcagcaaggaggaaauguaaucgugcgaggcgcuacauuuuacaucuacuaggacgcgaguccacacucacgccuacucuaucaugaauuuguuguccuugaacuaccauuaauauuauaauauaucuuugucacauugcuuagcgguauguuuucuuauaaggaaaacaauucccuuugaaguuaggagacuaaagguuugaauaaggauguguggugcagaacguagucugucucagcuguucaucuaagacuuggaauguuugguugaaaaugcuuuggaauugccagugcuauaaaacuuguaagauguaaggaaguuguuaguaacuuuuuaaagugguuuaaauaaacuguggaacauuugggaagucuuucagagacacugagaugaaaacauacuuccuuuggaaaucugacuuggacaguucacugguuuccauaaugauggagccagcagggcagagacagugccagcuucucccaagccauuuuucuccaacaucagccuagaagaguggccuauuuguuuucuucuuagccauggguuauugcaggaauugaagaaagagauguuccugccucguuucacccagaaagucagcugaaguaucuguguugacauaguuucugagggguggcuugcuguuuguuuuuuguuguucacuuaugugguaaguguacugccaaacuaaucuuuccccuuucucacagacagagagaaucuuuucucaccuuugcuucuuguugugugucaucccauuuguuugugagauucuguuuggauugacucgcuguuaugcuguccacugcuuuccacacaucucauuuacccuuccgcacugcacacccuuucacagggcgcacccuuucucucuuguucucacuaccucaccggguguagaguguguucuuucuuaccuggguauuuugagacacauuuccgaguggcccgugcuggccucacacacuggugauucuccuaagugcugggcuugcaagcaucugcuucguguccaguaaucuacuaagagucuuagacaguuugugucuuuggcuauaaauacaaguuguuaagguugaaaaaagaaucagaagcuugcccuuaguugaugaucuuaucguuuauacuugaccauuguuacugaaugguaaaucacgugguauaacuuauaccgugaugugcuuagaggcaaauaaagguugauuguaguaaauguuuaauucagacuuuaguguaguagccaaugugugcagugcuguguauggagcaccucuucaaagucaauucucauagugaccccugguuguauuaaagaauuggaggaagggacacuggaggccagcuucuaucaaaacccagccuguuuuucuguacgcccuucggccucuucccuccacauugauguguggggcaguggucagagaauuugaggagaguccauaagccuuuuuccuuugagcacaaaaagaaacaaaaagaaacuugugaaugagaacagauggaauggaggcagaaugccuucagaucuaguccagcuucuccuucucuggaagggaucugggaccuuauguccugaacucuuucaaacaguuuuaaaacuuacuaagguuguaaaauguaaugccuccucugaaucuuucaucuucuucaauguuuuggaauucaaaaugaaccuaauuuucugugcuauuugaaucugauuaucucauuaacuggucggguuuuuguuuuuuaaagugcauucugagugagucuuccagaguaauuguuaccuuaguacaugacaaguuuaugugucaugucuuaucuuacgacaacuuuugagccugugaucuuagucagugucaugaaauagucacggagaauuaccuguggacugauacuccauuacaugguaaagaaagcagggaagaaaugcgaugucugcccagcuauccgcuaugcuguccuguggccaugcucuguuggaacagaggcugaguguuaccgauagugcgugaccugcaggaaggcauaugaaagggaagcgggacugcugcgucccugagaggaacuguggugugcuuccugagccuggcugugugcucgccgccccucagcguggggcuugcacugcuucucacuucucccaacagaagcuacauuuagcuuaagauguaagcucucuuucuuucccccagcagaacaugaaggacucguguuuccaugauuagcauaaauaugauauaggaauaaggaaagguauuguucacuuacauaaauucugaauagauauaacuaaaguuaaaaccuuauaaaaggagaggcaagcauuugcucccccagugauuccuuugcauuguaaagauuuuacuuuauauucagauagcugguuagcucccauauugcacauaugaugcauggagaaggaaauuuguguuaugaaaauacuuaggagaaguagauuuuccugaaucuacacacacauaaaagggaagcuucgucuuugaguccgaagucccaguuguccacagaaauaacaaagaacucaguacauauuggcguaaaaaucccugaauuuagugugucagaaacaaguuguucuuuaaauuuuuucauuuguuaucaaauaaguaaaaugucuauguuggugagauucuccuuuauagacgcagguuggcuugucauggcagagauggcaguuauccuuccuucucacacuguacugaacauuucugcagauagaauugguucagugggaagacuaaauacauacagaucaugcaaaugaagguauacaaaaaaaguauguuuuguggguggaaaacuggagaaaugggguaaaucccauuaaaauguuuucuuuagauaguggucagguuagaaaaucucucuggaagccauguucuaaccaagagaaccuuugucaaagcugugggacuucaggcugcccugcuagagagggaugcaucuagaggcaguguaccucaggcucuuuguugggcaagggaaaacaggaaacagccaugcugggcgucucaaagaguccuuguguggguauuuaaacauggaaggagauuggcauugaagucuguggucacgacaaacguuuguaauugaagguggcuguugaaaauaguucuuuacauaacugaguucucaaagucuccacaagguaaguagauugaauggggaauggccuguuugucaucgcugagccacagaacugggaaaucugcuaccuggaaagagaccuuaaaagacaucaggagagaaaaguguuugauaacaagucaaggggcuguuugugaaaaaauguggaagggauguaugcccagggauguaugcccuuggauuuuugcuauuaaccccaucccuugcaacaguaagagccucuuuaauuauguggcaucacccaucagauguuuuuugccaaaucauuaguuagauaucacuugagcaugcuucauauaaagucuuauucugagagucuuacgcuuuugucuaaugcuugucuuucuagccuuagaaacaaugauuuagaauuuuggaggggaagauuguaaauagucauagguuuuuuuuucuaguacucguguggauaaauuauaaaugcacuguauauaaaagcucccucuaccuugugaguuaguugaccuccagggaguguguauccagucugcacaguauccugcaaacgagugggcacuucagcucuguagucugagugcugggcagcuuuuguaaaacaggacgaggagggagugcuuuucuuagaggaaccuguguguucauccaaggcagcagaggacauugagugacuuguggggauuuuauuuucucagagccccuucccuaacuugaaauuuaaauuguuuauugugcuuagggauaggugcacggaccuugucagaagagugaaugagacuucauuugacuuggguuugcuaguucacaguacucagcauauuuggaucucuagccuuggcuucugacagugcuguaauccuaggaagccauucaccaugaaaacacuuguguuucuccuuucuuuuuguauuuguucauuugaaaagccuuucagugggaauugcagccugcgugugauuauagcuaucaguagcacuuaaacuaacugcugagaugaaacuuuccuuuuuggacccugcuaauuucacacacuaagagaaaugcacacccucccuucagaagccaucuuugcuaauugguagcugcucuuuggauugagcuuagauuccuuagggacaacauuugauagaauaauuuuugacauuuuaauuugacaagaaacaauucagggaaggaauuuagacacgugccugaaauggaagcuucucuaguggugacugugaacuuggugugggaacugccuuuugaaagucgcugcaagccauuccauaggcgagucacagcugcuuggcugcuuuuguguaggugcugcgcucagagcuuuacauuacuggacauuuuucuauugauauuagacuauggguggaauagacaaugccauaaauucuuuguaauaagagcuuugagaaggacaguaaguugaugugugcagcauauaagauguauguccugguuuccauguguuacaguguauguuuuuaaagcuuuuuguagggcaagguuggaguccagugccccacgugaacugguacucuguccaggaggcagcuuggccgaugggcuucuuagaauaguauuuuaaacaucccuccucuugaaaaugguaacagauuauuuguguguguuucuauggaaaacaguaaaguuaaaccuugaagcaaccacagaguauaaacauuagacacacauuuuucuguuuuugcaaauuccuaauaugugacauuuuguuucuuaucuaguagaugugauuagaagugaauacucucaaaccccacgaugacugcgauuuacucugugugcaguaaacacccagaguauuuauuuccuuuccaaaauguucucuaggagugagacuggcagaugacagggagacuggccaguguugaccgacccugguuuucacuagaaaacauuauuaguuuuuauuuuaauauaucaugguuaauuucuuaagauauauucauuuuuauuuuauguauauggaugauugcuugcuugccuaucugcguaccacauacauucagugcccauagaagccagaaggggaccucggauccucugaacuagaguuacagagggggugcugccaggugguugcuggaaauugaaccugagaccucuagaagagcagccagugcucuuaacccuugagucaucucuccagccaagguuaaaauuuuuagugaauucuuauuuccucucucccucccuuucccucucauucuccucccucccuuccuccuuuccuucuuaguaucugcccuccuuuucuuucucuuugggggaagggcuaacauauuugguugacuuuguggcaugucugacuauugauugccuuacuuuuccauggagacuugggauauaaauaacuuuaaaaagucacuuuuaaguuacauuuuacaauccauuguuuaaaauuguucauaaaagcugggcauaguggcucaugccuuuaaucccagcacuuaggaggcagaggcaggcggauuucugaguucgaggccaaccuggucuacaaagugaguuccaggacagccagggcuacacagggaaacccugucuugaaaaaccaaaaaccaaaaaccaaaaaccaaaaaaaaaaaaguucauaaaaaugccacuauuuaaauuuucuuuaaggaaaaaagucaacauuaacauaggguauaguggacuuggguuuauauucuuuuuuuuuuuuuuuaaucuugcaaauaaaaacuguuggacuaugacuauaauaaguauuuuaauauuaucuuaaaagauguaguauuacuuaaauuucuaaaaaacuugaaauaagcacaaaaaaaauuuugggaacuuaugguuuuaccaugucauguuuuuggaacaucaaguuguauaaaauuuacuuugggauggagacucaugcucaaaucagauuuaggggaaacaaaauaaccucacaaguucuucccacugucgugcugcuggacaggggcucaggaagucugcaguuuacauuccuaaggaucagauuauagugccaguuuuacacaucacaguaagugcaugcuaguaacagcuggacugucccucccucaccuuuggaaacuugccuuaacuucagaaauguguauuauuuuaauauugguucuuaauuucaaaaauauguaccuuuguuaaucauauauauauauauuuauauacaugauuauauauauauuuuaacuguuuggagcaggagacucagaaaagacagguaaauauaugauuggacagcaauguguuugcugcuauuguuggucauggcccuccuugcauuacucucuugccacuuaaugauuuuaucuuagcauugagaauuauagauaaaauuuauuuguugaaaauuaggaccaaguaaauaagguuuuaaaauugcuaggaaaugccaagaaaauauuggaaaaugccgauagcuuggaaggagaauggacuauuugucauuuuugucucggagaauguuuagugacuuuaauaaacauagcauucugagcuuggcuugacaaggaguuugcuguagugccauuagcccagugguaaugcaguacccuagucugucugcuuuuuaaaguaaacugagaaacugauggcuguuacuaugacccugcaucagcacugauguguguaacugugacccugcaucagcacugauguguguaacugugacccuguaucagcacugauaugugucacugugacccugcaucagcacuguugacugucacugugaucaugcaucaucacuguugacugucacugugaucuugcaucagcacuguugacugucacugugacccugcaucagcacuguugacugucacugugacccugcaucagcacuguugacugucacugugacccugcauuuuaauguguaaaauagaaaaauguaauucugggaagucuggaauccauuaagugagcagaggguauaggaaaaacgauagcagacaugguaauauaaaccugcaaaauacaugcuaaaauuaaauuaauuuagaaaaaguauuuuuauucuguuuauuuagguucaauucuauuuaauaauuugauuuuugaacuauagaaaaugugagcauuuuuaauauuuauaugaauauaaauagcugguguuuuuauuuguuucaugguauuuuauuuuagucgugugugaauguuucugcuuuguguacaugcagaggcaugugccuuugcaugcauguguggaaggcagaggaaggugcagacuggucuccucugucuaccuuacucccugagacaaggccucacugagcuuggagcccccuuuuccuuucccccagcaacccuccuuuuauccuauccagugccacucuugcuggcacauauggccaugucuggcauuuuagcguaugaaugcuggggauuugaaccaggaucuuuauuguuugcauagcaagugcuuguacccacugagccuucucaccagcucuggugccauuuauuuuaauuugcuuagaauaagaccuaaaaguaugaggguaagagauacuuguguaauugcccaguauugaagaaccauguuucccagcuguuuccacagcaagacuagacaacggaagcuuuacugaguugugucuguggaaaauagguacaaauguauggcaaaugcaugaagaucagagauacagucauagaagugaaagcggggaagauagaaacacuccaugagagaauuagaacaccgucucuaccguaaugcuuugaaaggccauuucacugggacugcuuacaugaacaguauccuuaaccucauccaacuagagccccuacuguuugugcuucguccuguaaggugcaucagguggauuugagcuccugguauuuguagaucaugguuggguauagaacccuaaguugcacugaguuuacuguuuucaugagcaggacauuaaccauguccugcugcgcugaguggauucucaucuguuuaguuucuuauagauuugaccuggugaguugguggugcuugcuccuuccugagcaaaugaucuauuuguucccagugccuucagcuuuugauaaucuccuggcaccgccagugucugaaaucccaucagaggggaaacagagggagcaucuugccagauuuguuucaggaagaccguggaggaggguggccgagagagcggcccuggguggauauguccagaggcaggacuuuuuuuuuuuuuuuuuuaaucuuuguuuuacugcuugauuucggaugauauuggucugauuccguuuuagugucauucuguuucaaaaaugaggcuguuuaugguacagacuugcuccaaggcugugaauaugaaauaguuauuaguuugaauaggucuugcuauauucucagaaagcuguauauagucaugugucaaggaugccacagccgcuaugguugguauaauuuugcucugugacccucaggaaaugacaguuacucacugacacacuucucacaugucccuuugucaagggacacuaguugcauuuugcaaauguaagagauuuguauuauuuacuuuagaauagcagaagaugacacugaaaaaguaguauccacuaguagacuaaagaauucuccaacuguguuccugccugccugagggauccauggagcccgguuguuacauagacaggcuauacauaugcuguugcauucagccauuuccccuucgguaagggucucgaguugaauguuucucucggcaucuaagucuuguacugagagugguaucuggcacugggcugguuuaacugagucugagguuuccaggcagugucuguggcucagcuaugaccacaugcugcagcugccuuuucugcccuccagguccacgugugacauuaaggcauucuggcacuugccauuuggaccuguacuugcuggaaaaugucaggacuucuagauaggaugaagacagaucuagcugauccuccucucuaucccugaaggaggccgaggacauuguggguaaauugaugaguggcacacuucccuuaguucugagagauuguacacaaaaucuguguccaaagcuuuguuguguuuaagaguucuuauuuucccucgaaccuccuugguaugacaauaaagaugcuguuuggauaagcaaguguuuuaauaaucacuucugaguuucauuagauaagaguucagacaagaguucccuucauugcuccucccuuauguuuaugaaaaaccucaguggagacugcagcuuuuggagcugggcuacugcugugacagaucaccaucccauguguaccugguggcuuucacaucuucacccaggaguuagagcuccuauuccaggucuuuguucuuccucugcuguuuucccuuuacuauuugggguuuuaagacccaggaguuaguuguuaagcuaaggcaaaacaagugauaacuuaguuaaguuugcuucucaaaguuacugauguuuaguggggugaagaauggaacugaacucuggcauauaagugaaaauuuagaagacuauuuugcugcugcugcugcugcuauugcuuuguuuauucuuaccuugcaaauuaaggacugaauuauaauuggcucuaugcaauuuaguaaacuauugccuaaguuacauucaccuugaaucucaagucugacuuaaccacggucugacucaaagugauuugggaaaggugcuuccauaacuuuagucuuucaauugaaaaaaaaaaaaaaguugacaagcagauacuguaaacacuggauuauccagauccagagacugaugagacugcacuaaugggaggucauugcccuguggcuucucuuuggaaagcugccucucaguggcuuucaguggcauaguggaaaugaagagugaaauuggucaacaggccuguucauuguaggaugacuuacaaagaugaagggaaauaguccuuaacaacuagaaagcaaggaagacaaacauguuagcaagagccaucaaauagaacauacauguuugaaauuauguuacagugaaagccuuguaauaaaaccuuuacuaauaaaaaccuugcuuuuuucuaggucaaauugaauuauauaaauuauauaaagaaaucuuuucuuuuaaacgugccuuucuuuaucucuuaauuggauccuuccuaguguaacagcuuguacagaauccagaaugugugucucauguaguagcuacauucauggaauugugucuucacuuugggauuugcauuuuugguuauaaauaaauuauuggagaguaaacauuauuuuggguuucaccuuggaaacuauccacuccuaccugaaucaaauacaucuuggagcaguuucuacauuugaaguuaggcucuagccugaguuguucuuauuuccuucuaacuuaagguccugcagacuuucagcaaggggcuguuuuggcaugcagauuaguuuuaaaaggccucaaagugaagaaagucaguauaauuaaacaacaacaacaauaacacacacacacacacauauacacacacacugauauuaaccagacguacccuucaaauaaucuuuauaaucuucauaugguguguugccuuuuuuccuauuaaucugcagaguugauagcuauacaucuuaauuaagcauagugucugucaguccuauggcugaccagugauuggguuaggaaucaauauuuuucauugucaacacugucuccaaaaucugaaguuguagcugaaggugaguacauuauguauuaaguuaaaaccaguugcagguuuuauucuuucuuuuuuccuacaaaggucuguuuacgaugauaacuacaauaauauuaucaguuguaaauggggcacacccaaggaaagggggauucagcuaaacaauugacuuuaucccaucggccugugugcaugucuuagaggcauuuucuuaauugcuaauugauguaggacgugggcaguuccauccuuaggcagaugggcuuggacuguguaagagagaucgcugaacaagccagaggcaggaagccuauaagcaguguucuuccuugguuucuugaagcuccuaccuccaaguucuucccuuagcuucccucaaugaugggcuagaguccgugaguuaacauaaacccuuuccuccuuacauugcuuuugguuauguuuaucacagcaacagaaagcaaacuaggaugaauaggcuuugcuaagacaaaauaggcaguaugcugugaauaaugugcccacaugguaugugaaugccaugugcuacagcagaacgugagcauucacauuuuucaagcagucuguuuuuuguuuuuuuguuuguuuguuugcauuuugaagcuuuagaacauugcuucucaaaguauagucccagacuucaccauacuuaaaaacuuuuauauuucaagacucugaagagaaugaaaaggcaaacuacaaacuguguaucugcuaaaggauuuguauuuagaauaaagaacauuuaaaacugauuaauuaggagguaagccaguucaaaaugaagaacaaauuuuccuagcaguccuggaaaggagccugaguccucauccucacacagguacucugccacugagcuguagcccagcucuguuuacauuugauguugagacagggccucacuaagugacccagguuugccuugaacacacuguguaaaccuagccuuucagaacaugugcuccuccugccucguccucgcaaguaauuggauuacagguuuguacuaccaaguugugcuaaagauuucauuuuacuggagaaggaggaaaaggaggaggaggaggaggaagcagcagcaguaguuguugcugcugcuguuauuguagccaauauaguagcuuugguuuaaaaaacaaacaaacaaguauuaccaaggguaugagucagucauacauuguaccuaaaugauuucuugaaaaauuauuuaaaaauuacagcccaacauuccuacuccugagaaauacauucaaggugagaaguguauggcuugcgugcacaggagugugaaaguguuguggcaguaguuaguauccaugaaccaaaaagcagaacuaguuagucccagaaauuuuaagaugugguauauuucuuuuuuguuuguuuguuuguuuuucucaauuuaaagauuuauuuauuuauuauuauauguaagcacacuguagauaucuuuagacaguucagaagagggagucagaucucauuacagaugguugugagccaccaugugguugcugggauuugaacucaggaccuuuggaagagcagucagugcucuuaacugcugagccaucucaccagccccaagauuugguauauuucuaacuaugaaauauucagcaauaagaggagacaguagaacaugcacauugaauaagaugggcauaaaaggccaagcacugcaugcuugcauuguuaauaugaaguguacagaaauguaagcguguagagaaggcacauugccaggcaccaggauugagaaugcgaacugaacccacauggaguuacagaggaccugucugagguaggagcaucggaacuuggauuucaguaugacuguacauuuacuacaagguacugaggauggcuaaguuugugaaauguagauuacaguucaaugugauggcuuaagugguaaacaccucuaguacucugguauuugaacacuugguccccaguugguuacuuagguguggccuuucuggaggaaguguaucaguaagggugggcuuugaggcuucaagccuaagcaccauuccaggugaacucucuccuuucugcuggccuaaaaucugaguccucaacuuccucuuccuaccagcaugccuucauuuggccuauaaccuucugaaacauaaagccaaguaaccauuuucuuguagaaguugccuugguuguuguauuuuaucagagcaauaggaaacuagcacgccuaauaaaaccuccaaaccaaaacuguguucccaagaccagcagcaccagcucugccaaggcacucgucagcagugcaaaugcucaguuucaguagagcagcaacucugagggggaguuuccagccauuuguguuuagccaugccuucuugcugauucugaugcaggcugaauugugagaauugcugcuauagaauacagagaguucauuggagauguacugagaguauuaucucguuuuuguacauucaaucuacacuguuccuguaauugcaagaaagguuuaaauuaaggguuguucuaguagaguuaaaggaaauuacagggcaaugugaguaaaaauaaacuucuuucauguucuugauguguuccccuaagaagcuuuaugauuguaauguuugugugccacauguuaguaaauuccugugcucuuuuaggcuugccuucauuaacgaauauagcauaaacagguucauuugccauaacaaugguggaaguuuagauccuugaaaggaauuauuucuccuaaauauuuacaugguguaauguaguagaagugugcagugauccugcagacaugaagauguggcuauugauaaagaauaaguggagcagcugucuggacugagcuacacugcacaggcuaugcgauaagcgacacagagagucuugcccuagggcacagcuuauacacggcauaugcuuuugggaugcuuuucagcauuggcuggauacccagaaggaguucugauggcaggggcuguuucacaagggcccggugauccaaccugguugcucuuugaagugauagguugaauuuguaccuagaggggaaguugacguguuaccccucugagaggaugcuuauguuccuuuuguggggaaaugcaaguguuggaugggaaagaauaagagggaugggagccagagcauggaaaugauaacuucagcucacuugucuguggaauggaaucaggguugugaacaguagaaguuaagaaaggauuaauuaaagaguguggugcaagccgggcgugguggcgcacgucuuuaauuccagcacuccgggacagagguagguggauuucugaguuugaggccagccuggucuacaaagugaguuccaggacagccagggcuacacagagaaacccugucacggaaaaaaaaaaaaaaaaaaaaaaaaaaaaaaaaaagugugaugcaaacuuuauugcuguagaugaaagagcugagcuuuuguugcaaacucucuuccucuguaucuaaccuucucucucuugcaguacgucccuacuugguguguucuuuguuuuucagacauggucagcuauaggccaggcuggccucauucucacucuugauucccugcucagccugcccagugcugagacugcuggacuaaccaccuauacucucuccuugucuucuaaauuaaauuucccccucagucgcccucucugacuuugugacucgcucucaaucauuuguuuagugguuugcuuuuacuguuuaagcucgagcucauacuacucagcaguaaguuaucgagcucuuaguggggugucagaauaccauguucucucugucuaagauucugaguuuuugaagucuggcuauacaauaaagaaaauuuggaauaaguuucauugagaaugauuuuagcaugcuuauuacuagacagauuuuccuucaugcggugaugguaaacugucagguugaaucgucuagagucaccuaggagaugugccucugggcaccucugugaaggguuaucuuaaugagguugaugugugaagacgugguucccugggcuugcguccuggacuacauggaagcuagcccagcauuucuauucccccuuucugccuccagaccguugaugcaaugcagcagacugcuucuauugcugccaggacuuaacccuucaugagggccaguauuccccaaaugagaaccacagcaagcucuuuaguugcuuuugacuggguggguguuguaucauagcaacaaacaaauucaacaagguauauuuaaagguuuaaacaaguaaaaugaaugaagcagacuucucaauucaaauccaugucucuguaaauuaaaaucaaauuggaauaagaaaaugcagcuaauauuuuaucaugagcagguacaaauugaguacauaagaaguuucuguuuuagaguuaacuguuaaucaaggggaucauuaaacuuuccguuguugggaggcgggggaacuugggaguaggaugacguguuuucagguccaugcauuucagaguacuggugacaaacguucagaugauagacuugaagcccccgcaagcucagggcguccugcgucauguaccacguuucugucucaugucagugaugacucuggagcugagcugcuucuccuguccugcauuuagcagggccuuugccucaccguauggcuggcucuguggcguccuuaguggagccaugugcuuuuuauaguaauuuuaaguuggucucauacauagguggaguggggaugaaaaauuuuucaaaaugaaagaggauaaaggugugggaaaagaauugcuguacuucuuguggaaggcacacagaaggaaagguagggcuuucugucuuugccccucccauugcaguuguuuauaccucagaggacguuuuuacucaugguaucagucuuugaauccaguagaguugucagaauaccucuacugguaucaaaauagagguauuuugauagcagucgagguccguaugcuguuuuaacacauugagacaucaggugacauagccugugauacucugaggcagguucuuugcuuaaaugcaggcuuuuuuguuguuguuugauucuuuuuaaaaauauagauuuuauuuuuauucauguguguuggugucaugucuagcuccaggugcccuggaacuguuggguacugggaacuucacuccauucucuggaugaguagcaggugcuccugccugcuucacccagucuccaguucuucaaagacagagccucagguagcguagacauggcuccaguuuauaauauugacaaggcaaacauugaacuccugugccuuugcccccacugcccauugggaagacaggcaugaggagagugccaguuuguuugcuuuguuuuuuuguuuuuacuauauuuuguuuguuaauagcaugagaaaauuuguugcuagugcuauuaggaaccucagacuccaaguucaaguucugcuugacacuuguugauuuggaucugccccuuuaaggcgucuuuugugcuuauaaaguguucuuuucaucuacagugcugugaaauugugggaaaauuagccaggggaacuugguucuguugaaauugcucucuaggcaacugauaggauauccaugugggagugcguggaggucucccgcauguccacucuaagccucccaggcuuguaguggauccucugcgugguaacugcaccauugcugaugguguucucaggaaaauaaauggucauuguuuggaauagugcugggacuuuccccaacugcugacugaggaguuguucccagccugccugccugccugccaccagauggugcuagagcuacacacguaaaggcaaaugcagcugcaaugcagaggcaaugugcgcucucucucucucucucucucucucucucucucucucucucucuccuucccucccccucccuuccucccuccccccagcucugucccuccuuccauucccccccccucuuuccuucuuucuuccuuccuuccuuccuuuccuugcugaccuuccuggcaugcuuugaaauggguucacaccaguugagccaguugaccacggacaauauauuagugauggaaacuuagggccaugcaacuugucuuuccuguaaaaguugucuugaugcauuggccuguguguaaaacugacagugugagguuucugcauccuuuuaaguagccacaaaaacaccauguuuacaguaaucuaaaggugauguucagaggacauuaccaacaaaauaugccugcccagauuuuaagucaaaauagaauaauuuauaacuggguacauuucaaaauauuaacuauuguuuaauaguagaguaccuuaucaguuagcaauuauacuuaaauuugaaguguuuuuuaaauuacaaauaaauaugacuuggguauugcagaaaauaaaaggaauacuuuuuguuuaaguuacucacauauuauaugaaacaauuaucuuuguuuacacauuuauuuugaagguaaacuuauuauggucauacaguuuuguuaguuuuuucucuuaauuuaucuugaauauuuuacaugaaaucaaaaucucuuaggaugauaauuuugauucacaagcugguuuuccauucauugacucuuuaaugauaggcauuuggauuuccaauuacuuuuggucccuucuuaaccaaaauuuauuucucuguguuguuuuauauuuauuucauauuaacgcuaaaaauauauuucuagaucgggaagaaaggguagcuuuuguaacuuuugcucgaauuuuuauuuuaccaccaagcuuuguaguuaaauacaaagaucaucaacagaucacuucuguuuuuguuacugguugguuucucguuugguucuugagucagggucucucuauagccuggacugacuugugaucuugcuaccucucagcccccgcccccaacgcuggagguggaggcguaacugccacgcccagcuugguaacccuccuauucagaaggauugagaaugcucugaaaugguaaacucuacuaaauacagauuuaagagagcuugguuguauuccuuaacauccaauccuugagacucuucuguuuguggaauuugaauuuuagguuuauuaccuguucuugagauauaagccaauauucauucauacuucauaacagacuaacucacgggcagagcagggaguugcuguguguguuguuaguuucucuuaaaggauaauaauacaguaaacagaauagaauaagaugaaauaaaaacugacccgcugaaguuagaccagacaaacagcuggaaaagaguccaggagaaggcacaagaaucaaagacuucauguuuccuaauacugagaugagaggacaguuucucuaugaauguuuccagccugaaaaguugcaagaacuauguuuaaaaaguuauuuugaagacuugaguggaauguagcuuuuuaggguagcagagguguaauacauauauuuuaggaaggcaaaaggaaggaauuacauucuuaggaagaauuagaagcacaccagucuguguuaauggaagaauucugcccuugcaguugcuuuuugauuuuuuugguuuugcuucuuuuuguuuuuaaaucucagucacuauauuuuuauuuaagcaaauuauuucuuaauuaaauucucccaucaacauaaggaaggaaguaauuuauuuuaaaauuagaggaaacagcaaagcuauuuucguauuuggagaauggauagagaagacgcuuuauggccuuucaagugaaugugggaacuguuuguacuuuccagaaaaaccaacaaacaaggcagaccuagguuuucuuaugcagagaaucucacuguuucaucuuuuguaaaaaagaaagcagaaggcacccuguucuccuaguuucccagucacuaugacaaguacuuacaaaacuagccgaaaaggcuuuaucaacauacagucuguccgugugagagcugagagauuucacuucuguaaucgaaguaucucuuuaaaaaaaaaaucaguuauuuauuuaugauguauuuuauauaagcaacauuauuggguuuuauuugaggauuaaaaauagcauuuuuauugagagaguuuuggggauuauuuuuuagugaguugaaaauaauuguuucuauauuguagguauuugacuuuuuagguuaugaggguguagcuuauuuuuuuguuuuuguuuuuguuuuuguuuuguuuuguuuuuguuuuuguuuuacuuaaagaguuacagacaaccccaaaaucguguuuagguaaaauguuucuaaaauuaccuauuuauuucuugagacucaauauacuagcacguagauaugaggaaguggaacuccacgucagcuucuguaaucagccuuuuacaagugcaguaugucagacaucuccauuuagguguugucuuagcuguauaguuuagaaggagcgucuuuauucucugagcgucucaaaacauuaguucauuuacaacuuuaucacuuacaacuuuaucacuuacaacuuuaucacuuaaaauggccccaaauaauaaguucugauuacuccuguuggcuuuauguucagauaaacacaguaaucagauuguuauauuaagguuagaauacuggagagaaacuugcuuuuuaaauauaaugcucuguacaucuuugcagaugcugcuuucacaaagcucgacguuguuuucuucauaucccuggauuuuacaggccaucagcauaguucccugccguuggcugggagacugccacuaaacagaaagugccugauuaaucugacauggguccugcugaguggcuucccuugaacuuggaacaggaauagggcuguagagggacguccucaguaaguucccuugguaaaaauugucacccucugauuuauuuugaguuuagauacauacaugucuuaggccauauauguuuuauaucugaauaaucuuccuuuagaucauuuagcuuucugacccaugauuaguacucaacuguuuauuggguccacauugcucaguaaauaugguauauaaaauuuacuacauuuuauauugauuuaauuguguuaaucuaaaaucuuugggugcaaugugucacaucuguuuuguauuccucaguuuaaaagaaguggcaguauggaauuuggaggaauauuuauuaucugaguauuuuucuuugcaaaaguuuccccuuaguuuguugagaaggauaaccuucaagagaaagugaaucauuuggcaaauucucaggucuccaacaacuaaaggccaguuaauuaaaauuuuaccuuaccauuuaaauucacuuuauuuaaauaguuggaaguauaauauaaauaguuuggaaaauucuggaaauaauauaaaguacauuuguguaaaguuuuuuaaauauucuuuucuuuuaauaauggguccaagcuacauuucgucgauaguuaaaauuuuuuagaaaggccuuuauuagccugaguguuggcuuguguugaaaugguucuuuccauaacugguaacugaauagucuucuccugugguaguuucauaaccccuuuggagauuaccaguuaacccauuucccuagggauaagugugcguaaacauagcauuucacguguaguuucaaguaaaccugcgucuugcugcccaguuauucagaagccaguuagaaaacuguguggaaacugauguccuuccuagucugugacaucagcuucucuuccugugccacacuaagacucuucaaugcaugacauuacauuuuuauuuuauuuauuauuauugcgagaccauguaggcacgugugcuuugcacacuaguggcggucagaggacauuuuucagaagccaguucucucuucugcuguccucugugaguucuggggauugagcucaggucgguugucaagcuugguggcaaaugcuuuaaucuguugacccauuucaucggccuguguuuucuacaccuuguuuuauuuaauguuacauuuuaucuuuggucauuauauaguagaagauaaggauaaucugggucuuauguuggaaggaaaagcacaauuccuucuaguuuaaacuuggucucacauuaaggaguuuuauucgaacuuaaacaugcuuuagguucuaaagaaaacaaacucacuuuuucuugggguccuaggugaagacacagggagggagagagguaugaguucuuugggaauccuuguuagaacaguggaucuuaggagagaugcuguacagaacugaguugucauguugaugaaagcugugcagcucauuagcagcugcucugcugugguuguccagcucaugcuuggggaccaggcagauugggauacagcccagcccaguuguucaucagcuguaaccuugaacacacugucugcccauaaauaggaccuaacuugcuaaugagcaucuuucuguggaggacguguuuucugcuucagugcuccuacuacuugucuucagacucuagagcaauagucucaaccuuccuagagcugggacccuuuaauacaguuauuuccucacguugugcugaccccaagcauaaaauuaauuucauuacuacuugguaacuguuguuuugcugcuguuaugagucauaguguaaaugucugccauguaggauaucugauaggcagccccugugaaaggaucauuuggccuccaaagggguugugacccacagguugagaaccgcuucucuagcguaaccucacacauuagugacuugcaguugucgcauuucaguaaagaguuuuccauuugaugauuagcaaagggaaguauguuaaggguuaucuaagugugucuuagauggugggaaaggaguuugagaagcccagaaugagagagguugcuaaaagaggaauaaaaauuaaacacugacaugauucucuuugaaucuucacacuuggauggucauguggcagagcugaaggccucccaguugcaucaaaauauauaaugugccuuugcuuuuaugucauaauuucaaauguuugaguaggcacaugcuuguccaccacugugcaaaugguaucugcaagaugucuucacugugguuuguaaagcccugggugccccgaggaagggaagagggagcuuuaugugguguuugaugaguaaaugacgaaggacuucuguaguaccugccugaagggagagcuuccaguacugacgcuccugacagcauuggugggccgguagucucucugaccuuuccuucccauguauguuguuacauaugcgacacacauaugaccagguaauaguagaguaguguuuaugguaaugguucuugccuccuguccacaugugcacuaacuaccacaccaaggacuguugacuaggauggaauuauaaaggucagucaggaaugcccacuaagcacaagagagugaauauauucuggcaacuuugaaguuggcauuaggggaagguauucauuguguucauuuagaaaugcucuuguuggugagugagugaguccuggaugugagccuuugcaucugcuauccagaaaagcacaacuuauccagguaagcacaacucagcgcuacugccuguggugggcgguccaugcugcugcugcuguccagcucgucguguacugccuaguuuaucauguguucccuuugaccagguggagagucuagaaaauaaucuucccacuuucuaucuucucagcaucgucagugaagcaggggccuccaucuacagugucagccccgaagcgaacaaggagaugccaggacuggacccuaacuugagaagugcaggugagaagcuguuaccaucacacagcauagaacugaaacauuuuagaucuguaacugugacaaacuaaauaucuuacauauccaagaaaguguaaaagcuuugccacaugaacaagaccugaugcauuugcaaguuuuagacuaagcuaaaacuggaauuaugaaaaauuugagcaacaguacuuuucuguuuuuaaauaccuugaaauacuguagaaauaguaaaaauuaaacacaaagucguauuaaauaaugaggagaauaaaaugauuacaaaguaguuauuauagcauuuucucggcaguagguaacaugagcauaaaugcagugccagugugugagcguacauagacuuugguuuguugcuaaauguuuggcaacugaacauucuuucguggccucugauugaggcgucaugguaaugcauugcuuuaaaaaccaugccuuucuuuuauuuguacuugguugcuuugaugucuaggauguggaauagcuaaaauuuuguaauagaaaauuaaaauacuuucagaaaucuagggaaagcaauuggaauaaauaaaaauuuauaucugacauauuaguuuuuaugcaauggggaauauuuaugucacuuucuuaggaauuaaagucucaauuuuuguacuuaaauauuuucacugacuuuuagaauuuuuagcucuauaacugggacuauaauuuuuaaaaaguuuuugcauugaucuaaagcauaaaaaaguuuaauacaaaagacccgguugcaucuuuucaguugauuguugaaaugagacacuucguuggcuaaauuaucuucugaaacugaaaccuugcuucuucuucgauggauuccccuaucacaccagcucagcuucuuucccaaacuccuagcuagugcuugccuugaaacagugggaguguugaccaugggaggagugggaagucagcagagggaaccuaugaacuagccuuuccuacccagagugcuggagacacugcaggccgucagcacagcugccccagggacauuacacuaacuaaggcuuaaagaggccauacauuuugugaguguacuuguaauauuugugucuagacugucugaauaaaugauaaguuuuauuuauuuuuaaaaaaguaaaaggauugccgaauuuggcuuucucuuguaauggaguguugggaagaauauuuuugccauaauuuuugggaggcaacaguuuucccgcugcuaaugaaacuccuggcccaugaagaugaacagugucauagagucauagguagaaacagauuacaguguccagcacugcccuaugaaggaagaauguuagaaaaagauaaacuucugcccaguucucuugcuuugauuucagaauauuaacuggcagugucuucagucuauguagugacaaauacuccuucccucagcccgcgccugugcagaagugguaguguuuaauugauucugagucagagcauguuaccaagccucucaagucuucaaagucuguccuuaaggaaaauagucaaagaagcuuggucuccaguguggcuccuugggcccacuucccuuuccaagucuuauuuuuugucuaacauuuugcuguuuccuaguaauugaugcccaggaugauuucauacuuuauuucaaaccucagcaccuagguauggauuuuaucuuuaaacccuuuuuuuauacuuuagaugugguuucucccuggauuaaaguguuagaaguuuggcaagguauggcaauguugauaaaugauugaaccuuacagaacuggggccuaggccuggguguuuggaccguaaaaccuucaguaaacacuagucuucugaagugaguuacuucccauaagaguuuuuuuguucuaaaaggaggccacacaugugcuuugccuguuuugcaugucaugguugguuuuuuguuuguuuguuuuuguuuuguuuuguguuuuccuuucuuccacauuauaauccauucccucccuaccagaagucaaauagauagaggccaaucaaucuuagacugucuaacucuacaacugagaacugaauuuaaaugagcuuccuuuuaaaauuaaugacccacugucauguauuuugcuagagcaacugaaaacagacuaauauaaauccuguauuaauuggcuauguuauaauauaacagaaucauaacuuuuagaagcauaucuaaaaugaccuucaaaaggacguccuuaucagcuuauugaaagcaguuguuguucuaccguaugcuagugucuccucuaguaaauacauuacauaggagaagcauuaacauugaacugauagaacuuauagauuucugaguuaacauaguagagugaauauugccuucauucuuucucuuauuucuaaaauuuuguuuaaaaaaaugggagaaacaugagugaauagaaacuaggacaaaaagaaaaaugagaagagaauacagcagcauguuuugaauccugaagcuagacagaugaguaguaagucagccagccagccagccaguccagguugaaucuuaagauagcacagauauggccagcagcacuugucaccguagccaaaggcuggaaacaauccaaauguccagcagcauuagcuuuucuaaguaauggaagaaaauacguuucagacacuaggauauuauucagccauaaaaaggcagaaauacuaaaacaugcacaccaugaaugaaacuugaaaacaucaaguuguguauaaggagccagucauaaaagaugacguucuguguaauugcgucaguaggaaggcuguagaauaggcagaucuguagcaagaagcagcuaggugugcuugucagggacuagggagagguggccauagagugacugaucagugcguucaggauuuccuuccucuugaugugaugaauugaacauuugagaacucgguaaggcagccacauggugugaguagaguaaguugcacugaguuuguguuuuauguaaaaugccuagaguaguaaaugucacuucaaccagauggcagcagcaggcaucugcuuucauacaguguuucugucuuugugugagauuggagguuuucgcugaguagguuaucuggaaagccccuacgcuaauggauauagccaaauauuagaguggggaucccugcuagggaggagucugcagagaugucagugcugcucagagccuuagaggagagcugagcuuucaugcagauucuucacccugacugacaccucaggacaggagccugaacaaggucccaagccuuggccuuugaguagcuagaggguaaucauaggucccuccugugagaaagcccugcauuauuaaagaccuugucagaacacagcgggauaaagaagcugcuuggaggaaauagaaaugauacagaugagaaaaaugaacaguccaauuucucggaauaauaaaaacauuuccaucguuugagggguaagcgcugcaacacagauccauuaccucaucuuaggcaaggucucagcaccuugaaacuuagguuccuucugcugcagccucccaagcagcuccagaacuaacuuggggacgaagaaacaucuaugaauuuuaacaaacucaucuugguugaguagcuaccaccaucaucacaguuaagcuguagaaacaguuuaucaggucucugcaauugucagauucuuguucaaaauagcaguuauuuaucagaaggucaagauuacaauccacuugcucugaguauucaaauuaugacauagagaagauuaauuuccuguguucccucuaugcuaguuagguuucuauugcugugauaaagcaccaugguccuccuuggggagggaaggcuuuauguggcucacagguuacaguccaucaucaagaaaaagccaaggcaggaaccuagaggcaggagcugaugcaaaggccauagaggcaugcugcuuacuggcuugccucauuacugcuuaaugacuuagaaaccaggaccaccuagcugggcaccauugccagugaacugggccuucucacauccagaaauauuugccuuaaaguuuugcuuacaguccacucugguggagguguuguuuuaacaaaaaaucuggcaacaugagaugaguguuagauuuaaaaagaaauacuugucuuagauagugguuuauugcucugaagagacaucaugaccacagcaacuuuuauaaaaggaaucauuuaauuggggcuggcuuauguuucagagguauaauucauuaucaucauggcugaaagcauuuguaggcacagauagugcuggagagguaguuacaaguucuacauccggaucagcaggcagcaggaagagagaggcacuaggccuggcuugggccucugaaaaucccaaagcucaccccuagugacacacuuccuccaacaaggccacaccucccaauagugccucucucuaugaauguauggguacaguuuucauucaaaccauuucagcacuuuuauuuaauauuguuaaauaauaagacaaaguuuaaagacuacugcuuacuggaguuuugggggcaauaauuuggcuugcucuguaaauuuuaagauucuaacuauuucuuagaaaugaaagucccaaagcuuggggccuguuuuauccuuaggacauaggaagaaauguuccucucaaggcugcugaggguuuugaugaagccauccuuuuuaggaccgagugcuccauugucucucauuuucugcauauuguccaauuaugggucucuguuggugcccauguacugcaaaaagaagcuucucugaucuaugaguauaggaguaugucauuacgagucauuuuauugcuuugaucuuuuagcagaauaacauagugggguuucccccagggcccaugaccuaucuagucucagauucuuggccauuucagcaauuucaaguaugggaucaaugucauggaguaggcuuuaaagucaaagauaaagugguuaguuacucucauuauacuuaugccaccaugacacuuauauuacaauuauacgaugucaccgcuacauuuaugccaccacacuuaugccaccgugacacaaugucauuaccauacuuauguuaccauuacacaaugucaccauuacacuuaugccaccauugacaugaugucaccaucacacuauaccaccagacuuaugccagcaucacauaauaucaccagcauacuuaugccaccaugacauaaugucaucaucauacuuaugccaccaugacacaaugccaccaucacacuuauguaccauuacaggaugcugccauuacacuaucuuacagucuuugagguugcagggcuuuuggcugagagauauuauuaccuuucucgucuaguagcaugcaaggugucuuccagugccaugagcaauagucaguaggggacaagcuucgaguuacacauaacuagaaugucuccacauuagaugacauacauaagugcaguuuucagcaauaggaccuuacuaucaaguuguggaggguaaccaauagccuuggcaaucgccugugauguauggaguuuucaugggaccccuuuggccaauaauucaacaagauauaacucauuucugacacuggauguuauacuugguggcaugucuugugagacauugucuccccuauuacuuggcuaccccauuuauacuccuuucuuauauguauguauuuuaggaagcuucuacaguaguaaguuuccauacuuccaaguuuuuugauccuaaauuguaauggggaggaaagguugugaucagagccaguagguagauuccagaguauccucuacaguuaugucuaagccucccaagugcauucucuuaccagcauaaccugguugccuauaauacacuaacaucuacucaugauuaccguguucuaguuuuauuaagaauauuagaugucauauugaugauagcaaugcaagaucauuugaaacaaaucuuucuauacucuuuaaagcuucaggcacuccacuuaugccuuauuuaaagaaugaacagauaauuuuaugaguuuaggagcaagauguuuuauuuauuucucugaaucaauugucuuuccauguauuucuuaauaaugcccaggagucuuagucaggugugguggcucaugucugcuaacucagcacucaggaggcugaggcaggggaauuaucauggccacauaguaaguuccaggccagccgaggccacagagggagaccuugucucaaaaacaauaauugaugccuagcauauaaauauauacauacacacuuguauguacauguauauauauauaugcucacauaauuaagucugaaaucuugcauucauuccuuuuugcauggagaaaaagaacuuugaaacuuaauuaaauuguagugucuuuggaggugggcacuagagggcuaggauuaagaguuuguaucaugaggaacuagccuaagcaaucaugugaguaccacuuuucacauuaaaucguacuuguuuucugauucuguuuuuuucaguuuccauagcaaggcguguucaagauccauuagcugagcuagugaaauuugacccgaagcacauuggaguuggaauguaucagguaaagcaauguggaucguuuaauuuugaaacccaucaauacaaagaguaugcuaagccugacuuuguacuuagccauuacuggauguagauuuccauuuucaaagccuauacaguuucaagcugucagggaaagagagauuucuucuugcuuuuucuugucuuaauuauuuugauuaaguuuuuaaguuggcuauagucagauuuaaagacuuuggaaacauuaguccagguggaauggugcguaaacauuagguucaacuggguacuugauuuggagaccuggucuuuuucaacucuauuacaaaacauggaaggaguguggaccauugggcaugugacucuuuguuuaaaccagaaugaacucaguuguuacugaccucccaggaaccucucugguuuuuacugugaccuuuuuucuauauucacuucuauuuggucauuauuaguuuuggauuuuaccaagagcaguuuaaagucuuguaguugcugauguacugccacccucauuauggcuuuuguugguacuguauuuccaauucuugagguuguaugcaugcacugaacgacugaggauagcagugaaccuuggcaaagagagguacauaaagaaugugggauauggaauccugaagguugugucaaaagaagucuccuuuuuguaguaauucuuggcuaaucugugcaugugauauucacuugaacuccuagcuacucaugaggcugaagcaagaugauuucaugaguucauaaguuugaacccagccuggccaauaugcaagacuuugucccuaccucccaaguuguccuuguuguugcuauuguuguuguacaguuugguuuuugauagagggucuuacuguagucuaggcucccuggaaagcauuauguaguccaggauggccucaaauucauggaaauccuccugucucagucucuucauguuggaaauauagccaacccuggcaggaaagugcuuuuuagaucuaaaguacaguauuuuccacucagauuuucauggggcugaguggugcuguguuauccuuuuuucuaaaagaguauuaagucauggcgucuguauuaccagaaaugggagaaauuccagaaaucauuccgcucuaccccaucauuugacagcaaaacaaaaccaaaauacugugcccuagaagcacacaguggcagaguuuggacugaugugucacaugcauugauacccaacugagacuauuagcauuuuaugcuggcuggugguagaacuagcuaucgucuagucuauuuggacuucgagaugucuuuaagauugcugauauacacugcuguaugucuauagaagguuaauaaggagaaaaggugugaaguuuuuuguuuugccuuguuuuguuuugguugguugguuguuuugugggugacaucaccuaccagacuagaguacagaggaaugaaggaagaaaggcaagcuucucccugcuuccuggccaccaugagguaggccacauugcuccaccauucucuccugucaaguaauaaaauuucuggaaccuugggccaaaugaaucuuucuucucugaaauaguuuugcugagguguuuugucgcagugauaaaaaucugaccaaacaagaugaaagaaaggaaggaagaguagaagcagcguggaaaaggaccauguagcacagcuccacaugcaaggcacuuguuaacacaaaagugugaagccagcugauaggguagggaaauuacuugccauaaauucauauguauuguguaacaauuauguauuuuacuauuaagaacuuugauuuuuuuuccuuguugguuuauauauauuuauauguugguuuauuuagaacauuuauauacaauauauaaagagccugucuccauagcauggcaccauuaauaaugcaggguuuugugcccuauacacuugcaagcgaccauaguccaggcccugggaugacugaguaaggaugcagugcuuccaugggcacugagccaaacccugucucagaaacaagcaaacaaacaaacaaacaaaagcagauuccuaaggaaggucuguuaacaugagaaguuauuuuugaaaugaucuauuuaaauuacacaaaguuguuaauacagaaguaaacugaauuucaaaguguagccgugaauuucuguuaaagaagacagugacaggcagaacaugaugagaaaguuuuacuuucuuugaucuucaauuuucuauauugaauauauauucugaaauuuuauuauaaauuacauauuuauuuauuuguuuauaucccagccuaugggccauuuaauauuaucuucauacaauagaacaauagugggacugacuuucuuuuuaguuggggucccuuugugacuuugauuuaaguuucauuuaaguuucauccugacuuaaaacaagagaaaagccagauaaacauuguugauugagaaaaugagagguguuuaaagaaauuguguuaaagguguuaaugaagucguagaaacuacaguauaacuucaauggaaacucaaaugccauuggguuaacagcagcuaaaauccuuuugacaguguuccaguucuugucugagaaaaugaggagagcugauuuuaaaaacacaugccuguuguuauuucuggagaacgaggcagccaguguggucgacugacaacauaucccugaucgaccccuaaagauguugcugcaaaguggcuugguguugcucccaaacaaacagucugaggugaaaaaaagcaggaugacgcagggccuggguugggugcugugggaugugaggcugaaggcuucacuuggccuuguggugcccugaguuuaggggauggguguacugguucuuaugucuuaugguucuuauaucacguagaaaaaacucagacacccucuuuucucauuuugugccucuguuagaucauuugcugauauuacagagugaggaggcagaacccuuaguggacuguguacccagaccguccuuacuccucaaugcuggggauagcaggagucacuguaaagggaaccuggcaggcagcaguuugcauuuucuccucuccuccuccauggaauaaauccugcauaaaaaaauaaaguaaaucagaaccaaacagaggugaaaguucuuccugucaaaguacugggugggcagaacccucugcaaccugcaaggguacaggaauggcuaggucauaaaggcgagccugcuuaucuuuuuguuuauugcuuagauggaucuuuuaaaacacaacacauuugagcugcugaguaaggagucaguauagagugagacuucugagcugcccauaguuaucugggugacuugcuuaggucacuacuaucaucguuagcuucuucacuaaggcaaaugugagacagagaacuuuccaaaugagggguuagccacugcgcugacuggcuuuugucugcuugacacaaaucuagagcuaucucggaagaggaacuucaacugagaaaaugccucaaucagacuggacuguagacaaguugguguuggaaggcccagcuuacugaagcagggccaccauugggcaggugguccuggguucuauaagaaagcagacacaguaagccaugagggaagccaauaaacagcauuccuccauggucucugccuuaguuccuuccuccagguaccugccuugcuucccuaauaauggacuguaacuucuaagccacauaaacgcucccauuccccaguugcguuugguuauggccuuugucacagcaccagaaaccuaaccaacuggguaaauuuccugccaaaaugauucugcagucucaucccucaacugagcaggacacagacuguauugaaucucugcuuucagaguuuccaaagagccuggaauucagagguuucuucaucuaugacuuaacugaauguauacaaguaauugaccaugacaaacacuguaaacuaaacucagauguuaguacuuguuaauuauuacucaaauuaucaguuuuaaauguaucaccugaauaguuuucuuacaccugauuauauugagcuuucuacacugaaauaguaacuucacuuuuugucugacaacggaugcaugccccauacccugguguaaauuguugguguuauuugaagagccuuuuauaaguaaugcauugaguuaauagugacauaucuaacuucucuguuauuuucccuugcaugucauuagcuucaguagugaaacaaaaauuuuaugucauuuuuuacuuuauaucuucugauuuuuauauauuaacacuaaaaucuauuaugagauauagaacuuuaagauauuuucaguguuuaaaaaugaacauuaacauguuaacaugagcacugaaaaacuuacacauuacaguaaaaggugaccauaaagggaaagauuacacuacguuugaaucuaaaauguucucugggucagaccgcaauuaggucacauacagggagaacacuggugauccugcauauuccucauagggguguagaucagcacagccucuuagagagcaguuagaaaccaguaaaguuggagguagagacgccaacccagcaauuuuuuugcuacaagugcagagccuagaaaaaucaccucauauugauccaaagugacagggacaagaaguuucuggagacacuguuucuagcagugaagauauacagaugugugucccuugucuggaaaacaggaagaaaaauuaguguaauauucuuauauuguucacuguugugugcacugagagcuaccuuacaggagguaauagagaagggggagagagagguggagugugugcacaggcgcauauagcuggcagaaagcuagacuguaacaaacagcacggccacuuuugucuauacauguauaaagauauaaaaacaaacuugggugccugagauaauggcugcuuuaagugaagcgaggacagggcgaagugggaaucugaacagcugucucuuuuugagcuguauuccaaaacauuuguuaaauauuuuauacuuuuaaaaauaugcaggaaguuggguccaaugcuaaacaugcccuaacuugggaacauugucuuucaguugguuuuuaauuucucauacguuuugugucuaaaugugugagaguagaggauuuuuucuaaaaucagaaaaaaguaaacaagaaaaaauuacucuuuuagguuaugguuguuuucaaaaugcuaagcgggguauuuuucuuugagaccuaauguuguacagaguagucuuuagggcuugcuuugauaauaccuugaggaaauguucaccucauaaacacagucuucuguaaauuuuaugacuaaauaucauuucuuuugcuuccuuggaaacuguagagauugugcccagacagacuguuggagucuaauguucauuacaggacugcgaaggcaucuucagacuggcuggcaucugugucugacuacucauccugcagugucgcucucucugacuccagagugcucugaauuagaaauguuaagguugagcaagaaagcuuuaaaaagaaaaauaaucugguuuagaccacacuccucagagauuuuauuucgcuuggucuggguugggccucacauggcaacagagcuuuugugacguaucugggccaugugggaucccagaaguugcucaguauugacauagaacggguuuaaagugcacauucuuguaucuuuucaaggcccauagaauaagaaauuugggggaagagcuuuccagccuguuuugucagcccagguuuaauaguccuggucucuaaugcuucucaucuugaauaugcuauauagccccguggagguucucaaagugcacucucuacuucaguuggccugugguggucaguaagauucuguuucuagaaagcacccagauuauagcaagacauccugcuucaacccucccagggcccaccaagcaucacugaaucggauuaggauuuucauaagacuucuagugucugaaaugucuauuauggugucuguaauguagcagauauucagggaauccugucagggaagucaagcauuugaggaagcaaacauuauuauuauaugaaaaucacaaagagaaaguggaucaauaacuuaggauauaccuuucauauuucauguucaaaauggaaagagggagggguuuacaggaagaaauucugguguaguguuguugaaagggagaccaguuguacagaagcaaggcuuuuugaugguuuuuaccguaaugaacccauaugugaagggacagauacuguuaaccugauuuaaaaacauuacaccauguguguauguauguauguauguauguauguguguguaugugccuguauaccucauuaauauguacauuuuauguguuggcaaaugcauuuucaaacuguaagauuaauacagaggaaaagccaaucaugacaguaacaagagugaccugacuacaucgacagaaggaaaugagcgguggaucugggauucgcugaaugagaagggaacauggagagacagucacagaucuuaaagaagcucggaacuagaauauuuucaaguaugaauuggagaagggaaaaguuggagauuguagaggagcaagcugagcaugugaagggauauugugagccaggaaguggacaugaagauuugagaugcucgugggugugacugauaagagggauuuagcccaggcuuguacacaugcuaggaaaauauuccaacauugagcuguauccacagccauuuacacacauacacacacacacacacacacacacacagagagagagagagagagagagagagagagagauccucuuguauuacucuagucuuaacauuuugauuccuagaauuuuuauuuuuuauguucaauuuacaaauuaguucagcucuggcugcagaagugcuuaaaccauuuuccaugugaauguuuacugccacagggguguuggggguagauucggguguggguauggaggugccucagcuauagcauuucauccugagcauugacacucauuccguugaauacuugcaauaaacuccuaagaugacaugcucuaguauuucauaaauagccuccccaccuuaguccucaugccucaugucaguaacuuauauuggguauauacuuuuuuuuccagagucuuacuguuaagaccuuaguaaucugaagacguuuuguguuguuuacguauuuugacucauucacacacugcaugcucuggaacacugaugcaguuucugauuuugagcuuuauuguuuuuuuuuuuuuuuuuuuuuuccccuacuagagacuacaagccuuuggauuuaguucauaguagagucuagccacgugaaagcuuuguuuacauguucuaaaugugauuugucccaaagcugagguagugaugugcugacuauagcugcauucuuguggcuccuugucagaacaaugcuuuauguccaguacauggaggcaauacuaauuaacccuuuaagaaaguaacucuuucucuacuaaaucuacuguuuauccaguaaucugaggucguacacaucuucagaagauucucuguaacauuguuuuccuagagugauuuccaguuaaaaccagcaguugaaaauuguggguguaaaacagacccugaaugugugagguccugagugaacccaugcuguugacaugaacagugucaaggucucucaccucagacccauaggacaauggaaggagacacagagagaaguggcaaaauauucccuucugguccauguguggauguugcuagugugugcaggaaauguccaccacagcuucccaccccuaccagauguuuacagauugaagacuucuucccaacaggacuguccccaccaagacuagacaaaccuguuuccuugaucuaguugugugcuguaaccugccucccgguuugucuguaugugacagucguugcucaucuauauccaguaaucucaucucuuuauaugugugugugugugugugugugugugugugugugugugugugaauaauaaacaugcuaagcuucaagaugugaggcuucuccaucuaucuauuuauuuauuuauuuauuuauucccagcuuuuuguuucugucugucugucuaucugucugucuuuucuucauuuccuucauugcucccaacugggacaaauccugggaggcccaguaagggaucuguggaaaaguuagagaaggugugguuuucccuguuguuagccacugagagucugccugagacaggaaagagcuggcuccucuguuuucuuuuguuuuaaagaaugacugaggaagaaaggguugcugcuguugguuggcagaaccacaguccacacaccucucuuacuucccucuuccucuaaacuguguaugugucuccauggcaugauguuuaccaggacaggggggaggagugcugcuguagugucggaaaucagcaaaucuauuucuauuaacuuuuaccuaauacauuuuuaucagaaauuccuucguuucaguggcauucauuagaauagggccuuuccuuuagagcaaaacuaucaaaagaaguuugucugcccuccuaauugaucuuugguauaagcccuaagaaaguuuuuaauaugcuagaccucauauuggcugaauauggacaaauauuauauggacuaaggugcuuuaagauuacucuaaaaauguucaguuugaguauuuauauagauauucuguuuugcugaguuuggagauauacuuaugucugaaauuacuggcacaacauggagaaucuuggaagcaguuuuuaacuuuggaaaaaaaucucucugcacuauaauaauauucgcauuggagaaaaggaguugagaggcucuuguguagugguguacaugccucacauguggaauauccugaauucaguucccagcaccaugaagggauaguugaaaacccuaguacuauaagauuauaacuuugugcuaguaaauuagugacugagaaaagaaagaaaauguguaaauauuaaaagggccauuuuguacugggcauuuaaaacuguauauuucuaauuuaugguaucuaguacauugagaaauacugaacauagcuuuauuuauaaguagagugccauucauuggucaucgucuuuagaagaacccugguaauuagagugcucaugaaauuccguuuuacauccauggaaaggaacuaucaguagcacaguggcggcucacggugauccaugcuccugggggaaggacuugggcagaggggcugcugagccacgaacccugugucugcaaagcgacucuaaugaaaugugguacaggagagcuagccaugcugaguugcagugugagcgcauccucacaggagcaggcaacacuaccaaaucugucucuugcuguggacaguugcuuugcaguaucuuucugguacuccuagaauaccagaauccaaaugagaagaaaaaaauuaaaucaagaccagaagacuguccaaguuuaugaaaguuuucuuuuccucucuacuguccucagcauuuaauaccauuaccuagcaaaaaaguucauuugcuaggaauuguacagaguggucucugaguccauaggaggagaagcaccuguugccugacauuuugaacaacugauuuuagaaaacaucuuuauuugggggugagacugcuacuugguugacaucuuaggguaccaggauaagauuuuuuuuuaaauaagaucagguaucuaaguuguuuguuguacaguuuuacuuuuacaaguguaugcuuucaaauguguaauugaaagagaagucucuucugaugugcccagguuucauuauuuauuuggaguggaugggcccagaguaugaguacagucagauuuuguuggaggggcaacgacuuucugagacaugauguacacgugaguguuucuaagucucagaggugugauuaugucauagcagcauaaccucugggcuugcuuuauuaccuuuauuaaaacaaaucuguauggggugcuauguaugucucggugaugaaggaaaugaggugguuaauuuauuaugugaacagcacuuucaacuaaccgcagcaugauucacugagaguggcauagaaaaccccagcucugcggaguugcuccgcugcuguuugauuuguggaccuuaacuuucaacaccagagcaugaaguuuaucuacaaaacaguucucuccuuuuuuuccucuaauauuuuugucuaaauuuaaacuugaaauuuuccuuuauuuuauugugggcacuuacugagucaaaacggaacaguccuugccaaugaccucaaggggaaguaggccgagaaucuaugugugaggccauuaggaaagcgaguagcauaucgugacaguuuccaaaccucuggggucccucagaagaccuucauggcuucaauacguaaagauaacuguguagaaucagacuggaguuaggggcaaguccagcaucugaggucuccuccuccuguuccguguccucacacuaauacuacuauggaaaagucuccugcaagaggcucccccccaccccccggguguuuauuuguggcuggagggugguugugggaggagcugugagcgccacaccacacagagguguguggacgacagugagguaggagaggagcugggagucuaacgagcucacagugcauauaaagcuccuguuguauacucauaaacagccacugaauggccggccaagaagguuguuuuccuuggagcugagccauguccagcaucaucugugaugugaaccugacuagaaggugagugaaaauaggucaucuucccagggugauuuuugaaagacucuuucuuuucauuuucuagauuugcccgguaccacucauuuauagaccaaaagaaaaaagaaaaaaagccaagcuagaaaucagccaggcauuguacuaacaagcuaaugaggcauuuacuaucugagacagcaccaguuucuguaacguaaggcuagcagagaguguggacggcaagggugcuggcaucuggggugggugcugcccaggcaucacagccaggcugcccuguaacagugugccugcacaugucagccugcuucagcuacagcugcagcagaaacuucaucucauaagaaguuggggaguagccaaacuuugagccauaaugauugggucucuccagcucccaugucuucucgcuaggagaagaaaaucauuuuggaccaauaggcuuuggagaagacacuuuugggcaguagguaaccuaguaaaagugggcuucucaacaguuuuugcuacaguuuagaaggcugagauuuaacauuuauuuuugggaguuguuuuuaaaagucuaauaguuuuacuccucucaguaccacaacucagugcagaucaucacagccacugccaaagccuggguccuggagaagggccggcccugggguaccuugcaaagcacucuucugcgcugguuucugauggcuccaaguaacuccugaggcauuuguucccgagucccuccuuccaggccuccuuacccauccuuuaugugguuugaaauauauccaggcauccuuugacaagugagccgaucauuauuuguagcauaaaauuugcaaagaugagaguuaacacaaauuuaggcagcuuuuugaauuucucaauguacaaauguauggaucuguacaaagguuagcagcauuaccugcacccaggaccaguaauggcagcaugacacagggaguccccugagucugcugucugagcacagccuaaaguaaaugucaccuuacaguugagagugauacaggaagaagaacacuuuaugggaaauuuauuuaucauuaagcuuguaagagauucuuggguagguauuguauccggggcacaaaaccauguucauugaccuaugucaaucuuugcaguugaauagcuguacuucuggguguguuuaaucaguuugccugagggcuaguagucugacauagacagagucucucuuaaacuuaaauuguguaaacauucucagggcaccaucaugguuucagugugguucaguggagagaauguagccucgggcaccguggcuuuaccuuuaccgccuccccuuggugaaaucauuuuacuuguucaugcuuuguugggaaauaaggauacccacaugcuuucuagaagacuguuaaaaagagaaagaaaauagacaugaccgugccucaagguuaaggcaugaaugugcuuuuguugcuuaggagacguuaaauaaauuccguguacuuuagaauucuuuggccuuuuuguuguuguuguuaaaguccauuuuacucuaaauauuuauucauauguuaagcuuaucagguauucauagacucauucaaugucaagcuugcucaggucauacuggcacacauaaacauguucguuccugucugccaaaagggaggaggacagaagcagcugugggcaaaauuuacgaacaaagaaucagaguggcagccucgcuaugaccguaguccaggaaugaggaaaugaggccugugcugccucucacuuguacggggagaggagaguuaggcguuuggagccgaaucagagcaugcaugugagacuucuguuagugauuauccaagucuacagugcuucacauguuaucugauucacgugugcaucugauucuucuguugugguugucccguguuuaaguugacucacuguucuggaggugggguuagaagagaguagagcgcuuaaagacaaacacagcagauaaagcagaaacaaucuccgcgguucugggccucacgaucugauugugcgguggcaacaaaaagcagcuguuuguugacagcugccuuuccucucacaaucaagcuguuucuaaucauggaauuaccagcucuuuuguguuggagacuuguuggagauuuauagucgguaucauaauguuugccgaacgucaucguuuagauaaaauuagugauucuccuguagucauccuacugaaauaugcauguggauuguaauaaaagaaagaugccugaagaaacuuccgagguacauucugaacugaagggcgugcagcgguggcuuuucaugcauguuucccccuuggugcaaugcucaccuucuuggggacccguuacugaaaggcauucuguuuuuggcuuccuuacacgaauguagucuacacaugugcagacacuagaaaagcuuguucugaucccaaaggccaucguugcuggccugcuggccucuugacauucuucccuagaacacuguugguguucacgccacugaugcugaagccagggaugaagccaggaaaugaagcuaaaucaaaguucugcuucugcagugaugcuucagccuccaggguagcucuaccagcuggaaaggaccugagugugccucuugcuguccauguucccaggccuuugugugaauccuccucacucugcacugccauuagaaacgaggaagcucugugcucuaggaagcagagcggguaaaggugagcugcugcugcuccacuuaauccuacugaagaauaaaagaaagguuuucucuagacuagacgugcuucucagaggcugccuugggaaauaccccugucacugcagugugaccacucugcuuuuauuuucuaagugugucuuugauugcuuuguugcucgcuuugaaauuugaaauuucaacaguuaaaaauaauugacauaguauucucccucuggucaucaagguguauuauagaaauuaaaaaguauucgcagucuaaaaauguauuuuaaaaagagacagugaauagcaacuuuccuugugagagacugagcaggaaaaggaauguauuagcuuaaaauguguggagaaucaauuuuugaaauaaauauuuuauaguauauauuuucauuaugcuuauacuguaucuuucauaugucuuuucuaaaagucuaaguuguaaaaauauuuugcucuauuuuaaaaguaucuaucaaaauccuuccucuugucuagccaaaugagcccaguuguuaacgggcacuaggcccucagugaugccaccgggccucaaugaugguugauacuuggggucauuaucaucagagucugacucauucugauuugauuacaccacaaaaaugucauaucuuuuagccgaucuuaaacuguuuuaauuacauuuaacaugggcauuuaguccuuaucuuaaaccuuagcuguaaaccacuguguugggauccaaaccaagagacuaagcaccaugguugcagcagugagaggugggagugugagguggucuccgcccgcagcugugccgauggcaggacucccuuggacugcugcuuuaguagcgcucaggugcaguucaggcaaaugagucacagaugagccaguuacaguacuuuacugcuugagugucaggggaaaaaauuuaguuguaguuuugagaacuucauccccaaaucauuuaaugcuguauuucauuucagcuguuccaaguuuaugaggauaaaaaucaaucaguuauauauaaaaaaugugcaaauccugacucuuaugaccuguguaggggaguaguagggcacugggagaagucacaggauauuauuacaccuuuuuauuucauuuuccauauuguuugguaaugccuucucaaaaacugugcuaaaaaauccauuauuaucagaccauuaagaaauacuggguuguuaugcuuugauuaacauccauggcuuuuauuuuugaaucagauucauaaauauauacauuuucucugucagucauugucuaaaauuucaauuugcccugcuuuccauuacauaccaugaauuauaugaaauuaauuuaaucacuacuacaaacagaaauugaaugugcccuaauccagaguuacguuguuugcuuuuacaacuguaagucauaaguaauuaauuuuccuuggaaaauuaauucacuuaccauucccaguagcaucauguguugacacaggguucuagguaguuuaauauuuuucuucagcauguuggccucaacuuuagaagaccuuaaaugaaaacaaauuaaaauuuaaucaacugaauauaauuugggcuuauuuaaaaauugggcuuauuuaaaauaaguguuguuguugaugucauccagguggugauuugaaaauuauauucaagcuuuccagaaucuccacuaguauauuaacaccucuaaaacaaucuaucuuugaaaagcuguuuacaugacaguaaucauuaguaugcucuggauaaacauuuuccaggacagcacuagacagugcaguauuugggaauguuuugccaucuuuugcugagugugcaaaucuagagauguacaugcucagcgcuuuggcggcuaaaguagcuggcugucauaccuguuuaucacagagguugcuuucaagaucucucuaccuccagcuucaccgaguaggaagaucucuggcaaacucuuuuuuuuuuuuaaguacuucuuuuuaaaauaauuuaucuacuuguauuuuauaugcauugguguuuugccugcuuguaugucugugugaggguaucagaucccuuggaacaggcguuacaggcaguugugagccgccucgugguugcugggaaucaaacccugguccucugaaagagcagccagugcacucaaccacugagccaucuacagacugcaagcucuucuuaaaaccugggcggugccucguaaacacgcgggaaguuguucccauguugauugugcuccuccgguccucucagccuccuguuuaauuccuuucccucuucucccagaaaggccagcauggaaacugaacugaguaaccgucuuccagcuaaagggauuaaguugcacacacugccgcguacauucugagaacucagaaaacacgagcaaaccaaauuuagcuucccuuugcauuugccagagguuauuuaguaaggugacuuuuuuccugguucauggaacucuauaaaacauacaguguuuauaacucuguuuauauuuguuuaagucacuaaggugagcuccggugaugcaggcaggguuacuuuucaacaagugggagcuuauuuuauaaaugugccuuuguggccguagcuuuagagagucaugugguagcagugaugugcucuuuaugucuuuuggaaagaaaauccacuguuuaauuccaaccuagaaauagcgugagaguccagaaucacugcuguugguuuuccuuucugucgguguucaguccagcucuuugcccugugcccuggaggugcagagaguccagggagaugguuugcuugcuacucucucuguagggaagcaacaaggacguccucaucccagugacucgguuucugucuucuaauuaguaguacggcuuucuucuuuacauccacagacaagaugaagacuccuguaacauaggaguagugucaagucauaggcacguuugugcugugacccagguacacauggcugcauggucacauuguuaagggaccuuucacauagaacugaagugggcauugaaggcagugaagacucgaagcuguacaucgugcacuuuuuauacuguuucuacagcaccuuuauucucaacugagccgaacaggcuugcuuugucuucuuuugaagugggaaaguaucaguaagcauuuuuacuuugaggauaaccucagaaaguuacauucaaaugagagguguuugacuugucggucucuuugcuuuuugggugaaaugguuauauuuuagaaccauguuaguuuuaucgugaacuaaggcacauacgggguuuauguguauaaacaggucucgagaguguggaaauaagaggugaugaauuugagcuacagauguuuaccuaaagcuggcaaauaaguuuguuuaaaaauuauucauucaagaaaggaaauuuccguacuuauucuuaggugagaauagaagaacuaagacuuuguaguagaaacauaguuuuaaaaaauuauauaauguuaagaugacacaaauuuugugacuuggcaaauaguacuuguaauguuugugacacucaacagaccagugacugucaugcaaaugccuuugugcagaauuuggcuuuggucaauuauaccuuuuuuuuuuuuuuuccggcccagaagcagaguguaaauaauuauacucacucuuaaauugcucccugaaguaugguaaaagugagauuugcagacucuuaauacuuguuagagaagaauauugauguuguauaaauuguaacuguucaguggacuccuuccaaaugacauggaguggaaaaguuaauuuuuacuuaaagaaacugcacaacuauucauuugcuuucaugccaugcuguuuuuuuuuuucaaagacugaauuugaauauauuuuuacuucucucaaaaauaauaauuaaauuaaggcgauagauaggacaauaaaauggcaguuugccagcacuaagauuaagagacucucuaguccugcaucaugggagucaugcucccaugguauccuguauaaccuggauucuaugcagauacaauggaguaaauccugugauacgucgacuuuuacuaagaugcugaaaucaaaccacaaacaacgcagacaggacugcacugaaaugcccagcuuuuuuugcuugccaaggcaacccaccgaccugugguguagacccagcucaucuagauaugcuuugcugucugugcaacaucauuugcgcuugguaucaucuuccauccaauguauuaaaacaucuccaagaaacugcauauuuguguaagaaggggggcaguuuaaaaacugcccucugaugacucugaagcaaacuagagauuuguucauugcaugggugagaugccacauuugcuccccuaaagcugcguagcagaagagaggaccauaacccuuagauucugccgucucugcguuaaaccagaacuuuuuuuccuccaucuauauuagaagagcaaguuuugaguucugauuuuuuuuuuucucacaaaucaaaauuucaaaguagaauuucuucgcaaacuuuaccacucacauugaguuuguaaauuuuaggauaaaagaacacuaguuaagaaacuauuuuaaaaauaaaacuaaaaacuuggauccuugugaacucuacagagcucucaagugugauggugucgccuuucacccucugcucgugucagcagacuaaaggugaaucugugcguggauucaucuucugugguaacuacagaaaugcacugcuugcuaauaaugacauugaguuuacuuuaacgccauuguaggcucugugugcuguaauacagaaaauaaugaguaauaugaaaugaaguagauuauucucucuaguaagggugcuuaacucugguggggccaccaaggaguuuggucaugauugacaagcaucuaguggagucuuuucuuuuucuuccucuuucccccccuguagcaauguugaagucagucaaagaauauauacaaagcugagcgaauaccaguuuccccaguacaggggcuauuuuuucaggaagucuaacucaaaccagauguuuugccuagaccuagaguuuguugcugccaaguaucucaucagaggucagaguucugggcucugggcccugcuagaauucuuucacaaauugcuauuuggugagguuuuaauccuaauggaaagaauaaugugcuuguaaaaucugcaguuauuacaaacacaguauacauauugugaacuucaaaugacuacauauuuuauucccauaaacagggacugcagauggaugccuacugugauagcuuuagacacucugacuaaagccuaguauacaguuuaugccacguuagccauuuucauuuguauuacccaguaaaagcaaugccuguguuugggugacacugggaacgaacucacacucucuaccaggaccaguuuucuuuuucuuaaaaacaaucuuugcaaccucauacagcuguuugaauacacaggaaggucuguggagaugacagcaggaagugaaaaguuccucgggugacaccaucgugucagaaugcaaguguccauguucagaaacaugucuguuggcaucacgugcauuugcucagaucucuuuggaaugguggguguaauugagacucauugggaaagaaggaagauuagugauauuuaccaauaguguauacuuaauacuguaaguauuauuacaugcugauuuaggggcucuguuguuguacaaguccaagaauaauucugaaguaccuacaauguguaaaacccaagaauccugauuuggccaauugauaaguuuguuuguuagacuggaccuacuaaaauuaaaucacuguuguaaguguggccaguuuguguguguguguguugacaauacaguagaauaucauauuuguggaaaagaaaauuaagcuuaaaaaaauuaaggacaaauucuaaugucucugaauuaugccauuucauuacaaagcauuuugguuccaacaguuuauaguauuuauuuggagaugggauucuaauuuucuuuuuguuuuuaaauggcaccaguauaagguguacuaaauauauaaauacagugcaaaaagguucuguaagucuuggaaagaaauaaaagcaguuaacuccaggacucauaauucuaauaggaccuaauaggauguauacaggagggcagugcuuucuaacuaccagucuuguuucaugucuauaaaagaaaauuagcauugaugccugcucugcugcacagacuggccauucaguuggcguugggaggggucaccagcucuaugaacuggcuguccuaauugcugccagcaagugagaaaaaaauauugaaguaugauacaaagagauuuuguuugggaaaaucuguaauguaucaauuuauuuaaaauaaaaggaucuuucuggcuucucuuccccuuccuacuguguacugacagcaucucccuuccuccuuuucucccucccucccucccucccugcaucuccugucuuccauauguguguguguguguguguguguguguguauuuguguguguguuuguguaugugugugcacugugcuauagaucaaaccaaggucuugaacuaacaagacauagacucuaccacuaggcucccuuucauauccuaaaugguguuuucuggucauucuuuuacucuuugaugccucugagcgugcauggucggccgcucucgcaccuagcuguggcccauucagaaccuuucagucucgcuguagcuaagcuucccuacagaaggucuuucuugaagacagguuuaguauugcuuucuaauguuuuuauugucuuugauauuucugagcaggaaaaugguguguuuuuaugaucauacgccucaguuuguagguuuuccuccuagacguccaaggagauaccauuaucaauuucuguaaacaaguagaaaauaaaugucaaaacuuaagccuccaauccauccuauguggcacaaucauucaaguauaauuuaaaacacagucugagacuaugaucacguaaugagaaacaaacaauuccauauuaaugagaacccauuugccaauaauucugucauuuguaacuugaaucagucaucaccccugcaaauaacccucucaagacauuauuugcaauuuuguccucugcuuucuguccuugauguugugaaaauggccgucuacuguuacaggaaugaaaagagaucccauucaaacaucuuuuguguuuccacuuucagugaaaaauguuuuucaaaccugcagcugguuauuucugcaggaguucccacuuaugcucagauuugauugacauuuugaaauggcagguuuucaugaaaagcuguuaacuuguagaauucaguuaugguaccaagacagacugacuuuguucuguggcugggaccuguccaaacuaaauagaccccugcaucugacuuuaauagugcacucggccacgauagggcacuuugccuuuuacuucccuccaagacugaugccucuuauguguucaaaaugaacgugauggauagucaugccaacagccuucuguucugcaguugcuuuaauuggcuuauagagucaucuucuuccccucuuaaauaucuaauggaccaagacagaccuucauuuuuaaauggaauaauaauuaagaagagcuucuuaauuugcaacuaauguuauacagcacaaaaaauuuaaaaauagugcagguuuuuuuuuuuccaguauagaggaucuaaaauuuuuggaaagccauuccuuauggaaaaguauguuacauauggcuauacagaucuguuugauauauuauucugugcaaauauaguuaauauuauucaucugcucauucaaccaguggacaauuucaaggacagcguacuagguagccaaguacauguacaguguacuuuuaaauuaagugucuuauuuuauauaacugcaggcccauaaggcuguuagcuccuaagguguucucccuguuuaagugccucacuguuuuuuaccuuugauccuauguagcaacauucucaugaguuuaauaugaaaaugugacuguugugcuuuccucugcuauucuuuggaaaauguaaguaaaaauguguuucccucccagcuacuugggugcugcuuaucuuaaauauuuuuugggggugguuugguuuuccuaucaagacaguacuaggaaagguuaucacugucaguccugauaucuuuuaguuuguuucauuguuguuuuaaauaaaauuuugcauuauugcccaugcuagccuuaaacgugagacaccccuucuauauggacuucuacauguugacuuuaagcacauaccucacugccuggcuucugauugccuuuggaagcuugaauuuauuucauugaaauagcuaauuccagaaaucuuaguucauuuuaagaaaaagagcuuauauacauacaagaauaugagcaagggcugcacagcccaucucuaagacugcuggucagagauauaguguuuuagugcuuuuuaucuuuuuuucuuauaguuuagguucaagguugaaguucauugagaauacaugaguucuuagcucuuuuauccacaggaauagguuggaaaacccuacaugauucuuuagaucaugcaugguagcagacccuauaugugaauauaugugucccuuauguuuuuuguacuguacuguacacacccauguuuuaaaaauuaaauucuaaauugagcacagugagagauuagugauaaugguuaugcagaccaguuauacaauguaaaguaugugaguagggucucucucuaaaucccuuauuucacauuuguuuuuacccuaaaggaaauacuuuggcauguaaguuucuaguaucagugcuccuguacauuguuccuauacauuacuccuauauauuggagccauugcuaaguagaguguggguuacucaaaugcaggcacuggggugccaagacaagugaucugaaguaagcuagcuacugagugauccaucacacagguggugaauacaacgcagauguacuggacaaaggcauccauguccaggaacaggcagaacagagcagaacuugaaacugaaguuuuggguuuguuuuuguuuguuuguuuuguuuuuguuuucugaaauuucccauuuaaccuuagagccacgguuaaccaccagaacugacacuguggaaagcaaaaccacagauaggcauacccuuguacugaacaaaaaugacaauucuaauagccuuggauuuuaguguucuacccaaguuuugcuccccaacaauuuauguaguugaaauaaaauuauccauuaccagucguaguaauauagaggauuucagaccaucagagaaggcuuauuaauaaaaguaaugcauuuugaaguuacagucucucugccauuucuaaucccagagagcuacuguguuacaaaauaucugaaacucaacaaaccaagaguugaagguaagucuacuuggauuugaucuugugcuugcuuacacauguauaguaagcauguagucuaauacccuacaucagagcacuugcuccuccagcacucaggaggccuggcuaagugagucugggaguuggagucuggccagggcuacacagagaaacccugucucaaaaagccaaaaacaaaacaaaaaaguuguuacuguucuuguuuauauacugcaaacaaaaugauggccaaggucccugguguugcucuuuauaacgucauuaaccauaaccagugucccacugcuuacuuuuuagcugaugguuacuguguugagauacagagaagaagcaguggugucugccauagaccugauaaacaccguuaacucugcccuaggggcagugcucuuccuccuuauguagucaggcgugcucagguccacuguucuguguacuuagucauaaccucaacccuuugauggacugccaccacagcucugugcugaauccccaucaucacagacccauagucaguuucccuuucgguaaaagaagcuucucugugaaacaaaaaucuuaggaaggcuaagucaccaucucagaaauguaaccauuuuaaaaguaauuguuuacaacucauggggaaagggugggaaaagccacugaaguaaucucugcuauagacuguauagagaguuuaauacaagcuuguaugccacucauaggaagaggggaaacacaccuaccuaugcugguggagaguucugggagguguguaaauguuuggcauguugaaaaauacuuuacccuugaaugauaguuucgcuagauacagacauucagauugagaauaauguuuccguaaagguuuuccugcaugcagucuacuaucuacagugucggauccauggugauuugguuuucauuucccuugaagaauuauccauauuuugaaccucugaaguuuguuguugcuugucgugacuugcaugggaguggccccgaaaagcucaauuguuuggauucuugguccacaguuggugcucuguuggaugugucucggggagaggggaugggcuuugagguuucuaaagccugugccauucccaauuaaugugcccacugccuccccauaugcuuuuggauagagaagugagcucucacuacugcuccagugccaugccuccugccgugcucccugccauaauggucauggacucacccuguggagccuugucuucuagaagcugccucaaucauggugucuuuucacaguaaaaacugacuaagaccaaagcuggugccugcccaggguaugugacagcccugaccauacuggcuuuuuuuugaguaauguggaagacuugggggcuuugaauuaagaaagcaguugagugguuuaaguaggaacuuggaagacaguaauacugagagcauuguagacuauugaagccuggcucagguuucagaaaggaacaauguuagguacuggccuagagaccauucuugauguuuuggcaaagaauguagauggcuuuuuguccuucuuauaugaaucugccugaacccaaauugaagaguuuuggacuaauuuugcuggcagaggagauuucaagauagccuaaaauugacuauguugcgugguuauuagugaacacucuuacguaggucuauaauaaaaaugagcaaauggggcagaaagaaaugcaaaauauguggucugaggagaaaaugaacauuugggaauuuaauguuuaagccaaugcuugugcugaaacacccacccccauuaaaaaggaaggaggggaaggggaaggggaaggggaaggggaagggaaaggaaaggaaaggaaaggaaaggaaaggaaaggaaaggaaaggaaaggaaaggaaaggaaaggaaaggaaaggaguccaaaugcaaguaaaagugagugguaaucuugcuguaagaccucauccagcuaauuccacagucuaugaaaagaaaagagcuaaagaauuaucuguuccuaaaaagcaucaguaaagguccuacuaacugaggagccacuggcauucaaucgcuguggggagacagaacuggguuucuuuaaaaacaaucacacccgaccucacaguaggccccacucccuguaguaguuuggcaacacaaauuagacuugagauauauaugagaaaaugagaacucaaaauuauaguggugaggauaaaucuagaaguguuggaaggugagaugaauaugaucaaaauacauuauaugaaauucccaaagaauuaauaaaaaaaauuuuuaaggauccaguuauccaaagcagacaagaacucuguuuuauuuagcaguacccacuuucuuaguagggucuacuuugccaggaucuccugaggggaaagugucuaccugccacacugagaaggacuucuucugggggcuuuguauauagguccuccuuagugaagaaacuguguguguguugugggggaggggaggugaaauaaauacuuuacaugccucuugggguaagccuugugagugucaugguugagcugugucccugacaaguucaugcuuuauuugaaaagagaaucuuugagauauagcuugcuagauaaggccaugauagauuaaugugaaccuucauccagugaccaauguccuuaugagaacaaagaccucuggcacacaggcagagaauaccaugugcaggagacagggacuagaauccuguauagaagacagaggcuagaauugucccugugaggauuaucaugguccucgggauaaucuauuaugauaguuuccacauggcacaaaugccagcccaggcaucaguuguuggccuguuaauuuuugcugucuuggaaggaaacugcuguguagccugacuuugaauaaaugccccugacuuguccauuauggucucugacacauccuaagucagagcucuggaaaggcucuaccugccuuggaaagcucccuccucaauuguauucucucugcaguguccuccucaaggggcuuagugcugaggcacugaagcagacaggucccaagcugcugacaccugguggcagauccacuguggaguauuugucaaggaaaaacaaaaccaggaucuuuuuuguucuccuucaugcuuucuuaaacuucacugggagaaaagucuagaacuuacaucuuuaaauuuaguccuuauugaaauggaaaaagguuuuaugggugagcuuccucagugguugagaauuuggucugaugcuuaauaacagacaucauuaaaagcaaguauggcucgggcguggucacugauagcacguggcuuuuuucauggugucccugcauguuuuuuuuuuuuuucauguguuucuaacuuggguuuuguggcuuaacuaguacuaacucuuucucugguuuaucuuuauccugugagguauugccucuguaaucucacauuguagacaggaacuugccauacugugaccuccuaacccaugcaauaaauccucugaaauuaauucuauuucauucugaucugugcccaugugacucuucucaagacuccauuauuagauucugacagccuuuuaaauuuguaagugccacaaauaugucacuagagacuaauggauaaaaagagaauuccuugcuggagaggauauggguagaauauuucaaguggcagaucugcaucaauaauguuaauguuuauggaguguugaaaaccguggcagucuuaugccagaaucauguucagcugcguacaagaaguuuugaccacagaagcuaagacauuuauuacuacaaauguuugucaaguucuuugcaacuauuuggaagacaguugucauucuucagagccugaaccauuaaugacagcgauaaauuguuaccagcaauaaaaguguuguccguugugcccaagaugacuuuucucugccucaaauucuuaaaauggagucaauuaauuuaguugugugguuuuacuuuuuuuuucuuuguccucugggaauauuuucuuuuaauuuauuaugguaugugugugugugugcgcgcacguguguacauauguacauguguguggacacagacacacacucggaggucaacgcacaauugcagaaguugaucuucucuuuccacuuugugggucucagggacacaaacccaguggguuugugacaugugccucugcaagccaucuucccagcacccuagcaauauuuuuaagaacauuugcaucauucuuucuauugacuucuggccuugcuuccuaugucagaaguuuguguucccugcacagugagcagccacagagcaagaaccuugccuuguuuuucacuggccccaagaacugcuucugguuugggagacugggaaguauguucagaggaaauuugagaaaacauaaaggaaauuacccugaauaugaugucagguagcauguugauauuguuauuuuuagcuaagaggauaaagagcuuuucaaaauuaucauauuuuuuauccucauauuggcauugccuuugauauuuuuucuugaaaacuaguagcaaacagaaaacuaauuaaaaacuaagccaucauaaagugucucugagaacugaaaagaagaagggaaaggaagggaaagagagaacaaagaaagccaugauuaaagaacugagcaccuccucacggcauugcaacuaaaccgguguccacauugugugagcaagcaucucuuuccaaggcugugggaaggggcugccugagcaguaauagcauugugacuucacugggaaacuucacauuacauacaaagcaguugcuuuaguaaaauggcacauuucuuaaauguacuacaacaaagccacuuaacccacuacagugaaggguaaagaagaaaaguuaguucuugggaaguacuuaaggggaacgagauaggaguguucucuccacgguacaacugaugaccuugccaggaaauuacauuucacuuaauauuucuacuagccuucauuuaauuuuucuaacuuuaagagggugggaacuguucagaggcuaaggcuagaagcucacaaacuagaggccagccugggcuacagacuggaaaagaaggagaagauugggcuguggcuccaugacagugcuaaaggcggaacaagcuagcguggcucugcaucccaacugcuucaguuaagauggugacuccacuucuguaaaguuguagauguuaagaugcuaguauugagaaagacaucuaaggccugguuagccuauccucuuuaucuaaagaaauugaagucucaacagcuaguuaguguuucaguuauuggcagaacacuguucucuuccccucuguccucugaaucugcuguauggcagcaguuucuagauguuuuauuucauggccuaguagcauuuucuaaaagucuauuguggucacuaguuuccaggguauuugucagugauugccgacuccuuguauugacucccuggucucaucuuuucccccauuguaacagucuuucugcccacggcuugauaggggaaguggugcugugucucugacaccccauuauucaagguaaucucaacuuaauuaacaacugcuuucaucuguccuuguggcccacacugggaaggaaacucccaugccaugugcagccauaugcaguggccuggauggggaggucuggagccucuggugguagcaguagccucugaggaguuuggcacuuaugugagcgaccuugcaaggaaccuuugaccugaccguaccuccagccugucucuucacagaaagcucauaggagacccuccugagaggcucugccaagcuguucagaaacugaggauguaagugcuuguugcccguggccaggcuuuaggguaauuuguuacacagcaguagauaacuaaggcaguuggauagugaagaucugaugcauuucuaaaguuuucccuuguuggagcugagaaaaagaaaaaggacugucuuagcaucaaaauagcagggaugucauaauuacauaguaaaugacaguuacuuaaaggaaaauuaucuuguugagaaacuugucacacugcuccuucuuguguuuugcuauggagcaccgacaacuuuaucauuaccuggcauucacuuccugcugaguuucaguugaugacuuucaacuuugcccuguuuuauacucaguuauauucuagauaaaagaaaaaaaauguuguuuuuugaauugugccucaagaaacacuaaaccuaggaaaccaaguaguauggcauaauuucuucuuuguggcagaagauacaguccauauuuggauuuuguuuugccuucuuuuugaaagagucucacuguguggcccugacuguccuaaaacuugauuuauagaccaugcugacucuuaaacucacagagaucugccuguuucuaucgucuaagugcugggauuaaagacaugcgccaacaugaucccuuucuagguuuuaaaauguaguuguuuaaaaauaaauuugggaaucucaucaagacauguaacuacucagaaggaaaaaacaccaacaaacaaaaaacaguuggugagauacguuucuccuuucucccugggucugcugugggcauccgcacauguucacguucauguacaguugugugcaguaaccuaccaguguaauggaaaugucccaaaguagucauuuccauggaugaggaaguacaucugucacucauagcugaguugcuuagauggcuaaucauaauuauuuucugugugucagauaaaauaguacaguugguccuucuuagugacagaaggauagaaaaauuagggggaaagaaacaggaggaaggaaauuacaguuuuaugguaguucaaacuugcacccugucacggcaagucaccaugccguuuucugagaaaucaauuaucuuccuuuuucuccuaaaauugcacacagcuaccacuuagguaagauuuguaauacaggaauuuaaagguuuaucuguucucuuagaacaguuuuagucauagcaagucuuacaaaugagugggaaccauauuauaaacaagaaaagguaugcuuauuauuuuuaaaaaugugcccuuaaaaaucaagagauagguaaagucgguggguuuuuaacuuacgcaaaaaagcugggguuucuaacucuuuuauaggaagaucauauuuaaaugcuagggcuccagagacagagccauuguguucugcugcauugccuauaggaacuuaggcuguugcuucaguuucuucuucuauaacauggaaaaauaauguuucuuauaccaaggcaguguggggauggguucagacaauauuccaagauuguaugcuuccccuagcacccaacauuauuuuuucuagauuauuacuuugaaauggauaagauguaggugaagucuggcagccuguauggguucccuguagcauuuuuugcauucugcuccuugugugaauaacuaguaagcaaauugauggguccuauggcaauccagcccugucacaaccacauagagcaccugcugguacagcuuaagcgccugcucugcuggaugccacuggagauuguucuucacaaauaguagaacauuaccuccugucucccacagauggaauuuucagcaucauuuguauauagcaacuguagaaaacguggcaguaagguuuuggugacuuucuugcuuaaagaauguacauuuccacguugucccuugguucuuauggacccuuauccuguucuccugcaccuucccccaagacuuuccugcuuagucuguucaucccaucugaagaguaggagguccaucccuucaguucuauagaucucuggaacccuaaccuccacaccugcuaccuauggucuacaaguuagaaaucuaauaggcaucccagacuuacggguaaaaaagaaggcucagccuccuucuccccucuccagcugaacacauucacucaguuuguaaagcugcaaaccucauugaagcgucucugucuuaaaacccugagacuagcucuuccuggaggccacccacaacuccuugccaccugggugacuacauccauauuagauaauugucuuuaccccauaauguaacuuccucuugggaaugacagccauaugcuacucugcaaaccacaggucucuuucacaaucaagagggcaggauuacaggcuguaucacucaaagucaccuuaggaguuucaguuuccuuagugguggccugagacuacuuggggcuuguugguugguuuuccuuuuugcagagcugagauugaauucagguacaugaaagcaaggugagcucuuucuccaaguggcagccacagucuguguggcuuuuagacuggaugaagcucacuacugcuucccaguggaauggacuguggucaucuuuuuuggauuuuccauucagaacagcacacauucggacaguacuguuuuugugaugcauacaguagugccuccauuauuagagugucucugugguucccuuugccuuuuguuucuucucagugucaagaaaacaaauaaaacucaaaguaaacuagaagcaaaguguaaagugcuauaaacuuuucucuuagcacugcuuucauugugucucauaaguuuggguauaaugugucaacauuuucauuaaauuccaggaagucuuuaauuucuuucuucauuucuucccucaccaaguuaucauugaguaaagaguucuucaguuuccacguguuugugggcuuucuguaguuuuugcuguuauugaagaccagccuuaggccaugaugaucugauaggaugcaugguauuauuucagucuucuugaaucuguugaggauuguuuugugaccaauuauacagucaguuuuggagaagguaccaugaggugcugagaagaagguguguucuuuuguuuuagggugaaauguucuggagauaucuguuaaauccauuugauucauaaacucucuuaguuucacugugucucuguuuaguuuguuucaaugaccuguccauuggugagagugggguguugaaaucuccaacugcuauugugagggguucaauauguguuuugaguuuuaauaaaguuucuuuuaugaauuuggaugcucuugcauuuggggcauaaauguuaagaauugagacuuucucuugguggaguuucccuuugaugaauaugaagugcccuucuucaucacgcuugauaacuuuugguugaaagucuauuuuauuggacauuaggauagcaacuccugcuuguuucuugggaccauuugcuuggaagaccuuuuuccauccuuuuacacugagauaaugucugucuuuguuguugagguguguuucuuauaugcugcaaaaggcugaaucuuguuuguguaucuagccuguuagcuuaugucuuuuuauaggugagucuauuacuauugagagauauuaaagagaggugacuguugguuccugguauguuuguuuuuguagguagcuuuaugugcuuguggcucucuacuuuugacuuugcugugagaugcagaauaucuuguccuuucuuuggugcagguaucuuccuuguguugaguuuuccuuccaggauccuguaggcuggguugguagauagauacuauuugaauuugguuuuguccuagaauauucugguuucuccaucuauguucauugagaguuuugcuggguauaguaaccugggcuggaauuuguguuaucucucuuuuuuuaaaaaauauuuuuauuagguauuuuccucauuuacauuuccaaugcuaucccaaaagucccccauacccucccccccacuccccuaccaacccacucccacuuuuuggcccuggcauucccuuguacuggggcauauaaaguuugcaaguccaaugggccucucuuuccaaugauggcugacuaggccaucuuuugauacauaugcaccuagagucaagagcucugggguacugguuaguucauaauguuguuccaccuauaggguugcagaucccuuuagcuccuuggguacuuucucuagcuccuccauugggggcccugugauccauccaguagcugacugugagcauccacuucuguguuugcuaggccccggcauagucucacaagagagagcuauaucuggguccuuucagcaaaaucuugcaaguguaugcaauggugucagcguuuggaagcugauuaugggauggauccccagauauggcagucucuagaugguccauccuuucgucacagcuccaaacuuugucucuguaacuccuuccauggguguuuuguucccaauucuaagaaggggcaaaguguccacacuuuggucuucguucuucuugaguuucauguguuuagcaaauuguaucuuauaucuuggguauucuaauuuucugggcuaauauccacuuaucagugaguacauauugugugaguuccuuugugauuggguuaccucacucaggaugaugcccuccagguccauccauuugccuaggaauuucauaaauucauucuuuuuaauagcugaguaguacuccauuguguaaaugucccacauuuucuguauccauuccucuguugaggggcaucuggguucuuuccagcuucuggcuauuauaaauaaggcugcuaugaacauaguggagcauguguccuucuuaccaguaauuuguguucucuuagagucugcaugaccucugaccaggcccuucuggcuuuaauagucucuguugagaaaucugguauaauucugauaggucuacuuuuuuauguucccuugcagcuuuuaauauucuuuuucuuuucuuuucuuuucuuuucuuuucuuuuucccucugugcauuuaguguuuugaugauuaugugacaagaagauuuucuuuucuggucccauuuacuugguguucuauaggcuucuuguaccuuuauggccaucucuuucuuuggguuggggaaguuuucuucuaugauuuuguugaagacauuuucagguccuuugagcugagaaucuucauucuccucuauucugauuauccuuagauuuguucuuuucauuguguccugaauuuccuggaugcuuugguuuaggacuuuuuuauguuuugaauuuucuuugacaguugugucaaucucuucuaccguaucuucuacaccagagauucucucuucugucucauguauucuguugguaauacuuacaucugugauuucugaccucuuuccuagguuucuauuuccagguuugccuccauuuguguuuucuuuauuguuucuacuuccacuuuuuggucuuggauugcuuuauucaauuccuucaccuguuuaccuguguuuuccuguauuucuuucagugaauuauugauauccuuaaaggacucuauuaucuucaugagauaguauuuuaggacauuuuccugauuuucagguguguugcgguggugggagaacuggguggguucugaugaugcccacauauuuucgcuucuguugcuuaugcucucuugugccugccuuucaccaucuggauaccccugguguuuguugugacuguauggagucugccucuuugucucuggguuacaggucuccugguaggcuuguggcccugacuguaucagaccaccuauggggcauuccaacugggggcucuucacaagggcagagaagaugcugaucuuuguccuggcugcaguggaucuccugggaggccuucagacuguugggucuucagugaagcagucaagcuguuguccaacugcgcuguagagcagaggauccucaacugcucugagugcaguguguccaacugcucugagugcaguguguccaacugcucugaaugcaguguguccaacugcucugagugcagugggguccucaaauucucaacugcucugaaugcaguggguccucuagguuguauugggauauggagucuacacaggagcagaccaacuaggaggucugccccagcaauaaggacccggcagaagugguaauauuucuuuguacuuugguucaagauccuccaguuccuuuugugucuugaguuguaugaaauuaguggaguucacaaugccaggugcuagguauuacugaguuuuuagaaaagaggcacgaguauuugcagugcagagcaucagagauuguucucgcucaggucggaauuagcaggaacucuuuaaccuggaacuguacccagaaaccauucuucugcagacuugcuauacaagggccuggggucagucuuaauacacuauguuagagcagcuuagauuuuaguguaaaacuucugaguuugcugcuaacuguaccugcuagaaggguuuucucucuaauaugcauuuggggccgugucuccucauaucagcaggguguucaugcaccagcaccucuucuuacuugagggcaacucuuuuuuuucuuaauuuaauccucagcuuuugcaggaagaaucaaaaggcugagcugcaagaacuuuggcccugauuaacccucuuuucucuaguguauugaguaccugccauauccuggcagucaggcauuaggaagcagagaugcugagaauaguccaaguggcacauaaguccagaaaaacauccuccgcguaucuaguauucagugaagggcacaugaagauggcaggauucagcacucagugugugccagacacacgaggaaaugaaaugaaguuucuuacuuuuuacauucauuacacagaugaaagcaggaaaugagagggcagcauuucagagcccauuguucacuccuagcaaugcaggaagcuagggcugcagaauuccugaagcccacaugaagcuccugggcucuuugcugccaugauggcuugaaaagcaggauacacaagucaaaccuuguugccuguuguucugcugugacucuguggacgugugcugcuguggauccagugcuagcaauggcagccuucgcuuuuacuggggaaaguaagcugucucuaauaauaaugugcagaagccaguugguagccagagauuuauguagccacguguguaugggaugugcauuuggggagaaaauacacaucuuuagaacuuagagguaucaucagagaaccuuguuucuuuuuuaaaaacaacaaaaaccuugcauugguucuuugcucuucaucucugcuaccuuaggagacaguuaugacgaggagugucugugcccuuggacuuccucuccccgucccguggucucagaucagauuuucuacauucuucauuucuaguuuauuagaagggaauuuucucuguuguagcuaaaucuuuuuugcucuuuuuuuuuuucccugaagucugcuuuuaugauugggucauaaaucacuaaaacuaaagauuuauaguagaaaugucaacuccuuuguauuauauaaggucaaacuaugccacuaauuagugugcauuuguccaugcuuaugucaugagccaagaguauguuuuagcuguguggccacacaugaggcguggcccagcucggauguguuaauguucuuuuugcuaugauugaguggaucuugguuuagagaagucugugggcaaggcaggcauuuaggaguuaugggccuuuacugagccaaaacugcccaucuucucuccacuauaucauccuguauccacuaggggacauaagaguaccugcugugggacagagugaaagucaguucagaugugaacacugaacaguuacgucaauaugaaagacucaguucucauuucaugauucacaaggaagcuauacauucuguuuaagucucuguuaucacgagggauuuauaaggcaagaucagcaucuuaaaggaaugggaccaaacaagcagcuucuagcagguuuugcuauugaccugugcuccuuucuucggagucugggaaggugggaugagaaugcuucuaucuuucaagauaauaaguuuaaaagcaaggcuacuaaguguccggagagguccucuacugucaguccaauggacaaacuccagaguacuguauuuuacacccagucaccugccucagagccaugaagcccacgaucgagagcauaguugaguaucaguguucccaucuaaaccgugagcugagggaaucagauaucuuagcuaaugguuuggaagcuuagacuggaguuuuauuuuauauguucugugugugcugugcgaaggagaauggaagcuagaggucaacagcaggcaucguacuuauugggacaggaucucauuguagcagcgcucaucagucuggcuaggcuagcuggccaaugacaucuggggaucugccugcacuggccgguguugggaucagaauucaggucucccugcuugcccagcaggcaguuaauuacugacccaucuccucagcucuuuucagcuaaccuaaaauuauaaucuaugugucaaaaauacaaagacuuuaagugguaaaagacaaauuugcuuugauugaaguguuuaugucauuggacuauagcuggcacauuuauggcgcugcccugaggucuccagcuguacuccucaccuccugcccucccucugccugcugcuccucuggucguccuuugcugccuuuauuuggacagaaaagucaaaaaguuucuggcuuucaacuuucauuuguauugguuuucaccugcacuccucugcauuuuuuucugaguuguuaggcuagggauuguaauauauauucuuaccuuuucacuaauaugcaguggucagguuaccccagucccuguguaugugucacauauauaauauauaucuccaaauaccauguuaucauuuuuugcuuuaagugcuccuuuaucuuuaaguuaaauuagaauacguacaaacucauaauuauauacauguccacucauuucucaucuguugucaauuuucuuuagucagaaauuccauuuagcauuauuuuuguaggacaggucugcugccacucaguucucaucuaucugaaagugccuuuauuuuuuuuuccuuuaucuuugagagagagauuugaaguugacaagguuuuguguuucuuuuuccuuacacugaacauugaagauguccuuguccuguuuguuucugauagccaauacucaugcugcccuuggcccuucgauuauggugcccccuuucucacugcccugcucucacauuuccccuuugcucagcucuucagcaccucacagcauuccuauguauaguuuucuagucuuucuggaguucagcgugcugcuugaauuuuuacaauguuuuucaaaagaacuggaagguuucccuguccauagcucacauuuuuacuuuaucuacucucugcucuaaggucuugcacauuuacccuguuugguuucugcccugcagucacuucugucacugaggcucugcuguccccacucugucccuccuuuucaucuuaucucucauguuggaugauguccaugagucucuuuguguucucugauacauuucuccugcaauccaccauuaaacuuaauaacuuugguccauuaauuuuauuuuacuucagauacauuuuuauaaccauaugguugauauagccucuaauucucuucuuuuucuguuugcuuguuuguuuacuuacuuguuuguuuaucauauuugccucuuaguagcuuaaagcuuucuuaaaaguccucaccuguucucucugccauccuacauaauguucuguuggacaacuguugaccucuguuauagaccacauuggcucuuuuuuuuuuuuuuaauaccgacccauuuuauuuuacaugggacauaaugcagauuuuguuucuuccucagaguacucaauuuauuuugucaauaagguaauuuaccaacagaucagauugaauaugauagggauuuugagagguuuuaaauuugcagcaaaacuaagcagaaacuagaaagcucucauguauuuucuuccugcacagaagagcaggaucucaaacugcuagcauccugcaucauaguaguauaguuauugcagucgaugaacccauuaucaccaaagugcagaccugagaguuuuucuucuguagauuuugacauugguguaauggcauauaucuaggcuucuagaucuuguggaauaguuucagcauccugagaaguuaucugagucaugccuguucauucuaccuucaccucagucagccauaagcguucuucauuuuuuuauauggggcagccuuucccagaacacaguaggaagccuuugagauucacaccuuguacuucacaguguacguugcucaugcuuuuccaugaucugccagggcucuucuugucuggguauauugccauuuacaauucugucuacuaaaggcaucuuggugcuccugaguuuggguaauuaugaugaaagugaaaguuucuguguugacauaaguuuucaguucauuuggauaaggaccaaggaagaccuuuguguuuagaccugguuaaugcuuuaguauggaucccccaaaugacagagucuaaagcacccugcacaugcuucuuugccaucuguguaucuuuugccuguuuaaaguaauuauuccugaaucuuaaggguuucuuaggcuuuuuuguuauuagguucuaacuaauccauuuucucacagugugaccugucuuuucauuuccugaugguguccuuuucagaacagaagauuugaaagguauugaaaucagcugaucaguuuauucccuuaguaagccaggccacuuagcucucuccccagugacuggugaagaguuggugguuccagauuucacauuuagguccauacucacuuugaauugguucuguguuuacauucauuguuuguuuguuuucuuuuucauuaauuaauuguguauuuauuuuauauccugaucaaagcuccccucccuccucuucuuccagucccacccuuacaaaucuguacucccauuaccccuuucccaccuccuuagagaagggguagacccucccuuggguaccaccccacccugggacaucuagccucagcaggacuaagauagauagauagauucauuguuaacauuuuucugugucuagcugcuuuagcaacacuuuguugaaaagaugcuuuuugcuuuacugcauugccuuuauuucuuuguuaaagaucaguugauuacauuuaugggagacugucgcugggcuugucuguucccuuacucuguuguuugcuugcuuguuuccccccagugucucacugcuuacugagguuuuauagcaaauggggucuugacaguucacacaauugcuuguguccaucaguauuccauuggccauucugaguuuuuccuucucuguauaaauuuuaguaucccaaaaauaaugugcuacaauuugacuaguauugguuugaauuuauagaucaagaugagaagaacugacaucuuuucaauauuggguuguucuauccaugaauguggaauaacuucaacucauugaauucuucuguauauuuugccaaaguuuugugcuucucucucucucucucucucucucucucucucucucucucucucucucucucucucucacacacacacacacagggaaggagaaaagaugggagagggagagagacuauuuauauuuccaacuuaaauucuuuauuucuggacugcuaaaguaaauaauaaugucuuuuuaauuccaaguuucauucauucauugguuauagaagugugauugaaguuuauauuaauaugucuaucuguaccuugcuucuuuccugugauuucaacaaggacaauuuauuguuuuccuuuucaauauauacacuaucuuuuuucccugucuuccugggucuuagaggaugauguugagaaaggacauccuggauuuauugucauguuaguaauaaaccuaguugcuuaaccuaaugauguuagguguaggaauuuuuuaauaaauguuuucaauaaaguugagucagucagcuuguucaguguucccuuucuacaauaaugcugauuuuaccaugaauaaguguucaguuuucaaauguucuaugcauucauuuauagaauuuugugguuuugcuuguugaaaugguagguagaauccauugauugauuguugaguguggagcuaagguuaucuaucucaaauaaaucauaguugguuuuggcauaaauuuugaguuuaauuuguucauguuaaggauuuuugcaucucuguucauaagagguauggguuuaauguuuguuagaaguaacuauccuguggauccaugugagaaaagauuguuuuuaaaguuagggacauuaacucuuacucuagggcuaggauagccuacucugucuuuucugggaucucaacaaaacaucuggggcaggggagggagauggguccacacacgcacacacauacacacacacacacacacacccaugauugguaaggauacagcaucuuguguuuccaggcucuguggcccccacgucccagguagcuguuucuucuguguucuuauagacucuuguccuagaggucugguguuguguucauccugagucccacuaucucuuaaacaaacuucuggagcuuuguucuucaaauaguguguucuuaaaacuccagauaugucaguacucuuagacuacagggaugccgguuaagcucaguaagacugcugugcugccccaaaucuagaaacuguccucacacagcaagucgaagcuuuacccuauguggaguuuccuccucaggcuccucaucuccgauaauaguucuucauugccugcuuucuaguaccaguugucaaauauuaagguguagauaugacaagauuccuugaagccagacacagaaaaguugcuggagauuugugagcugugcagagauucccaaagguacauuguauccuggaaacaggagucuggucaugcagagugaaggaaucucaccgaacaucuguggauacucacuugaugcccugaaagguuaggcguuuaaaauuaaucaauuugucuugugcagaacaaauaaguuguagucccaaggauuuuucugucaaauuggcuugaauaauugauucccacuaaauaguaaaaacucaugcaaacuggaugcuuacugccauguuagcagucaccagcaucccaccaucugcuucacuggggggauuuacagagacuucuuccuguguuguuuuccucuccuaaccucuggccauauuucagucuguuuccagaucugaaaaucccucuggugcugaaagacuagugcccuuugcugucuuaaucccagggccccaugagcacagugagcuguucucugcacgguuugcucauuuaaagccuagaacuccucugugccauuuaguauguauguuuaaggaaugugcguaggaagaacucuuggauuuuugcaaaaucguuugucuuguugcaugugagaauuaucugugcccgggcagagcuagagccaggcuuucuguccugucuuuccugggacuucauaaggaccuuugugugcuguuguuuucucaagugcuuccccggcuccugucacuuccuucacccaugggucauucccacacuccccagaggacucacacugccccgugucaaucacagcaaaggacaugcaaggugaggaaagcagaggaaaccggccuggcugacaguuggaugggcguuccuguaaagugccgugucucacugcuuuguuuugcauggcggcuucugguuguauuuuauguuugguucgucuuuaagggccaggaaaggaccugagcgaugauuaaauaaauaaauaaauaaauacuccaaaagaaugccggucugagagccacacuugaaguuuagugugggauauguaaagugaagugcuguaaagugaagggcuuuugaaaaaauaauugugagaugauuuuggugcuucaggacagaauaacacaagcacuuugaugagcagucuccugaaguuugugguaaauaauaaaaauguggauucugaccucaaaaaagcugacuggcauaaaugacuauaauucucuuuuuaaaaucucauaaauuuuauguaaaaguauaauggcccuugaauuugaagaagucuguuuauacaauucacauaccccccccuccaaaugcagaguuggguaacuccuuuuuaaaaauagaaugguccacauuuucuggcacagguccuuggggauuauuaguagucagcgcuaggccaguagucacuucuugggccagugacuucagguauugccaugugucaugucucggcuuucagcaagucucagagaagcucugagacauugcaggugcaucacuucuagccuugucagcacccggcuccaugugcagugucugguagagaguagggguggacaccuuugcuuccaccagugacaugggcacaguaugggacuuuuagucucuuccccagauagacaagagaccauuuacuccuuccugagcagaaagguagaggaagucauuagcaaaggccaugaugauaguggacagcagugcucacgugacuuauuaaggaagggcuucugagggaacacaagcucagggaugcuauggacauuuuuaaacacaguauucuaguaaaauagcucgucuacucugguuuucauuugacugguuggcugauuuuuaguuucauaauacaucauuguguggcuguuuuaccaugugcuugucugagcccccucugaauggacaugggaacaacauacucagccuuacauuuguguugcuguuuccuuggaauauucuuauugugaagauauuaugagaaauagaugcaugcuguagacuguugugagaauucaauuagaugauguuauaaagacuuaaauaaugccugacugggaaaaaaaguuacaaaaaaaguauuuguugguaugcuucuucuuuucaucaccucugucuucuuuguuagacuuugagccccuagauaaggcauuugguuggaaaaccuuaguggucucagcucaaaaguuguuagaaccauaaggaaaacuauuauuauuuguuaagcagugaggaaaccucauuaccagaagcucaaaggaggggagaacacaguaaaguagcucacaucauagcaaucagcaaucaggaagcaacaagagaugggaaggcggugucuagagccgguucacccuggagcucccaucucuccuuguauacauacaccauccucagugagucaacugcucuuaugguccugcugucacauggugcaaagcuccuuguggucucuauugagcaauaguggcaucucauuauaaaucccugacagauuuacccucauguuucauuuagcaucauuaaauaaauguuuggcugaaacuauugcuuugacccauaggaagaggugucaccuuacccauaacacacauauuuaagcauguguauaugucauucuuuacaauagaaucuauuuuuuuuuaauuguccugaaaacagucuacuagccuuuaccaccuguugugguuuguauauaaaguacauagcaaaaggcaccugugccgaaggcuuuguccuccaucaggggaaguucuguaaaugaggacauaggaccuagugagcugcaguagguugugaacacaggcaugugucuuguccugggugccuucccaucucucguugcuuccugauugcugauugcuaugaugugagcuacuuuacuguguucuccccagcacacugaaaaucaugaacugaaacaaauccuccuuuaagcuauuuaacaccauggugauggaaaagugacuagcacaccaauggaagauuaagcaugguuuuauguauguuuagaaaccaaacacacaaauauuagaauagauuuaauguagguagcugucagugaacuguuuccaguccccaggaugagaggacaaugcugucagaccgugugacauguucaugcuucuuccuuugcuucucauaguuuuagauugguggcuuuaguuuuuaaaauguguuaaucgugcaucaguguuuugccuguauguaugucuguaugagggugucagauccucuggaacuggaauuauagacaauugugagcugccaucugggugaugugaauuggaccugaguccuuuggaagagcagacaggacucuuaaccacuaagccaucuccccaguacugcuuauuguauuuuuaauugagucaaggccaaaaauaccacucacacuuauuggaucugauauaauaacauuaacaauaauuuauguacauaagagucauuacuguaucccauucuugguagaaacauauagaauaguuggauuugggaucgguagaaaccaucuuggaagcugccuagcaaaaguauguaaagaugaggcaacuauguuuaauuuaugaucccaaguugaauucugaauugguaaggcaauucuguacaaaauaauuaggauacuucagaaaacuucaguauggccuauguauucgauaauuuuguuuguaucaauaaaguucuugcuuuuaauaguuguauuaugcguguauguggcacuguucuuacuauuuggaaaacacauugaagugucugauggaagacuauaaagaaguucuuuuuccuucuaugagcguuuccuugugaggugaacauucacucaucccagauggggugccaguaacagauugaaguaaugauuccaucucacuuggguacagugaaccauugaauuugcucaaucaggcucauuuacaggaacuuaacuugcugcccaaagaucugcauucugaaagcuuccaccuaaauguaagugacagcuucuuuauggcugcauccauggaacuaccacuaaacucccacauauauguuccaccggagaccacugggagcuggaggggagcccaggaaggaguggcuaaaaugcuaauggcauucuucucugaagauacuguucuacaauaauucuuuuuucugaauuugaaauuaaaaguuuagaaauuucaaggauuauuuucaauuuuaaaauauguauaucuaguucuugaguucauucauacuguuugucaacauauaacauauacauauaucuuauaacguauguauucauaaguauaagauauauauuguuuuuuaaaagguuagaaaacaccuuaauuuuauuuuauuccuauaucaguaccacaguuauggggaaauauaccucauguauugaaaaggacagagcuauaacagauaaagacucagaaauguacaucucauugacacuacauuacauuaaucaauagcuauaccuuuugcaaaguggcuaucauugcugagaacaagaaggguuccugguugagcugcuguaccuuuuccuguuggauuuggauugucaguguuguguugugccuguguucacagggggcuguuuuccuguuaugucucugucugccuuucauguuacguuaauacuggccuuccaggagaaagugagaagcaaucucuccuguaauuggaaauuuugagacggacugacaguaauuauucuuggaaauguuuagucauguucaccaaugaagcaucuggacccaaggucuuucuaauuauaagaucuagaguuugaaucuuuugauagaacuguuuucuguuucuucuuggaucagucaguuccuagggauuuuguuaauuuuuuuauuccuuuguaguuuaacuuauauugacuaacaguacacauuguuuauuguauaaguaucugauuaaguuuuaugcaguuauauuuaaaccacacagaauaaacccuccauaaaaacugccuuguuuugugcaucuuaucaaaaaugcacugugggugauggggcucugaguccucucgggccacgucuuuaccauuauuugguguuugcuaucagguuggaauauuccaaguguuuuuauuggcuuuucaauuuugaagauuuaaagcugucauguauaagaacaucauuacuaaaaauacaccuucagucuauuauggguuuuuucccauuuccuuuugugugugguaugugaauguguauacaugcuuuagaauauauggaagcagauuccuucauuucagcucaguuauaucuguuaacagugugcuuaagaggaguaaaggaauuucccauggugcauauuagucagcuaccaguaaauaugagcaggaauaaacagucuacaaauggcaucuccuuuauuuuaauugcuacugcaucuuugucuuuucagcaugauguaucccagacauuacucaaggcaacacuggacaguguuguagaagaaugugucagcuuugugggaguggauauuaacauuuguucugagguuuuguuaaggugagacaagaguuuaacuugcuagcuaagagaaggggacauguguauaacauugucaaguauagacagucuauaggcuuauguucucuguagaaugaccagagaagaaggugucauuuaaggaaagaaugggaagaguucaacuguuauuuucagugaugcacacacaaaugaaggccucaugguaaccauugauugcaccagugcugcugacagaauuuaaauaaggccagcaugggauagugcuguugucccaagcuggagaguagauauucuucacuagcccagucucuugcacacauuucucaaagcugaugguaacccaaaguagggaggguucaagaucugucauuggccaggcgugguggugcacgccuuuaaucccagcacuugagaggcagaggcagguguauuucugaguucgagaccagccuggucuacagagugaguuccaggacaaccaggacuauacagagaaacacugucucaaaacacaaaaaacaaaacaaaaaaaaagaucugucauuggguuuuccaugauccacaagucaccugugaucuacaugucaacacagacuggcuguucuccugcugauuauagaagagcucuucucuucucuucucuucucuucucuucucuuuucauuucucuccuuuucuuuucuuuguuuugauucaccuugugcucuggauauacaggucugcuggugugucauauuaaguuuccggaucuagacccuucucaccaaaacugugagaguggaaaaauacccucuguauucuaagauagcacuuuccuaccaagccaugaaagccauaauuccaugcuugaaacuacacaguggaauuagaguucucugcacuaauaaucuuuucauugaaagcaagcaaacuccuuauugaugcaguuuucaugccuuugugccaaccuugccauuuauacagaagucugaaguggaaacuuaaggguucuuuagaaaguuguguuggaugguguuguccugaagugggcacaggugaaaggcuaaggcagacucguaaaggaguguuuagcugaagcaggcacaggagaaagaauguucugcuaaagcaagcacaugaaagaacacaugcugaaggauucuucacuaaggucauacauguauugguccaucuuacauuguguaguauguguaguugagcuccauuuguugggacucuauagagagaaacacacacacacacacacacacacacacacacacacacacacacaaacuuccaguggugugcugcaguuucuugccgcuuccaguuuccaaggaauuggguugauuggcagaguuaugucagcugagagaaacacacaugcugaggacacauaauguuuggagggaguuuguccugacucaguggacauuggcugaagcugagguuggcuugcuuauagagcuagcuaugcaacaguugugggucuugcaucuucacugaucuucgcuuugcugagagaggcacgacugagaacuuauccugcugacucaugucaagaccgaggccuggcugucucugcuaggcagugcuaccacagcugauucguguuugcuauccagauucuacagaacuggacugcugguauauccgugaaguguuugggaguggauugagcugccgcugcuaaccacugaacucaacugccaauuuccagacagcacagacuagaguuguugcuccaaagaaccuuucuaagcaggcccacuuucacuguauccauucuuuccugcuaccucuguuaggugguaggcugaguuaaagcauuaaagaaccaucauuaaacguagcauuaggaaaaaaaaauaaacuuacagaagucccuuucuauacuucagcuuugucuaucaguggacccagcagacaguucugauaacugugcgauacuacacaaagcccuuuucugcgacagagaugggugcagccuucccugaguggggggugcaaagcuuaugagcuguguggggagcagauagaauucugucgcugcaucaguuccuccaguaucacaagcagcagcuggcgcaucagugcuuuucauugugccuccuuccuguccuuucucuuuuuaauauuaauuuggacauguuuuaaagugcaguugcaggugauuuuaagauccaagugauuugugccauuaucuuuuuaggugcaagcuuuuguuucuuucuacuuuuauuucuauuauuuuaauuuaccauuuauuuccuaggcauauugcaggacucaaugccaauagagccaaaaauauuauugaguggcgagagaaaaauggcccuuucauuaaccgagaacaguugaagaaggugaaagggcuugguccaaaauccuuccagcagugugcuggcuucgucaggaucaaccaggauuacauccggacauucugcaggugacuguaaaagcuacaccucuggugguacugccagcuuucuccccugcuguuguuaucccuccugccgaaagcucuagaugccaucauucauuccuucaccccauggggguuguguaauauugaaauaauuauaaaaaucccagugucggcgugugccacacugcccuucccaauuuucuguguucccaaaugaaagacacacacacacacagucuuuauauuuugaugugucuaauacagcucauuuccuggcuacugccuaaccuccaugcaguuaauccaccucccaccaaagucccgaguuauuacuuacuaaaucacucuaccuuggcugcccuggacccaguugugcgccuucaugagcugcacucuccugacuccuucauaugauggcuguccuuucuguccugcaccuucucaggcgaggcaucacuccuucuccuccuccuccuccuccuccuccuccuccuccuccuccucuggucaugucgaaugaaucuccuucuccucccuuuucucuguuccuugacucagaaucaugaaagucccaccucugucugcccugcccagccauuggcuguuggcaucuuuauuuacccaucagaaccaacugggggcaggguuccuuugucauaugugaggacuugcagacucucaugcaaacaauuuugggggacucauauuaacauaagaauacaagcaacauuaggccaaacccucuacaggguuaagcaugucugcaccaggcuaggaguauagcagucagucaucgagauucacaguguaaugcuugcauaggacaauaagccaacaaguaaagagguuucaagcaguaaauacuugcugucaaaauuaagagccuguguaauauuuuaauuacagaugggcuauaauuucauguuuucauuaacuuauugucuuugaauguguuuuaucaugguuuuacugcauuagucaacacacugacucuucaggccagagccaggaaacugccauggucacaaaugagaagcugggcaaaaagaagaacaaagcagaugccacccucauaccaaacccacuggaccagacuugcauccauccggaauccuaugacauagcagucaggugagccagaggccagguccagaaugcuccaugugcccagugaguucaguacagcacauguccuuuauauggguauaacaaggcugugcuuaacaugacaguaguuuuuagaaauuccacauugcugagugaggagggaaaccacaauuccuagagcugugucaagccaguaagaccugguucuaggagagaaauguguggaguggaaauuuuguggcacucugucugucuuggaaauuagcauaacucaguugaauagcaacugguauaacuugggcucucugaaagacaaacuccuuuuugaaaguauaaacagccaacaugccaagaaauucugagaauuucuauaaccuguuggguuauagagucuaauguucuuuuagugagaacacauuaacagagaaugauaccgagauaauuuucaguaaaagagaaguuuaaugaaagguauucaaagaaaaaacuuuuaaaaauacuuauuauuuuuauuugguuauguguacauguggggaguggggcaaaggucgauacuagacuaauuaauguagaucaacaagagacagacaggguaaccccuuguugggauuuuccuaaugaguccucuuguagacaccaauaucaaauuauuaauaucaggcaucucaggucagcaguggagaaacuaaucuacaaaacaauuaaccaacuccacucugaagauagacauuaauaacccagauaucaaacucagaguagauucaguagauaaacaaacaaaccaagaaggaacaagaauauuauuuugccaaacuucuauagaugaucagaggcccaaagaaaaaguauuuauaaauaguauugauauugaagacgugguagacacuggaacagacguaacaaaaaucucuccaaacucuugucaucaagauugaccucuucaauauaauuucuagggcuuuuuuaucccagauaaaacaaaguguagcauggcuuaaguguauagcgucagaaagucacagaggaaauagaaggccauauguggcuaauauagccaugcauuaauggggaagagaucuauugcaacaacuagaaucaugaauuugcauuccuccauuaucggggacaaaguguaaaaugagagauguuccuggugacaguaucaaaaacuguuaucaagagcagucauggacugcccaaggugcccauaagcaggacucagcagaggcugacucuccagcuuucuauggaggaaacacugcuggcagaacaccaauggcccuaccacuaugguaguuaucuaacaagccuuuuuggguagaacaauggccaugacaaaagaaaaauugcaguuacuagaacagcuuguccaagagcaacucgaggcuuaacacauagaaaagcccaccagcccuuggaauucuccaauauuugcuauuuuuuuuuuuuuaaaucuggcaaaggaggauguuaacagaucugagagcaaucaauaagaucauucagccaauuggcucuuuacagucuggaaucccauggucugucacagugauugguuuagaagauugcuuuuucccaauccuuuuguaugagaacaauagagaaagguuugcuuucucagugccugcuuauacuaauaguaguccauuaaaggguaucauugaauagugcuuccacaaggaauguuaaauaguccuaccuuaugucaauaguuuguauaguagccauuacaaauaauauguaaacaguuccuucaguccauaauuuaccauuauauguaugauguauuacugaccaauucagaugacgauuccuuaggaaaaaauguuugaagagaauuuuggcuuuguuggugauuacaaauuacuccugaaaacaauacaaagugaaaauucuauuaauuauauaggauauaagauaggacugcaaaagaucuagccacaaaagguacaaaugagagaccaguuaaaaacuuuuguuuuguuuuguuuuguuuuguuuuuugagacuggguuucucuguguagcccuggcuguccuggaacucacucuguagaccaggcuggccucaaacucagaaauccgccugccucugccucccaagugcugggauuaaaggcgugcgcuaccacugcccauguacucuuuaagcuuucaccuuucuuauucuaaucuucucuccccugcuuucuacaauaaaguucuaaaaccauaaaaaaaaaaaaagaacucuuaaugguuuucaaaaauuauuggggauauuaauuggcuaaggcccacaauuugauuaacuacucaaagucuaaguaauuuauuuuaaaccuuucuagggugauaagugcuuaacuaguccaagaaaauuauaagcugaggcugagaaagaauugacucugcuagaaaagaaacaacaagaugcacauguagguuguuuggacccaaagaugacauguauuuuaguuauuuugccuucuacucauccucccacaggaauucuuaugcagaaagauuauaucuuagauggauaauuuuagcauacagaguaaaaaaucaaagaucuauguagaaaaaguuucugaauugauucugaaaggaaaaaauggugcuucaucaauuagcaggaguagacccaacagaaauugcaguaccuuucacuaaugcugacauuuccucaugugcagaaaaugaacauuggcaaagaacuuguagugauugggggggaggggugauugacaaccaaugcccccaaaacaagugacuucaauuuauaaaaagaacuaauugaauucucucucauauaguaaaagagacacuaauuucuggagccucuacauucuauacuggugcguauaaaucaggaaagguggguuauaaaggggggggggguguaaagaggugcagaacccuuuuguuucaauucagaaauuagagcugugugccauucuuacaguagcauuggauuuuucugaauaucuaaugccauuugccaccauuacuuggggcuaccagaaggaacuggacuuaauauuuagugaagcucuuagcuggguuugagccugugaaaaggcuacuguugucuacuguuaggaauagaguguacgggucaggggaagaagcagggagauuagucagacugacugcagcagcccagucaagaaugaugcugacacucagcaacagcaacgcugcugagccaggugcacguguuagauauucagaaaaaucugagaguguuuuacacucccgauuugauaggcuucuugagaauguaggucaccucuauacgugcuuugguucuacacacccuaccacagugccaagugauaaauaaaaucaucaccaaccaaauucauaugcuaaauacugaaaccaguaaaaacaauaguuggggcugaagagauggccccauaagcccuguacacaucaagacacacacucauacacauagauagaaagcaaauaaaaaaauauugaacugaucuuagagaucauguugcauaaaaauaaagaaaaguaggauuagacuuaaauuuuggcauuaaaugccuuauauuggugugacugugauuucucuacuuuaucuuacauauucacaauagacuuggauggccaaaaaaggcacuguaauaggaguuaaaguugggguccucuacaauuguucuuaagcccaucgcauaaauaaugcaucugaaaaguugucaucagauuuguuaggcugguagcaguuaaaaguuaguuauugcaggcuguaagcugcaguuggccagagacuaugagacucuggcuuacagcuguaucuauagcacccaacaaauacugaaccugccauugaaaggaauacaugacagacgugagaaugaagagaaggauguagaacaccuaggaaagcauguggaaugaacugacagcgcaggcagcaggcagcuuagcuuugcuuccagcacucugcuguagucuaaacuggcugagauccgugugcaagcaugucucugugaacaaaccgggccuuucuuuccuggcaugcuugccucaccuaaguccauccuugagaaucccaaggauucaaggaccacagagcauccuguguccagugaccucucagacauuacagaguagaccagcaaaaggccauaggcauuucuuccugcacuuauuguuauggagaaauccuuccauaucuacaugugagugguuguguugugugugauacuguagccauaaauaaaauugcagguagauuuugaauagaagugggcccaacaagaguaugucgaguucccagcccuuccaugccuacuuucucuuuguucuaccauuuugguuggucuagcagcaggccacuaccuuauuucuccugcuugaguuaggggaggagggagcucugggcugcaggcucugccaagcccucuggaucacaugggaccuggcacucagccacagucugcuguguuaagaauucaaugcacugcugguagucacugcugugcucucagugcgagcugaaaaaugccaggaaacuucaugucaaaacucacucagcacuuguuuugauaaaguauaugcuauuuccauuuggacuguugggcagcauuuuuuaagacugguuuccagaaauugaggccuagcaggaguaagguauguagugucauuaucgugugccaggugagcagauuucaaagaguaguuccuaccagcuuagugcuggauauuagagcuaugggauuuaccuuguuacugcagaucuuacaaacaacgcagcaaagugguuuuugagaacaucagcaacugaauuuaaaauucggucuaggacaagaguaaucauauaagcuugacaugcugcuuccucaaguggggaggaacuuuuguuaaaaaacaaauguugacuugauuuauugagaaguuguauuggaguuuuuaagaccuaaaguagaacaaauccacuugaugcacacaguggguggaagacccugacuggcuccccugggccagcaguaggacagcuggagaaauucuuuggagguccugccuuauaugaaggcgaauggcaagccuccaguacugacugggagaggcucugugcugccaggaccucucuuucaguagaagcuucaugaccuuacacuagguugugcccagcuaggaacggagcuucuaacugaaaagcagcuguagugcagggaguuuacguuacuuuuugugaaaaaagcaagcaggugguaaagugguggugggggcgggggggggggggugucacaguuuggguauccagaaccaaguaaaugcuggaugugcauaaagggcaaccugugaucccagccuuggaaaaauggaagcaguggguccccagagaaagcaggcugggaagauuggucaauaauaaauaaucuaaaauuucucauuguaguuuccaggaaauuguacuuagcaugucaaaagugaaagagaauuugccugcucaagaacuggauggucaggcccugacacaccgagaaacaccauacacacuguuccaauauggagagcccuggaaaguugaagggccuucagacugccuggcuguuggaccuggagaugguuuugaauuuccugaccuuaguuuucuugucuguuaaaugacuuaaauauuagcagugaucugauggaccugggaaguuaaugcauggcuuguacucagcucuggagauacagcaaugacuguaaagaucacuuauuguuacugucaucaagaaggugccgucagcuaagcuguagacagaaaagcaugggaagucacaauagcuucuuugagguggugguggcaguagggugcuuuucuucucugugaucuggauauaauuugcacaguuaccacuguuaauucauauuaauaccaguuccugggacugaggagaaggccaguuuaucugcauucugccauagaacuacuuuucugccugcuccucccaguggaagagaacaaagagggagcugccugccagccauggaauuguguggcuuuagcaucuucugucacacaagcauucagguguccuucuuguccacucuugcucagucuugagcccaacauucagggagguauugauuccaucucccguuaacugucuuuccugcucccaguccagcuguggguuugagucucuguccucugauucugugccauccaucacaagugagcuacuacaaccuucuuccccauguuaacggagugucccuagcccauucagcgggcagccaaaaaugguggauguugauggugaaaugguggguguuaguaagccccuacuaguuuuuggaaaggaacauuauugacaguuggccuugugguaugaaaucugucucugaggaguuuuucccugucacuuggguugguucggaguagcacaagaguggcuugcuucagccuuuuuuucugucagccgccugugugcuucugaaugcuauugcuuuauuuacccuccucuuucaaauagucacaggcacuaauccacauuauagcuuuacaggcaguaaauuaaauuauauuaauucuaaacacaguguuuuugaacuauauagaggcugcagccuuugaaaccacuaacuuaauuuuguccaacccuuacucaguaacucaaaaagagccaaaguuucuuucuuucaaauuugguuuaaaaaauaauaauaaauugcucccagacaguaguucugggugccaaauuuuaucugcagucucaaucuugugucuacacugaagcuccucuaaagucagaggcaaggcaugggugauaugugagggguuguaacucuuacuuuaguccaacugugugacuuacccacuggucacuuccucccucagggguugagucucuugugugcaaagcuacaucuauaagaagguucuugggagacugaaaugcacgauuuauggagcacauugaaggugugugugcaucugaacauuaacccuaccucugagaggccaggcggaacucaaacagucccagcuggccuggucuccauccagucacaugguuuucaaauaaagcuaagaugcucuuccaauguaauuugaauugaucucagcauuuugucacauucuuuugauuuuagcaagucuucaucauuugacguagggcauguguauuugagaacaccuaagcucacuagaaaggaggugaucaaguggaaugcuuucauccugcccugcccccaccauugugcucucuuggaugugggagagugaggccauuucuuuaaaacugugagaaaauggaccuccuuauggcaccaguaaauuugugaggccguuccuaagacaagaggagucuagacauuuucacuucaauggcaacauugcaguaugggugugugugugauugugcacacgcaugcauauguugcuuuucaauuagaauuaaacucugauacguauacaguaugagacucacaacaagaucuuccggaauaaguuaccauuuuuuauugcugcaccagucuuccaagcuuugguuaaauugugugagcgccaucuucaacagucucuaaccguaugaucucccuaaugcuucaccauuuggaaggcauguaaagacauuuaacuggcacuuguuuuuagguaaaguuaauucccuauacugcaauccuaaggaaugucaagauuuucugaaacagcugccugaggccagggucuacugcaguuacuaugacagguggcaggucucugcuuuugaguguugucugaccaguccuuagauagaaggaagcgugugcuaagucugccgaagaugaaagcagauggcagcuuggugcucaaaaggagccuguaguccuccaucguggcagcuuucucuugguucucggugacucucugcuacucacuaaugcaggagacuucugaaaacauuccaggcggugccacaaaaggacucuaaagauaccccagcuggcccacauaguucauaccauuuaaaacuggacucugagggccgaauggaagagccucagagaaagccccauuguauuuucaggauauuuacuugugcuaugucuuuaaagucuagucagcuguauauucuucuggaacauucuccuucuuucuguuggugauucagugcuaagaaaagccacuuaaauagcguuuuccugagcauucuguuaacgucugcagggccuucuuuaagugcauuuuaccugcauuuauacuuguuugugggcuucauaccagcccagauuuuuaagauucuggcccagcucugugucuugguuuacccaggagaaauuugaaaaguguuuaauaaugaugacagugcuguucccaugacugugaccugaugugaucccaagacagcugagauugucacguaguuaccuggucuaccaggccagacugaacuccuugugugcagcacacuuguauguaccagcugaggcagagggccaagggggcugucuuuuaccacagggacuucaaguucuuucucucuuuuucucuaugauagauuugaaacuauauacuuucuggagauuuuagacuaaguaccaaacuauugcuggacuuggaaucauuucagugccccccauuucacacacaacuccauuuaaaaaccaaaucucccuaaaucauugaauuucuccauauauuaacaguugugaccugcccucuuuguuuccuuucauuuccaaaauagcugugcucuuguauuuaauuuuuuacuuguugacgaaaucucuauagaaugaacggauagagugugacagcuauggcagucucugaggacaguggucuuugcggugguaacauggcucucuccaugggcuauacaccauuugugcucuuuguaaagugaugguguuauaucaccuagguucugagcucugcagggugucauguugcucuaugaaacaaaccccucagcuucuaaaucccugugcuggaaaugauuacauaaaucugaauggccauuuccagggucuuacgaaucuggagaauuccuuacucuuugggggaagaguuuuacaaagacuuuuucuuuguggagaaggaccuggccuuuguagcaagcuucuguugaaaccguccgcagugucagcuuggguagcuuugcauugaaaaguaagcaugaugugugcuacucugugcucuaacuccgugcagaugugugcuaagagaacaugaugugcucauuuguugcauuuaugcuacuuucuuacuuuaaguaagauggaugaaauuacauauuaaauaaaaacagcagcuccaacagcagcccuuagcaaauggaaaagaccuuccagagacaguagagauggcuuuaauaacucauugacucgagagaacugucuauuuaaaagcuugugcauaauaacuucuuugugggauuuucuuggugcuaacugucuaauauucagaagugaucugccauuaaauuguguuggcacaguauugcccaacacaucggucuucugucuuggccaaauauaacaguaauuuucuauaugcacucagugacauaguacaugauacgaaacuccauggagcagcgguagugcauggccugggcagccugauaguccugcauuuuaaaguuccuguuagaagugagugaaaccuacagcuagcccagcaugcuguguguuugucauuauguguuuauucugggcugcaagcuccuuacaugugcacuuucccguggcacuuuggagcuaggaaguucuuuguguugggcacacuucucacugccagagagaacuuuagacuguagaggagacguucccugugcuacugccaaagccaggucugaugaguggcuccagcaugaagcaucucgucccauccugggcugccgaguaugucugagacccaccccagggcuggcucugcuucuucccaguuucucccccuucuguuggcuuuuucugugaccugguuaacuuuaagaaaguuuucaaaaugcaaaaacuacuuuguuccaaaauaggguuguuuaaaaauaggguugaucaauagaaagcauuagcuggaggccaacauggcacuuccuuauugaucucagcagcugcugcccacaggcaggcuucugugagggugaaaggauauaugaacugcacucccaggacaaacagaaagcagacuuccuuuuuauauggaagagauucugcaguacacagcuauccacuggacggaguacaggggccccagugaaggagcuaaagaaaggacccaaggaguugaagggguuuacagcuccauaggaggaacaacaauaugcaccaaccaguacccucagagcuuucagggacuaaaccaccaagcaaagaauacacaugguagacucauggcucacagcagcagaggauggccuagucggucaucaaugagaggagaggcccuugguccaaugaaggcucucucuaugcccaguguaggggaaauccagggccaggaagugggaguggauggguuggugagcagggggaagggaggggagggggaggggggcuuuggaaggagaccaggaaaggggauaacauuucaaauguaaauaaagaaaauaucuaauaaaauaaaaaauggaaaaacaaaaagaaaaaaaguguaaaguggaaaaaaaauaugacucuggaaauguagaaggcuugcacauuugaauccaagagauucccuaguuaaaugugaggugaaaggccuuucucaccaggcuugagguuaucagcccuggaugucacugaagagggcugcucugccugagcauggugcccagaaagauuaggaguggcccgcaguccguccugcaccgugcaguuccugccacgggggcuguaggcagagacacacuccagcagccuccuuuucccuuccgguauugagagacauucucagaggaaagacugagggcaucaggaucuguuugauuacuguguugacauuuuuaaagugccauuaaucauaggaaauagaacuuaaugauguagaaaaauacccagccagagaaugucaggaaagagagccauggcccggaacucacaugaaacuggagcaaacucggucuuacccguaacuuguugauucguguugucaugguuuuaccucauuaacugggcagugucugugcaagccaggaaggcagcaggcagggcgaaggugagguccaaggcagcaucgcugcucaguggauguaguggauggaaggacauucagcuugcauugcagcuuuggggguuuacuugcauucuuuugggggggcaucacuuuuucuuucacaucccucccuuuuauacuguuguguugcuguggggagcgugagcacacccaccccuaaccgcccucugugauuuacuuucccgcugaauacuccgaguguuuuuuagguaauuucacuuguguguggcucgauggcauuugugucacccucccaaucacaggccacaggcguagcuauucauguacaauggaaauugagcagugucaaaagcgaggagugcuugacacaugucauguuggacucugguaucaucaauggaucauguuugucuauuaaucuaaauucaaauguuuuccuacugaaaauuucaggaaacgugagauaauauagacagccuugucuaggaacuacacaugugacacugaacugucaugaccagcacacuguaaaguguuccuugccacacuuggaaaauagcacaagagccuaaaccccccuucuccccuugcccacaugccuuuagcuaaaucuuaacacagcacagaguauacuguagacucucaacugacugaugugcaaguguccugggaugagagaaugugaaggugaccagaagguaagaucacugauaaauuguugggcuuuucuucccacugaagguuuuuaucguucauuggggggacaaugugugagauuggaaagccugaaaugcagcagaaaauaaacgugucucucgggaaagaaggcauagaggaaacugcugaaagguuacagacaacugugcacacacugcaggucaucauagauggacugagccagcccaaaaccuuugacauccgaacaggugaguugucgcccuugucuccaggaaguucccaucgccaucuuagguccucucgacaggagagggccacaggagaaggcugagagucagcauccgucguccacaggagagggccaagggucagcguucauccuccgcacucacuuagauuccugucuggagccaaagcuacaaguauggcuucggccuccugguccauguugcugugcugcugcaccaagcuggacaccucucaugugcugugcuucugugugcauggaggcaugcucucccugagucuccuguaaacgucuuugugucugaagagccaggagggaaagcuuuccauucacaccaaaaagugaaucuucuuccuaaauuacagccguccagguuucuggauuccauuucacugagcacauugaacaaauaagaugauaucucugugcugauugucuuucuaauuucgaguguucucagcuuucugugcagggagaggguaaaggaaguguaauagccgugguuguugagagcaaugacccauugagacagaauugcagcuggagaaaacaaaacacugaguaagaccagugccaaaagugggcaucaaagccugccuguucucauagaaaguugcugcuccuaaauacgggacuguggagaagccugcuuuuccccuuguggacuccagggcugucucuugcagggacacuaagaccagugugucucaugaggggugggauugguaauaugccuauacacucacuggaugguugacaggggcacuugagcuauagguagccucgacucuauuuuccuguccaucuuuauuuuucuaucaaggugucgauugcuaaauaucucaguuacaugagggacucaaagcaaaggcaagcacucaguuagcccagcuagacagagccccuccuugaggagccucuaguugagcagcaugcggaugggccugggcucuccagagggcauuccaaacaggccucuccaagcacacugucaacacauuuccaggggagaggcagaugacuuuggagguggggggcaggguagacaguauuuuggguauuuccauguuacaguauuuguauuacaucucuuuucuccuuuucucaaaaguguuuccugucuuaugccuuauuccucccuuucacucaucuggcuucugcucuuugcugacaucguuccuguuguuuaagcccuccuugcugguuaguuuccuuaauucagagcacacuggugccguggcgugacugcucccauggcccuugauguguaaguguacaugguucauggaggcuuucugcuuucuccgugcucccagcugucuuggggaaccugcugagugguuccugacugguuuucaugccaagcuaaacugagcagcugaugagaaccccauggggauuggcagccacuggauucuacaaggcaaggaggcgagagauuucuaagcaugaaacugccuuacuggccuggggaccagccuaccucugcccugggccuuaguuucacuucauguugucauggucucaaccuugugugguucaaauuaccagaaguuccugcuuuggaauuuagcaucaggugaaaucccagcguccacucccagguugguguguuuaaugaggacagugagguguaggguuuauggauuuuugucuuguuuugcagaaguggaaggagcacaguuucuaaaaaagaucguggacuuaaggugguuugacuggggagggaaaggaagaggugaccaguuguuaauacaaauguaaaagauagcuccacaaguaaucaggguaaagccaacagcugugggggaaaaggaacugggucagaggguuggagugggggcagggggaugucuaaguaaaggagauccagcuagaauguguuguuuguuaucagaaucaacacucagugauccuagggaagggagcugagcuggagggguaaaugcaggcuguggggacucacaagccccauuuaaacuucuugucucacuaucucacaccuguguuguucuauguuaucuggagccauaguggcacguagccugcuuuguguucauguuuuaggggcuacugucagugaauagagauauguagacugggaugggccaagaaagggcugaaaagagccuaagacggggaccuagggucuucgccauuguguaucuggcauacagcagagcaccagccugagguaaugauaguaaucggucaaucaacugaacuggaggaagagggaggcuagcucuggcagacugguuggugugcauucugagccauagguaauugggaaccuauaccuucugguugaauaaauguguuugaaauagaauugauuccugaauacuuacuaaagugaagagagaacauuugacuuggcucacauuuauucaaaagcuaguggaacguugaccaccuugaaacaauuuaagaauccaggcacugaaagccaacucccccucuugugucuccagggcucccccguucugagcauuugugauuuagucugguguagucauugagcaaagcuagacucugacuguccuuuacagggaggacagcaagccagcuguccagauccucccaggcaguguuuacagccccacuagugaggcugagcuuagagaaaaggaaagguuugggaaacuuuucuugaauuuucuguguuucucccagaauguauuuuuuucucaagacaggccuguguccuucgcuucuuuaucucuucccucaaagagcuuuauugaucugagcauccauaucaaucaauacagagugaacgucugcccucuaggcacaguggcuucuugacuacacuaguguuucucuucucuccucacagauuuugauaagccugacuucaagagaagcauagugugucuggaagaccugcagguugggacaguucuuacaggcaaaguggagaaugcuacucuguuuggggucuuuguggauauaggaguggggaaggcggggcugauuccuauccgguucauaacagaagccaagcuguccaaaacaaagaggagaagaagccugggccugggccccggagagaaaguggaggugaaaguccucaaugucgacauuccccgaucucggauuucgcucgaccuccuccggguguugugagugccccaccgaaggccaaacaccaauguguucccucacuucuacagccugacaaggacgagccagagcucauggaaccuagagagcgggggggggggggcuccuggguagaaguguucaucacacuauccugacucccacggaaagcaacaggagaccucgcaugguguccuacagcagcaguuucugucuuuguaauuccuuguugaccacauacagcaggcagcuucacguccucccgcuaacaucugcugccuuagaccugggugggaugucuugcuuauuugaaauguguaguguugauugacacauuaagacuagcagucuuuaauccugccacuuuauugagguguuauuagcacuuuuguucauaauucauaauuuuguaauaaucuuuauuuucccuuagcaaaccaaguaaaaauaaacuaguaaaagauuaucauguuuuaugaccaucaacggaaucauuuuaauguguuccucagaacguauguauugacuucuacaauaaaugacuggcuggugac

SEQ ID NO: 8770 - RNA, 2017 nt, Mus musculus
caugggaaagggugugcuggccccaugcaacauggguggaccccucugggagggaggcagagucagggugaccaggacuccuggcuggauucauugaucgggaagcagagauggaguucagaugguuccagaagccaaggccugaccgucucccugggccugugacucgaaaacagcccuggcuggcugccaccuuucguacugccuguucuguaaggucacacacagggucaugccugccuucugacauucugcucaccccagaucagagacagucaggugaguggaagggagaagggugauuugccaugagauaggaaagagaggaggagauuggaaaacagaagagccaggaaugcaaucacugagaccaugccaagcuugccuacguagucccuuccccuugucccaugggauucugcacugucuuguguucauaacuugacgugcuuaagaaacgccuccaaagucgaaggcuagacgcucaaaggcauccuaaggccacccucaugaccagaccaaguccaauucauccucaugagucuaugaagcacagaagccauuuaaaacuccaaccaaggcaagggcauucccugccauacaacccaaccaaggacccuguccccuggacuguccaggcgacaagauucuucuucuucuagccucaagucuuucuaagagggcuccuuucucuaaggcaguguagacagccccuagaugaacagcaucagaagagggagaugggugaugacagacagcugugacauuugagcacgguuuaaaaagguaaaaagagugcucaaucugcagagccacccgaggcaggcugcaguggggcgcaggagaaggagcaucuaaaucuucuucucccugucuuucugaagcaucaccgugcccaaggccaaagcccucuucuccaggaugacuguaucaagaagccccaagcaguggauucaucuucuaagugaucugaucucacaggugaaaagagagagagagauuggggaugcaauaguugguuuuugccaauuugacauaaaccuagacauagcuaggaagagggaaucucaauagaggaauugccuccaucagauuagccuauaaggauaucugugagacaucuucuugaugauuaaugcaggagggcccagccucauuccuauggcaucauagggggaugguuagcgucaucccuaggcagguaggccugaccuguauaagaaagggguuguaagccaauauccaguauuccuccacagccucugcuucaguggcugccucaguucucaccuuggcuucccucagugaugaacucuaagcuccucaagcacaaggagcagcgaaucuugcugccucggucgcuaucuucaccccaaaucacuugccugaccaagaggagcaaacaaggacgggaucucaacucccacucccaagaagcuucauccuuagcagccuggaccguucuccuggggacaguggcacagacuccagcuggccccagcugccaaagagcuuagugugagagcugcaggucuuagggauugaggcagaucgucucaggaucguggccuucaaaagucuaccugagaggcuggggguucugcggccuccuucguccuacacagccagagcacaccugaacacggacagcagggaacuaggggagucaggaguggagggcuggagauguugugacacuuguuuucuuagacuuccauucuuauucccuagacugcugcccccgcagacccacgauggccuccucuacacaaagccuguucuucagaggccacagauuggcccuaugugaugugagcacacggcaaauacucaacucacccaccaauaagcugucugcugccacuuaacuguuccaagcacagucaucagguaguggcugcaaacuugcuggggaagagccaggaucaaggacaaagcugagaauaaggucaaccuacuaggaaggcaauugagagagauaaggaugggguaauaaaaucugcaauugcuaggaaau

SEQ ID NO: 8771 - RNA, 1734 nt, Mus musculus
guguuugcaucccucugcagucggcucccuagcagaacagaauucacguugggccggccaugcaaucagcuuccuuggaaggcaagaguaugcugaaaauacuguguguccuaagccacccuaagcggcaucucccugugcacgacgagccacaucucuaaaucccaggauccuuccugugaguaugaaccccaccccacccgccguacugagccaaccuaaggacgucaccaugguaccucugugugcgugcacauggcaucuuugucccuuuaggcugcccauuucuugugacuguccccuucugcccuuaacccaaggcuagcccuuuuaccugaaacccacucaaaccacaauaaugaauggaaauuaacagcaaaugaaccuuucugggagauaguucccucaccugccagcuccuuuuuacagucucuuuucugcuuucaggagauggcaggugaggguuugguuuuccugcuucagagcaacucccuccugucacccacaucccugaccacuccuggguuucugcacaagcaucccaagugccacugcaccucaaagccggugucauggaucuggcaccgggacuuucggggucucucugaaaacugcagagggcguaccuccgaucuaucuucugcucagagagacacggcagagcugagcuuacgaugggugaaguagucaggcacagugagugaugccuuucacucaggcuaggcaugcacgcccagugcagccucucaccuggcuucccucacccuggugcaagccacugcacaucacaacucguucucaccguuguccuccacaucuccaucccaacagcagcagcacaaguggauaggaacugugguguagucuauacaaaccuugcauguacugacaaccacacagcaugccuuccugugcacccucuguggucuccccuuuaaugaagguaagaacagcagccuacacugaccacagaugacucugcuagguucucuaguccaaguccacagucuuuauuguuucugugccccccacucccaagagaacguccaguugcuuuggaacugaggguuagagucuaaccuagcucucuucauuuuaaagucuucacauggaaggaggcuaccuucuacaaacuugcagccagcagucccacaccauguccuagucccgucccugcgcugucacacucucacagaugcacacugguaagacccacccugucccaacaccccaccugucgucacaguaggugaacuucauguccaugcuguggcggcucaggaaagucuugcuguccagggggauguccaugugggaugggugcuggauuggcucacacaugaugauaaggcaggacagcaggggcuccuuggagccacagaggcuacugugaggggggcaguuguuguagacucucacuugcccggugcagugcaggaccuggggucaaagcacagaaguaagacaaggccgagacggccgagaagagggagaggccucaggcaccuccugcuccuggcucuuucuugagacuccacgaauccuaccuuccagguggccgacuugagguugacaguccggccucuguuggugaccgugcacuucauccucaugaagaagucacgcucgguggacacgucuuugcucuucuucccaaaaccagagccugaguggggaagggcgugggagccaguuaaauuaauccaaauuacaauguuucugggcaacuuguau

SEQ ID NO: 8772 - RNA, 1642 nt, Mus musculus
agcgguguggacaccugcggcaagucugagaacccgaauuuaauccccgaggcuuacacgguagaaaaagagaacugauugcccacacgcacgcugugguguguguguguacagcacacaccuccaaauaaauauauguaauaaaaaaauuacccccagugaaggcugggcucuuacccacagggcuucgugaauaccagagcgccuccuaauggugccggaauccaacuguggaaacccauucuccugggcucuccuuuaaauagagugaguuuauguuggggugaguuuguuuccucucccgaccuuaaagucuuaccccaaugccucagaauguagcuguauuugaaggugggaucuugauggaaaugaccgccuugaaaugaugucacgacaacagucugaauccaaugugacgagugucuuuagcagagggcagcaaugagccagagggaagacggugccgacacagcgcgacaaaccuugggcugguuccccuggggaaacagagugacaggugacaggaaagaaacgugggaaucagcucgagagguuauagaggugaaaaagcccacagucucauucuccguucuaucuugguuuacugaagaucucgguggacgaggcccacucacacugggugggagucugcuuuucuuacuccguuuccugcaagguuaaugucuucuaaaaacaccuucagaaauagaccuauaaauuacggccauucagccgacgaagcacccuaggguuggcccaagucauguugagcgcacagcgaaugacuacaggcuggaucagagccucugucuccgcguuguaaaagacugcugcugcuuucauccuaaugccuagccuuccgaacaccgacugucagcaucagcugguugagccacccgauccaagaaauccucucccuggggaaggaguaugaccugaccugcaaaucccaggaagaguguguaguggaggagaggaugccgggagaccggaaguagacuuugucuucuuuggguuuauaaaaacacacuuaacaaaacccuuucaauagauggagucagggucacaguguggaaggagagcaugcuacauuugaguccggacucgguuguuauuaucagcugugugaccaagagaauuguucuaugaaucugauguuucgugccuucacuuauggaugggaaaagugagaaagacaacucacuacagugcaguacuaacaaaggaaaugauguauuccauacaggacuaaggaaugauugccaccacaauuaguguaauaaugguggugguggugauggugaugaugguggugguggugaugaugaugaugaagaugauggugcugggacuuugcuauggcgugaaauagaauucaaaucuacccuuuuggagcuggagagguugcccuguuaagacugcucucacaguuugcugcuuaugcagaggaccugaacuuaguucccagcacucuugccgggcagcccauaccuuccugaaacuccaguuccagaggaucugcugcccucuucuggccugcguggacaccaacaaaccugcagacacauggugcauaaguuaaaaucuguaaacaacuuccuuucuguguauguguacguguaaaguaugauguguguguuua

SEQ ID NO: 8773 - RNA, 15739 nt, Mus musculus
cgagacaaucucaucuuagaauugcucaaggaugccaagaugaggcucagcagaauugugucggaugaagaaaucuaccaggaccugcuggauaagcucgugcuccaagccuugcuccggcugcuggagccugugaugauuguccgcugccggccacaggaccuccaccugguggagucugcggugcuaagagccaucccucaguacaugaggcucugccagaagcauuuggagguacagguugaccaaacugaacacuugccuuccaaugcugcuggagggguggaggucuacagcagcgaucagaaaauaaagguuuccaacacccuggaaagucggcugaaucucgcggccaugcagaagaugccagaaauacgagggauucuguuuggagacaacaccagcagaaaguucuuuacaugaggcucugggacagggagccugggcuaaacugcagagccuucaaagucuaagucauuuggacaaagggaacugggguggggguggggugucaucuuccucugcagcccuuuccuagcuuugaauagcuaagaguguuauacacuguuaacuuuggaauaaaucccaaauuaugcucagaagucaaguuguaguccaucugucuugacaguuucuggggcauuuugaagugugggaugaaggugucugucagcuuugccggaggugagaugugaauuguaccuuugaccuaggcaucugaagcucuaagcuuauucagauaugaagugugcguguccucuugcuucaggugcaguaacuugggacuaugggauguaaugaaggucagcauuguggacgugucugguauaccguccccagguucacgcucagaaaaccaccaggcaaucagaaacugcacccgcaguuuaacgucuccauagccacugccuugagcuuccugaugguaucgcuggagcuauguuguagaggagaggcugcagugggaaacugggguauauacuacagguuuagagccuuggcuuaugcacacuacugauuccagaggcccgccuguauuccugaagucuguccuuggccugucugucccaucucccuggugcccugaagcccagccuucuacaucaccagcuaacauuccaccucucugaccccguaugcauggugggucagagggaggugugcaugcucucuggcauucagaggcuacagugguagacggaucucaguucaggcucagugugaugggaaagagaaccaagaaguugucaaaguaucaaguauuaagaauggaggcagaauccucaggaauguugaagggugugccuguggccugcagacacucccuacaccugcuugaacacucccuuggauaacugacugccugugggauuugggcgaucucucccaacagcuugaaguacuuucugggagaagcgaagaaacacagaucauggucauuuuuguuuacuuguggguauuauguagcguagaaugaguagcggggcuggagauagagauauagcucaguaguuaggagcacuuguugcucuuucagaggaaagccccgaacucaguucccaggacccaaugguggcuuauaacugcucaucucuaacuccaguuccagggggauccaauuccuuauggccuuugcaggcaccaggcacacauuugauacacacguacaugaggcuacuacucauaaaugaauuuacuucucauaaaugaauaguaaaaucucugcugauucaggaagacaucaacuaauaaacacgaagagcagagaaaccaaggaagaaagcacuucccacagcaucacacuucccuccccugccauuuuacacuggaccccacaaauucuguauucaguucuguguggguaugugugcuuucagguugaaucuguauauaugccauugauuaaaagguuuggaacagaagaaacuccgaacaacuuuccagaguaaaugcuuauguacaagaggucugguuagaacuguguacugaauagaaggcccgugggacucaaauacaacucuggggucagguuauuaguaaguuggggugcuucacaggacacagacagaaaucucauggugccucaggaaaaggcuagaauuaaggcucagaaagucccuugaaucuuuuaucuccuaagucccaucuccaugucuccauguucugccacauucucuuucucauggguugccaugcuacacgugacugcuccuccuccucuccuuccuccuccucucacucuccuucuuccuccuccuccaugucccuucagcaaugcccugacaucuccccaguucccagccacaaggaccgaguccccucgaggggucagcacaaggugccuuuaugugcuggcuccucuuucccaccugucccuucucccacacacugccuuccagacagugauccucuucguucucuguuguccuccugcuuguggcuuuugcaccuggcauugggcaacagaggcggcucugagugaguauucauggacauucugaaugagggacuccagggucucuccuguucuguucuggcuugugagaaggaaaagggcuacgacucaagggccuggggaagguaucucugggguauuucagaaucagagcuuaacaaaacaacaacaacaacuacuacuacuacuacuacucugcuguuccuggaaggaggggcuguaacagagcaucuaaacucaaggaagacugugucuccugcuuugccucucacccugaugcauuuggggacuucugcacaccuuccuuugaugggcauggccuugcuuugcccugugugcacagacugaggcugucuggagggccugugccugaccaguguccuccacaagcacggugggaacugcacauuccagccuuuggaucugcauggcaucaguacuaacuugacucuugguagacuaccucccuguggagcucacaguucuaugugccccaccccagggucuuugcuuuagaagcgcgcaugcauuucauuagggggugggcacucuucauuagcaaccgcauccugccccaaagaagguguguucuuggagcaaacugugagaaccaacagucagcacaacucucccccucauuagcgccucugccugaggugugagguaagcuguugacugcagagaggcugugccuaaagugacauggagggccuguggagacuccucccacggaugggagcuggggaauguuaguggcaccagcagcucuuaccaccaccaccaccaccaccaccaccaccaccaccacagaugugugcuucagccagaguuaguuuugucagcaggcugagggggaaaauacauucagcucugcuuccuggagagcggcagagauggaugcaugugaggcuagucccagagaaaccugggagaccagaccugcaaagauacaguagggcucuggugcugacccuaaagucauagggaccuuagaaaugggccaccagauuauuucagacccaaaccacagcccuacugguaccucugaagagcagcuguggcaucuugcugacugcuuggggacguugcucuuuacccuccccaugcuuuccccaccacacacuuuacuccuucguccucagagcccuccucuaaagcuguccucccuccugacagcugaggaagguagcccagcuuucccuccccccucccugcccccagcuuccauuguaauaaagcaaaagaacaccgugccccccccccccagcuucuugggcaaaaucauagcucauggggcuuguccugcaggguggcccucuuuuauggggaaggugggguacuucugccugaagacacagcuaaaaccccacccccggcucuaagauacaggccuucugacuccugccccacauccuuugccaucuccugagagagaugaaugugaacucuuucuuuacugggcaaugagccuauggagggugauccuggguucauccuggaggcucccaaacccaugaagacuuguccuggagguuacagaaggcucugagguccaggacacccagcaagcuuaucgucugcuugaaguucugaggaaguaaggaagcaguccggccagggucauaaccuaccgauccauaccugcugauaaccugggauccagaacaagucugaagaggcucaagucaccgucauucauuuuuauaaaacacacuguguaggaauugagagccuugguggucagcgggucagauaugacaguaacuacauggccauagcuggcaccgcagagaaggcuucauuguuucacucucaggagguccugagcucaggucagucacaaugaggacucacagaccggcgguaccugugcaagagagggggugacaggagggcgccagggaaggacugugcgcccaaaggaacagagugggagugggcaggaagguuugcuccgcccacggcaccugacccagggcuaucuucccaguggguacugaugaaucucugagaaagaaggaaagaagaaagggagaaagggaggggaggaaaagaaauauggauauauagauaugggcacuggguaggagaucggggauagagguucucguugcagaguugcaagccacuugcuggaguaagcuaggagcucauguucuguccugacuuucccuuggugaggcaggagagacaugcaguuucucucuggggugauuugacgguaaaagaaaacaaaauagaaagcucuggggaaaagccaaagagagaucuauguguuccaaaccuuaacucaguggaauuguuuuuauuacugcaugauacaagacauaagaaaacaguauggaaguccagcacgauuagcaagccuuaaaacuuggagcauuuaguaucugaaguuuauaauuuggcuccuuuuaaaguuaccauaugcucacuuuuccugugaauaaaaaauaugcaucuuuaaauaauuaugcacaauauauuuauuauacuuaucauuuuaugccuagguuuuucacaugaaaucauggaucuuuguaauuaucauuuucuuuguuugcuuguuuguugcaagacaaguuuucucuguguagcccuaguguccugaaacuuccucuguagaccagacuggccuugaacucacagagaucugccugccucugccucugagugcugggauuaaaggugugcgccacuacugccuggcuguaaguuucauuuucaauguccauaaacuauugcaagcaacauguuucauaauuuaacgaacccagcagaaacugacagcugaauuacuuucaaaguuucauuucuguaaauaauucuguaacacauuuuuaaaaaguaaaauagaucuguacguaguauuuugucuaguugugcuaccgagagauaccauaguaaaaauacagagaucugcuuuuugagaaagagagagagagauucuuguaauguugguuggucucaaacucaccguguaauaaucauagcugaccuucaaauccuaacguucccaccucuaccucccaagugcugggaauacaagcauggaccaccacaccccacaccauuuccuagguguuuuguguauggggggggggucuccuuuuuacaugcaugcacaucgcuggccuaauggugcacacgcagaguuaucaugugacuuagaaugguuuuauucacuuacuuauuuuacccgcugcuacugugguaagcaguaagugccugagggucagggggucagagucuagaugaauaggaaccaaacucaaagcaaggcucgacuaaauucuuccgucucagcacucaugccuuggucagcacucaugccuuggucagcacucaugccuuggucagcacucaugccuuggucagcacucaugccuuggucagcugguuaacccugagaucccuuuggaaggagagggcuugccuuuccagggaucccagagagagccuccgucagcacuggcacacgguaagcacgccauaaguaccagccgauccuuuuuuuuuuuuuuuuuuuuuuuuuuuuuaauguauacuccaugucaggaagcauucucagauaagauuuuuuuuuauuuucuuaauuauugucauauguguuugaguguuuugagugaauguaugaaaaggguaguccauauauguggguggugucugguacuccccagacagauccucaggagcuggacagacaguggucagucaccacauaggugcugaggacaaaaaucagaguucccuggaagagcaccaaugcucuuaacuccagagccguuauuccaguccugcggucaucauuuauagugacuuccuagugcugugcuguuuuauauacuucaacuuauucaaugucacugcauauuuuguuuaucuuaguagagcagugauuuuuggguaccugaaguucugccccaguuuuaaguauuuccaccccagacuuguguuaucggaguuaaaggguaucauaauuuuuaagaggccgcuaaagcauaugcuaaguugcuucaacagaagagauuuuaagaucagggcucaagcuugguuuucaaacugcagcagcaggaacaacccuuuccuaccucccuuuuaaaguugucgcgcuggaaggcauacacuucagauuccugaacuuuugagacggucccuugcuugugaaagggaccagaguauagaaaggggaggaggaagaggaggagaaggaggagggaagagcagguuugaaugucauaaacgcccugucugacugucuuaguaauuguaucacggcugacagaugcagcagcggucacguggcacgagcaugaccucauagcuccgggccugugccaaggcccagcagcugugggaggaggggaggcaaggucggcugcaucaccccaaguuggcaaguuacuuaaaggaggcuugagggccugggaacucuucuugguccccggagugcagaggaaggagaugcuccgacuuuuuccugaugguccggaaacgauauuucgcugcuucauuaguaacuauuugcugcgugcagcuggaugcccagcuccgacugcaugccaagcucugugccaggcgaucugcccauuuccuuucccugcgcucugauuagccacaucuuauugcccaggaaauaggauuggaaacagaaugagaaaacuuuagguucaagccaagaagugaggacaggacuggcagcuucaggcgccccccuccuucccccucccacccccccccugcuuuugagguugggacccuugggaugcgggaaacuuccugaaagaaaggggagaggcaagaugggacaggaaagcacagcagacagaacuuaccuagaucuguaaggcagagaagggcauuuuugagagaaccaucaagauaaguagaucaaaaggacagaauucauagagugaaggagcgcucucuucccaccuaaccagcuaugacaguuccacuucccuguagaaugccugcgaaagacuggcaaagacccaggaaacauuuacaacccuagguuuugcaugcacucuagacagcuuccuaguacaugaaaaugccaauuccaucacaggcaaucaugccugugaauguuccaaccccuggaugccuguguacacacacacauaaauaaauacacauacacacacacacacaaaugugcacacacacacaugcacacacaaaccacaagcacacacauauacacacauaacacacgugcauacacacauacacacacaaacgcaugugcacacacacacauuuuucuuagacuucuuaaggaacaaauccaugcagcuucuuguacauuuuuaggcuuaagcauucaaauauuuucccucaguuuaaauccuuacaugggauacacuuucugguauauugcaaauauugacauuuuaaaguaaaaugguuacaguacucugaaacauguuuccaaaugcaacaccgcagugguuggcuacccacugccaucccuuuuaaaaauacaugaagacguuggaaccauuucaucucucucucucucuccccggcgucacacauuucuacuccauuucucgguuuagcccacacuuuuaugaauggaagucuccuggauccauaucauagccucgcucacuccagcgugacuauuuuuguauaccuguauucauacaaaaugaguucguuuaacacauuucuugugacuguucacucucucuuuaucuuuaucauuaaaaaaaaucauuuugauaacuuuauauuugaucgauuauaccauuacccuuucuaaaccccugaacccuucuccugaacaacuuccuuccccccucucuguguaugugcauguguucaugugugagugccuguguguguaggcucauguaugugcauguguguauuugugagugacugugugcacacaugcacacaguguguauguaugugcaaauguauguguguaugugugcacuuuugugugcaugugugugugugugugugugcccuaauucagcuugcuugaauguguaggggagaggguggguuggcauggguagaguaaggagugaggguagguuggcaugaguagagacgaggagugagauggguugacauggguagggaugaggggagaggguggguuggcgugggugggguaaagguggccuccaggaggcacuggguaguguguggagccuuguacuuagagguucccagugagcuucugucaguuugacgcuguuccuuuaucuuaaagggcaaagucaagaaagccaaacuggcauggacuucucagcucaguucauagaccuccucucugucggugccucaugucccaaaccuuuggucucagcugagacuuaguugagaaaaaucguuaaagcucaagguuucaggcggcuguguggcagcuuucuguuuagccuggagcaaggaaucuaugaaccauuauuuuugaaaucuguaaucacagccugggaaaacucacaccccgauucacuaggaaugagcugggagagcccucucacaaguagcacuuuuuaaggaucucagcuccuuacuuuuauagacacccagcagaagcuugcaaauagagcguggcaaaaacaggcuuuuaaauguggauacaaaguagccggacacauggcucaguguucuagccucuuaugcuggugaauuauacuucagaaucaccccacaggucaagaauaaauuuagaaccuacguacuacucugauggcuucacgagaggaugguagcuguguggagagcugacuccagcccaggcacagucuuccucagcugcacccacagcccauagguggcucaucuuucaacaccaacucugccucaaauuuugagagcuugcuacauucuaccaucauggaggacccaucuggggaggcaccugcagaucuuagaaacagauucuaaaccucugagguggggaacuccaugguuuuauguaucccagggaauguuccagaaagcaaagucauaguuggguguguugccugggugagguacauccccuaagaaagacugaggcuggagagcuuuguuagugugccagucuagaauaaugucagucuauaaugguggcagcuacaugaucuagggcuuucugcagcucacccugccacacagagacagggagacucgacuugcuuuucuucauuugggagcugcuuuauuaagagacuguucaccucacaugcauuuuacccauuuaaaagcguacaauucaaaugcuuuuaguauauuuguagagcuguauagccaauuaccaccacgaucaguuucagaaccauucaagaccccaagggaaacucuguacacuuuggcugucaccccacaauuucccuguuccuauaaucuuaaucaagcacuuuauuucucaucauuguggaauaauacguggaugaccuacauuuuacuacccaccuacuacacacaaugggcuuuuagguugcacagagcacugugcgcuggcauuaucagcugccccugaauugcacaguggacuuaccuucccagccaggccccacugugauucucuuggcaccaugaucaaugcccucucugccuuaccuugccagugcaggagcuguuuaaacccaaggauggagcagacaaggcucuccuugcagaagggcacaugcucuccuggguaccccaggagcucucccuguagcuuggaaacucccuuguguggguucaucuccacaucuuucuccauagacgaggcuggaaagagacacucacucaguguuggugcagagcacagguggguccacguaaagagagcaccuguccuuguacgacuuucuuuauauuggcuucauccucagguagcuuuccuaaggcaaaacaagacagcuacuaggaauucugugcauuucuucccacagcuuagugccccagucacaaagugagaggggacugcugccgcugcccagcagcccuccuggguuuccucuuuuuuuauucagucugugaccccaguucacccacauuuguguguguggggucccuccuccuuuaaaccuaucuggaaacacccucaaaggcaaacucagaggugucuccuagguaguccccauccaauccuguugacaguggaaauuaguaacuauuuucaaaccauuccagcuaccauacuuucucugccuugauggaccguauuuuugaacguaagcugaaaggcaccuucccuuagguggcuccugcgccuugguuacagacacaacacaagaaaaguaauuaauaagucagcucaccugaacuacauggaggaagagggagucccucccaaagagagucagagggaauaaauuugaauaaacacauauagggacugugaugauuuguauauggcccagggaguggcacuauuaggaggcguggccuuguuggaggaagugugucacuauggggguggacuuuuggggcacuccuccuagccagaugggagccagucuucuccugucuacuuuuggaucaagauguagaacauaugacuccucucaccccacaucugccuggaugcugccauguuccugccuugaugaugauggacugaaccucagaaccuguaagccagucccaauuaaauguugcccuuuauaaaaguugccuuggucaugaugucucuucaaagcaauggaaacccaaauuaagacaguggcugucacuguugucaccuuggccaaugcccugucuggagucugcucacuaguguguuuuacacauucagaauccuggugugggcauucccaagaugacacugggguccuuagugaccaucuccuucggagagccuagaaauggauuagcaagacguuaagccuucuaaugaagauuuauaauugaacagagcgaagucucaggaauccacgagaugcugcucucacagcggacucucgagcuuccuggcaggacagugccgggagggaacaccuugaaucugagggguccuuuggagacccggagauuugcugcgacucacugagugcacgcucacucauccauguuuagccuguccgugacuuaauuucacagugacagauuuaugcugaagaugggcagauucagagggccauggagucuuagacaaagggaggagugcucuaggcagaggcaaaagcagauccuccuccagacacccccuucuccuuccccucgccuugguuccuucauuaccauggcaacuaaugaugcuccuccucucuggcucucucugguccccagaccccaccugucuuugucuuacaaacuucacagagcaguugccagccucucccagucucaccagggcccccagcuucuccccuuuacccacacacucuaacaccuucuccccccucauuucccuucucccaggccuccaaauugagccuuccuuaaucuugaucuaggcuuaguuaaauucccaucuauaagaaguuguaugaaaauuagauuuuugccacucuaaccugauuugaaaugcauuaggagaucugucucuugaaacaccucaaggugagacaacugcuucucugagcuuaaacucuguuagggggugaaucacauuguauuucugugccaggaguucuucuguuuaaagaaauccccuggcuugucucugacagagacuacccuaaaagaaacaaugucucaaguucagggauucugagcugccggccgcacugacuuuuuucaggggugaagaucagccaaagaaaaugaaccggcauuugaaagcuagcagguucucggacgagagaguuaguucuggcugcccugggcugggcguggugugugcaucucuacacagugaagggggugggaaggagaugaggcugccugccugccuuucuggugcuuuguuuccugcuagcgacaccagcuccccuccuuuaccuggcacaccuggguucgcuggcauccacgagucugagugcuuacccuaacuguucugguguguguguguauguguuucgugucauguguuucuguaguauauguaugugguguguuugugugacaugugugauguguguauguguaguguggauaguguguagcacugugugguguauguauggugaguguuugauacauauggucuauuugagguguucaugugguguuuguguguaugauguguaucuggugugucugugagguaugcauguguaucauacauaugauguuauaggugauauguguguguggucuguguaguauauacguggucuaugugugguaguguguagaauaugugauauaugggaggaauguacauguuauauguaugcuaugguguuuuguguguaaaugugguauauauaacacauguguggguccuugugugguaugugugguguuuaugugguauguguacuuggggaguauguguguauaguguaugcuugagcaguguguaauauguguggugaugugugugcucuguuuguauguguauauuaguauguaguagugugugguauauguauguuauguauacuguauacauaagguaguguguggcauguguguaguauguaaaaugcauaaugugugagguguguauaugauguuuacauguaugguauauguguguauaguaugucugugugguauaaggaguauauguguacuguguguguguauguaaaauguuugugugguauauguaugauauguuuaugugugugugguagcaggcaauaguguguauaaauguguaugcuauguaugcaugugugugguauguguauugaguagaauguaugugugacaaaugucuguauguuuggggcauguguguguauagcauaagccuguauguuugaugugugugguaugucuauacauaugguguauguaguaugugcuggguaugugugcugaggauuguauguaugugauauguuuuugucuuuccacugcugugauaagcacgauuauaagugugugucaccacgucuggcuuuuuuguuacuguuuucuagggacugaacuuugguccuugcacuugcaaggcaaauguuuuauacugaaugaaugaccuguaucucuggccccuggagucagggcuuuuaaagauguaacuaagaugaggccucugugacgugugagugacacccuuacugugauuuccuccauggccauggccuucgucaccauuaaggcacugcaguuacgaagacgcacucaagcccuccauggugucaggcugugagcacacugcaggaagucuggaggcucaggcaaccuuggggagaccuucagaggcucugcuccucccuaagauuaucuaagaaucgaagguugacugaggugggaugucucaaggguuuaccuuccuauaaauaacccgggacaucuucugaggguuucauagcugcuucugcaaaccauccuaauaaauucauuaauccaccgggccgaacuucaauggaguucuucuuuuucuccucucuaguacuugggauggucagacaucucuauguuuucccagaaagagccaugcaacaaagacauguuggacaccuggguugugucuacgcagaggaaagccaucuguaagcccaggucugaggagaagcucagaccgggaagagcaccucgcucugaggcuuccaaccucuagaacugggugaaacgcaugcuguuuaagcuaccugugcgauuuguuguggcgaucugaacagcuuaagacuagguagccacggagugacccgcccaaggagugcacugcacagagcaaacauacuggaagaacuuggacaagaugcccccuugcaagcugucacacuaugagcucccaggcucuugaccagacuccccuugcccuuuuuuguucuuccccaccccccuguggaauuacugcuggacccagaaauugggugggauguacagccucaacauucaugguucuggcaacuccaggauccaaagcuccaguagacuugcucagagaggagccaccuggggucagggagagcuucuuggggguggggaaaugccccacaccccucccuauuucuucugccaggguccccuggcucaguacuuucagcagggcuuccugguggcugcuguccaagaccuuccuucugucccaggacugaacaaaggccccuuugaugaaaagugugauuugaagugagucugucaucugaggcucagggggauaaaaaguguagcuuucuucuacuggggcuuucuaaccuugagaaggaguaagguggacaggagacagaaggcagaagggaggagaggagaggagaggagaggagaggagaggagaggagaggagaggagaggagagaggagaagagaggagaggagcgcccaaguugaagaccuuaaguucucaguaagcccuaugaugaugaguagccgugggccugcaaugugacaugcucaauaaaagaugccuccugcgugcucagagucugcucccagagcugggaucuacacauaacggcuugccuuggacaccagacucagcaccuucacgcuggguacacgccaaugcacagaacccggcuuucucccugcuguggguggaagccgaggacuaccucucucagaugggaucugagagacaguaugaaaccgagaccccagagacaucuucauucacugccaggguuggcuuugugggccugccauaggucacaggaugguuggaagagccugugcgguucugucagcaccaggaagucccaaccguuauagcaggcaugggugugguguggugugggugugggcaucaucuuucaggugcuggccacuuugugguuuuucuuuuccucucccucccucccucccucccucccucccucccucccucccuuccuuccuuccuuuuuuuuuuuuuuuuuuuuuuuuuuuuuuuuuuugagacagggucucucacuagcuggcuggccagaggcuaccccacugccccccaccugccccuacucccgccccaggugaaccuugcuucuuuggguagguucuaaggaguggacucacuuuaccaacugaacugucuccacagccaguggauugguuuugaguaaugacccugcguccucuccuuucacacguucuggaguccuguccuucccaccacccucggaucuuaaauucaggcugacaccuuuuaccuguucggugcugcuucguaccccaggcucuaaccugaugaucccgugacucacagcccagcugaggggcugccaucucucaccgggccaccguggggacaacaaggccuuugaugucaucauuuugcuuucugaggaacaaaaaugcuuuccu

SEQ ID NO: 8774 - RNA, 3784 nt, Mus musculus
cagacucccggcgccagaccaaaggcagcuccuggcauggaagugguaagggcucagcuagagugucuauuccuccacacauguccggguguccgacauuucacaccccuuacccuucaucuaggguggcucccaaaguuggugaccuuuggaguuacucagggagccuuuuuuuuuuuuuuuuuuuuaaagacaggguuucucuguauagcccuggcugcccuggaacucacuuuguagaccaggcuggcuucgaacucagaaaucugccugccucugccuccugagugcugggugcgccaccacguccggcuuucggggagccuuuuaaaacuuauuucaucgauaugucuuguguaggagcagggaguguuuuugcucuagucauaaaaaaccuuaguuuucaaaaguauaccuccaaauaacauaagauaaauaauaugcuuuucagaaagauuaucugauuuaggaacuugcuacgugggucuagucagccugggacuuacucuguggaaaggcuggcauuagauucacagagaucugccugccucugcccaccaggagcugggaucagaggcuugagcugccacaccuggcuguuuugagaauuuaaaauuacgugaauguguaucagggcacaggugugaagcuaaaggaaaacugaccagagcuggggucuuccaccaugugcgugccguggauugaacucagauccucaggcuugguggcaagugcuguuacccacggagccaucuuaguaguccugcuuaugcuuugaauaucuuucuaauucaauuguucuuuagcucuaaaaaauuauuuaguccuuuuuauauuuuggauauucuuauuuuguucauauauuuuccugagccugaugagauuugaguuuuuaaaucaauuucuuugauaauuucauauauguauauaauacauucugcucacagguaucccuucacccuccuuacgcucugugcccacaccucccacugugccuccuguccucucaccaaagcgucaccauauuuucuugacuuuuaguuuuguugauuuuacuuuguuuuuuguuuugugacccacugaguuuaaccagaucacucacguggguguggauggagugaugucacucguggguggcggcaucacuaaagaaaugacuuucuguccugcagcaggucaggcuuccgcuagcuucccugggugugugggaccccacugaccccuccucugucuaagaccgaaugcucgugaguucagucuuaggugggccccauacaggcaacuacagcgguuguaagcucacuagugccuuggccguaucaugccauugggacagcauuuuauggcccgaguagggaagaucuuuuaacgucuucuguuuucauuuuugguuauuuguuuuuguggguuuuuuuuuuuuuuuuuuuuuuugguguguuuuguuugauuuuggugugcaaggauaaaagccagggucaagggcuuauuaaguaaaugcucuaccaggauuuuccuccuccucuuccuuuccuuccuccuuuuccuccuccuccucuuucucucuuuccuccugccccuccuccugucccuccuccugcuccuccuccuccugccccuccuccugccccuccuccugcucuuccuucugccccuccuccuuuuccuccuccuccuccugccccgccuccuuuuccuccuccuccuccugccccgccuccuuuuccuccuccuccucguucucucuuuccuccugcuccauuaccauuggaggaggacguguauaugacaaaagucugugaaugaggaugugcacugauuaucauugucacacauucacagaggucagaggucaacucgguucuguccuuccaccuuuauuaggguccuagggaucaaacgcagguucucgggauuguuugcaagcacucuuacccuagccuugcagucuuuuuaacaugcagaaucccaggugacacuggcagagacuuugaugacaacaguguaugaggagcagcagguacugagugagaccuucaaacacagacuucuuaaaggucuaccggcugauugaaauauauacagaaacuuggacaccauuccuggugaaaagacugccuucagccucuucaaccccacgccucuccccagagugcuuuuuuucucacuuagccauacucucaugucauaacagguuuugugaagccuccugccuccaagcagucuuccuggauugaguccugcauuaccagguucucaugauuccccuccguccuucucauccuauaauguguucauugauuuuuuuuuuuaaucguuggguauuuuuauuuuguauguaugggggacuuguuuguauauacgucuguguggcagugccugcagaggcuguaaggaggugucagauccccuaggaccagaguuacaggucguugugagcuuccaugugaauaccaggaaucgaacucaggucuuaauggccgagccuucucuccagccccaugcugagccauucuuuaugcuuagguauugauuugguauuuccacuccauugccuuccuaccugagucuuaggucauugcugccuagagagaacucuggacuagaacggcccugaccugcggcuauugggugacagugagugaacagaaacagaauggcagagggugaagcuugcguuucucgggauugacuuccuacaaaucacgacccaucucuggacauugguuaacguaucuacucacggagggcuaucgagacaguuuccggucuccuucccuucagacucugauuucuccuuuucuccucuguguuccgcacagggagggagcagacauuagcaacacccuggaaacucuguucuacauugaagacaccagaagguccacaggcccugccucugcccccguuucugagagcagccauggcccugacugacauagacgugcagaagcagaucaagcacaugauggcguucaucgagcaggaagccaacgagaaggcggaggagauagacgccaaggcggaggaagaguucaacauugagaagggccgccuggugcagacccagcggcugaagaucauggauuauuuugagaagaaggagaaacagauugagcagcagaaaaagauccagcuguccaccaugagaaaccaggcucgcaucacgguccugagagcccgagacaaucucaucuuagaauugcucaaggaugccaagaugaggcucagcagaauugugucggaugaagaaaucuaccaggaccugcuggauaagcucgugcuccaagccuugcuccggcugcuggagccugugaugauuguccgcugccggccacaggaccuccaccugguggagucugcggugcuaagagccaucccucaguacaugaggcucugccagaagcauuuggagguacagguugaccaaacugaacacuugccuuccaaugcugcuggagggguggaggucuacagcagcgaucagaaaauaaagguuuccaacacccuggaaagucggcugaaucucgcggccaugcagaagaugccagaaauacgagggauucuguuuggagacaacaccagcagaaaguucuuuacaugaggcucugggacagggagccugggcuaaacugcagagccuucaaagucuaagucauuuggacaaagggaacugggguggggguggggugucaucuuccucugcagcccuuuccuagcuuugaauagcuaagaguguuauacacuguuaacuuuggaauaaaucccaaauuaugcucagaaguca

SEQ ID NO: 8775 - RNA, 1989 nt, Mus musculus
cgaggcaggaaagauggcuguccuugcgccucugauugcuuugguguacucggugccgaggcuuucucgauggcuggcccgaccuuauugccuucugucugcucugcuuuccauugcuuuccuccucgugaggaaacugccaccgauuugcaauggucuccccacgcaacgcgaagauggcaacccgugugacuuugacuggagagaaguggagauccugauguuccucagugccauugugaugaugaagaaccgcagauccaucacuguggagcaacacguaggcaacaucuuuauguuuaguaaaguggccaacgccauccuuuucuuccgacuggauauucgaaugggucugcuauaccucacacucugcauaguguuccugaugaccugcaagcccccgcuguacauggguccugaguauaucaaguacuucaaugauaaaaccauugaugaggagcuggagcgagacaagagggucacuuggauuguggaguucuuugccaacuggucuaaugauugccaguccuuugcucccaucuaugcggacuugucccucaaguacaacuguucagggcuaaauuuugggaagguagauguuggacgcuacacugacguuagcacacgguacaaaguaagcacaucaccccucaccagacagcucccuacccugauucuguuccaaggcggcaaggaggucauucgucggccgcagauugacaagaaaggacgagcugucucuuggaccuuuucugaagagaaugugauucgagaauucaacuugaaugagcuauaccaacgagccaagaagcacucaaaggguggagacaugucagaagagaagccuguggacccugcucccacuacugugccagauggggaaaacaagaaggacaaauaggauccugcauuguuuuugcuuccucuccugucaauuucaggaaccuuugaggcccaguuccaguuauaaccacaauccuugccugaggccuuuugauuucuguuuggcugugccuggguaggggcacugugccugcuucugauuuugaaagaagcauccuggaaaccaugaaguauucuacuaugaagggcgcaucugcccuggucagcuguuucucgaagggagugaucuuaucgauagagguagaaaugguuucccuccaagguuggaucaauguguaaauugcuauucaacacuuggauauuaccagucugugguuuaauuauuccuccuagugagcuugcaaagcauagacuaaauuaaacccuaauguuagaugucaguauaaagcccuuagaauuuuuccucaaggaccccuucuuccuuuaggccuuucugucuugaucugugcauuaagaaauuuaaguuuggggcuggagaaauggcccaucgauuaagaaagagcacugguggcugcuuuuccagagauccugaguucaauucccagcaaccacaugaugguucauaaugggaucugaugcccucuucuggcaugcaggcagaauacuauauauaauaaguaaaucguaaagagaaaggaauuuaagggguuggagaaaugacucaguggcuaagagaauuagcuguucuuccagaggacccagguuugauuccuagcagcacauagaggcuaaaccaccuguaacucuagucucaggggcuccaacauccgcccuugaccuuggcuggcacuguaugcauguagugcacaaacacaugacggaggaacacauaaaaggcuuguauguguuaucauuuaaggucacuguucccaauuaaaagccuucaaccaugauuuucaucauuggaaauagaauugaauggccacccuguguugugggaacugagaagggcaauauaaaccugagagguuccuuugugugguggggccugaagaagaaagccccauggcuggacagcuguucucuccuccuaucccacagcuuccccuaauaaagggacuguucuuuugggaaaaaaaaaaagag

SEQ ID NO: 8776 - RNA, 916 nt, Mus musculus
cuggccaaggagcccugccguucucgcacuggugcaguaauaauucacaggacucuucucucuccuccuuucucugcuuaggcgcaacugaccgauuacuuuuggagaccagaggagaaagacacagccuugccagcuagaagaugcuuagaaagacggaagacucacccacaugccaguaguucacuaacuagccuuuccucaaacagccagaccauaggaagaauuaagucccccaaaagcccuucuuggugaugucuguggaggggguaauuguaccugugagauuuuucaccuggagaccaaggguggccucuuagguccugggcauagucagaaaugugccuuccccugugugagaauacagagagccaggaagaacaaaacaguguaauuuaucuccgaaucccuguaaggccugcuguacaguuccacagaaugaaguaaauguaacaacuacaaauaagccagccuuguauagauccacggcauugaacugagacggcccggcuggcaggauggugcaauagguugagguacuugcuaccaagccucaagugagaucucaggagccgugugguggauagagaaaacugacuccugaaaguugcucuuuaaucuccacaugcacgccaaggcucaagaaagugcucagguacacacaugucuguauacauacacacuugugccugcacacacacacacacacacaccuaugacacacuuugaauaaaaaaaaaauaaugauuuuuuuuuuucuuuuugaguccagaucucaguauguggcacugacuggccuggauuucccuuauagaccaggucagacuuaacuaguagagaucugccugccucugccuccuaagugcugggauuaaagguguguaauaccauaucugacugaaaaaguaaauaagua

SEQ ID NO: 8777 - RNA, 11507 nt, Mus musculus
ggaagauucaaaagcgaguucauucggaaggauacaaaccacgcuaaaaaggaaagagaagcugaacacagaauccccugugcaagacagaacggcccagggccuggugagcuaccucacagcuucugggaggaaggcaggugugaaugcuggcacugauccagccuccaugcggcaggaggcuucaugggggacagagucaacgucaacagcugcuugcuuuuucauccauuuuauugucagauagccagaguucauuauauaaaucuuucaaaauaaugagauauuacaagaauagcuuacaugucagcucugauuucacaaauacuugacacagaaaacugucuuacaagaauacuuuaauaaagaaaaauaagucucuauucaccuuagagcagauuuggcuccauuucuuuccugauccugcuaucauucuggauucucuuacggaaugucuacaacaucucacagagcaaguacaaccuguggcagcuucucuuucagcuacuacugagguucacaacgcuaaagggcuuuaggcuuucuuuucugaucuucccugaaauuaaaagaauucuuuuauucuuuuauucuuuguauucaggcucgaagagguaauuuuaaaaacauuccuuccaacuucgaugagguuagccacugcucuuagugacugauggucucaggccucgcucaggcuagaccagcugacaguuuaaccugagauaccaaguuaacaguucacaagccaugaagggagcccugggagcaaggauacaauacaggggucaggaaagcucagacaguggaaagugauuagagaacacaccccaauucaagguuucccuccuggucaaaugauacaacacaggguauggcaguaguuguggaagauacugaagaucuggaaaaggcuaauuauucaggccaguggugcuucauuuccaaaaggccagugggcaaggaauccuagacucugcaucuggguggccucagugggcgacauuccucuucugcuguggcuuuaauauaugaugcuguaugccuggggaacagaauacugaccacaucugccuaaagacaggaccaaccagggcaagcguguggcuuucacacucucccuccacuguuucucaaguguguccacuuggccaagcagccugucuuuacuuuagguagcauggauuaacaucaagaagucagaguggcauucuacagucggauuccugagaacucgggauacccaccgcccuuccgaagauccgcauccagcucuugcccaacaagcuuaaacacaccucuagggacugaggccugucccacuucucuccacagucauguggcuucuuccucaccccacucuuacagacugccacaggcucuuaccaaagugcugagcaguagacggaaauaaguuguuucgcauuaccagacacauccaucacauuagcaagggucacaugugcacaaaggaaagagccaacggucuacugcagugacuuugcaaacucagcguagucgauguagccgucguuguucuugucaucgucccucaggacaccaucuaugaugcugacgagcucauccucgcucaugacuggcgccugcucacuccccuccuaccgagagguacacaagacggugaggggcagaauuacggagggcauuagcaaacgccuacaagggucacuuaucuaggagcccucgagggagaaugugccacuucuaggaauccagacucaggccaggcagggucaauuuauaaaacuccaagugagaaacuacauaugccagcuacagaaagaugggauaaaaacagguccuggcuuuuuaucacuguugauauaguaacaagguaauguacagacacugcagacagcugggucuggauuacaaagaaccgcuugucagagucugugacuucuacacccauccuaaggcaagagcucacugccugauuccuccacagggucagccuacugcacaauuugccuaagaaaaugggaacagugacaaugaacaccucaaggucaaaacaagaggaagaaaacacugcaaaacacugcugaagagaaagcagcgcccuguucuagaggcugcugacagagggcugugccugcgacaaagcucuggccauucucguggagaccaccuugguccaucucccacaccaaugucauggccacacugccacucccgugccaggacugcuggauccugacuccucugacaguagugucaccuccacacagaauccacugcagugaaagcuugcugggcucccuacugccucucaucucucacccccuccccgccuccaucaagcagaguaagugucuccccuauugaugcaggcaggcagggagccugacaugaccaugccuugggacagcaggaaguaccucacaguaugacacaacccccaccuacuuccaaagcucugccccuuggucccggugucacccuucuucucagaugaaaugaccgcuuuccugugcccuacacugugguuuuuuggccggacccucaaacuccagcuguagugaaaaugucaacauuuuagcuugggccaaccaggcuuagccucucuggggugagggugggauacagaaaccggauaaugcucugcugaggcaggaacacagcacaggucaccagcgugggcacugucuacucagaugcccaacccugccuccuccuugaccuaccuccuugugcacgugagugauggcuauggagagcucuaggccgucaagcaaacuguugccgucguaaucaugcauuuugaaguaauggagcugcaguuccuguggggacaucuccgccucuggcuggucgaugacaccuuccagauguuccaugaugugccugaaaaccaacagucagacuugucaacaccuuagaagggcuuugaaacaguccacggucaagaacauagcacacagccagggccaccaaaggugcagggccacagcacagcggccaccuggcaccuucuuuuuacuguuagaccuugguuacaauauuuuuugaacuaccaauuuaauagcaagcuccagacuaaccaggguaucuacugagaccuugucucaaauacacaaacaagcaaaaaacagauaacgaagcuaaacgugaaguuuacuggccaaggaagacucaguguuggaaugugucacugaaaacgccuugucguaaucaggaaaccaugaguacauucuggauucuguuacugcaugugcuggacagggaagggggaaggaggaagucugaauucugacaaauaauucgguguguuuaggcuucaagagcccccaaccgugagaugcugaagacagguaucuuacuaccaggagucccaagggauaauguugagcacugaaaacuguucaggggcccuauaaagugacaggacgggaggaggcgggggcagccuaugagcuauggcugcagauggcagggacgcagagcgcugccccacugaauacauacucuuggucgugcacugugcucuuauccaggcccacgcugccaugauggacaucagccccguggucaugggcucuggcaccuggagcacaaaagacccaaagcaggacacacagcaagggagcucugagcagcuguaggguugccaugcuuccggguggguaccuggaagguaagaaacacagacggugaggcacaguaccagagcuucuggaauccugggaggcgugaggcugcagacaagagcacugagaacgggcagaggagggcaccugcucagcgugcgugugccaggagcugggugccacucccaguaccacagaaaaggucagccuagggugccggugcacaccuuuaaucccagcaguuggaaaguagaggcaaaggcaggcacaucuccuagcucgaggccagccuagucuacagagcuaguaccaggauagccagggcuacacagagaaacccugucuccaaacacaggggagaggggagaggggagaaaagggaagaggggagaaaagcggaaagggagaggggagaggggagaggggagagaagaggggagagaagaggggagagaagaggggaggggaggggaggggaggggaggggaggggaggggaggggaggggaggggaggggaggggaggggaggggaggggaggggagaggagaggagaggagaggagaggagaggagaggagaggagaggagaggagaggagaggagaggagaggagaggagaggagaggagaggagaggagaggagaggagaggagaggagaggagaggagaggagagcaagccaauucugccccagcucaccugcuucccaucaccgaacugggcaguacagauccacagaucuguuaauguccgagggcugagcagucacccaagagcaugcaaggauccagagacuauuucuguauagcagcccagagagagaaacgcuuccuaguugaguacaacaaaagcagagugagggguuuucaaaacagaaaagaaccuuugggaguuccgaagaaaucuccuugggugacggcugacagagccaguaaugcuucagccaguccugggcagacacuggagcugggggacaauggcagcugaaggcgagcaagugcuaaggcagcgggcacauguggagccaagaggcugacacuuccugagaacaagugggagcaacugucaagucaugacuaggcuggcguggcuucagguggacucacugacggugugauggagagcgauggagagaggcagggcuucgagaaagaccacgggagccgagggaagcaaccaagcugguccuaucaaccucaaagcagugaccuggagaggaggccaccguccccaccuugugcaccugccaggguccugagagggucucauaacuuuaaccaucacaaagaaaagcuacagaaaaacucauguuacaucuuaaugaacuuggaauuaagaucaacaagacaauucagccaggcaagcucccugaagacuaacuuacaucauaccauggauaccguaguuaauugcugguucaaugcaaaguucugccccucugggcuuagauuagcauccuguggcauuugcaaagauuuccccaaccuauuuuacccaucccccaccaucuauccccacgaaaagaucagcaaccacugggaaggugucuuaggguuuuacugcugugaagagacaccaugaccaaggcaagucucauaaaggacaacauuuaauugggcuggcuuucagguucagagguucagucuauuaucaucaagguggcaacagggcagcauccaagcaggcauggugcacgaggagcugagaguucuacaucuucaccagaaggcuacuaguggaagacucacuuccaggcagcuaggacuaagguauuaaagcccgagcccacagugacacaccuacuccaaggcaauaccuacuccaagagggccacaccuucuaauagugccacucccuuggccaagcauauagaaccaugacauuccacucccuggcccccauaggcuugugcagaccauaccuaaacauaacauaaugcaaaauacauucacuccaacuuccacaguccccauagucuaaaacguuaaaaaccuaaaguucaaggucucuucugagauucauccaaucacuuaacuguaauccccaaagcaagacaggaaaccauccaggcaaacuccaaacucugcaucuccauggcugaugucaaagcagucuucagaucuccaacuccuuuuugucuuuguugacugcaacaagcuucuuuuccugggcuggccccacucccuguuagcuuuccucagcagauagcccacggcucugucgucucaaacaucuugagaugucuaaggcaacuucaauguuacagcuucuugucucaaugucugggauccacacaugaucuucugggcuccuccaaagggcuuucaacacuucuccagcucuguccuuuguagcacucuaaccucagguugauucaauccacugccgcugcuguuuguggugaucaacccaugguacuggcaucuccaauacacuggggucuucugcugaaaccaggauucaccaauagccucucauagguucucuucauagugccaaaccucaaauccuuugcaugacccuuucaguccugggcccucaacugcaacugagacugcaccuucaccaauggccuuucauugcuucucacagugccaagucucagcugcucuucaugaccccuucaugccuucaaagucaauaccaccugggugacucucagacaucaccaaguccagcugcaguaugagguacaaccuuggccaucucuggaacacagcuucuuugugcucucagaaaacgcuucccagguuucaccucagugauucuggucucuucuuaaucaccacuaauugcuuagcgccagcuaaccagaaucaucaauuguccuaguagucuccuccucuugacucuagagccagagccacauggcugaagcugcaguucugcugcuugcgggaacuggaacauggcucccguguucuauuacauuugcaccagcuuccucuuuuccagcuccuucacugccuaagcuuggcuguccuggaucuugcucuguagauugaccuccaacucagagaucugcaugccugucuccugggauuaaagguguguaacaccaggccuggauuuaagcuuuucuucaccuagaacuugcucugucucagacuggcuuugaacucagagaucugcuuggcuuuaucuccugguauuaaagguguguguguguaccaccaugccugggucuaaacucagcuggguaggauccugccccaaagucccacugccuuaauuuguuaucuccuugaacacaggacucagcuccauuucacuuccaggcaccccuuuaacacuugaaccauauauucuauauuuuuccuuucucagcuugcuaugcuuguuuaaaauguucuuuaugagauugaaccagagaacaaagucuaugaugggcguuucugaaacuuccuuugucaaugcaauuaaucugagucucuucaccuuagccucaggcagacucuucacauaagggcaaaaagaagucacuucuucaccaaaacaccacaagaacagucuuuacaccacauacugaaauucuccacugaaaccucucgggccaggucugcacaauugaaaucacucucaguaaugaagccuuccauauuccuacuaggauagcccauuaaaccccauuuaaagcguucuauugcuuuccaaauccaaaguuccaaaauccacauucuucuaaacaaaagcacggccaggccuaucucagcaauaccccagucccuggaaccaauuuugucuuaggguuuuacugcugugaacagacaccaugaccaaagcaagucuuauaaaagacaacauuaauugggcuggcuuucagguucagagguucaguccaucaagaugcagggcagcaucuaggcaggcaugaugcaggcagagcugagaguucuacaucuucaucugaaggcugcuaauggaagacucacuuccaggcaguuagggcuagggaauuaaagcccaaguccaccgugacacacccacuccaacggggccacaccuucuaaugaugccacucccuggccugagcauauacaaaccaucacaaaggaguaauuuucaaggugcucaaacgcaguaucuagccugacuacugugcaaugacauuaugcaaucuaucacgcugcauaagguuucuaauagauucaaugaaaaaaaaaaaaaaaaaaagcaggcaguaagucuacccauaauucacugcugcaaaguaaaucuauacacauauacaaguaugccucuaacccucaucucugucucuccuaccugagcacugggauuacuggcagcugcacacauaccugacauuuaugugggugcuggguaugggaacuccaguccucaagcugcaugcaauuuacccacugggccagucagggcuacauaaugaaauccuaucuaaaaaaacaaaacaaccaaaccaaaaacaaaacaaacaaaaaaccuacuauaaaugacuuuuuccauauauguauguaaucccuaccauaauucuaauacucaauggcaguuucuagcuaacauuuaccuccagauaauucaagaguuagaaaccacacuuccaacuuaagaagcaagcaucuagacccugccaagguuguaccaggaacagagaacauguucucaaguuauuccuaguagugccuacuaugcugaugucacuuaacccaggccagagcagaauaacuuauucugggcccacaucuuaggaguguggggguaggaaggaccagaaaugggauccaguccucccuaacccucggacucaauuaucuucagugucuucuccccuuggcuuuuguuguuuuacuguuuuaaaacaggcugucacuauacaacucaugcuggcuuaacuacagucaucuauauucaccuuccaagugcugugaugcaggcaugugccacccugagccuggcuucuauguucuuccaguguuuuugguucuuggcuucuggacuggaauaggaagacauucucaguacagggcaccugccuggugucuagacuacugguucacaacuuguguguccugugggucaugguccuugguggacuagagggauaaccacagauacacagcuaagauuuaaaaagaaaagggaaaaaaaaaugugcaugcugaggaagggacagugugcuugagugugacagccacacugaugucacgugucuuguuuaguuguuuucuacuucuauaucgagaggcaaggucuacagccugcagccacauucugaugucaguguaauuggggaggggggcaccuuggagcugucuacugaaaccauggcgccuuuccucgaagaacaugguuggcuccagcugggauguguaccuguggcauguuuuaaacugauguaauagcagaccuugacccaagugguuaauaagcacaggaacuuugaguucagguuagccucucuucaguauaaaagccaagaaccucugagcuugcgucgucggcaaguucccaacaugaaagcucaagaaauaccagcuccaggaagucagaaggaaucccacaaagcacggggacgacaagaggcagggccugccacuugccagauucaacuguucccagucaaaaaggacacauugcaucauccacacuccaguuacuuaguucaaggccaugggcacaaggccuggaaagauaagccccaaggguucccuggcucacucaccuucaggaaacggcaaaggccaagcuagagaaaaacccaacuaagggagaggcugacaacugacuucccuuuucuaaagacccccauguacagagacucuucuugaugggccuggagucuuagaaacuugacuaucuuauguugacuacuuauauauucuugacugaaaggcuguugcucauccuuuggagaaggucaucuucaacagaaugagcaacucugggagagacacacacagcaacgaaagaggaaaaggauauugcuaagcucagcagaccaccaccacuaacccugucgguaugaucagugggguaugaucggcggcggcaagcagaucgucuggaaaccagagagggcuguagaaaacaaucagggccuuagcaugagucugacagggcaaugcugaccugccucagagccuugacuccaacagggcuccucucacugcuccggacgccucuguugccacugugucuggucauuccuccuaggcccgguucagaugagacguaaagacucuugugguuaacaccccuugcuuccuugucuguuucuuccuuccuaucuuuccuucuccucuuuccaaaggucaggaucuguguucucucauuugugaacugaacaacgcugagcuggcgugggacguggucagaauggggugagaagaaacacaguacuuaagucucuaucucagaggcccuggccuaaggcugagcucucccuuugcagcacuccugcccacccuuccuucccacugggccauuauuccuaucagggagugggcuuuccuccuagcagcuguuggcagccuucagaggcucuuaguugggaauuuacauucaaagcaaucacauuugacaacaccccagacauccuguuacacggagccaaggccaacugacuagugcuuccuaguuguagucaucuccaugcucuugaaguccaaguaaccagcaaguuucuggguuacagaaagcccccacaugggcugagguugaaaacuuguccugaauaggcugguguuuaauagucugguccauuuguucacugggggauuccaaaggaaugccaugcuacccuuauaacuaacauuuaacuaagagccuaguuacauagggagagcagagcugugaaggcugugagaacagucagacgccucucgacagcaaaacacaggucacuaaagaggcacuccagggguaucacacacacccccauccacagaaagcaugagaagaaauauuucaacccaaagcaaagcacgccccuccauauggcagugaacaccuaaacaugacuuaaguccaauccagaauauucagaugaggaggggcaggucuugaguaaaguacaaagacagugagugagucacaacaggcauugcaggaaggaaagaagagcuuggaagggcaaugagaauccacagaaggaccugggaauggggcaggguggcugagcgugucucuaccuccccuguacuggacacguugaggagggucaaucaauauuaaaggagcagaaaagagagcugauugcuaaggcaaggugucuggaaaagugagaguuuugaauagguucaauguauuugaugaguguagguaagagugacgcccaggccucugguuugggcauauguguggauggaggugccaugucccagaaagggaaaacgagacaaacgagcaucccuugucuaccuaaccuccuaggcucaaacuagccaacccugucgagacaacaggaccugugggucugccccgaggaaggugggggagccagaggcagauggaguaacgccugagacccgcgugcuuccaggccagccaggguccguguccagcccacacagcuggcccuacagccuaguacugagacucccagcaauggggugagcgcaaacaacagcgcggugcucagccgggcagacacgucuggcccccgaaacccucucggaagacaggcugccuccgugggccacaggucccgcugcgcccugaagguccgcauccuccaccccgccacccgggccucccauucucgagccccaggccgaccgaccucugccccgagggucaggccuccggcccguggguucgcucaccccgauaauccccgacgcagucgcgaagcacuccaacgugaaccuugccagcugccgucccugggacgcuuuucuccgcacgccggucccgccccucgcccagccgcgcacgcg

SEQ ID NO: 8778 - RNA, 2291 nt, Mus musculus
ucauaagccuuauuucauuugcacauccaaaauggcugucugaagccauccauguagaauggaggugggcaccuaggacuacagagggugagacaacugucgugccucaucacagugccugugugcaggggcuggauugucccuguauucccaggcugcccugcggcccucugaaggcagcgacucgggucaugguuagccugugagggacgaggcaagcaggcggcugguggggcagugcugacugcguguuccuccccagugccuagagcgagccaugaagugugcuuuuggagaauuucaccuuugguaccaaguggcccucuccaugguggcuugugggaagguaaggcuggggcugugggggcggggguuugcccgacgccugcuccgaucucuccuggggguggugucucagaguuuggugcuggagacguugguggcccaguauugggaugacucccugagguggauggggaaggcgcuguguucacgugcuagcgauggugagcgugcccaugcgcaggugugggcguggguguuucucucuuccugugguccgccacgggguguuugcaguugggagucgggagcgugccuaagagggucgaugauaaugaugaugaugauguagcaagaggugccuggguggaggcagcagaagagcccagcucugcccagagccaggguaggcaggcauucgcccuccaucugcccagcaccugcuccagcauuccugauuuuugcucagaucagaacgaugcuuauguaagccucuauuuuaagcagagacaugaaaggagaggcuuuccggagcugggggcugagggagaugugucugaggaugcuaugaaugcaggaaacaagguggucugagcucacagacuguuucaagagcuguaaauacccagagcccuuuuguggggcugagggaauucccucgcccccugcccaucugcgcuacauuccauuucuagccccacagccucuccgaggaggccuucccagugugccaguaccgccuccgcggaugggggcugccgccagcccugggucucuucaguaagacaggccagggccuggcagggaggagguucaggcgcugcaggcuugucagacugucugcagagcacagccaaagucagcggggaggcuccucgggcauccucugcuggguaucugcucuucccagcccuucuccaucacagggcccaccucccagagcaucucaaagucacagcacaaccgaccuuggcucugcucagcagggaguuaucagaacuccgggagaaauccgaauacagacagggcuggcccugcaggauuggggggacacucccuaggagcaagcagcacgagaugaauggagaggaggaggacagcgggcacuccaggcagagggcagugugagccgagugggaggggccaaacgaccguagugcaaacagagcuauguaggacuugaaggaaccagccugucuagggaguaacagaaggcugggggggagggggggugcggcgggaccugaugcggauccugcauacacagcagcaugggacagcuucuuccugcuuucccccaaacaggaaacaccuuuagccuuagcauagcggagaugaggaacaaccuagaguccugcagugcucccggggagguggauuuuuuuuaagcuacccccuuuaaaaacaaacaaacuaacuaacaaacacaaaacaaaagaacaaaaaacuauccaugaaagcuucaauuucgagagaguuccuggaggccccagccucaggaaaaggacccacaaaugugggaucuuucuccuccuuauggggaagcuggacccaaagugguccagacuccggccucugggaagccaucaccuacucuggcucauucaugauccagcaaggugggcauggggaguuggaguggugagcaguuccucauaucugaggcuacacaggcugcagacauuggucuucucccacccaugcacccagugcacgggagacuguuguagaaggcauucuccaaucccaccgcccugagaauccugcaugccaaauccauuugccugacuauccuggcagaccucaaaggaguggcuggccagagcuugccuuugcugagcccaagguaggaacccagguuccguaccuuccagaagguacggcugggcagauauaaauaugccucaugcuucaccccauaggaauaacggaugaguucuguggcaugauuuaggucgcucccucucuuggucuccaugcggcaguuucauuggcuguguugcuaggua

SEQ ID NO: 8779 - RNA, 51386 nt, Mus musculus
gccucuggaaggccugcaaggcugcagaagucggacgcaugcgcaguagcuagaguccuagaguucgcgggaagcugggaccuugcucgcuuaugauuggcuacugcgguagacucccacccaccggggcgcagcgcugcauggugauugggcgagcccacagaggccggacgagguuuagggggcgagguuggggaggcgggaaacgacgcggccagcgcagggucgcucugugcucuagugguguugguguggagcggcucggaaauggcggugcagccuaaggagacgcugcaguuggaaggcgcggccgaggcgggcuucgugcgcuucuuugagggcaugccggagaagccgagcaccacggugcgccucuucgaccgcggcgacuuuuacacggcgcacggagaggacgcgcugcuggcggcccgcgagguguucaagacccagggcgugaucaaguacauggggccggcaggugagggcagccgcggcggcggggcccgggccggcucggggccgcguugccggaaaccugggcgcaugcagcgguggggcugcggcggagcgccccgcccgagagcugccuccccgggccacgcguuuagcaucuuguuuugguucgcuuccgcacagugcgcugggcggcugcacaccgccgaguccaggcuguccucggacgccucgaguuccagccucccaaguugauaggauuagagucuugugucaccguggguaccuccaaaucaauaacagcccgcagccuaggagcgaggaguggagggcguuuugagagcuuccuuuaagacacccucauuugccaauaggcuguguuuuguuuuguuuuuuuuaaaccgucucgcuugagaaccugggauggaccauugcugaagggcaguaucgccaaguggucaggaccuaggauaugcccuggagcugaacugcccggauuucaguuguggauccccuacuguuugcugagugcgguugagcuaguuggaaagcugugcuuagcuagcuagcuagcuagcuuucuuucuuucuuucuuucuuucuuuuuuuuuucugccaccuuggcucucaccacucagcaucaucucucccuaaaaggcuucagaacucauuuguggccuaggaagauuaauuugaucaccauaauaaccucucccccacccacccccguugcuuuuucuuucaauuacauugaauguccauuauaucauacuuuggaguugugaguucuaauuuuuuuuuuuuuuuugguuuuucgagacagggcuucucuguuauagcucuggcuauccuagaacucacucuguagaccaggcuggccucgaacucagaaauccaccugccuuccaagugcugggauuaaagacgugcgcuaccaccgcccagcaugaguucuaauucuuuaugcuguuauaugcaaauggauguuacagacaucguauuucugccuggucugugcuagguaauagucugcugccuucacaaccaguugaauuuguuuuuguuagacagcuauucuuuaucuugaguuaaagagugacacacacacacacacaagaaauguuguguccauuaauaauguucucucacaaucuucccaguccugaccucuaguuuuccuucucuggauauucugggauguagcauguaaaugaagagcuucaaggcuuaucucugucaucagcacuucguuccuuuugguugcuaaauaauuguguggauuucccacauuucauuuagcuccuugucccuggaguuuguuuuggcuugguuuuuggagacacggucucacucuuuagccuugguugaccuggaacucaguagguuuaccagguugucacuuacacugccacugccuccugggacuacaggcuuucaccaccuugcccagcugagcuguuacuggaaucuacauuuccucgaaucuguaccgguuccucccaacagugcagugaagaguaagcucuuggcagcuuucuggaucccagccgaugggcguggguaggguucuguugguuuuucauaguuuucugcagcucgcaucuggcgguaucccuuuacugacauuuuaccugcaugauuggggucauguaaagauguguuauucuaaagcccugaucagggagagccuccugccugagccucccagguucagaugcugcaauuccaugcaugcaucuucauauuuauuacaggauccaacccuucucuccuaugucccacuuccuggcccaguuggaugcacauagggguuccaugucauccucaagagacucuugugugcacgugaaucugucccuucugugggguguggguaagauucaagucugaucguucgugucacagcagaaaaguccuguuucacagacaaggcccucagaugcuugucagcaggugugcacggccucucagugggucacacaugugcugccuucuagagaaauggccccuuccuucagaggauaaccaaacuuuuuuugagaugggucuacauggugaagcacacgauggccucuggcuucagaccuuagccucccugguggguaccaccucaccuaucugggaagucucuguauuucuguagugcuagggauagaagagggcacucgucucauuuaccucuccgcuccugggucuuagacaguaacacauuuaauaaugaguuccgguuaguaaaaagaccaagaaacaguucucuggguucuagcuagugccagauagauaccacugcuguguacuguaguuaugcacaagaacagagaagccagaugugguggcgaauaccuuuaaucccagcacacggguagguggaucucugagaucaaggccagccugguccaccuagaagaguuuaggacagccaagggcuauauagagaaacccugucucaacaccguccccacccuccacccccaacgcuguacucccacaccauccccccccccccaaauccuucaaacugaaaaacacuaacuacaaaaaggaacagaggggcuuguacaucugagagggcuucgugaagugaggagccuuuaaugcagugagugcuucagcagcccuguccuguccggaugguucuugcacgugcuguggguugguucagccgcucucccagaauucauccagaccaucuucccucagcgugauauuuuuuuaccaaauaagauugcauuuuaguuucuaaauugagagcugauauauuuuuauuuuauuuuauuuuuugcuuuucacacagcgucuuaguguguagccuuggcuagcugggaacuuaccaugacucacagaccccccugccucucugucuucccaguguuagggcauucucccucagacugaccucuuagacguuuauguacuggguuuuauauuuuauauguguuuugucugagugucuguacauguauguaugccuggugcccagggaggucagaagaaagccuaaaaauagauuaaguggccauguaggugcugggacaauugaguuuuuguuuuguuuuguuguuucuuuuuaaagauuuauuuauuuauuauacauaaguacacuguagcugucuucagacacuccagaagagggagucagaucucauuacagaugguugugagccaccagcugguugcugggauuugaacucaggaccuuuggaagagcagccagugcucuuaaccacugaacuaucucgccagcccgaaaauggaguuuuuauuccaguggaugguguggugauuuuaucuguguguggaaagguugacuuuauguguauggauggcuucucugaugcuucucugcaccaugugcaugaaucuagaagagggcagaguuccuuggaacugaaauacuuccugcuaaaucagggucucauccuugguacuauuugcauuuugaagaauaaaucauucauuucuugugagccauucuguccuaaucauguuaacagcuucuugcgccuguccucuagauuccaaagugcuauuguucccucaugacagcucacaugucucccagaauuauuauacgccccccccccccaagaggagcaggaucacgcccaguugagauauagaugagaaaguuuggaaauuuuuaaaaaaaauguaugugugagucgugucugcauguaugcguaucgugugugucugguccccacaaaggccagaagagggcaucugauccccuaaaaccagagcuacagaugguugugagccaccaugugggugcugggaauugagcucagacccucugcaagagcagcaaguguccuuaaccacuaggccaucucuccggccccuggaaacucuugcuuuauuauauucuuguucuuuuucuuuuuuuucuuuuuguuuuuguuuuuguuuuuuuuuuuuuugaaucagagucucgcuguguacugccuggccuggaccuggaucuagccuaagccagcuuggcuuuucacuuauagaggucuugucugucgaugcuuugacugcaaagacacccagcuuccugaggacucuguugacuguaggaaaguagauaaccauagagggaggcagucugguuguuuauuaaaucacacccaugagagaauuugguuuuagaaucuucucaacacacugggaacccugagcauuuacagguuucuucgugaagccuagcaaugcugaggaaauugguuagaucacuagacauaacucccaguacacagaagccaguucugugugguuggagcaagcucccuggugauagggaacuguguguguauccauggugauaagggaacaggguguguauccauggugauaggggacaguguguguauccauggugauaggggaacaggguguguauccauggugauaggggacaguguguguauccauggugauaggggaacaggguguguauccauggugauaggggaacaggguguguauccauggugauuggggaacaggguguguauccauggugauaggggacaguguguguauugugugaguguauaaaagggaaaguaaugauuuacauaugcuauugaauauagacugaaacucccagccuguuacugguaagcagcuggcuagggacagugcuaaaagggagacuugacuuguuugaaccuugaguucuguuuacaaguggaguaugacuaggugucguuuuguguuguguuacugagaagccaacccaggcugucacacaugcugggaaggugcuuuaaugcugagcaaaacccagcucugagcaguuucagaguccuuuguaaauguacuuuguuuuguuuuguuguuuugcuuugauuuuuuuuuuuuuuuucuuuuucugagacaggguuucucuguguagcccuggcuguccuggaacucacgcuauagaccaggcuggccucaaacucagaaaucuuccugccucugccucccgagugcugggauuaaaggcuugcgccaccacgccccggccugguaaauucuuuuuauucaucucuuguguguuauguauauggcugaacacaaugcaguagggaugcaggagucaggccuauucuucuaccugagaggucugaguguuugaacuccauuaggaagcuuuuauucauagcaguuaccuugauaacguaucuucucuguaguccaggcugcccucaaacuccuccugaucugaaguuauaccccugccucagacuuccaaguggcuagacugcugauaugccccguuguacauacaugccccguuguacauacguaguguuuguucauucagcaguuuguuggaagguuggcuugcugaggaaaugcaaguuuaggcuaauuugugaaguucucaaacauguauuaccucacagccucaucuuuaacauuuaaauuuguuuauuuguuguuuauuucagggaguaagacccugcagaguguugugcuuagcaagaugaacuuugagucuuucgugaaagaucuucuucugguucgccaguaucgaguugaaguuuauaagaauaaagcuggaaauaaggcgucuaaggagaaugagugguaucuggcauuuaagguuguuauuuuccuuuuggauguuugucuuagaaaauuaaauucagugcauguuuuacuauauuaacuagguugugauagcaaaaugccuugagaaauuuugauaguguuggguuucuaaaaguuacaguuuaaucacaguuuagaaauucaguagucuaucuauauaaaauguuuugaacacgccaaaccuugucucacuguuccugaaauacaacauuagaugauaaccuggacauaaauguuauaauuuuaaaaagauuaguuuuauuuauuuuuuuaauuaaaaaauuacuuauguguacugggucugcaugucuguccguguaccacuugcaugccuguugcuagagcgaggagaccagaggagagggccuuggaucccuugggguugguguuagacuugugagccagauucuagaagagcacccaguguucuuaaucucugccugucuuucugccuccaguuuuuuguuuuuaguuuuuuucuuuuucuuuggaggcacagucucccuguguccucaggguggccuaggauucuuggcaauccuuggaaaauggcugucuugaugugcagguggcucacgccuuugaucccagcacuugagaggcaaaggcaggcugaucuagaccagccuggccucuagauggggagaaacccuguuuugaaagccaaaaacaaccaacaaaaagacagagaaaaaugccuaacucagcuucucaaggugagggauuaauggaagcuauuuuuucuguuuuacuuuucuuagaacaggcucagucuggugucaucgaucguccugccuccacuucuccagcacugaagugauuacagacaugcucugccacacuugccuuucuuugccuuuucuauaucugaaguaugucagacagguuuuacugucccuaaugucucauuuauaggaacauuugugacugcacauuucucaguccacaccuuuagugagcgguauagcgucacacaagccuggagggugcuuuggucuuugagauagcaucuuccuguggcccacgcuggccuugauuggacccugacauucugucucagucucuuguguucugggaggccugaaaaucaguuuggcagaauaguuucucuguaugguccuggcuguccuggaacucacucuguggaccaggcuggccucaaaccacagagaucugccucccucugccucuugagugcuaggauuaauggcaugccaccaccauugcccgucucuggagaaaucaguaacugcaaaaggaagagagggucuuuaaagcacauguaguaauaauugaaaauagacugacaggcaugauuuuguaaaaaaaaaaaaaaaaaaaacaaaaccaaaauuaauuggauaauuauucacuugcaaaauuuaacuguguucaauauuccuuaaaaacuguuuuuguuuuugcucaggcuucucccggcaaucuuucucaguuugaagacauccuguuugguaacaaugacaugucagcuuccguuggcguuauggguauuaaaauggccgugguugauggucaaagacauguuggaguuggguauguggauuccacccagaggaagcuaggcuugugugaguuccccgagaaugaucaguucuccaaucucgaggcucuucugauucagauuggaccaaaggaaugcguuuuaccaggaggagagacuacuggagacauggggaaacugaggcagguaagggcauucagucuaggaacauccuucauguaaaauaccccuuccccuguauuuccuugaaccuaggaccucuagaauacaaggcuggugcucuaccccugagcucuggaugcuaggccagggcucuaccccugagcucuggaugcuaggccagggcucuaccccugagcucuggaugcuaggccagggcucuaccccugagcucuggaugcuaggccagggcucuaccccugagcucuggaugcuaggccagggcucuaccccugagcucuggaugcuaggccagggcucuaccccugagcucuggaugcuaggccagggcucuaccccugagcucuggaugcuaggccagggcucuaccccugagcucuggaugcuaggccagggcucuaccccugagcucuggaugcuaggccagggcucuagcacugagcucuggaugcuaggccagggcucuagcacugagcucuggaugcuaggccagggcucuagcacugagcugugguuccagcugaugaugcuuuucauuuaucaggggaaaaaaaccaguuuuaauucuaauuaaaauaauguuuuauuuugaggacaaucuugauucuuaacuuugaaagaacuuggcauucuuaagucaucaugacaaguguuuuuauaagacuugcugagguggcucagcaguuaagagcacacuggcugcucuugcagagguccugaguucaguucccagcaacaucaugguggcucacaaccaucugugaugggauccgaugcccucuucugucugaugccaucuucugucaugcaggcauaugugcaaauaguguucauauacuugaauacauaaaucuuaaaaagaacuuguuuuucauuuagucuuuucuucugucuucacuccaagagaauaguuauaguaacuaugaacuguauuuggcauguuuaucaggcauuaaauaguuaugauauuuauuucguauuuuguuggggaucuuggccaggcgugugcuaagcagguacuguaucacugaacuauaucaacccaaaccuagaauuuuucuuuaaguuucuagguuuuuuuuuugagucauugucuuacuugacagcccagguuggcuuagaacucacagacauccugccucagcagccugaguucuaggauuacucgagugcuacuacagauggcuccuguuucccuuuuaaaauuuagccuuuacagaacuuuuugucuauguuguguguguacguguauuuauuauuuuagauuugcagccaaaccuggccuugaacuuaaaaaagaaaauuagauuuauuuuccccggagacagggccucacuguguagcuguggcuguccugaaacucacuuuguagaucaggauaaccuugaacucagaucugccugccucugcuucccaagucuuggaauuaaagcugugcacuaccauagccagcuaaaaauuugugaguguuuugcuuacauguguauauguguaccgcaugaaugucuggcauccauggaagucaggagaagguauugggugucucggaacuaaaguuacagaugguugggagcccccaggugggugcugggagaggagucagugcuuuuaacugccaagccaucuccaagugcugcagauacuuuuuaagggacgaucugucugcuaacucacuggccaugcuggccugcuucuaacaggcaguccucauguuucuuccucccuagggcuaggauuacagggauggacuucgugcccaccugauaacagccuuguaguacugggcaccgauaagguucccagcaugccaggcaagcucucuaguacugcacuuaccccuagccaugccuccccuuccucccucaacauggcauucaaacucuccucuguuucagcuucuugguuggauuaaaggugugcaucaucgcaacaagcaugaaacauuuuuugaaacuuucauuuagucauaacuuuaaaauugaauucaaaguccagaguuggguuuuuuuuuuuuaaugaguggcagggucucacuguguagauuuggcuauccuggagcuccuugugaagaccaggcugaccuugaacucaaagaugugagacccaccuaccuccgccuccugaguucuuagauuuaaaaguaguuccugccgggcaugguggccuugggaggcagaggcaggcagaucucugaguucgaggccagccuggucuacagagugaguucuaggacagcuaagacuacacagagaaacccugucucgaacacacacacacacacacacacacacacacacacacacacacacagaguaguuccuaaggacuuggauagugagcagaauuuggugcguguuaguagucuucuaggcugucgauauuuuaugcuuucucauguuagacauuuccuuuucucauugauuuccucaaagucauuugaaaucuuuccuauaaacagguuauccagagaggagggauucugaucacagaaagaaagagagccgacuuuuccacuaaagacauuuaucaggaucucaaccgguuacugaaaggcaaaaaaggagaacagauaaauagugcugcccuaccagagauggagaaucaggucuguggguuacaaacaugugcuuaaaucacuacagugauguuuguaaaggcuaauucagucacuuuaaaaauugcauuuauuuauugugugcgcacacacccgugcucauggacgcacaccaccgcgugcguguggaagugggaacaacuuucgggaguuugguuuuuuucaccgugugaacccugggguaagcgcccaggcuuggugggagggucuucaucugcugagccuccucacuggccacacuccugucagauucacugugaaaucugaacucugcgucggugauacuauuguacguacaauaagguuugugaaaaacaggaaagugacuaugcauggcaguuaaucccagcacucgggaggcagaggcagguggauuucugaguucaaggccagccuggucuacagagugaguuccaggacauccagggcuauacagagaaacccugucucgaaaaaccaaaaaagaaaaaaaaaaaggaaugacuaugacuagaaaauuuuaaauauaaccucauagccuuauauuuaaauacuguuauuuuaauuuauguauguguguagggguaguaugcugcccuuaguggauagagacaugggauuccucuagagcuagaguuacaaguggaugaaagccaccuuacauaggagcugagaagugaacuuggguucucuggaagagcucuuaugugcugaacuguuucuccaccccgauaaucauacuuauguggauuguauguagaguauauguggaaggggaucguguuuacaugaacuugauaugcaagccuguaauccuagcuguuagagcuuggaucaggaguucacggcuaucuuuguaaauguugcaaacuugaggcgagccugggugguugagacuguguuucuaugaagaggaggaaaaaagucgucacaugaaagaaccugacuacugucacuucuguagggauauauagcauagucuugccugucccaccuuugcugugcaccaccaguuccaggaaucucucauaaauuauuuaauguuuuugagagagaauuuaauguuuuguuaaauaaguauaaauaugucuacagugaacgauuguuauuggagguuagcaaguaauaaaacugaaaguguguuuaccuuuaaaaaaagauucauuuauuuauuuuauguauauauuuaugaguacacuguagcugucuucagacauaccagaagagggcauuuguaccauuacaaaugauugugagcuaccacgugguugcugggaauugaacucacaaccuuuggaagagcagucagugcucuuaacugcugagccaucucuccagccccugcuuuuuuuuuuuuuuuuuuuuuuuuuuaaaugagaacauaaaacagugugggcagggcaggagauggaggcagucucagauauauauugaguuggaauacauccuuggcuaaaugaaacuaccucaaaaaggcaaauagaaaccuaguaagagugaauaaaaauccuagggcuuagaaaacuuucuuccuuccuggaaauguaaagaagcugguagagauuugguuuauuuauuuauuuauuuuuuguuuuuuguuuuuuuuguuuuuuuuuuuuuuuugagacaggguuucucuguguacccuggcuguccuggaacucacucuguagaccaggcuggcuucaaacuuagagauccgcuuugagauuuucuuacucuucaucagcaacagggcaugguccuggugcugacuucugacaguauagauuaguuuaucuuuuucuguuuguuuuuuuauauaaaugaauaauaggacuauuuuucugucuuuccuauuuugcuuuuggagacagguuucuacuuauucaugcauacuauugaaauaaauauguuguagcuuauuuauaaaugaaaguaaaaaugaaugagcaguauuuuagaagguauaaaaagacaacccuugccuguguuggcggugguggcacacgccuuuaaucccagcagucaggcaggcaggcagaucucugugaguucaaggccagccuugucuacaugucccaggauagccaagguuacacagagaaacucuugucucaaaaaaucaacagaaaaccaacaggcagucuccauggggaccgauucuagcucuccaacacuugucuauuugagaugucaaccaucuucccucugggucucccacuuguaagcaacuggguuuuuccauguuuuugagacggggaaugaccguauucuugucuggccuggaacucagacuguagucuagauuggcuuugaagucacagauccccguaccuuugccucucaguugcuggaaauaaaggcuugcgccaccacucguggugggcuucacuuugauuauacacguaugauauauauauuaucaugugagcaugugauggucaugagggugcuccaucuuguucgugagcccaggacacuuguggggagcucuuuuugccugcugugucuagggcucagacucagaucacaagccuugggggacaggugcuuuagcuacugaguugucaccagcaugagaggcugcccuuugcauuguacacuuguguagacuugcuaugcaucccaggcuggccgcacccuugacuugccuguguuggccuuucacucauggacuagaauuccaggcaugggccuccaugcccagcugaucuucuuguacuuuuguuugcauuucugguaucucgucuuaugauugaagaaugaguuauuuaaauuuuuauuuuuagguugcaguuucaucacuaucugcaguaaucaaguuuuuagaacucuuaucagacgauucaaauuuugggcaguuugaacuggccacuuuugacuucagccaguacaugaaguuggacauggcagcaguuagagcccucaaccuuuuccagguaaaagagacaacauggguuaaaaacugaauaauuaaaaaaaaaaaaaauuccuuuugcgaguaaugcuuuguuuaagggauuuguaguuuauaacauuauuggagcuagaauagauaguucuuaacuauuguauuuauuuuuucuagccucaaguaauauaugucgacguguccuagguuuuugaauaauuuugugugaugauagcagugcuuuaaaguucuauuuuaguuugguuaaacacugcaguaacugggagcagagacugggaggacagaggggagggaacuuugguuaggaugagaaaaauggugucauugagggcaaaguaugccucuguaaguauagauuaacagguugaaauuuggucuuagcuuagaaacauuugugugggggcuggagagauggcucagcggguaagagcaccagguccugaguucaaaucccagcaaccacauggugggcucacaaccauccguaaugagaucugacgcccucuuguggaguuucugaagacagcuacaguguacuuacauuaaucaaucaaucaaucaaucaaucuuaaaaaaaaaagaaacauuuuugugaacaguucucaguuuauuuuuggagaauaauacucauucuuuuugcccaaagcguauuucauguccuauuagucuuugcugauguguguguguguacguauguauuuauuucuguguucuaggguucuguugaagacaccacuggcucucagucucuggccgcauuauugaauaaaugcaaaacugcucaaggacaaagauugguuaaccaguggaucaagcagccgcucauggauaggaacaggauagaggagagguacggccuggagugugugcuuucacugccucugagcagcgugugcuuaacugugugggaaugccacuuacucugauacauacucaguuucacacucauuuuaguuuuucuuuuguuuuguuuuggaguccugguugacucugaacucaauauuuaguugcggaugagaaaagaaauuacuaugugcaugguguguuuuuguguguaugcccucuguguguguguagagacagacauacagacaggcaggcaggcaggcaggcagacgcaugagcacguacagguguuggcuguacauucguggcaucccuucuuccagcuucauguaggcuccgggggucaaacucagcaaauagacagguuucucagcgagcaucucuguccucugagccuuucucucgccuaacuuugaacuucugauccuuuugccucuaccucccgggcccugggccaccauccgcaguuuaugugguacugggagguugaagcaguccuggaaacucucguucaggaugcugugcugagcucugucccuagcccaguuucuuuucuuuuuuucuuuuuuaaaauuuauuuauuuauuuuauguaugaguauacgguagcugucuucagacacaccagaagagggcaucagaccccauuacagaugguugugagccaccauaugguugcugggaauugaacucaggaccucuggaaaagcagucagugcccuuaaccagugagccaucucucuagccugaugcuguacuuuuaauacgcugguuugauacgagccauuagcuuacacaagaccuagucccaacucgcauaccuucuauguucucacccccugucuuccuuccccuggaugauccggucacugacgaaugaaugcccuggugauccagaugacgucugaguguaugcaugcacaucacgugugcgggagcccgagagcaucagcacagaguguucagcacccuguaacuaguuauaagcaacugugacugcuaucuggguacugggacucaaaacugcuuucuuuggaaaagcagccagugcucuuggucaucucuccagcucccacgaacguugguuuuaaaaacccaguguuggcuuggugaaagaugcagugguuaaagacaguugcuuccaggcccgaugaccuagugcaucugagggacccacgcuguagagggagaagauucuugaacuucgaccuccaugugugugcugugacacaucuguacacccauguacuccgggaaguaacugugaucauuguuuugaaauaccagauaucuuaggauugauuuccagagagcccuuuggaauuuuagggacuaacuggcucuuaaaaauuuaucuugcauuccaguuaaauugugaauuaauuccuaucaaauuuugugcagcugaggaauugaauuuaacaugagugauaggaauauucucuuaaugccacucgaagcuuugauauuucuaaaguugugaauuuaaaguggcauugucaaggagacagaagucucuuccuuuuuuccauugucuguuaucuagagguguaaacugacacuguaauuacuucuuaggugguugcugaauagacuugugaaaccagcaauuuguuaggcuucucaggaucucugggccagacugaaggagcauugugauuuguuuugugcuaguguguuuugcuuuuuuuuuugcuucaaguccgggucuugcauagcucagguuggccucaaacucagauuucguguucuuccugucuucaucucccaggugcuagcauacaagcauggcuuacuuuaccugucuguugugccugaguuuuguggaagauugcucacacucucucucccucuucuuuccccuccccuccccuccccuccccuccccuccccuccccuccccuccccuccccuccccuccccuccccucccucucuccugagacaguuucucuguauagcccuggcuguccuggaaguaacucugcuccuuuuucuccuccuccucuucuuccuccucuuccuccuccuccuccucuuccgauuuauuuauuuauuuuauguuuauaaguacacuguagcugucuucagacacaaccaggagagagcauuggaucccaucauagaucauuguaagccgccaugugguugcugggaauugaacucaggaucucuggaagaucaguugcugcucuuaacuccugagccaucucuccaguccugcgcuuccccuuuuaaaguuauuuuuuuuuucuuuagcuaaccauggugauacucacauguaacaaaauuccagccuuaaagagauagaggcggugaggauagugacuugugugugugguggcuuguugccgcacauguggaagucagaggacagcguggggagucaguuccccccagccguguggaccuccuggggauugaacucaguugucaagcucgguggcaagugcccuccuguugagccaucuuaucacuuacucguguauuuuacguuacuuauuuauuuuuuuuccagguuaaauuuaguggaagcuuuugucgaggauucagaacugaggcagaguuuacaggaggauuugcuucgccgguuuccagaccuuaaccggcuugccaagaaauuccagagacaagcagcgaauuuacaagacuguuaccgacuguaucaggguauuaaccagcuccccagcgucauccaggcucuggagaaauacgaagguaucgugcggucagccagccagcagcuuuguuuuacguuagcuuuuccauuuuucccucaccccguuuuacuucccuguguucuaacaaaugugcuguuaggucuguggggauguuacacuuuccaauagguuuguuuugagucaggcccagacaggggucuaguaaggaaagggaccuugguggcuagcuguaggaguguaauguaaugauuuagcaagggggagggcaaggccucccagcaccacguuugccguguuucccguguuugggccuacuaggucaaggucagcccagacugcacaacaucaugucgcaauaaaaaggaaguccauauaguuaucuaauagaauauaugugagugagaucauguccuugacaaaggugugugugugggcacuguggagaugagcgugcuuugcauauauagaugggucguguguacccauguguacgcgugcccagagcuacacuugagaguuucucucccguucagaugcuugcuuuccuaguugggcgauggccaguugaugugugcucuuggacucugccacucccccccccucagugugagguuaucgggaggggcagccaugucuuacuccaucugggugcugcagaucuggaugucauucccauuuguccugaacuagugcuuuuggccauugagucguccaucuucccagucucccccuuagcuuccuuggauugaaugcaaguuucuacaacacuaauuuuaguuuguauaguuauuaaauaucuaacauguaaagcauuuugaguuggaauuagacaucaacaacucuuagagcuauuaaaacauaccccguaggggcuuggcaguagauugcuuauauggcugauaagcgaugagacccaguaucucaaaauagcucugucaguguuacgggaaaauuugcuuucuuuuccagacaaauuuaaauucagcuucaugaugacagaacacaaauugaguuuuguugugacaauaauuuauuuuguguaaugugcggaagcaggagggcagcuuuggggaguugguucucuccuucuauccugugggucacagaacuccgaaaucagguagccaugcuugacagcaagccccuuacccacugagccauguugugggcccgaggcaccaagguaacugagggcuaaggaguuuaagcacuugguacacaggccuggacugaaguuggggugcucauaguuccagguggagacgggaucuuugaagcuccaaccuggcuagcaagacucaucacaucagugagcucuaguuucaacuaggagaccuuguggguucgggauccagagaaaagcuccgcaguuuuuagagcacuuccagagguccugaguucaacucccucugguggaucugaagacagcagcaguagacugacauacauaaaauaaauacaucuuuaaaacagagagggagagagaccuucccucgagacugccguggggaagagcagucuggaagcuuccugacagcagccuucacuuggaugugcauccgcucgcaucugagcguguggacacacgcucauacaaacacgugggaaagaugauacuuuacaaaggguucuuauuuucucaaaggaccuuuguagaaacacuccuccucucgguugguuagaugugccaaccggugguacaagcucaucacugagccugggaccccagugaucuuagaacccaugcaguggaagggcugacuccugcagggcuccuggucugcacacacagcauggcucauauacaaaagagacagaaugaaaaccugauuccuccacucugugacuacgaauuucugcuccucgugccucaguuuccccaucacauaaauguguagcaucugcuuguuuccuuuuuauaucauuuugucugguuucagcaggaauuagggaugugcucugacugggccgcucuaagcaguaaggccucagcacacagcagcuguuuggggcuuucugcuuucauguaucucccacuguacaguagcagauagauagccuuuuguuuccuaguaagucaccuaguacacgauuaauuacucauuauuuacucaucuacucacugauugaucgauugacacaguguccuaugaagcccucccuggguggccuggaauucuguauaagcaaggcuggucucaagcucacgaagaccugcccugcugagguaaaagcacugcacaacugugcccagcuugugugauuuauuuauuuauuuauuuauuuauuuauuuauuuuuaauucucccuuucugugauuuagcacauuuaaguguucauguuugcccuauucccucagcacagaucuggucaugagaggcggcagaguuugaggccggccugguuuacauaggaaguucuaagauagcaaguacuguguagagagacucuuucucaaaaaguaagacugacugacugacgacugacugacugacugacugacugacugacuagaaaaaacaaguccuagucugaaucgcuuuugguaugagugcaucuuccucucucggcucccgguucuaaaagccugcacuucuucauccucugcuuacacaucugcuucugacccugaccgcagggcugggcugacaggugcuaaggugccuguuuguugauagauguagccagcgagcgcgcacaccacacacacacacacacacacacacacacacacacacacacgcagccugagcuuauaaacuuuaagaagacaucuuguuuuauguuccguguucccgguuuccuucuguggguccucccauccccauuauuuuuaaagagcucagcacaguucuuuagugugcggaauuuaccgugcuuuaaaaaguauauuagcauccauuauuuugagauguuacagauaauuuguccuccugugauguuuucgguuuugacucauucuaagcuugcuuuuuaguccagagaacagcaagagucagguguguucacagacagcagggggcagcagcagcuuggaaagggagggcauuugcauugguuacaguuuuucucuguaagauacuugccagcuuauugggagguucuagcuggguaauggaguuagcugcacagagguccucaacaaaagcaguuuuccuaucuuugggaaggugacugcguggcuuuaguugaccccauggagcggggugaugccuguccagccagaucacccucacaucuagaaacagggauuuucaugucuaucucaaauguuccaggguaaaauauaaaauaacgauguucuacauuggacacguuuccagcagauuaagauaacucacgcagacauacagauuauuuuaugucuaacuuaucuguucggacuuuguaaacuacuuugaaaaguuauuauuuuauguguauuuucaugucuaucugugccugaaacugguguuacagaccccuaacccuaacccugacccugacccugacccuaaaccaaacccuaacccugcuugucagccccugugaggguacugggaauuggacccuuacccucuggaagagcagccagugcucuuaacuacugagcaucucaccagccacaugcaaauggaauuuugauagagagugcauugagucuuuuugguugcuuaauguagccauuuucacaguauucugccaaucuaugggcguggggugucuucaguuuguuuaucucuccaggccugacacuucaugcuucaguuaauuuaagaaguucacaauuccuugggugaucuuugacauccaagacccuuacugagcaagcaugagagaugcugagaaggcucagagauggcucaacacuuaaaagagcacugggugcucuuccacaggaccuggguuugauucccagcaccagcaugguucauagccaucuguaaaucaggcccaggggaucugacacugucuucuggccuccuuggguaccaaacaugucagugaugccagacagacagacaggcaaagcaccugugcacuuaaggcuuuaaaaugugaagaaagagaaauuacugaugcuguauauaguggcugauacccauaauucccaaacuuaguaugcugaggcaggaggauugccauaaauucugagcuacauaaauuuugggcuacagaaugagaccuuguuucaaaagccagaacaaacaagaagaaaagaaaacaaaagaaagucagagaaacagccagcuucuaggauuugagaggcuggggagccucacuguaucagccagugaugcguuuaaggcuagcagggguuagacauguugaagucaugaagugaggugaagugauuagucacagugcuagaaaauaaggggagagugguagagcugaggccugcuaguguguguucucucuccuuaaaauuaaaagacaaaaccaaguugccuuagccugcagaguuccagacagggcauccaguacucuguaauuggaguuauagauaguugugagcuggcauguggugcugauauggaacccaggcccucuggaagagcagucagcccucuuaaccucugucugaagcccuuuccgcagcuguguaucuaguguuuguaacuuuguuucauuuugugcuacacaggcuguuuuggcuucuaauaaaacuuauuuucagaauaaugguuuuaaacauaugaaauaaaacaaggagaaaagaaacuaauuguauugaaguguaguuaucaagauacaaaaccuugauacagagccauacacuugaguuuuuguuuuuguuuuugguuuugguuuuuuuuuuuuuuugguuuuucgagacaagguuucucuguauagcccuggcuguccuggaacucacuuuguagacaaggcuggccucgaacucagaaauccaccugccucacacuuguaauuaaugcauuuaaauuguguaugcgugcguccaucugucugucccucugucccuccuucccuucggaagagacaguaagauaucaggucuccuggagcuagaguaaauguaguuguuugcugccuaguguggguucuuggaacuaaacuuggguccucugcgggagcagcguacaguguuaacucuccagcuccuuaguuaaugcauuuagaaagauuguaaggacuggagagagagccggcuaaguguguaagauggagagagagccggcuaagcguguaagauggagagaaagccggcuaagcguguaagauggagagagagccggcuaaguguguaagguggagagagagccggcuaaguguguaagauggagagagagccggcuaagcguguaaggacuggagagagagccggcuaagcguguaagguggagagagagccggcuaaguguguaagauggagagagagcuggcuaagcguguaagauggagagaaagccggcuaagcguguaagguggagagagagccggcuaagcguguaagguggagagcgagccggccaagcguguaagguggagagcgagccggcuaagcguguaagguggagagcgagccggcuaagcguguaagguggagagcgagccggcuaagcguguaagauggagagagagccggcuaagcguguaagauggagagagagccggcuaagcguguaagauggagagagagccggcuaagcguguaagguggagagagagccggcuaagcguguaagguggagagagagccggcuaagcguguaagauggagagagagccggcuaagcguguaagauggagagagagccggcuaagcguguaagguggagagagagcuggcuaagcguguaagauggagagagagccggcuaagcguguaagagcauuuguugcuuuugcagaggacagguuugauuuccagcuucuguggccaucacaaccauuccaaacuccaguucuaggguaucugauaaccucuucugacuucugugggcaccaaggaugcauuuuauauaaaauuaaagauaacuaaaucuaaaggggagggggggaugcugacaaguuggcugugguaguuuaauucuguaucccagcugcucaggaggccgaggcaggaacaucgauuuuuauacaacauaguuacagccuuguuucuaagagaggaaugaaaggccuacucuugcuucaauuucagaauaaugaaucuguauuuuaaauuuguaauuauggauaugugggucuguugacaugcgacuauaggugcccauggaggccagagucugaaacccuuggagcugggguuacagcuaaacugugagcugcccagugugggucucaacguugaaccuggguccucugcaagaacaauuuaugcuuguauccacugagccaucucgccaaccuggaaugcugaguuuaaaugaaacuuuaggauaacuccaaaagcuguuaaaugauuucagagugugguggaucuuuugacugguaacagacacgguugucuaauacugugcaccuucauuaccuguuuugggaaugcgaaaaaggugaaacgaugaccuguguccaugcucugccuugaugucaaggggucugugggccuugccuuagcuuuugcagggcuuuccaggcugugguaguuaauggagaaugcagucuuuaaaaauccaguuggaaauuggcaacuaagguucaguggagguuaaaacucagggaaggaggcugaggguggucaugaagauuccaggaggucugcauuagagaggguaggggacaccgaggaugacaggagccucacaucugcaacagcuguuuuuugugguguaguguauagugacuguucggcguggggcacugccuguugcugugucgucucaggcacgcaccuauccucuggguaguugucaucgucacuaccuugugcagacaaggacagggcucaggacagggcugugcugaggaugagaaagccacagagcagcaugcccgggcuagcgccagcccugacucugccuucuugcacauuguugguuccuguuccccuccucccacgauuccucgggauggcucucaaccgccaaguuccaauuuaagcacuggauucagccucugcugauuggagcgcuggguuguuaauggaaauuaggaugcaaauuaggucuuauucuaguggcuuugucuuuggcucacuuagucauaauuaauguuuccacacccucugaaggagacccagaccugcagggagggcagugcucuaguaguugggccuugggcacuaccacagugguccccugucuauagaugauacccuuugaguuaaagcauaaaagagaauugaguuuagagaccuggacaauuugugcuuucugguucaaaggauuucauuauuuuaauauuaugaucuguuguuuuuacuucugucucugcuuuguuuuaggaagacaccaggcacuguuguuggcaguuuuugugacuccucuuauugaucuucguucugauuuuucaaaauuucaagaaaugauagaaacaacuuuagauauggaucagguaugcaauucacauuuaauucccacagcaaaguauuuuuggaagggaaaaaguaaccagaaacaacagaaaaaucauauuaaaaaaugucuaauuugucuugaguuuguauuuuuuuggcacuuuguguggcaccucuguggccacuugauguaaacugaagugacagacaaggaagaguggacuugccaggcggugcuggggaaucaaacccagggccuugaauguggugcccuuggggucgagaauaagguggagugggugggcuuuuacuaaggcauacuuagaauugguggagauguuggcccuuggcucuguggaaugccuggcuaaggcagcucagccuacugugaagagguccccgcugggaggcaguuugcuucaccgguuucaguggaguugaccacagccuaagcugcuuggagguuugcuaaucuaugcaagcauccauccacagagaggaugggagcagcccaggcaaccaagagagcugaggagcgaaacacugccuuguugggacagagacuaggaagggcugcagaguaaacgucaucuacaugauagagaagugugcuaggaaugaagcuuggccagaaaaaugaggacggcccuggaagccuugagagagaacuguccgugugagcugccccgaagcccugugucaggguccacccaggugaaggcaaagagaaagucaauaugcagggggacaguaaagaagggagggguccuuuagguccacaaugguaaaguagaaggcagaggaggaguauuagggaggaggguagaaguguugguaaccacaggguggguuggaaccacugccauauuuaauguacugugugguaggcagcggaagcucauguacugcgcgcgcugggagagcaggagcccugugaggccgucagugggaguguccgagauaguggguggguaauggcuugagacugcagcggugguuuucagagacgggaaacuggggucuggagggaaaggaauaggaggauaaagaccagcugcgguggguagcagucacgguguggagauauuccacccuugagaguuaacuggaucuguaggauagggacaggggagucugagguagagaucugugaggcaacuagggaaagaagaugggaaucaggaaagguuaugggggccaggguggcuucaaaguagcuacggauuucauggcggaguaaaggaaccaggcagacaggcaugaccagaaacacuugagaagaaucacccuacaagaaggcagggaagaagagguguacaggaggggguuccaucuauguggggaagaacagggucuuagguguacaggagggggguuuccauuugcccccccccccgaaguuggugauaauacuguagcauuguccuuggcuuggcagggucaccgagucugggagccuaugcuaguggggcugggccucucugugacugggcacagaagaugagcccacaugggggcauacagacuucugauggccaggcugccaggggguugggcgugacuuccugggcuacugaggguugccgcaggugggguagccuucugcuguagccaagccugucaggaaacugccaccuccucucuugcuuuuauagacuuuuuuuguuuuuuguuuugugguuuuucgagacaggguuucucuauauagcucuggcuguccuggagcucacucuguagaccaggcuguccucgaacucagaaauccaccugccucugccucccgagugcugggauuaaaggcguacgugcgccaccacgcccggcuuuuuuuuuuuuccuuugcuuugcuuuuaaaggcuuuagaagccauuuucaucagcgucuguacugggguuugagaaccauccucuuccuucuuuaguuucuuuccaacucugugguuaggacuuguagaaguuagguuugguucgacugcuuccucccaugcucccagaaauaagacucagacucaaaauauauuuacaaauaccuuggcucuucucugacuagaucauaacguagauaacccaguuauuuuaaccuacauucugccacauggcugguuaccugugcucagguacuaugcauaugucuuguuccaucuuccccgcgggaaucuucccgugccuggcucuguaccagaauucucugugccucccagauagcccgcuucccauuuccugccuaagccauaggcuuuuuaaauugacaggugaugugucuauacaguaccgaaaauauucucucugcaaugacagaaauaaaauggguagcgaggaccguggccucugcuguggaggcugaguccaggcagguacugcaucguggcggaauuuucgucagcuugcugcguaauuucauggaacuuaccaaagucaacuuuaguugacucuugucuaacuccauucccugaaggaggcaauaggucauaagcucccuccucugguggccaccuuaacccggcugguaaucccaguuggguucuuuagcugaccuuggcuugucacccacuagggacuguuuuguccacugggucuacucugcauacuuccugccagacgcccgaaccuacccgggaaugagaguggaaccccguguaauguacaggucagaggucagaggccuggcaaagguaguggaacucuuuacucuagauggauagguuggcagggaaggagccucaccaccuuucagucugggugaggugguguagggagaaaggaacgggaauuggagcaagucccucagcccuugccaccucuuggagugggcagaggagggcggagucugccagagugcuguaagcagccacaggggaggagaauucaggcggggcagacuaggguguggguuucggggucauagaaggggagggggcagagucggcacggaggagggaagaggauggggagaagguugagaaaggggagguggcaaguuagaaggggagcagugggaggggaggagagggcggggaagccagugacucaggcagcucaguccugguggaugacucaggguccagguccccggguaaaaggccagcgagacgggaugucaagcacuggacacagaagugcaacuccccaaaaacuugaacagucgggagcucacacccuaugcagacauuuucaaggucauggagaguauuaaaguuuacagagugccuucugguggccauuuagauugguuaucuagagcauacugagaucaggccacagagcaaagagccagauguguuagccagguucugagguggacccaauuuagcuaaauuucucagcagacaguuuggggauugauuuuagaucuggcagugcccauuguccagucuuugcugguuggcuuauuucuugaguggagaaaaccgcuugauggcaaauggcagggcucaggauguuggcucaacugcuaccgguagccauucuagagccagaaagguuaaggggauuagcucuuggccggucauacuaacuugaguggcaagggauagccaguaaguccaucccuagagaccuucacggccaggcuucuagacgacucugggagcugaccccgugaggccaggccaugccccccucccucugcuggggcuuugcccucuugggugggguuuuuccucccauugcauucuuuaugugagguguguugugcagugugacuuggugguguucuguggcucccuauugccggaaccuuugcauccaauccguaacacgcacgucagcacccuccagaaggaggaggggccuucagggugagcacugcaggcuggggagggcugcuguggccaguagcaguuacuccucaguuacugcaacuggggacacucacaguuuauaguguagaacggucuuaaauagucacaguccuaauuaaaggcugcacuccugggggcagaccuaggcaggccucuagccguaucucagguuauaaggcaaguucaaaucaccgucaucgucgcagagauuuguaguggauuuagacauccagauuacauuuuuagaacuacuuucagaaauucuccagggacucucaguuguugaugucuaaucuuugaaagccugguugugcuccagcugugcuuaggaguucacgugauggagggucucauuuacacaguggcaugcuuccugugcccuucccucacaccaccccccaaguaaguguuucuguggcugcuuuccauaaguccucucuuuuuuucuuuuuccuauuuuagaaauguagaucaaaacuauccuaagccaaaauuccaaaaaggcauugauuuaaaaaaaaaaaaaaaaacuaaacaguuuccuuuguguuucagugaauuauauuaauuuuuaaagauuuuuggacaguuucauauguuuauaccauuauuuugaacauauccaaugcauuucuuuccacuucuccuccgugaugguuugaauaugcuuggcccaugggaaguggcacuauuaggagguauggcuguguuggaggaagugugucacuguguaggugagcuuugagggcuccugguacucacacucugcccaguguggaagaagucaguccuggucaucuccuggcugccuucagaucaagauguagaacucucagcuccuucuccagcaccauguuugccuggacacugccgugcuuccugccaugauauuaguggacugaagcucugaagcuguaagccagccccgguuaaauguuguccuuaugaguugccuuggacauggcgucuauucgucgcaauggaaauguaacuaagacacccuuggucuucauugucauguuuuccuuuuuuccuuuccauccuuuuuuaauucacuucuauuucaugugcauugguguuuugccugcaugugugucugugugaaggugucagauccucuagaacuggaauuucagacaguugugagcugucaugugggggccggaugccugcaugcucagggaugccuuccccuucccugggagcuguaacugucaguggugccgcauguagccaggauccccgugagccccugcauccgugcagggauguguacuggcucggcauuaugguuuagcuaacuguaccugcuaugaggagagcacuggcuaugucauguccauacagcauuuccugcacuccuucccauccucugccgcuuaacacacuuaacacccauucucccacgaugucacccggguuaccuacccuccaccgugugugugcgugcaugggaaagagagacagacacagacacacacacacgcucaguaaacacuucucgucauuuagaugacauguguaugcguuaccuacugaccacuacagagagaagcuucucugaccaucgcugaggacagcacugaucuggguguaagcauaaauugggaauaggcaguuugauguguccguuuaggaaaacagcaguaauaguuguccccgccuggggcuggugaucucccuagcugaggucuucugaccagguuuacaguaccugguaggaauucccuccuguggauuaggccucaaauccaauccuaaagccguugguuauucccauaaaacuucaugcugaucuuaguggucauuuuuaugauagcgugacacaagcaugugagaugagggaaccuugauugagaaaaugccuccauaagcucagccuuguagaacauuuucuuaacuagugauugaugggaaggggcccaucccacuauggguagggccaccccugagauggggucccaggcucugugagaaagcaggcugagcaagccaugcaaggcagcaagcagcaccccuccacggcguccgcaucagcuccugccuccagguuccugccguuuuaguucuuguccugauuucugucaguggugggccacaguguggaagugugauucacauaagcccuugcuuccccuggugccccaucucagcaaucguaacccuaacuaggacacugcuguugcuccagugggcaaaucuuguuuguugaugaggauugcgguaugcaguguccacuuuuaugcuuggaagcacuuuuaccaacugagcuagcuggccagcuccaguguuucuuuuuuuuuucagccaguuccuauuucugcuccauucuggaggacuaacaguccucuuagcuugcccccucugccgugagaaagaccaugcuucaccucacagauuacaguagguguggaggaugcugccuccugacuugcuccuucaccggcucagcuucucaccggcucagcuucucucuagcucagcuuacucucuuaugugccucagggcuacuguccagggauggcaacacccacagugagcggggcccuuacacaucaagucauccucccaugccuugccuaccugcucgacuucauugaggggcuuccuucuucucaggugacaaacuaagugacacagccaccacuauguauugaacccugcccggguuccuccuuucuuuccugacuaauccuagcuccuaaccccugaccccuaaccccuaaaccuaacuuggaacuggcuguguauagauaggcaaguuuggccucauguacaguugccugucuuugccuccagagugcugggauuaaaagcuuguggagccauguucuggcaugaaguagacuuugaaaugaucucccugguuuuauguuggagaaucuuuacuuggcaucagcuagaugggauuuuucuccagcugaucauuuguuuagaaaaacaugcuuauaauauuuuaucuaauacuucugggguaguggagcuuuuauaacaugauugucuaagacauauccugggcuagagaguugacucagcaguucauguacguguucuuguaaaggaccaagcuuugguuuccggcacccacaaggcauggcagcucauaucuauuuguaccuccagacccaggggauuccauggacucucuggccccaaggucaccaaagcacacacaguacacagauacuaccagggaaaucacucacauccaaaaaguaugaaaauauauaaaaccuaaaaaucuuaguaucuuuuauguuugcuuuguaauuccuucaucuuuugauguacguccucuauaaagguuucuacucuuucagaauugguaauuugauuucagaccaucucugguguauuaaugaguccucuagugacuuggcuaaggcccaacccuaccuuucucagucuuuucaucucacuguuagcuccuugcuccucugucugucugucugucugucugucugucaccuuuacugauccaguggcuuguucuagugccaaggucggugguacuguuugaaaaacaauugacuaacauugagauguccuauguggguggggcgaguggcagccuccugagcgaugcccaugggauguguguccuguaucagcguuuauuucagucacauuaaaggccuggucauuccccacauuaaaggccaggucauuuccccuguuguguuuagccccccugcagcucuuuuccuauuuuuguuuuaaacauuuauuugcuauauauguacuuuauuuauguaugugugcaugccuccguguauaugugcagcauccgggugcagggccagagaaggucagaagagacauuguguccucuugaacuauaaugauaggugguucugagccccaugugaugccuccauguggguggcgugagcguaggaacugaacuuggguccucugcaagagcaauuagcugccaguuccaucuccagucucgucacagcuuucagaggugcauucucugaucugaggaaggagagaaggauaccccuccagauuugagguuucgccucaccauuucuuuccuauauggugggguugaggguaggaacguggccuggucccuacuuugccuuuucacuggaagaagcaagugguguaguaagcacacuuccaaucuuccgugacagcauugggucccccaccccgccccgcccccgccugccuccuguaacuguuauaagucuugauccuuauuacuggauaaucuucauuauauguuuaaaugacuauuaguauucuguucuguugauggguuaugcaaauuaugugucuucaaguugugcuguaaacuuaacuguauugaggcuuugucagaaaacuguggagguuuucuccagccugugugcuuauuuugccucuauuuuaucauuuccauaaauuuucagccgaacagcugugucagaguaaacguacccaagucucauugugcuuugcccugcccuccaccuuuuugucuguuuuguguuucaagacaggguuugucuguguagcccuggcuguucuggaacucucucucuagaacaggcuggccuugagcugagagauccgccugcgucugucuucgaacaccaggauuaaagaugugugucagugcgccuggccacugcucuuuuuaaacauauaccaacuucacccucagcaggcauggcugagugagugcgugguuucaggaagccucccuagagugugccgcuccuuuuucuuagguggggacaggaaacugggaaggagcugguggaauagcugccugcacggggaaagcuacuguacaacagcucacggcuguuuaaauauucauaucuuuuauuacugcgcucuccucuccauuacucuguugcucauuuuaggugcuuaugccugcucauuugaugaccuuaauacuuuccuuauaugcaaagaagugcccugacaaaacagcuuuuguguucuuauuguuuugguaaagcugugguauaccuuuuaucuuuaaaaagaucuauucagaauuuuagcuuuuaauauuuuauauaguugguacauguuuuauuuuaaauauuuuauugauuuuccucuagcuuucuguaauuugauuuuuuuuuucuccuugugaauucacuuuaggaauaugaaaaugugcucugauuaaguggauaauaauuaggagcaauuugucucagccuuauuuagugaauauguuuuugucaucuuguuuuagaaaauugacucacucucauauuaagcuuuuauguguauugucuauuuaauaacguucaaugccugguacagauagacuucuuuuuaaaauauuccuuuguaauuuuauuuguuuaaauuuuagucauuugcuuuaaaaaaaaaaaaaaaaagaacaaucacuaggcuugaagagcuauuaacauuuaauuuucuguuuccaugguuugcuccuuaauuugaaaccaguucuauuuaguguucagguaaauugcauuuuaaaggucucuacauaauaaagacuugaaaaucccauguaugucuuugcuuuuaaaacugagauucauuuuucauuacacuuucuggcugguuaauaauauagcugguaaauaauaaaaagucagguguggugccacacaccguuacuccaaguacuccgggggcagaggcaaggagaucuccaaguucagugccagucugcagcuagaccugucuccaaagcaauagccuaggagcaguuuacaaagacaguguuuaagagugccauggcaagccgggugugguggcgcaugccuuuaaucccagcacuugggaggcagaggcagguggauuucugaguucgaggccagccuggucuacaaagugaguuccaggacagccagggcuauacagagaaacccugucucaaaaaaccaaaaaaaaaaaaaaaagagugccauggcuggauuugaucccagcauucacugcccucuaaaaugcguccaucaaauccugacauuuugagguggguguaagugugcacaccuuuaauuccagcccucgagaggcagaggcaggcagcucucuuugagucaaaaccaacauggcagagcucacucuguagacuaggcuggcuuugaauucacagagagguucucacgccucugccuucuaaguguuuaaguguuaggauuaaggacaaaugccaccacaccuggcagucacacggguuuagaaugugugugugugugccugugcacgagcgugugagugcguggcuggacaucccacccucccuuaucuguggagacagaggacaacaccagcaagucauuuuucacccuguaccacaugggcuccagggauggagcucaggucgccaggcguggcaguuuuaaguucuuuuacccaugagccaccuugccugcacuagcuagauagagauuuuuaagaaugguuuuuuggaggaggcauuggaaguggagugcugugcugaauuggagcuauugagguucuuaagguagaucuuugguuugggaaaagcauaguguagugaugauuuugaauauugaacauucuuuaguaauacuuaaggaaaaugcaaauaggguaguguuggagacagcugcaucauggacuuugggucugcuuccuguggguaauuccuguguaucuagaacucuuaagcgccuauuaaaauuuguuaauaaguagaaaguucuugguaguguuggcuggacauguugggggggucacuccugccgcgcgcaccagauaugcacaggcagaagaaacaucacguuucguaagucugucuccacacaucuguuuguaugacuuaccuaguccuugcuccugcgauagguggaaaaccacgaguuccuuguaaaaccuucauuugauccuaaccugagugaacuaagagaagucauggauggccuggagaagaagaugcaguccaccuuaauaaaugcagcccgggggcucgguaagauggguuuggaggggcagggucauucuggccagguguccccgaauccuuucucuuuucacccugagagggcacgugcuucacucagagacuagucauugcggauggcagaugucauugcgugauucccugugaacaguuugugauuuuguuauuaaacuauaauuuuuauuuaugcguggcucuuugcuguucucuuuacaaauguggacugucuauaguuuuuauugauaaauuugguugcuguuuuucagccaacaaauuuguaucuagauuuuuaaguguggccuaauaauuacuuugaguaaaauuguaagucgaggccaugauagaaaauuuuacagaucuuagguauauaaauuuuagcuagccagucauuauuuguucugugaaaucuucugugcuuaagaagaauauauccuaguuuuucuagugucuccuugucagagucagauuuuuguuuggaaauugcauuugcccacuuuucauuauacccuaguuuucagcuauucuuugguuaaaaagagaagccuggccuggggugauggcuuaguagauaaaaacaucaccaaacagccuaacuaccuaacaugaaccugcuugguggaaagagaccugacucccauaauuugucuucugagcucuacauugagccauggcacacauuuccacacacuccacauacaaauagauaaagugagaacaaauaaaucaagaaaauuuaugcagaacuacuuaagcauggguuuuuccauacccauuuucauagaccuccaacaucugaaacagcaugugcuccccaccaacagugcuccccaccaguggugcugcccaccaauagugcucugccaucuuggguagguuuacacauaugaaaagcagcuucucccaugucagaagccagcuuuuauaagagaacuuaaggauuccauagauauauuacacauaguuucccaaugaaaugggauuugaaccuuuuccaaugagccaaucauaauuucuaguaauuaugauaaaugacaauaauuucuagucuuaugauauaauaaguauguugcacuaaucagaugugguuuugaccauuuagaccaaaaaguggcuguauaauuuaugacuuuaaguuuuuucuuucuaaucguaaaggauuggauccuggcaaacagauuaaauuggacuccagugcacaguuuggauauuauuuccguguaaccugcaaggaagagaaagugcuucgcaacaacaagaacuucagcacaguggacauccagaagaauggcgugaaguuuaccaacaggucagagagccugcuugucacacucguaagcuugugguucuucauggcuucuccgguaaaagcaaagucuuuaacaaggaaucacugacuuaaaaauauuaacuaagagucagguuuuacucucuuccaagaagcuaguagauacuuuagcacuguuagcccaggaggggucguccuaaaagucccuugggaggggcaguaccccccuccuguacuguucuagaaccuguggccugccuugcuauuacuacuccuuaguauucccaguacagaaaacauauagaugggauccacucuuguaugcuuacguuauuugaguguaccgguguuuugucuuuguguauguaugugugcucugagcauaccuguuaaaagccagaagagcaugucagaccugcuggggcuggaguuaauggacaauugugggacaccauaugggugacccugggucuucuucuagagcagcucuuagccacugagccgucucucuagcccuguauuaacuuauuaaguacaguguguugcaugcugacauuauucuagguguguuagacaccccaguuaugaaaaugguguaaugguuccuuauaauaauuuuuugaaagaaguacgacaggugcauuuauuucucccuucacagaucugauaaaucucaguuccugcuuacaugcuaguuaguaauacugcuauauacugaaaccuagcucuuuuuuccccucuuuuaaacaguuuaauuuuuuuucuuuuuuuauuggauauuuucucuauuuauauuucaaauguuaucccuuccuggucccccccucaaaaaaauaaaccuaucccauccucucuucccccugcuucuaugaggguguuccucuacccauccacccacucccaccucccugcccuugauuccccuacacuggggcaucuauugagccuucaugggaccaagaaaguucuagcuagagcaguuaggcaacaaaagaaagucaaaggaauggauacaaauuggaaaggaagaagucaaaauaucacuuuuugcagaugacaugaucguauacuuaagugacccccccaaaauuccaccagagaacuccuacagcuaauaaacaacuucagcaaaguggcuagauguaaaauuaacucaaacaaaucaguggccuuucuguacucaaaggauaaacaggcugagaaagaaaguaggggaaugacacccuucauaauagucacaaauaauauuacauaccuuggugugacucagccaagcaagugaaagauuuguaugacaagaacuucaagucucugaagaaagaaaucaaagaaggucucagaagauggaaagaucucccaugcucauggauuggcaggauuaauauaguaaaaauaaaaauggccaucuugcuggaagcaaucuacagauucacugcaauccccaucaaaauuccaacucaauucuucauagaguuagaaagagcaauuugcaaauucauuuggaauaauaaaaaucccaggauagcgaaaacuauucucaacaauaaaauaaccucuggcagaaucacuaucccugaccucaagcuguauuacagagcaauugagaacaaaacugcauggugcugguacagagacaggaagaucaauggaauagaauugaaaacccagaaaugaacccacacaccuauggucauuugaucuuuggcaaaggaacuaaaaccauccagugggaaaaaagcauuuuuaacaaaugcugcuggcucaacuggcagucagcauguagaaaaaugcaaauccacccauucuuaucuccuuguacaaaguucaaguccaaguggaucaaggaccuccacauaaaaccagauacacugaaacuuagagaggagaaaguggggaagaaccucgaacacaugaauuccugaacagaacaccaauagcuuaugcucuaagaucaagaauggacaaaucggaccucauaaaauugcaaagcaucuguaaggcagaacugucaauacuguaaggacacugucaauaggacaaaaagacaaccaacagauugggaaaagaucuuuaccaauccuauauccgauauacaaagaacucaagaaguuagacuccagagaaccaaauaacucuauuaaaaaaugaggauacagagcuaaacaguuuucaacugaggaauaccuaauggccgagaagcaccuaaagaaauguucaacauccuuagucaucagggaaaugcaaaucaacacaagccugagauuccaucucacaccagucagaauggcuaagaucaaaaacucaggugacagcagaugcuggagaggauguggagaaagaggaacacuccuccauugcuggugggauugcaagcugguacaaccacucuggauaucugucuggcuauuccucagaaaauuggacauaguacuaccugaggacccagcuauaccacuccugggcauauacccagaagaugcuccaacauguaauaaggacacauacuccucuauguucauagcagccuuauucauaauaguuaggagcuggaaacaacccagaugucccucaacagaggaauggauacagaaaaugugguacauuuacacaauggaguacuaugcagcuauuaaaaaugaugaauccaugaaauucuuaggcaaaagaauagaacuagaagguaucauccugagugagguaaccuaaucgcaaaagaacacacaugguaugcacucacuguuaaguggauauuaguguaaaagcuccaaauaaccaagauauaauucauagaccacaugaagcucaagaagacggaagaccaaagugugggugcuuuuccccuuagaaggagaacaaaauccucacaggagcaaauaugagauaauguagagcagagacugaaggaaaguccauucagagauugucccaccuggggauccaucccauauauaguuaccaacccagacacuauuguggaugucaagaaguacaugcugaaaggagcuugauaauggcugucuccugagaggcucugccagagucuuacaaauacagaggcagaugcucgcagccaaccauuggacugagcaugggguccccaauagaggaguuaagagaaaggacugaaggaguugaagggguuugcaacuccauaggaagaacaacaauaucaacuaacuagaccccccagagcucccagggacuaagccaaaggaguacacauggcuccagcugcauauguagcacaggaugggcuugucaggcaucaaugaaaccuagcucuuaauauaacucauauugauuuuuccaauuuauuauaucacucccauucaauaaaauaccucuuaggcuacauaaagacagaaccuaugggguauuuagguaaaagaaauuggaaugauuggccacauggugcuaaaagcgaagaauccauuaccuucaaguuguggagaagauggcaugcuugcuuauguaucugacuucgaucauaucauuuuuccucuuuuaaagauuuacuuauuuuauggaaaugaguguuguaucugcauguauaccuacaugccagaagagggcaucaggucacacuguagaugguuguuagcuaccaugugguugcuggggauugacuuggaagaacaggcagugcucugaacuucugagucguuucuucagacucauuuuucuucuuaaaaggcccaguguguauccauuauucagaauaaaaccuuagacuauggcccauaugaccaggcaccagcccaucucuucagcaggacucucaguuuaugacauguucacgucauuucuuuaaaucuuuucauuuguguauucccuaguaaucuuuuuguguugcuuuaggcccauggccaggagccagggccaucccuuuucuuugaugucagcacuuuuggcuaacucuccuuucaauccucuaaagcaccuuucauuuuaaccuguaauuuucauuguucagauacuucccucguaagacgaaucuggauauaaaugcaggcauuuugauacucuuaauaauguuuugauuugcagugaauuguccucuuuaaaugaagaauauacuaagaacaaaggcgaguaugaagaggcccaggaugccauuguuaaagaaauugucaauauuuccucagguaaacuuaauagagcauaaaaugguggacgauauccuagcuuuuucuaaugggaugugugaagauuguuuucuucuguuuuagcuuucuuacuacauuuauuuaucucucucuguguguguguguguguguguguguguguguguguguguguauuuguggaggccagagaacaacuugcaggaguugauucccuuuuucuacuucuguggauccugggauuuaacuaaaguacucaggcggcccgcauauuuaucugcccagccgucucacuggcucuuacggguuucuucuuaucuuuuuuucuuuuaagguagguaagguaggaucuuucuguuguguuguagccgauuccuguguuguugcugauuccuguguuguguuguagcugauuccuguguuguguuguagcugauuccuguguuguguuguugcugauuccuguguuguguuguugcugauuccuguguuguguuguugcugauuccuguguuguagcugauuccuguguuguguuguugcugauuccuguguuguugcugauuccuguguuguagcugauuccuguguuguagcugauuccuguguuguguuguagcugauuccuguguuguugcugauuccuguguuguugcugauuccuguguuguagcugauuccuguguuguguuguaguugauuccuguguuguugcugauuccuguguuguguuguugcugauuccuguguuguguuguugcugauuccuguguuguugcugauuccuguguuguguuguagcugauuccuguguuguugcugauuccuguguuguguuguagcugauuccuguguuguugcugauuucuguguuguagcugauuccuguguuguguuguagcugauuccuguguuguugcugauuccuguauuguugcugauuccuguguuguagcugauuccuguguuguugcugauuccuguguuguagcugauucuuguguuguguuguagcugauuccuguguuguagcugauuccuguguuguguuguagcugauuccuguguuguugcugauuccuguguuguugcugauuccuguguuguagcugauuccuguguuguguuguaguugauuccuguguuguugcugauuccuguguuguugcugauuccuguguuguguuguugcugauuccuguguuguguuguugcugauuccuguguuguugcugauuccuguguuguguuguagcugauuccuguguuguugcugauuccuguguuguguuguagcugauuccuguguuguugcugauuucuguguuguagcugauuccuguguuguguuguagcugauuccuguguuguugcugauuccuguauuguugcugauuccuguguuguagcugauuccuguguuguugcugauuccuguguuguagcugauucuuguguuguguuguagcugauuccuguguuguguuguaguugauuccuguguuguguuguuguugauuccuguguuguagcugauuccuguguuguugcugauuccuuagaugaaguguucucuugcuuuaucuucucacgugcugaguuugaaggugugauccacucuacaguguuuguuuuaaaucauuaucuggguucacacugaagaguauggaaauaaauaucacuguaaagcaagugcaaaucacacaagacaagcugcuguugguaauucugcaugcuauuuauaaauuuucagucuauucuuggcacagcacuggggguguuguguauuuuuuuuaaagauuuauuuauuuuauguauaugaguacacuguagcugucuucagacacaccagaagaggguguccauuauagauggcugugagccaccaugugguugcugggaauugaacucaggaccucuggaagagcagucagugcucuuaaccacugagccaucucuccagcccccaggagguguugugcuuuguauuuaaagggccgugugacuuggauguuacuugccuauagaaugggugaauauauguuuagugcaggguagguaaugguguguuaggcugaggguuuagauaugaacuuagaugggaccuacagugguaacuguaggacagauggcaugagcugaggugacucagaagagccaccaugccacuguggaguguucuugccccagaccuuaaccugcuuugaaacagaaacgcaucagauaaaauggaucgugggcauucuuuuucaugcuuggguucuuuacaaguauugcugaagaagcaugagaaggacaggcucugcucaggauuaagggagacucauagggcaaaacagccaagccaaaggcccagccacugacugacuccagggccagggguguggcucgggauggggugcugugacaccaccaucuugguguaggaagggcaggaagguggccuuccucuaagggcugugagccaaauuauuuaggcgugaugaaucuuugaaaaggcuguaugcauguuuacuucuguuaagucagaagaaacagaacguaaggugguguuagcaugugcuguccguacugaugcggguugaagggaugaugugugaagccugcaugguugcagguaacugaagcgcaguaauugaguugguuugucuucuugaaucuaauuugcauuuuaaagagcucuguuaauaaaauacuguuuauuucaaugaugacgacgaagcuuccucagaaaaacaaaacaaaaacuguuucucacugugcuaguugaggcucugguuuuuaaccuuugagucaagagcuuuauauuuggagucaacuugauuuuuaugcuaaguucuuuuaaaauuagauuuuccuucuuuucuccucugucccucuccaugggcucagauuuuggcccaggcuaaucucaaaguugaaaaaaauaugcuuuaaaaaaaugauagggcuuaugaaaugacuuaguggguaaaggugguugcuuuaggcugugugaccugggguuugaucuccaggcccgacaugguggaaggaaagacccggcuaccccuacaaguugagcucugauguccacauaugugcaucagaucaugugugugugugagaugcacgcacacacaauaaauaaacgccuacuuuuuuaauuauaaaaauuuuauuuuuucucauuucaguuuuguuugagacagucuuaaacauugcgagcuagcuuugaguuccuaacccuucugccuccauacacacgccggugucugcagaagccagaaaagggcacugguagcugugagcuacccacuguggccgcagguuacugaacucagggcuucugcagggacagccagcuuuuuuaaucacuaaaccaccccuccagccccggugugguugaaaucuuaacaagguuaaaaguuauaaggaguggggguauagcacagcuguaaagugugugucuaacgcacgcgucauggcggcaaauaccuuugaucucagcacuguggaggcagagacagguggauuucugauagguuagaaaacaacacaaaacauagggguuuuuuuuguuuguuuguuuuguuuuguuuuaaugguuuuucgagacaggguuucucuguauagcucuggcuguccuggaacucacuuuguagaccaggcuggccuugaacucagaaauccgccugccucugccucccgagugcugggauuaaaggcaugagccaccacgcccggcuacaaaacauaguuuuauaauaggaugagaugauuauuuuuauguggguauuuaaaaguuaauuauuaucagcaaaacauuacuuuuaugugaaacaagagaaugaacaauaaguagugugggcauggugcacacacccuuaaucucaucacucaggaggcagcagcagcagcaacccucagugaguucacagccagccaaccuggccugcauagugagacccuauguaaaaagacaaaaaauuguaaagucaaaauuccagccauugaaacacaaaguaauuguaaaguaauuguaaaguuuaacucuggggcaucuagaaauuagaaggcacucaggcaguacugcaccccauuagcauggagacucugcugagacucugacccuuguugcugucgcauguuauguuuuauccagccuuagaaucagggagguuugugugguagcuuuggcucuaaugcugugucacaguggagucuugaauguguguuaaaugggcaccagggaucaacucaauccugcaagcaagcgugcugauccaacaaaaugaaacugcaaauauucuuggaaucuguucuugcucauugcuuauggugauuuuuuuaaagugguuuuauaguuuucccagacacgguuucucuguauaccccugacuccuuuggcuguccuggaacucacucuguagagcaggcuggccuugaacucggagaucugccugccucugccuccugaaugcugagaugaaaugugugcgugcaccaccacagcucucuugugaucugaacaggguugucaugauuucucaaauuucccaacuuuuaggggaaaguacguugugcuaguuaauugggauuucauaaggaaagaccuugcucucuguuuuugaagcaugaaggauacagugaaacauuuaaccccauguugagguucaaggcuuuucagauuuuguuauagcaaacuugcuaacuuuuuaaacggccuugagcuaagucuauuauaagguguaucuuauguuuuuacaggcuacguagagccaaugcagacgcucaacgaugugcuggcucacuuagacgccauuguuagcuucgcucaugugucaaacgcagcacccguuccuuauguacgaccagucaucuuggagaaaggaaaagggagaauuauauugaaagccuccaggcaugcuuguguugaaguucaagaugaaguugcauuuauuccaaaugacgugcacuuugaaaaagauaaacagauguuccacaucauuacugguaaaaaacaauuuuuuuucucucuuccuaaugaugauagaauggaaauguguuuucaauuaaugaagaaagucucucuuucuggcauuaaagaauguauuacucugguuggucauacauucagauccugacuagaaggaagacuuuuugggguggcuaaaguuuaggagauaauauuguuucaguauauaacucacgcccuggcucaccagagccaggacuuggaaaauggguaggaauggucuucuggaaaagcugcagccuaggccagcacgccucguaagacacucauguguucauacucauuugaaaggaggcugagcuguccugagauaguaacuagaaccagagacuagaaaauaagagagaauuacauuguagaaauuaugguuccauccuguuaguucccuaaguggguauuuaaauuauuuaacccaacccagauaaguaaauuguacauuuuccaaaagaaaugucguguagcauggaguuuacgugauuugaggaguuugcccagacugguuacauauaacuagcccacuuauuaaugaauacuauuacugaguagucagucgggcguaaucgacaucauuaaaugagucugugagccaggaagugugugugcguaguggcccacagugaugcuccagcuuagcugugcgguuuaugauccuacucucugguuagagggaucuguguggguuugucugacugaaugguaagaaaguugcauuuggggcugcguggacagugacuguccaugcauguuuuuugauggcuuguggguggguuugcauaucauugugacuuaaauaauugucaauugcaguuuuggacuacuaguagcuuaauuguuaguagugaaagaaaucaguggccuggcauauaauucacuuauaggucccaauaugggagguaaaucaacauacauucgucagaccggggugauuguacucauggcccaaaucggguguuuugugcccugugagucggcagaaguguccauuguggauugcauccuugcucgagucggggcuggugacagucaacugaaaggcgucuccacauucauggcugaaaugcuggagacugcuuccauccucagguauguguccuagucccuugaaaguggagacguguggccccguuuuauuugaaaugcauuugcagauuugucuauaauaugccacagguauucuuaguuuagugaguguuugccugugaauuguauguacuuuauauuaucuuaaaaggcugauuggaagcugugugugauggcugcucgccuuaaucucagcacuugggaggcacaggcagguggauguuugugaguuugaggccagucaagucuguguaaugagcucaaggauagcuggaccgcaaagacagacccuaucucaaaaagccagagagagaaauaugaaagguuaccaaaaucacuaaugugaguuuuauguauucuguugccuuguguuuaacaaauacuguacuacagguauccacuaccucugccucuuucgucuuucuguccccucugccaugaugagcccuggacugcauuuuuuaucauguaauuaugcguuucaggucagcaaccaaagacuccuuaauaaucauugaugagcugggaagaggaaccucuaccuaugauggauuuggguuagcaugggcuauaucagauuacauugcaacgaagauuggugccuuuugcauguuugccacccauuuucaugaacuuacugcuuuggccaaccaaauaccaacuguuaauaaucuacaugucacagcgcucacuacugaggagacccuaacuaugcuuuaccaagugaaaaaaggugggcuucuccgcucagcguggcccucagggccugaagugccauuagugcauucuuuauucuccguugggauuaauugcuuuuaagaacauauuuaccucuggcuuucuagucuacagaugagcaauauacauuaucuguaucaaaaugauaacgugggagacagguugguuuauuauagcuaucugacuauagguugguuuuguuuuuaacguaaaggaggauugcaauuucuuaaaggaucuaucuuauuuuuaauuaguguauuaugccuugugugaagguuggugcacaugacacagagucuagaagacgguauuggcuuuucucaagcuggagcuagagaggguugugaccuccccgacccaagugcuaagaacugagccuguguccuggaagggcucuaugauuuuaaccugagccagccauguuucuggcuuuuuguggucuuuagaccuggugaguccagauucucuggcacuguuagcgguggcgcugguguuggcgaucccuggguguggcguccuuccagaaaggcuacugguuagcgcccacucaucacugagucagugaugcugaccuccaugaggagguucuauauuguaggugauuauuucagaauaagggguucacaugucugucuucauuucuuaggaaaaugugugugguuguuuuuuuguuuguuugcuuuauuuuuuguuuucuuuuuuuuuaauauaauuauuguccgcaucgucuugaugcuuuccucuuuguuauuuuugccucggugggaauuaguuugcguuccuauguuugcauuauugauacuuguuagagaaggcaauauuuguaguagaucuggcauucagcacagcaugaaaccgguccugcuuuuaagauacuuguguguugugugcuacagaagugguuuccgaauacuuaggggauagaugaguauagcguggauagagauagaguaagcccagcccccauuguggucgugcuagcauguacuggacugugguuuacuuuuguuugcuccgaauugagcacuguccagcuucagguaacugaggcgggcgcagcagcuccucguagccucacuucugcuuacacgcggcugcauccuuagccguguguuacucgaguacuuucuccacugcuggugugcgguaaggcagaaugagcgagggugcagucacaugguugacgauugguuaaaaggucuaucugaggugcucugaaccgauuggcuaagguauuugaaauguaaaauuacacuuucuaaugaggugauaaacaggguauuccuuccauucacauaagugcuguuucuuuccucuuccacgccacccguuucuguaggugucugugaucagaguuucgggauucacguggcugagcucgcuaacuucccgaggcacgugauagcgugcgccaagcagaaggcucuagagcuugaagaauuucagaacauuggaaccucgcugggaugugacgaagccgagccggcugcaaagagacgcugccuggaaagagaggucggucagcagggcauucgucaggggugugaauuacugaaucugugugccacgcaaccaagaugaguugcgcguucccugugggauucuaguauuuacuuuuuggucauucuuacuggcucauauuucuuagcauaaccgaaaacccaucccuggauuauuguuguuugagguaaggucucaccuuauagcucuagcuggucuacaaccgcaggucuaauccucacccucacccuccuaaccuaagcugaucugcaacucuaaucugccugccuuugccuccaaggaugcugggauuaaauaugagaaccaccaaaaccugguucucucucucucucucucucucucucucucucccucucccucucccucucccucucccucucccucugucucucucucucccccucugucucugucucucccucugucucugucucucucucucccucuccccccccccccccccauccuuucuacgaaggaggguuagagcuggagcauaguccuggcacgcaggaaucugcggaucuggcucugucacaggcucacugcccuccugagagcuguggauuuggcagaaggaguaacgaaugaauaauguaaauaaguguucaucuagauuuaaucccuaaagcuauagaugucaauugauaaguguaacagcggcagcaaacaggacuccugcuccaugcuggucuuagacuuucugaggagagcggacugugggcagugguuauuagcagaacuagaucuuccucuguagcuauggggucaggguuagauggucacacagugcuguaguauaugucuaacuuguuccuuuuucacagccacaggccugcucaguaauaaaagaacuucacugcugccugguucuggcagcuucgcggugccauacauugugacagaccuuacugcacugcacauugugacaggccuuacaguggcauacaugugacagaccuuacaguggcauacguggugacagauaauggcguauuuguagcuuuuacccagugggcuuuuuuuccuguaaggauagacgguugcuauacaaaaaggaaagcuauauccuaccuugcccauaguuuuagauauggaaagcugccauccugagcacggagugucucuacauccagacucacuuaauauccagccagacccacagagcugacgauugggauuggcggggcuauguuacaugauuccugguuuccaagaaaacugaaauuguguacuuuuauuauaauaagacguauuuugaaaagucagcuaaaggagacagcacguccuugcugccauuaguccgggcucuugucccuuugguuuuagaaaguacauuuuuaucucggcagugccggagcuuggcuuugccugagcgagggcuugggaggagagagagggguuuuguguuucauugguuuguguguuuguuugccugccucacagcacaugugggagucagaggucaguguucagggaucaguucuguugccugccuacccuguaggucucagagauccacuucagguggccaggcuugccuuuacaugccuugcagucuugccagcuccuuccgugugguuuuaaauggagagcuauuguucuuacgguacuugccaguugccccugugaugcugaugccagguauaaaaaugggccauuuaguuuuugaugugcuguaauaaauuacacaguacuaacucuugcuucagacgugcucuaaauucuuugaaucuucacaacaaauguaugaaguugguaauauuaauauccccauuuugcuugugcaagucagggaguuucaguguuuaugccuuggaaaccuuaaguucuuuuuugcugagauuaaauuccaugucagaugaagcagaggggcuuaagagcugcucaguuccuugucagcugaaauuacaguguaaaugucuuauuaauagcuugcucuggauaaguucauagcaaccaaggacuuugggauucucagaauugcuugcccauuuaugauaaaaauguguguuaaacaucuaauagcauaucuagaggaaaauuacagaaagaguccauugcuuacgcuggagaugacccauugcugcuuucccagaggccccgggcugggcucccagccucccacacuggguggaucuugaccaucuguaaacccagcuccaggagauccgacccugucuccuggcauauaaggguguccacggacauaugucauacccacaugaguacguuguaaugacuuugggacacguguguuuuucagcaaggugagaaaauuauucuggaguuccugucgaaggucaagcaggugcccuuuacugccaugucggaggagagcaucuccgcgaagcugaagcaacugaaagccgagguggucgcaaagaacaacagcuucguaaacgagaucauuucacggauaaaggcuccggcuccgugaggggacagugggugggcgugcacgggggagcucaccuuuacugugugcuguucuggguagugcuccccacuggaaccuggccuagcagcauccggaaguguuuagugaugcuugaaaacauuaccgucuguagcugggugcuguuuaaauggggacgggcaacugugagcacuaugcugaauuuuauaaauaaaaucauguaguuuguac

SEQ ID NO: 8780 - RNA, 11427 nt, Mus musculus
aaacagaucuugccugaguuuauuuguaaaagcagcauaggacacuggucauuugcaaauaguguguggguaggugugucacagcaguccaucugucuucacacuggcagaagccuuuucucuggggccuucacaggggccugggcaccuuugggggccugggcuggagcugaagccugggucuuagcuggagcguuggccugugccuugguuugaaccuugggcuuugguuggcagcgcuuacgacccuuggccauguagcuucgaaucugcuucccaagcuuggggugagcgaugaaagcccuggcgauggcugaguuugcggcuggggcccuuuggcaucuugggcuugauggccugaggcuucacgagggccuuguuggccucugcgcgcgcacucacugccuuugcauuguuggccugcaucuucuccaggccuuucuguugugcuucuuggcaaugcgcauguuccucaggaacuuggggucaacccccucaagagauucguaucuuugcgaccgggguuucuugaugucauuucugugccaguugcgggacugguugugugugccgugguucuuagacuuggccacgucugcacgguaacccgcggcucccgcagcgccugagaccggaagaccucagcaaaguuuuaaguuggagguuuccaugguuacacagagacacauagccucaagaaacaagcaggcaguuccaaaccaaaccaaccugaccaaccaacucacccacucuuucccaggcuuucaguguuguuguuguuuguuuuucauacuguuuagaacauucacuuuuuuaaaaauuagauucuuccuuccuuccuguuuguuuguuuguuucuagacaggguuucucuguguagcccuggcuguccuggaacucacucuguagaccaggcuguccucaaacucagaaauccgccugccucugccucccgagugcugggauuaaaggcgugcgccaccacugcccaguuuauuuacauuucacauaucauccccuuucuugguuucccccuccaaaaacucccuaucccuuacccccugcucaccaacccacccacucccgcuuccuggcccuggcauuccccuacacuggggcaucgagccuucacaggaccaaggaccaggcuugcauccuuacugcuccugaauuaccuaaggcuagugauaugaguuuacgauguuugccucuuguugucuagccgagacuuuggaaaagcaccauguggcucgaaacccgccucauuuacuggcuuccuuccucacaaccacucuuggucugcaagagcccuagccagguuaagcaggcugcagcugcaaggcuccgugcagccaccaggggucagccuucgccaggccgugaacccagagacucgguucgucuaaagcuccacuuggcucuuucaguuugggcuccugggaccccauccuacugaaauagccagcaccccuauauuuuccuggucccagagagaaaugugagaucaaacucgggguauagaaguaaggcugucaaauaaaccucagggacacaguuacaucugaauucucuaucuccccucacuucuguuauacacacaugcauacaaaauaaaauaaaaaauacauauuuguuuagguuguuuguuuuuguuuuguuuuuaagacagguucucacuauguagccuuggcugacguagagcccauucuauaggccaggcugacuuuaaagucacagaggucugucugccucugccucccaagggcugggguuaaagguguauacaaucauaccuagcuacaauaaacuaaaaacaaauagcaauguuuauaaccuacaauuucaaacuucuggccuccaaacccucaaguugcggccuucagucugaguaaaucucaucaaguccucacugagauaaccaucauaggucaugcuuuucucucuggccuccagcugcucaugaggccuaggcaggucugacgggccucgucagugggaacaagcugaaugcuguguucaguauugccuugugucgguuuugaaacagcccccgagaagccgcuuuuguccugacuucucgugugagcccacaggugacugaaggcaggacgccaucucugcgugugucuccauccccuuuacuuucgcagaggacacugaaguugcuccgaaaccugcagucauccuggcucccaggagaaguagaagcucagugcgcagaccccuccuccagaggacgcggggguagccaucacccgagaacugaccuguccccucagauaagaccuucugaccacuuuugcagaacucagacugaaaggguggcaggcagggccacaccucgaucaagacuccugaccuugguagauccauuuuuugugaguuugaagccagacugaucuagauagcagauucuaggccagccaggucugcgcacugcugcaccuugacccuugccagaauccauccucuguuuaaaccuaaaugauuugcugguaggggcauuuaccaucagccagaugacccacaugguggaaggaggugauuccuccaaguuguccucugacaucccuucauacacauucacucuuuguguguauguuguauauggaugugugggucacuguucuuuuucuugggcuguuucuuugucuccuaauguggccacauugaaaaaaagucucgcauggugguacacucuugauccuaccacuugagagguagaggcagguugauauuuuguaacuuugaagacagcuugaucuagauagugaauucuaggccaaccagagcuacauaguaacacucugcagagagagagagagagagagagagagagagagagagagagagaaacgaaaggaaaacaaagacgauaaaccucuuuugucuguuuucucuaccauguuccuuuaauugauaugauggauggaggauccauccuagccuucuggggcugccagagcccaagcuccugaagcuccaaucgcaaacuguaaaaaauguacucaucaguaaguuuucgcuagauuuacagaaccuaauauauaucuaauggucuucaauaagaccagaaaaugggcugagcguguuggaguguuguucuuuaauuagaaguagaauaauguuuaacucgaagggaaauaaaugauguguuuguuuaaggaacuagaguggcuugggcaacaaaggucagcuguccucucaggauauucuuguggaaaagaaaagauguauacuguggaggguguagacuccacacagcaacucuccuuucugucugcuuccagguucccccuuucucucccaauaaaagcucucucugucucugggucccccaacauaguuuuguaagugauagcacugugugguaguuugaauaagaauaacccuuguagguucauguguugaucaauucagucgguaacacuuagucaccagggaggguuacuauuugaaaggauuagaaggguuaguagguguggccuuguuggaggaaguaugucacuggaguugguuuuuuuguuuuguuuuguuuuguuuuuuuuuuuuguuuuuuguuuugagguuucaaaaacccaagccagcccuggucucucucucucucucugccuucacaucaggauguggcucaguauacugcuuccacaccugccugcaucaugccacaaugauaauggacugaaccucugaaacuguaagccggcucuaauuaaauguuguccuuauaagaauugcuguggucggggcuggagagauggcucaguaguuaagagcacugacuacucuucuggagguccugaguucaaaucccagcaaccauaugguagcucacaaccaucuguaaugaaaucggaugcccucuucuggugugucugaaaacagcuacaguguacuuacauauaauaaauaaauaaaaauuaaaaaaaaaaagaaaggccgggcgugguggcgcacgccuuuaaucccagcauuugggaggcagaggcaggugaauuucugaguucaaggccagccuggucuacagaguacuaggacagccagggcuacacagagaaacccugucucggaaaaaaaaaaaaaaaaaaaaaaagaauugcuguggucauggugucucuucacagcaguagaauaccuacgaagagacuccaucuuugguuuguugguuuucaaauaaaucugucuccuugcucuaacgacuuaucccuuccaggaacaauuuccaggucucagcaacugcuagcucagaucaggcaaguuuaauaaacuagagacacuucguuauugcucugggaaaguagagcuuauugauuaucuccaggaguguacagcucaauuccggguccuugagagcagacaacaaagcaucaaaaaguaggcguugaaaugcagaucuggcaucccaauacuaggaaggcaggggaaucgcuggucagcuuagguuacaugaaaccccgugaaaaacaaacaaacaaacaaacaagccucuuuuucucuacuugaaaauuucauaguuucuuuuguucuuccuauuaaugacuaauguuuagacuaaagguggaccgaccccaaguccauuuccaccuaaccgauggaaaaagugaaaaaggaaacacccaaagauagcauggcguccagcugccagcagaaucuacaguaggggacauuacugcuauugaguuuuugugugaugaaauucugcuccaugaauauuuucugugcaggagucaucucagcuaaggugaugggaacaaguagagaaccugaaaauuuaaaagcacuuacaggguggaggcagggcgggggcacauaaucaggaguucaagaccaaggccaggccugaucuacaggagauggcgauagaaagcaaagcaagcgaacagagccaucaagaucagcagcgggaacaggaaauagaagcgggagcuggccccucuccagaacaucccaccuagcuacccacuccugugauuuuucuuacaggauuuacuuacauuucuuacauuuauuguaagaacccuaacaaggaucuaaggaaaacccacuguccuaaaggagguuuucuagagccuuuggcaaaggcagcagcaaacgaaaagacaaaauuagcggccaaaaaugacaauccuccuccuccgcccucuaacaagcagacacggacugcucggagcccacugacucugaccuguauaaaugucucauacaaacagucggagcccgccucccaaagccccuggugccucaccccaaauggcagaucuagaggaaggacaaaggggguuuuaaccaccuguggugguuugaauagggauggcuccauacauacacucauguauuuaaaugguuggcccauaggaauggcacugcuagugucaugacuaagucauggggaccccaaagaccaccgaggagccaauucugauguaaacacauaagggucucuauuaugaacucaagagcaaggucucucacuguccccauagcagugagacaugaguaauuauugugguuacagcaagcuuggagaauuuccauaggggucagcaaguuaguauuuuaaaaacugcauuucuggugucaucuccaggaacugaacauggggacaaaaccaccugaugaacaggguggcuaagcuaucuauucucugcagaaggccuuaggcuaucucuauguacccugauccugcuauuauagccugacuggcuguugcuaagggggaggggggugucauaagaugccugcucuaguggacuuugugauuuuucuuccuggaacugaaguuuagccccuaauuuugcacaaaauggaguuucuucaaaaacaggguugguugggcuuuccauuggggaauguggccucguuagacuuguuggaggaagcguaucacagucacuuucucuugccugugaaaaaauauaacguaaaagcaaauuucuaggccuuuaggcccaggcuugagaaugugaccucuaugacucaaugcuccaagguauguuaucauaaaacagauaguggcguuccuuuacccacccgcuuccuguguucaaggaguguucauucaaagaaagucacccugaccuacccugaccauugcuggaacccgcuaugcaaaugugcuauuguuaggggcucuagaaacugucuugagaaauaacccgcacaauuaccagguauuccuugugacucuugugacuuugcacuuccugugacucuuaacugguauuuuugguauuuuccaacaacgcccuccccaccuccuugaguugugguuucuuccuuuaaauacccccuuacccagcuacucggggcaccaugguccucuaccccugugugguguaugacugugggcccgagagugcucuugaauaaaaguccucuugcaguuugcagcaagaccguuucucgugagugguuugagguguugccucuccugagucagaacgugggggaguccucacauugugggucuuucaccugcagauccagauguagaacucucagcuccuccuccagcaccaugucugccugcacagugccacacuucccgccaugacgauaauggacugaacuucuuucuuucuuuuucuuuuucuuuucuuuucuuuucuuuuuuuuuuauuguuguuuucgagacaggauuucuuuguguagccuuggcuguccuggaacucacuuuguagaccaggcuggccuugaacucagaaaucugccugccucugccuucugagugcuaggauuaaaggcgugugccaccucgccaggcuggucugaacuucugaaccuauacaccaacacuaauuaaauguuguccuuuauaagaguugccauggucauggugucucuucacagcaauggaacccuuaagacaccaccuaacaagauagcgagcugcccuccucuuagcuauucaaauucuaccccacucaaaugucccaugaccaaagccauguagcucuucuuaacugccacaaaaggagccucccuccuucucagcagagugugagaacuggucuacuauauuuaugucuguuuaauaacagacugcuuauugaaaccuuuaccucaauuuggucugguaaguauuucuaccaccucacugugacuuacuguuggcacaauggugacaucacagccagcagcagucuggucagagcaacagagaugaguaaaguacaccagaagagcaggaggcuaaaccugucagccagacaucugccaccgcugacucccacuggccacugcuggagagagauacacauucaugcuaagcagcaacugagcuuuucagcagcucauucauuguuccucuuucagugcucaaguauuaucugggugcaccucaauacauucggggguuguagcacaacccugaagagauuacagugauuucuccagaggauuucuagacuuaaugauaacucgggagggaaugaagacggacacaguaugugaaggagaaaaggaggacugccuuccaccagaggcagcugugggcugcugcggagacacagcuggagggaaaucagcuccaggaggaugggggaggcucuguggguucacagccuagguuucaucccaauccccugggcucagggucucuacugugggcacacuucuuuccaccuucagcacucucuaaacgcaggcucacguugguugcuggcaguacacuucuuuccgagucagaccaggaaauggaagaaauguggagcccagugaugcuuuuuguccucuguucuuacgcuggaaagacuugccuacaucuuuucaguccaguaggcaccagaguucagaugcuguguuagucacuugucuuacugugccaaaaugcccgaugaaagccacuuagagaagaaaggguuucguuugcucaguuugaaguauggucaguauagggugacaccaaagcuuggggacagcuacaaucagggagaagagaaaaaugaaagcuugugcucugcuggcuuuccuucuguucaguuuaggacuuagcccaggggauggugccacccacaaugggcaggucuucccaucucuuuaacccaaucuacagacaaacccagaggcuugcuucuaggugauucuagauccugaguagugggguugcagacgugagccaccacacuuaaccucucuucaacuacauuuuagaaacagauugguuugggauuuuuagagagucucauguggaccaggcuggccucagauucagagaucccccugucucugcucccagagugcugguacuaaagacaugugcuccuaaugcccagcuuccaacacauuuuuuaauaugcuacuaucuuccaaaagugucuuccuguuuuauaagaaaauagaaauggguuaaaugagaaauauuuccccuauggaaauaaaacuacucauucauaacaaaguugguuuguuguuuuuuuuuuuguuuguuuguuuuuguuuuuuuuguuuuuuuuuuuguuuuuuuuuuuuuugucuucuaagcauugagagaagcccugccgagaccaacucagggcuaucucagcagcuuuugcugcucugguuguucauucaguuuuggguuaaugaggcaauauauuugacagacauuguucugccaauaauuaugugagcaguuuaacguuuguuugcauuuuauuuccuuaauaaaauagaacugagcacacugcccucuuugguuaguuuggaaugcggggugggggauuuuaugucggucaaaaguaugucacugggauucucagauuaucauucacacauauucacagcacagauuucuacagaggcuugagagcagcuuccuuaugggcagacuggguuucuagagugacauugcuuccuccucucuguguagaggcauugaaccuccaagcucacagaacaauacgccaaggaucuacuaagcauuugaccuugaacuaggucauuuugaaaaaaaaaaaaaauuaaaauauuuaggaaaaaaguauguaguguugaauucaacccugccacucagguaggugaguccgagucucccugccaaggaccugauagaucugggacacuggagcuuuuccuucagauaaucccuggugccucggggugaaccauuuccacacccaguacaaaggagagcuuggccuugcuugucuguuucggaggucacagauguuccuggugucacaggacacagcaaucagagcuccaccugauccuuuaucaccagucaaaccccauagcucacaaaguacauggcuuauaaagcgugguuauggagaggagcagccacuuaugagaguagccaacuacugaucguccaggacggucauggcaauuugauaaguuggcugguauggccucaaagccucaaagccucuagaaguuucagugggaacaucauagagucccacacuggcuuuaacaggauuucagagaggagaaagacugagauaaagauaguacaacuaacauuuaucacugacuuauuaugugccugaauuguuucugucuuuuguggugcuaugaacuaaacccagugucugcugcugccuacuaggcaagugcuuuaucaccaagcuacauuaauggcuccuguucuguccuuaauguguuagugggguacacacaaaauccuauaaaaauagacacugcauggcuaccauuuuauagaacagagaguugagcuuuagggcugucagauaacuucuuugaguuauagaaaguaccagaacuaggauuugggcagacagguagacagauagggacagaggccuugucuagguaacaaacauggcgaacuuccaagauggcugaccagagauuaaagccuggcagcuuaaaaaccaaaggccuuuuuggcuuuuguucucucugguagggccccuuggugauugaacuagagggcacacauaugucaaagcagaccugucaguuacccugucucuguuuaaauggauuguuaggucuccaaccugggaauaggggaugaggugcuuauuuaauguaucaaaauggauggaccuggcuaccagguucuuccagcaucccucagucucuaccugucacagaguaugaccugauuauacccuugagcuggagcuuaggguagggggagcuggguaugccaggguuugagacuuaauacugauuuacacuaaauuugggaggaaggcccuuaaauacucuuaaaaccccagcucuccaggagaagugggacuaaagucuccucccugcuuuguagagggcccuugccuggguguguccugcugugaauguugcuucauccccacuaaagcuuuucuuuauggacugauuaugucugcuguguuugagauuuucucaguugaugccuguuguggcuugagaguuuuccugccuuuuaauuauuuuuuuuucuuuauuuacuuuacaucccacugcugccacccccuucucucucucucucucucucucucucucucucucucucucucucucucucucucucucacacacacacacacacaauucuuuccucucucccuccccuucuccucugagcagguagccccgcccacuuugucucaggcacuucaagucucuaugaggcuuggugcuuccccuuccucugaggccagacaaaacaacccagcuguaucccauguacaggcaacagcuuuugggauggccuccauuccaguuguuuggaacccacaugaagaccaagcugcacaucagcuacauaugugaggggaggccuagguccugccugcguaugcucuuuggugguucagagucugagagccccaaggguccaggugaguugacucuguuggucuucccguggaguucccaucccccuuuggggcucccaauccuuccuccuauucuuccauaggaguccccacgcuccauccaauguuuggcugugggucucugcauccaucugagucagcugcugggugagccucucagagaacagccaugcuagacuccagucugcaaacauaacagaguaucauuaauagugucagggauuggugcuugcccaugggaugggucucaaguugggcaggucauuguuuggccauucccucagucucugcuccaucccuucuaccuacauuucuuauagacaggauaaauuuuggguugaaaguuuuguggguggguugaugucccuaucucucucugucuuuuaauucuuuagcucugaggaagagacccuuagacagcaacacuuccguaucacuauggcagcacugccauuucuuuucuuggauagagucucacuguguagauuaggauagccuugaacaugugauccuucuucuacaucaacuuccacaguauuaggauuacaggaguaaccagcuaagccuaccuuugugguauaccaugaauagcggcauggauuucaacugauagccacuacaagcauggagucccuuggagaagagcagagucauc

SEQ ID NO: 8781 - RNA, 6307 nt, Mus musculus
cuuucugcgucaguacuuaauaacuuuauuugcauuuggcuccuuccacgguguggaagaguugggugcuggcagcagcuugggcauccugcgcccucuggugggccucaggagccauggccacacaagacggcagucaauagucuagcacaagguugcagugauccucacucaggucugggccccagacccaaccucagggaacugggcuuguuggggugaagcccugaaccucuggcucucauacucgcccguguuggacacccacauguucugaugagcuuucaucugcuucaaucgguccuuguccacuuccugcuuggugaggacgaagaagaggauaccacaggggaagcagauggcccaggcuagccccacggcuuucaugggguucuugccccuguuucugggaauguauucuagcucaggggagaggggcucgggcuccuccuugcauucuggugagcuguggcucugcagugcucugguccuguucugggaagccuuguuagcuguggcuccagagaggcucccccggaggacgcgggcauuucucuaaugugugucuuuuaaaacagggucuauuucccucuccuaaguccaggcuagucugugacucacuauguaauauugggccucaaacucauguaacucccaguccuuaucacaauuggcuucuguaauuguggaauucuggaauuuugguuccuuaaaaaaauauggaacuauuauaaaaauguuuuuguuuuagucccaggagugggauauugggcugcuauacagcagcugacuaugaugugccucgugcucuagcagaggcuugguuuugccagcugcugauaguuucugcgauugcguggcauuuggaauucugggaaauuuuccagagaguauauaaaguccugauagguggguuguugguuuguugguccaaggaacucaauacccuuaaucaucaggaaguaaucuagugauauacauuccaacccugaaucaaaauuaggguuuuucuggggucuccuuuccucucuauccuuuuuucucuuucaucuaguguuauggggcugaaaggguggaaugaaaggaggugagaagccaauuuugaauuauccacuguuaaggcccagguaacugcuaccugucuagccugcuauuucaugcuguuacuaaugucagaaggaagcuuucucauaugcuguuauugcugcuacuaggauguuuuggcccuuaguaguuuuuggaaaccagucacaacagaggucaguuagagcugcuuuguacauuuagccacaaaaagcuuggacccgaaccaacuuccagacagcacuuccuguaccuguauaugagcuuuuauggucuuugccuuucuaagcugccccugggauggaccccaauauaagagagacagcugcaccaauauaagaacccauuuaggauaagacuucugggggcuggugagaugucucaacgguuaagagugcugacugcucuuccaaagguccugaguucaaaucccagcaaccacaugguggcucacaaccauuuguaaugaaaucugaugccgucuucuggagugucugaagacagcuacaguguacuuacauauaauaaauaaauaaauaaauaaauaaauaaauaaauaaauuagaauaagacuuccuuauugaguaggggucaaguaaaguuuaaguuuccaagaccucccuggaaacuggcauucuacuuggcagaaaagggcaugcauguggguaacugauauccugguuggcaaguuaggacauggauguuaggcaagacaaguccuuugacacagcuggauacccccagccaaugagggcaggauaaaugcacaguaaagacacguuccuaaggaaaucccccaucccuaaagccugauuaguggaauaacuugacauggauguuuguggauuuuaggcuuaaaauuuccauaggauucuagcuaggagacacaguuccugagucuggacuaugucccugaaugaucagucuuggguguggcauuuaauaagccaucccuguuugacugagaucagugucugaguaguuuguguggugaucuccagacccaacaauguguauaaaauauauauggauacacacaguaugugugugugugguguguaucucuguguauguguguauuucuguaugcauauguguaugcauguguguauauguauguguaugucucuauguguguguguguguauuuagagaauggaggauaaucuugaggaaccagccugcucuauauuaggcuuaaaagcuacauguguuauaguaaagacacaugagguuaauucccguuuaugauuagaccucuauuucucaaugacugggcugugugccaccuguaccuuaacuaaaagcguucuauacugccuguuccaggaauaauaaucaugucucugucuuaaaaaguuauuuauaaucaucuuauaacccuaccuuuguuucaaaaguuauaugaccaccuaauaccuugcuaugcccaccuggcaaccaugucuucauuucaggacaaaucccccauuuggaaauccguuacaccugagcuauaaaagucuugucuuccucacauucaaugcugaccucuggagccccacuuuagggggaagcagcuuguauacauggauuaaaaagaauggccaugaugauuugagucagucgucuuucuccucccaucuuuugaauaaacaaugucuuuggguuugguugaguuuauuuaagaguaaaguaaggcagauuacuagggaaugaggagguuauucgaagaguaauuucauggauagacagaaugagggaugauagcauggugggggcuuggaggagagcucaggcucugaaccagagacaaucugcauggcaggaucucuggagagcaccagccucccuggcagagaauggagcaucuuauaguuagcucucugaggaugagagacuucacagcaagagcagcaacuaggcugguucccaggcaugaggcagggaaggggacaaagacaggauguggcaccucuuagaugucaacucaccucccaggugaguugucacagcacugggaagucagugagcuaggacucacacugucuaggcugugaaggggagagcugcuguguaagagcagcaagaacuuuuccucgccaagcugcuaccuuuccagccccagagucugguucuaaaguaagaacauuucaagacagcuguugugacaggccucuagcucuagggaaacugaggcaguguugggagcuauuaagacaacacuauuguccugaucucugaauugggccucucccagagaaaagaaaagggggucagaagcgggccacggacacaccguucagagaacaaccacagaauguuccagcccuaagucaucgccgauguccugaccacacccugauaccaccaaguuccugcuuccccguguagcugccaaaagaaaaaauuucuauugccccaccccucccgcugauaaguacuuccccuuuugcuugugcaauucuauugccccaccccucccgcuaauaaguaccuguacuuccccuuuugcuugugcaauucuacugccccauccuuccugcugaaaggcacuuccccuuuugcuugugcauuuaagccuugggccuggcuaauacaguggaaccuugauguuacucagaacguuucugugucguucuuuacacaagguucucaucucucucuaaccccccccaauuugguucuuaggagaagguccccucgagacccucgaauagaauaacuggaccugcuggacgggucaaggcaggaugagcugaacucugaggucagccuaaguuaaacagcaagaaccugauuaaaaaagaauaaauaauaagguaaacugagaacauguguaaaagccuaauguaaggauauaucagaggauagcagucgcucaucuacugcaaagacgcaaaggaaaaccaggucugcccaaacacagaaaaucacuuacucuuuuuuuguuuguuuguuuguuuguuuuuguuuuuggagacaggguuucucuguguagcccuggcuguccuggaacucacuuuguagacccggcuggccucaaacucagaaauccaccugccucugccucccaagugcugggauuaaaggcgugcgccaccaccgcccagccacuuacucuuuuuaaaaauuuaauuuaauuacuuauuuguuuugccauagagccuuaccgcauaacccuggcuggccugaacucauuguguagacagggcuggccucuaccagguucaaagcaccacucccacggagagugcuggugacacuguccuaaacagaaggccuuuggauaaacagaaagacuuacuggauuaacaagccuaaagguuucuguuuauuagcagagcaaaucuuuuaagguaguuucucuucaccaagaaccucccugaacguucccuccuggaaggucaacuaccucaggcaaugccaccugcuuuaaccuauccgaaaaacagaauaaucuuaucagcucagauuuccccccaccuccaccccgucacaaagucugcuuguuuucccaacaggcugcuccuaucucugucccaagagacuggccuuagcaguuugauucuaaaggaaucuuucugucuacaaaguggucuagcuugguaguuucucugggacaucucuuaacagccucaaacuucacagagauccccugucuccuaagugcugagaucaaggguguggccuaccauaccaaguuucuuuuguuuuuaggcugguguguguauguguacacacacacacacacacacacacauacacacguauacacgugugcacgugaccgugcccaccccaagccuauggagccugaguauagaggucagaggauaauuugcagcaauccuucacagugugauucuagugauagaauucaggucucuagcuggacuccaaagcaccuuuacaggcugagcugguuuuguccaacaaagcaaaucuuuuuacccuuuuaccaaagugaagguauugcuagccagagcuaaguccauucuuacuuagagcugaauuaagucucccaauuucucucucucuccuucuugauuuaguuguuuuuuuuguuuugguuuuuuuuuuuuuuuuuuuuuuuugugacaggguuucuccguguaacaaacccuggcaagucuuguaacuguagccaggguuguccuugaccucagagauccaccugcuucugccuggaacaaugggguuaaaggcacacaccuucgcgcucagcuccaauuucuugaauuugaauaggagcuccaauuuucgaaaacgcccuguaaucaaccuggcaggaagacauucugaggagaaacacuuggcucccuuuggcuaucaggcaauugaaauaauggacuccaaagaauuggaauuucuccaggaauuuuuuggugggaagggguaagacaaagcuucgaguuaguguagaggaagaacuugguuucuggaaagagauuucucaaguaucugaagcucguugaauccccauguaggacagucuggagcagagauuauggugggucagaccaccucuuacaagaccauucugguucccgucgcccgguuuaaaccaaaacuucacgucaguacccccaaagaugaacuuccggggggggggggcugaacuuuaucuuccuaauguggcccuuugaaaaaaaaaucuguuuuuuugcuauuuucucuauuauucgacuacugaggaugagugggaguuuagcucguuaggguugcuagggcccaagcguugacgcucaacauuaccuuagcaaucucaguuucuaaaauauaaaaaauucugcacacuuaugcuaaagggcucagauaagacuggaccuuaacugcccaucucauauaguaaggcguaaacuaguugaggcagugacgggccaaggaaaguuuuguggguagcugguuuuguggauagcuguucuugcacuuggcauucacaagugccgcucuguacaaugcucugcgaacgcaccguacguggcagacagcaacaaccaauuucucagcuccuuucaguccaaccgcaggaccgcccgcagggccagguguuuccgcagcgagcucgacgcggcuucucgcagggugcaccccgccguuccagcaaccgcgcaagccacuuccgucuucuuggugcauacuugcccggguagccaccgcgagcuccacugcuuugcaaaggcucagucucaaggcccgccaacccgagcuugggggcugggcccgccccgccccgcccauc

SEQ ID NO: 8782 - RNA, 49824 nt, Mus musculus
gggggggggggggauguggugcugcggcggccgccaccgcagcugccacugccugcucgcgccugggugucccggaggcggcugcugggagccacgggagcagcugcggugcucugccauauugugucuggcccggcccggcccucgccucugguucgcggcggcugagugacggugaguccccggggucgcgcggcgcggcgcggcgcggaggcagcgugugcggccggcgcugggcgugggggcgcggaggcggcugucccgugacgcgccgggacauuuuugugucccgggaagaauuggcgccccugcgcggggguguacccggcgcgcggcuccggcagagcgugggcugccccggggguguggaaccgaggcgagcacggguccccgggagugaggaguuaggaguuuucucccgagguaaugaccguaccggagggggcgucgcgcagucggagccacagagggcagaggacgcccaggcggaaaccugcgaccccgggaguugcugcucuaagagucccggggagcccgcgccagccacgucgccgcuccggcucccauccgagcgggacgcgcgcggcguggagucccaguccggggcccggcccggcccgggcgggauggcugggcccggagaaguagugcccaggaggacucgcguaaacuucgggcgcggggccccgaugugggguggcgaccccagcccgguucucgcggccggaggcgcccccaagccuggcuggcccgggccggggguggggugggguggggugggggugggacuuggacuguuucggcguugcaacaugugcacuuccuguucgccaucuccuucggggccgagguuacuucugcccuccggcccggcgcucgggccgggagggugcgcggugguccgcggccuugagcuugggugccggccggcgugcagugcccggcagcccgaagccgagccggggagguuaggggcagggaguccacgugcucggugcucggucuugcacugcaaacuccgcccccggcugcccuccggcaaaaugccuggguucccaccgccgcaccucacgcgaguuggggguagcaauuucauugggaagccgcgcucucgagaucuucuugcacuugguuucugcuuuaaagcuuuccuuuuuccaccuuuuggguggcggugggaggagucauaagugcagagaaaugacagacuuuuuuuuuuuuuccccuacuugcaacuccgcugugagcgguuaauuauuuccagguuaguuggugcucuuuucuccugucuucugauugugacagccacguggccggcugagugcaauagagugcucuagcggccagagagcuugaggcuucucucgcagcaggggcuuuguaaugguauagucuuggcuucugcgcucuaauaagaggaaguggaaaaagccgaaccgaucacaucuaguuguuucaccugaaucguagaauggcuuuccuuugcaauucugguaaggugucuauugccauuuuugccauucgcugcaacuuugaugauucaucuuaaaauuucagcaguguuagguaucuucaaagagcgacagggcaaugucuuuauaaaaagaguuccccgacucuuuagaaaaaucguuuuaauuucaaagccaauaacgagcgauucuaaugaaucugaaaugauaacauucuggcauuauuucgggcuuaugaaaaaaacucauuuguuucuuuuuacacagauuagcaaugaaauuaucuuuuuaaggauaaauacuaguuuuguauguagucagauuugagcagaauucauagguggaaauuauaguauauaaaagugaaagagaaaaugauuaaaguuaaaaaaauaaacuacuggagagugaagauuuagaaugucuuuacagucuagaucaugcgucauuuuuuugaucggcaauuuuaauuuguuucuauggcauguuuguguuauuacuuaguuuuacguuauuguuaaaccauuaagaaggaaaccccuuacauuuauagaguucuggagaaaugguucggacuucguuuacugggcuuuugaauguucuagugaaguuaaugaagguaucgaagaggguguaaagcuuucuguaggaaagaagauaggcuggaaagugagugugcacugaccacugagaacaguucauaguugaggaagaaaaguaaacgaacugaagagaagugaagagacauuuacauaaagccggaagccuggaacacugcaaacaguuuaaaguaaagugaaauuuaaaaguaauacucaaacagcaaguguguguguguguguguguguguguuuugagaaggcuuucacucugugguccaggcuggcuucaaaguuggcgugacccuccugcuucugcagcuuccuuuuguuguuuuuguuuuuuuguguguguuuuauuuugcuuuguuuuguuuugugagacaggguuucucuguguaucccuggcuuuccugggaacucacucuguagaccaggcuggccucgaacucagaaauccgccuggcucugccucccaagugcugggauuaaaggcaugcgccaccacugccuggcucuuuuguuuugagacaagcucucacuguggagcccuggcuguccuggaacuugcuauguagauuaggcuggcuugcaguucucagagaaccaccugccucucugcaccauggaugcuggaauuguagggugcaucaccuggguugcuugcuugcauguaguuucgguuuguuuguucaagacaggaccuugacgagaucagccucucguguagaugaggacaacuuuaaauuccugauccaccugccucugucucccaagagcugguuguauagguguguaccaccacaguuaacuuuauguguuucguugcuguuuguuuuaacaacucaaaagaaugguuauuuuuaaaauaauauuuuuauucuucaagacugucauacaguggaacuccccagauccacccacaucuuugcacccacccaaauucauguccuuuuuuuuuuuuaacuuaagagugauauuuuuuuugucuguuuuuuuguuguugguuuuagauuguguacuaauaacuggguuuuauguaaaugcaaacagucuuccaguuauaguuuugagugcccagggcuugagguugaagaaguaaaacacaacugagacaguacaaggaguuaaaccguacuaaaagucagauuaagagugaguguaagagagucagcggggaaggaagucguagaaaacuugggaggguaggagagguuucuuggaaaaggcagguguugauuucuacgggagaacuucuaugcuaauaaugucgcccaaauggccacccucuguuuauuauuaauuuauuuuguuuguuugguugguuggcugguuccuggaacucucucuguagaccaggcuggccucaaacucagagauccaccugccucagccuuccaagugcugggaaugaaggcguguaccacuaccccucccccuccccccuuuaaauuaagcuugcauaagaaauuuauuuuguuaacuuucacacuuugguuccagucuucuuucucccaucuuaauauucuacuguucugcagaaacuuaauuauuauaccucagcaugguacuacaauuuauauuuauguugacaguaucuuuuuaucuguuggaaauacacuuggacacuccaguguaaggccuggcugaaauacugauuguucuaugagccuuggaaucacagacuucuagauccaucuuuacuuucaaccauaaauucuuucccuuuuguaauagcauauaauucuuucaggcuguagcauucucuacugccucacugauuuaacaaaauuaaaaaaaaaaaaccauauugaauaccaugugcuaaguaagcuccaucaaaagagcagugcguggagcuggacaagagggauuccuucauguuuuauuaucuguuagguuuuguuacccuaauuaaaagauacguccuugaacagcaaguuacauagaauauauuauuugccagcaagacacccuuagagccuuauuuuagauauauacucucugccuagucugaauaaagaaaaaguaagauuuguggugugaggugugaaguugaauagaaagaucuguuuuuauaaguaaaggugggaagagaagaacuacuuuugaauuuaaauauggucucauuuccuccagaaugaguuggaauaugaaauaauccucuuuugaggaagacuccuuugacucggugugguccagcacucagagaacugggaggaacuggaaagaguacuacugaaggaaaaaguaacgaugggaugaaguuagggcugguguuaauagucaggaugcuuaguuuagucagcugaauguagaugaaugggagcgggcagggugaacacgaccuguaggaguggcccacagagcuugggggcaaugcagaggugacagcuagugguaugaauuuuuuguuguuguuguuguuuguuuuuuugauuuuucgagacaggguuaggguuucucuguauagcccuucucuguguagcccuggcuguccuggaacucacuuuguagaccaggcuggccucgagcucagaaauccaccugccucugccucccgggugcugggauuaaaggcaugcgccaccaugcccggcuaguaugaauuuucuuaagagcuagcaguuaguacugaggacuaaaauguugcuugggaaacuagaauguaacaggcauuagcuauggugacagggagguuugaggugacuacuguagacuuuaucauucuuuugguguuacugauaauacauaaacgugcaaaaccuuacccaguuugucugauuagcguuuuacacacucugguauguugucacaagcaaggaaacaagauuccaguauuacuguuaauuagauaaaucauucaaauuugccugauuuuucucuaaugucccuuuuuauuccacaacuaguuuuuaggaauuucguagaauguccuugaauugagauuaccugauauauuucucaggauuaggcuuggcuguugguuuagugcagguaaacaggugaagugccuguauaguauagacaguaagggugcaugcugacuugccgugccauggguaaccaucacugacuauggccuuugcguuccucacuuacauuccucacgcuccagagcugcuuuggaagcaaaguacuaaguacagcuccuguucacaggucuugacccaauuuugauugauauguuuuuuuuuuuaauuucccucaaccuaauuuucuguuacauaaagcaacaaacaaacaaacaaccugggcaaauacuugugagcaucuacuguacuuagugcuaagacuggaguugugagcaagagacauuuuuauacccaaggaggucugucugcugucaucauaaaguaggguuuauuggcuugcugugucuuuugauuucauuagcauuuauacauacaaaguuaccaaagcccugaaagucuaaacaaagcucuuuuaaguagccauuuguaagcuacuaucauacaacuuuaguaugugugccauaaaaauagcuguccuuuugcugucaacacacauuuucauucuucccaaguaguuauauucugauaaauuuaauuuaauuuguagucaacuauuuucauagcuuuggugugugugugugugugugugugugugcgcgugugugugcugcaccugugcuauguguuuguguguguguuuguacugugugugagugugugugugagucugucucaaagccucuuguguagcugagacugaccuugggcucugguccucuggccuccauaucuugaauccugguguuacagguaagaggcaaacuagaguuugcagguguaaagaaggcaagaauuuucuugccuuuuaaaaaauuugaauuuuacguguuggugugugccaguguguauguaugcagagcacaugugugcaagugccuaaggaaacuacugucagaacaccuguaccugcaguuauagguaguugugagcugcccaguguggcugcugagaauugaacccuguuccucugcaagauuagcaaauacucuuaaccacugacccaucucuucagccauucuuugccuuucugauaguucuuucuuaauaauacagauuuaguucuuuuggcaccagaagcuugucuuauuuguuugagaagugcuuugaauugaaauugauauaugaaaauauauguaugggaaaacagauugggaaaagacagggcacaugggcagguagaggucaggacucuugugggaguugguuuucaagagucaacagaaguuacaaggauguggcagguccuuucaccugaugagucaucuugcggacccucuuuuuuuuuauguuucagacaagagcgcuguguguucacacuggucucaaacuauugauugucccacuucagccgucugaaucuuaggucacagauauguagcaucacauccagcuuugaaaaguuucuaauuuguagaaauauucuuaacuuguggauucacggagcagaauuuaauuuuagauucugcagugauauggugcuaauagugauuuuugcuguuuuguuuuugagacaggguuuuacuauguagcacagauauccauuugccucuguccuaaguacuagggcuaaagguguauaguuauuuagaauuguuuacauagccuuagagguaaaggauuuaggaaacugauaaaaacaugcccuugugguuuauguuaaaaaagaaauacaaagaaaaauggggaaaaguuucuuuugaauuaagauuuugcuguacugugacuuuguccagcaucuucauccuuaaaaguuuaauugaaugauacucugucccccucccccccuaccccacccccaccccugccaaaaucaguguuugggucccaccugacaagggauugaauuaauauauucuggaagaauaaugagcucuuagccacugagcaucucuccagucugaaguaaaccuuucuuuuguacugauugaacauuuaucaauaauaucaauaauugcuaacucuuauugccuguuguguccuggccugcuagacacaggaguauauaauucucagcaacagcccugcagggaauaguguguuuuugcacauauacgaaacagauagugagacauuaugucaauguagugcuggcuggguuuugaauaaaaaucugucauaguaaaaauccauguucuuuguauuauaaucugaaguuuuuuaagaaaauggguuguuagaaugaaaugcuucuauauugaucugucccaagcuggaacaguaaagaaugcuugauagagaagccguuauucagaugccugaacuggcaggaacgccaccacuuucuuuguuacugugauuucaacaauaggugugguugccuaggacccaggcagguucagucaucugucagacuguguaggugaguugguggcugguggguuugcuugacuucaaaucuuacugugcaguuaccuagugugacauucugcuauaauuauuuuuuaaauguuugcucacuaaauguuaugggguuugcuagagcauaaaaaauggauacauugcauuuugccuacaaugacuuaaugucugucugucuacccacuuuucucccucuccaacucuguuauuuuugaggcagggcgccacguggucuagccuggccaugaacuagcucugcagggaaagaugaccuuaaaguucuguucuucaagugcuguuauuacagauagacauaccugguguguguguguguguguguguguagaaguuagaccugguucugccuccuagccccaugcucauagaaauaagacucagacucaaaauauauuuacagauaucuuagucauaucgcuaggcucuacucugacuagaucaaaacuuaagguauccaauugucuuacuaugggugguuagguagcaugcauccaucucacaucuuccuggguggaucuucaugcaccucacauucuaucccauaauccuuucuccuuccggaugucuuaccauuuauuuccugccuaagccauagccacagccuagccaccuguuuuuaauugacagguuuugcaucuauacaauacauaagauagucucuguacauauguguguguauguauccuguaacagacacauguguauguauaacagcacaugaaguguacacaagugccccuuacuuucaagucuuuaguauuucauaaauagaugcuagaaucaauauagauaauuuuauccaucauuccucugacaguguuggguucaguguaauaagugacaaaaggaaagcagcugcccucauuuuagacagacagcccugucauucugugagucuuauacaccaguguuguuguuuguuacuggggauugaaacacgggccuugcacacgacucccagccuuccuuaguugcugccuuuaucugcugguuaugaacagucaggaauuugauacacuguagcugcuaucuugagaaauccucucugggauaguuuuuaauuuuugggguggucacuuuuuuuacaguaauuuauauaacaaaaagucccgaauuuguuuuuuggguuuuuuguuuguuuuuguuuuucuguuucuuaguugaucuagcauuuaaggaucuaguaaagaggcuuaggaagggagagguugcagauauuuccuugacugcucuaauuuugauuaguaauuacuagccaccccuuauggaauagugcaggugcauucuaaucauaaagagaaauaguuggauuuaaauagcucaguauugcuggguuaguguuuggggaacauguuggauuuuauuauuuggagaauaucugauucagauaugauugcacauauuccuagauaguuugagaugcagaggcagggagauuuacuuagccucugggguaggacgccugucagagucgugcgggcucuguagugccaccuuccagugagucguauaccacguaaucucccuguuuccacauagaaaguagaacccaaugauaguaacuaucugguagggucguuacaaaguucaugagauaguuuuaggaaagguuuuuaaaugguaucuauuaucaauaagcaucaacaaguguucuuuuauucucuaauauauguacauauguacauuuaucuacaggaaagccaauaauacuugaauuugaguguguguuuaaagacaacaucuugcucuguuguguaggcuuacccuaaaauuccuaaguguuaggaugcaccaccugaauucaguuuugauuauuagauuauccuaguaaaauugaaucauaccauuucucagauaccaaaguagcauaauagcagaacuuugauucaucauacaacaaacauuagagcagaaaacaaaauacacaguuuugcccuuguggaaacuucagccuguuuguugaaagaaguguauuaagccauuugagguguugcaggguuuauuauuauuauuauuaauuauuauuauuauuuaauuguggaagaguagaagaaggccucuucuuaaucuuuauguuagaccauucuuacaguuuuuaaggcgaaaugugaaagaugaauagcuguugucuagaguuagguaugcuguguacgaacaauuuuaaggcagagauaugcaagggaacuuaauuuagggacugccuuagucaggguuucuauuccugcacaaacaucaugaccaagaagcaguuggggaggaaaggguuuauucggcuuacacuuccauacugcuguucaucaccaaggaagucaggacuggaacucaagcaggucaggaagcaggagcugaugcagaggccauggagggauauucuuuacuggcuugcuuccccuggcuugcucagccugcucucuuauagaaccaagacugccagcccagagauggucccacccacaaggggccuuucccccuugaucacuaauugaaaaaaugccuuacagcuggaucucauggaggcacuuccccaacugaagcuccuuucucugugauaaccccagccugugucaaguugacacauaaaaccagccaguacagggacauaucagaguuccuauguguuggaguuuccauuucaacauacuguaguuuuaauggucuagguaaaaaaaaaaaaaaagcaaauaaaaacaaaaacaaaacaaaaaauuagaauaaauuaaucccacgauuuagauaauagugaauguuuucaaauuguuuuguuugcaaccuaaaaauagaaagauucacuuucuuuguugggugccauguagguucugugauacaaauucagucuucugcaggagcagucagugcuugcaaucauugaacuaucucuccagcccuuacauuugggauuuuaaaucugucuucuagucuucagaauuggguguuauggaaugggcacuauuuauaauggagaacuuuaaaaaauauguuaaaacccuaguaaaagcuggggugucuuauggucccugucucaguaauuguucuauucugugaagagacacuguaauaacaaaggcaacucuuaugagaggcaucauuuacuugggggcuuacuguacaguuucagagguccuuuaucaucauggcauccugacagggagcauggcaguauucaggcaggcagggugcuggagaggaggggaaaggggggcggugagcagaauggucaggagagcuugaacucagagauccuucagccucugacuucugagugcuaggauuaaacccagccagaaggaucuugauaauagaaauucugauggaggacaguagauucuaaggaguugaauacaagugaacguaauucuguacacuuuuguuagacgcuguauuguauuuguugcuuugucuucuguuucugagaaugguaucaauaaguaaaacaaccccuuuucuaaauuucucagguuaucuuuuuaaagauuguaauuuuauauauguguguucccuccccacccuguguguguguguguguguguguguguguguguaugcgcgugccugugacuggagcuacaggugguugugagccacuaugguguucauuuuaaagauuucuuuuaugucuaagaauguugguauagugagguagcuagggcguggagucggcugacaccggcaagcuacccacaagaccugccacgggaucuuaagaccucuggugaguggaacacagcugcugcucccauccaauuacgcuggaccugagacugcauuaauuagggaagcagaaaacccggccugaucagcggcacaagucccuucugguccacgccagcacagugguaccuugggcauggagucugcggacacccguaagguauacacaggacccuccaugggaucuuaagaccucugugaguggaucacaacuucuaccaggaggcagguucgaacaccagauaucugggcaucuucccugcaagaggagagccuaccugcagagaguauucugaacacugaaacucaggagagagcuagucucccaggucuacugauagaggcuaacauaaacaccugaggaacaagaucuaaucagagacaacaacaacaacuaauuccagagauuaccagauggcgaaaggcaaacauaagaaucuuacuaauagacaccaagaccacucaccaucaucagaaugcagcacucccaccccacccaguccugugcaccccaacacacccgaaaaacuagaaccggauuuaaaagcauaucucaugaugaugguagaggacaucaagaaguacuuuaauaacucacuuacaggagaacacugcuaaacagguagaagaucuuaaagaggaagcacaaaaaucccuuaaaguauugcaagaaaacgcuaccaaacacgugauggaauugaauaaaaccauccaaguccuaaaaagggaaguagacacaauaaagaaaacccaaagugaggcaacgcuggagauagaaaaccuaggaaagaaaucuggaaccauagaugcaagcaucagcuacagaauacaagagauggaagagagaaucucaagugcagaagauuccauagagaacaucagcacaacauucaaagaaaauacaaaaugcgaaaagauccuaacucaaaacauccaggaaauccaggacacaaugagaagaccaaaccuauagauaauaggaguagaugagaaugaagauuuucaacuuaaagggccagcaaauaucuucaacaaaauuauagaaaaaaaacuucccaaaccuaaagaaagagauacccaugaacauacaagaagccuauagaacuccaaauagauuggaccagaaaagaaauuccucccgacacauaauaaucagaacaacaaaugcacuaaauaaagauagaauauuaaaagcaguaagggaaaaaggucaaguaacauauaaaggcaggccuaucagaauuacaccagacuuuucacaugagacuaugaaagccagaagauccuggacagauguuauacagacccuaagagaacacaaaugccagcccaggcuacuauacccagccaaacucucaauugccauagauggagaaaccaaaguuuuccacgacaaaaccaaauucacacauuaucuuuccaugaguccagcccuucaaaggauaauaacagaaaaaaacaauacaaggacggaaaccacgcccuagaaaaagcaagaagauaaucccccaacaaaccaaaaagaagacagccacaaaaacagaaugccaacucuaacaacaaaaauaauaggaagcaacaauuacucuuccuuaauaucucuuaauaucaauggacucaauuccccaauaaagacauagacuaacagacuggcuacacaaacaggacccaacauucugcugcuuacaggaaacccaucucagggaaaaagacagacacuaccucagagugaaagguuggaaaacaauuuuccaagcaaauggucugaagaaacaagcuggaguagccauucuaauaucgaauaaaaucgacuuccaacccaaaauuaucaaaacaggcaaggagggacacuucauacucaacaaagguaaaauccuccaagaggaacucucaauucugaauaucuaugcuccaaaugcaagggcagccacauucauuaaagaaacuuuaguaaagcucaaagcacauauugcaccucacacaauaauagugggagacuucaacacaccacuuucaacaauggacagaucauggaaacagaaacuaaacaggaacacagugaaaauacagaagagaugaaacaaauggacuuaacagauaucuacagaacauuuaauccuaaaacaaaaggauauaccuucuugucagcaccucaugguaccuucuccaaaauugaccauauaauuggucacaaaacaggccucaacagauacaaaaauauugaaaucgucccaugcauccuaucagacaaccauggacaaaggcugaucuucaauaacaacauaaauaauggaaagccaacauucacguggaaacugaacaacacucuucucaauaauaccuuggucaaggaaggaauaaagaaagaaauuaaagacuuuuuagaguuuaaugaaaaugaagccacaacauacccaaacuuaugggacacuaugaaagcauuucuaagagggaaaaucauugcucugagugccuccaaaaagaaacuagagagagcacacacuagcagcuugacaacacaucuaaaagcucuagaaaaaaaggaagcaaauucacccaagaggaguagacggcaggaaauaaucaaacucaggggcgaaauuagcagcuugacaacacaucuaaaagcucuagaaaaaaaggaagcaaauucacccaagaggaguagacggcaggaaauaaucaaacucaggggcgaaaucaaccaaguggaaacaagaacuauccaaagaaucaaccaaacgaggagcugguucuuugagaaaaucaacaagauagauaaacccuuagccagacucacuagagggcacagggacagcauccuaauuaacaaaaucagaaaugaaaaggaagacauaacaacagauccugaagaaauccaaaacaccaucauauccuucuacaaaagccuauacucaacaaaacuggaaaaccuggaugaaauggacaaauuucuagagagauaccagguaccaaaguuaaaccaggaucaaguuaaagaucuaaacagucccauauccccuaaagaaauagaagcagucauuaauaguuucccaaccaaaaaaagcccaggaccagauggguuuagugcagaguucuaccagaccuucaaagaagaucuaauuccaguucugcacaaauuauuccacaaaauagaaguagaagguacucuaaccaacucauuuuaugaagccacaauuacucugauaccuaaaccacagaaagauccaacaaagauagagaacuucagaccaauuucccuuaugaauaucgaugcaaaaaugcucaauaaaauucccgcuaaccgaauccaagaacacauuaaaacaaucauccauccugaccaagaagguuuuauuccagggaugcagggaugaaaauccaucaauguaauccauuauauaaacaaacucaaagacagaaaccacaugaucaucuccuuagaugcggagaaagcauuucacaaaauccaacacccauucaugauaaaagucuuggaaagaucaggaauucaaggcccauaccuaaacaugauaaaagcaaucuacagcaaaccaguagccaacaucaaaguaaauggugagaagcuggaagcaaucccacuaaaaucagggacuagacaaggcugccugcuuucucccuaccuauucaacauuguacuugaaauuuagcuagaacaauuagacaacaaaaggaggucaaggggauacaaauuggaaaggaagaaaucaaaauaucacuuuuugcagaugauaugauaguauauauaugugacccuaaaauuuccaccagauaacuccuaaaccugaaaaacagcuucggagaaguagcuggauauaaaauuaacucaaacaagucaauggccuuucucuacacaaagaauaaacaggcugagaaagaaauuagggaaacaacacccuucucaauagucacaaauaauaucaaauaccuugggguaacucuaacuaaggaagugaaagaucuguaugauaagaacuucaagucucugaagaaagaaauuaaagaagaucucagaagauggaaagaucucccaugcucauggauuggcaggaucaacauuguaaaaauggcuaucuugccaaaagcaaucuaaagauucaacuugauccccaucaaaauuccaacucaauucuucaacgaauuagaaagaacaaucugcaaauucaucuggaaauacaaaaaaccuaggauagcaaaaacucuucucaaggauaaaagaaccucugguggaaucaccaugucugaccuaaagcuuuacuacagagcaauuuugauaaaaacugcaugguacugguauagugacagacaaguagaccaauggaauagaacugaagacccagaaaugaacccacacaccuauggccaauugaucuuugacaagggagcuaaaaccauccaguggaaaaaagaccgcauuuucaacaaauggugcuggcacagcuggugguuaucauguagaagaacacgaauugauccauuccuaucuccuuguacuaauaucaaaucuaaguggaucaaggagcgccacauaaaaccagagacacugaaacuuauagaggagaaaguggggaaaagccuggaagauaugggcacaggggaaaaauuccugaauagaacagcaauggcuugugcuguaagauugagaauugacaaaugggaccucaugaaacuacaaagcuucuguaaggcaaaagacaccgucaauaaaacaaaaaggccaccaucagauugggaaaggaucuuuaccuauccuaaaucagauagaggacuaauauccaauauauauaaagaacucaagaagguggacucuagaaaaucaaauaaccccauuaaaaaauggggcucacagcuaaacaaagaauucucaccugaggaauaccgaauggcugagaaacaccugaaaaaauguucagcauccuuaaucaucagggaaaugaaaaucaaaacaacccugagauuccaucucacaccagucagaauggcuaagauacaaaauucaggugacagcagaugcuggcgaggauguggagaaagaggaacacuccuccacuguuggugggauugcaagcuuguacaaccacucuugaaaucagucuggcaguuucucagaaaauuggacaugguacuacuggaggaucccgcaauaccucuccugggcauauaucuagaagauguuccaaguaguaagaaagacacaugcucuacuauguucauaccagccuuauuuauauuagccugaaacuggaaagaacccagaugccccucaacagaggaauggauaaaaaaaaaaaacgugguacauuauacaauggaauacuacucagcuauuaaaaagaauaaauuuaugaaauuccuaggcaaauggauggaccuggagggcauuauccucagugagguaacccaaacacaaaagaacucaaaugauauguuuucacugauaaguggauauuagucccgaaacuuagaauacccaagauauaaguuauaauuugcaaaacacaugaaacucaaauagaaugaagaucaaaguguggacacuuugccccuucuuagaauugggaacaaaauacccauggaacgaguuacagagacaaaguuuggagcugagacaaaaguauggaccaucuagagacugccauauccagggauccaucccauaaucagccuccaaacgcugacaccauugcauacacuaguaagauuuugcugauaggacccugauauagcugucucuagugagacuaagccggggccuagcaaacacagaaguggaugcucacagucagcuauuggauggauuacagggcccccaauggaggagcuagaaaaaguacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacuugcaaacuuaacgccagggccaaaaagugggaguggguggguagggcagugggagggaggguaugggggacuuuugggauagcauuggaaauguaaaugaggaaaauaccuaauaaaaaaaaagaaaaaaagauuaaaggauaaauuuuuuuaaugaaaaaaaaaagaauguugguauaggguacagcuggcaauaaggaaucuuuuuacauuaauaaaauauuaaaauuuugagauuuaaauuauuauaaauugcuuaaaucccagugauuggaaggauucuauuaagugauacguuggcagaguccaguuauaaauauaguacaugaaacagagaaugaagaagugaguguugcacuaugcggaagauggggaaacaguuauugcagcacucugagaaguccauguucauggcucucaugcccaagucuguccuuggugaugggggagaggcauacuuaaucuuuuuguaauuucaaaacaaaaaauaaucucuguuaagugauggacuaauucauguuauagaaaaagcuuugugauagaaucggcuguucuagucauuuaagaggugauuucuguguagaccuggaguuuccugcuaagucugugaguugcuguggugugugugugugugugugugugugugauguaacuacuacaaauaaaauaaucuaucacaacauucuucucaagaaccuugagcuuaaguuuaaauuauaaaauaaauacauuaaagaaaacuuggaaagacaaaggccauuacuaauuuaaugauauaaacaacuuuuaaauauacuguccucuaguuuuuacaaguucuuuuguuuauuucauuuauuguuuuauaaggucaauuuuaguggcuaccaaauaguagauugaauagguaauugcaauuuuucuauugcaggacaugaaaguuaguaguuuuccaacuuaaaugauucuuuggauauuuguaaggauggagguggaagagggcagguuguagagggguuauagauguacaugaucuaauuuauauguuuuuggacagaaauguugauuuuuuuuaauuaccaauauuuuuuuaauuacuaauacuauacuugcuauauauaccauguucugugccacauaauaauuaacaucagauauuguuuuguuucuuuuauuuccuugauugcuagugauaguauuuuuuuacguauuuuuuuauuuccuugauuguuagugacauuuucucacguauuuuugcuauugacacuuaagucugccguggcagacauuguuuggauagagagugauuuuaguacucuaaaaugaugguguaaaacaauuccuuguuucuccuugaaaauacugccaauuuugcuaaggaaaugccagccuucuaucucaucgugaguuuuccuguaacacugaagcacguuuacugccauuuauacuccauuccuaaauaauggucuuuuagaauucauaucagugugguaauaugucagaauuguaacaggauugagggacacacacaucauaauagugugaacaccagucaucauaguuaugaacccaaaaagaaccuaauaaaggaauuuuuauaaacuuguauuuuagaagaaaaccauauuugccccauauaaguuaguuucugauaauauuuagugaagagauuuugauuuuugaguaccuguuacaauacauuaauacaaugguguuaucuguagcaaagacagcccagcacugccaagagcaggccaggagguuccuuuucugcuugaagacauccacucagguaaagccuuaucauugacugugccagagugaaacgagugagguuguuaucagacgugagaagucacagcuuguacccucuuagcuugauaacaaguucauuaacuauuaagaaagagauacaggcugggggaggaaggaguaaacagucacaaagcaugauaggcuucugggguggggggucacuuucuaaggugucuuuaccaugacuucacaugauccuguggcucaaagguuguaauuuacaagguuacagauugaucaaagcuuagacuugauguuuagcuauuaaguagaaauguguaagcugaggcacuucucuuucuuucagaauuuguaaguugaaucaaucuuguucaugguuauagcuuucagaaugagaaaggagaucugggaggcuccuuccccagcaccucacaagccagaugucaccacagcacagaccuguaguuccagcacucagaagguugaagcugcaggaccugaaguucagggucauacuugucuacauagggcucagguccugucucguuucuauacguucugcccuugaguaaacagaguucacuuaguauuuuagugcucuuacuauaggacuuuuuggcuuuuucaaggcagggugucucuguguagcccuggcuguccuggaacucacucuguagaccaggcuggccucgaaaauucgccugcccuuugccucccaaguacuaggauuaaaggugugcuccaccaccccggccccggcuuuuuuagauaucucuaugcacuuuugacuuuaucaguuguguggaaguuccuugacucugagucagcaggaaaaacaaauacucacgggugauguuuauauacuauuaccaugguauauugggacuagacuuuugguucugaguuugccugcuuggguguggauguuuagccugaguccuccuccuccucaucuauagaauaauaagguucauaacugucucaacuuuaauugauggcuaacugacacagauuccaaggugacuggcccucacaauauugacugauguuaucacuauuugagaaaucaauaauagcucccaggaugcaaauagacagauuucauaguucaugaguggccuguugauggugggcuaagcaaaagaagcucuauagguaugucucccauuuuauuuaaauaagcaugagucagucaaauugauuauagguuuuugcugucuuuaaaaguaagacaucuuuauguauacugaaaugaauuaaguagcacuaguauauccuucccucuggucaucugugcucugggaagaguuauuuguuauggcaguucaaacauccuauaauaaugggauauguugaggccgagaugauugggaauucagaguuaaguuaaauauuggauuaaaaaaaaacacaaaacagcaaauuuauucccaauuuaccuuagccaauaaugaauguagggaauacgaaauuggcaagacaauaaauauuaaauauuuucuuacuacauagagaaauaacuaugugaaaugacuuauuucauuuaugugggcuucuuuggugugugcaaguaugugugugcauguguguauaugugugggugugugggucuguagaccaagcuggccuugaaccuagaaugaucauccugcacugccuucuaaaugaugagguuauaggaaugcaugaucauccucuucuaauuagucuauuuuaaucauuucacaaugaauacaugugcaacuuuauauaauuauccugacaauuaaaauuaaugugauaauuuuuuuuaguaugacauauaaaaagagaacugguuuacuuuuguaaaaauuuuauguguacgaaugcuuugcuuacauguaauguggccaccaugugcccaguguccauggaaguucgaagagagcaucggauccuuuagaauuggaguuauggauggaugagcugucauucaaaugcugagacuuuaacccagguccuccacaagagcaacaagugcucuuauacugagccauugcuacaguccuaggaauggcucuuuucuuuucuuguaaaugauaaauauuuaagacuugaagauuuauuuggaauuauuguuuaaacacuuucaaauuugaguauuuuaaagauugaacaauguguauaacuauuacaguaaaauguagauacuuaggauaaauuauaaaguuaugaugcaguguuuacuauacuuacuuauguguggaaaccgcuacauaauacuugucacugugcaccuguggagaucagaugacagcuuacaggcauuugcucucuucuucuaccuaaugggucugagaguugaauucaaguuguuaugcuguauccaguaagccaucucauuagccccacuguguuuaauaauggcuacuacugguuauuguggacuagaaacuuugcuauacuauauuguuuauuauuaucagccauacguauaaugcuguaaaguuacauuuuauuuacuguuuauucuuucaaauaauauaaagcaacuaguacuuuguaugcauuauaacuguaaaaacuauuuuauaggggacuggugagauggcucaguggguaagagcacccgacugcucuuccgaagguccagaguucaaaucccagcaaccacaugguggcucacaaccauccguaacgagaucugacucccucuucuggugugucugaagacagcuacaguguacuuacauauaauaaauaaauaaaucuuaaaaaaaaaaaaaaaacuauuuuauauuuaaguauuauauggggagcugggcaugguggugcccaccuuuauuccuagcacucgggaggcagaggcaggaggcucucugaguuugaggacagucuguugucaaagagagacccugccucaaaaaacucaaacaaaacuccaaauauguauguguguguguguguguguguguguuuauuuaauuacuguauggcauagucaguugcaaguuuucuuaacuugcauauaugugaauguuuauuugcucuucuagaguuuuagauuugcauucauugguaauuuguuuuuuauugcagaaauauacgaguaaauggguccaguaauuggaaugacuccagauaagagagcugagaccccgggagcugagaagguugcaggacugagucagauuuacaaaaugggaaguuugccugaagcuggggaugcugccaggccaaaggccacucuugugggcagugagucagcagaugacgagcuaacaaacuugaacuggcuucaugagagcaguaaccuucuaacaaaccucagacuuggaagugaaggccuucccauggucaguccgcuguaugacauagagggagaugagaugccauccuuuggaccaucgugcuaccagaacccagaaaaaaaaucagcaacuucaaagcccccguacuccuuuagucuucucauuuauauggcuauugaacacucgccaaauaaauguuugccugucaaagaaauuuacagcuggauucuggaucgcuucccauacuuugccacugcaccuacaggcuggaagaauucuguucggcauaaucuaucccugaauaaauguuuucagaaaguggaaagaagucauggcaaggugaguguucauaaacaucguucuguguggugagggaauuaauagaguccuguaaaauucaagaccaagagaaauaaaggcaugucagguuagcucgaaguuaauuauagucuucaugugcuuuaauauaugguguuuuaagauuucuuaguguugaaagaaacuuacuaaaauuacauucaguuugcuuuuggcaccuagauuauucuuugacguuucuuuucuaccuuguuacccacccuuccccuuaucugaaauugaacuuagggccuugaagaugcuuuguuaggaaagcaugcuaccacuauucccagaccaccaaguugcuuuucuuccuuuccuuucccauucccuuuccgucucuucuguguagcccuggaaaucuacucucuguagaucagccagacuugccucaaacucucagagauccaucugccuuugccucccaggugcuaggauuaaagguguaugccaccacugcccagcagauuuuauuuuuagaugugugugugauucuggguuugugcuugauuauauugucuucagaagucacauggauguuggauuucuuggagcuagaguuaaaggcauuugugaacugccuaauaugggugcuaagaucugaacuuggguucucuggaagccguaguacauucuuuuaaccacugaugugucucucuagccccaaugaguuguugcucccaauuucuccaacuaugucaguauauauauguauguauguauguguguauguguguguguguguauauauauauauauauauauauauauauauauauauauauauauguauccuguuuauccaguauaacauaaugaaaguguagcucauuuauauuagaaguaggagguauacaaaggcaguauuucauucuguacaagugagaaauguaggcagguagaguggaaaggcacagugaaugugaaggcugaauguuauaaguuacuagggcuucaguguugagaucagaacaagggugugauaagguuuuucuuucuuucauuuguaaaugauagugcauuguuguucuaaacugucuggauucucuaaaaagagaauuguacauaguaucacacauggauaugguuuuaauaaagauguaggguuugaaguguugauaguaauacuugucucaugucuaagucuguggacuuguuuugacauuguguuaaaagguaaggauagcuuuagaaauuacuugauuugcauaguauaugaaaccauguucauacuucccuggaugcuuuuucuuuacuuuaacuuuuuuguuuaguuuuuguuuuuuaagacaguuuuucugugcagcccuagcugcuaauggagcuuagaucagacuggucuuuaacucagaugucugcagaccucuaccuccaagugaugagauuaaagguguaugccacacccagcucuuuuuacaguuacuuuuaaaucguuguuuaggaacuuacuuucccuuuugccuguuuaguuuuguguuuucuuggguaacaguauccauuccuuuggcuuuacauagcauccgggugcuaaugacucuauuaaguucuccuaaagaccagaccuaauuuacaacucauuguuuaaucuagagauaaauugggacuuuguucuuucuucuucuaagaccccagauucuaagcuugauguuuguucuucacgaugccaaguuacuuggauauagaauuugaaaggaauuuauacauuauccugaugaacuaucuuauuucaugaccaggaaaauaagaccuagauagguaaaacuguuugauccugguauauaauaacaguagcaaaauuauaguuaugaaguagcaaugacauaauuuuauguucagggguuaccacagcuagggaaacuauauuaaagggucucuuagcuuuagaauuguugagaaucacuggccugauauagaauaccauguucauacuugauuggauucucuuucuuuuaccauuaauugggggguggggacaugguuuugagacaggguuucucuguguagucccggcacucacuuuguagacuaggcugaccucacacucagagaucugccugccucugacuccaagugaugggacuaaagguguaugccaucaccaaccagcaaccauuaaccuuauaauugauuuuccuuuuaaaacuuauuuucacuguuaucuuuuuaguuuagcauucucuuucccucccucguggcuccuguagcccuuuguuuguuguuucuacaguauauauuauaguuguguacaaguuuuuauagccuacuggggaggguauaaacgcuucuaaaagucaaaaaucuuauugcaguaaucacauauggauaucuaccuacuuauccuugcuuuacauagugauuggucauagggcucaugauuccaccaaccuuucaacugcuggugaauguucaggaaggaggcgaaaauuuucaggcucuuguucucugaaacuagagaggggagaauggacuacaguguguggcagggggaggaauuauuuuguaaccuuaaaacaauguucaguauuucccaaauacuuaggcaucugaguuucuaaaguuuuuuuuaaagacuacuauauaaaguucuuuuauauucauuuuuacuuguuugauuuuuauuuaauguuuguuuccucccuccgucccucccuccuuccuuccuucccucccucccucccuccccuccucucucccucucuucuugucuuuguagaguuaggauuucauguaacccagcugagaucaaacucaauguguagcuaaggguggcugucuuauauacuuugaaauuguugugauaccauggccgauaucuggggcuuuucauauggugggcguguuccuuuaauuagccuaugauuuuaaggacaaacaaaaugaaaagggaacuccaaguucaucaaaucacccauaaaguggcggcaagaaguuacucccucgcagggcuguaguggcauacuccuuuaaugccagcacuuuugaggcagaggcauguagauuucugaguucgagaccagcuuggucuacagagugaguuccaggacagccagggcuacauagacaagcccugccucggaaaaaaagaaaaaaaaaaaaaaaaaaagaagaagaaguuacucccucaagcagagggagcaggcugggauccaagaggaggguaaggguccuggagcccagaguggacagcccaguaaauuuccugugggagagcugaucacugaucacuuucuucucuagaugcccuccuaggccguuggguauugcccaugagaaccacaaagucaauauggaaauggugauugccaucucagaauuccaaaagccaacuuuucuuuuauaaagcuuuuauuuuagcauuaaaguuuuguugguuugucuguuuucucuucucaugauagggcuuuucuauuuagcuuaggcaggacucaugauccuucugcccuggccucccacguauguuaucaucacacuagacuucagccagugcuuugcagauaacagaggcuguaaacagauauucaaggcagugucuggaaggcaagagcacugagggaagcugccuaggaaagacagaaggaaggaacaaagggaccccaaaggcagggauaagugcagcucagaaaaaugccugaauaucaugguagaaccaagaaccagccaugcaauauauuuuaagaagacauucucagcuggaugcucugggagucacgugauuaucauggagcuccuaggagcucuggaugcugauccagagagucagacagcuaaaacucuguguuuagaaggagugcuguuguaguauuuucuacuuaauaaaucccgauggaggguuugcccgccccaagguuuauguuccugaaugaaacacacgcacagcuuuuauauuuugauaugccuuaaguagcucaauagcuggaccacugucuaaccuccaugcaguuaauccucaguuauuuaccaauuuuauguucuaucuuggcuucucuggacucaggacugcucaguugggccaaacucucccagcucauuaacauggcaaccauaucucucuucucaggcaucacaucuuuccucccuccacacuuuccuggcauguuggaucucuccuucaucccuucucucuucuggccccaaaccugagaauccucaaauccugccugugucuccccccccacccccagcuauuggcuguuggcaucuuuauuaccaaucugaaccaaugggggcggggugggguggagaagggagggugaugggggggggcagacucccaggaguuaagugcagacacucucauacaaacagguuuuuagugaaacauaauuagcauucguaauacaagcagcaguugguucuucaucuaucaaacaagaugccaauggccaauugcugaacaaaggaaagagacgggacuuccacauccugccaagcaggcuaagagacacaagacgaggaagggaaaugucuccaugcuucggagggagaaaaggugaccagccaugugagaucuuggggagccgcccgccauaggccacuuccccaggugaaagauuagaaaaaaacuagcugagggcaguuuuggguuguugaacaaggagaagguaacugggucacuaagcuaagggcagauuaagaugugcugagcuaagaauagugggaaggacaugcuagcuacaggagauuagaagugcccagcaauugaaccaagguggcagguugaaauugagcugugugugugugucuguguuuuucguccauggauccaguauucucugggcagggcccgguagugcaguccacucagagcuuaaagcaaguucauaggaacuacaugcuacaagaagcuacaguguaggcugguagguggggcuuugauggccccaccaggagggaucccugcgaggacagggaggaagacuaagaagggagagaggggcuucuccuauaggaaacaccgagaaggucagaaaagaaaacuuuauuuucagaggccaggaaugagaaguucacagucuagcacuggacagucggagaugggagaaaggacuccauggguauacacgauaaagccccauccuggcuuccccacccuuugggagagguuugaggcaccauaggacuaggcaugguuggugugguuugaaugaggucuccuguaagucucccaacauuuggauauuugguccucagugguuguuugaagaggauuaggaaguaugcccuugcugaagaauguauguuaugggggugaguuuucagauuucagaaagacuccuacaaagaucgccgaugcucuuggauuggcaggauuaauauaguaaaaauggccaucuugcugaaagcagucuacagauucaaugaaauccccaucaaaauuccagcucaauucuuuuuuuuuuuuuuuuuuuuuuuuuuuuuucccugagacaggguuucucuguguagccuuggcuguccuggaacucacucuguagaccaggcuggccucgaacucagagauccgccugccucugccucccaagugcugggacuaaaggcgugugccaccacgcccggcuccaacucaauucuucauagggaagagcaauuugcaaauucauuuggaauaacaaaaaaccuaggauagccaaaacuauucucaacaauaaaagaacaucuggagaaaucaccaugccugaccucaagcuguacuucagagcaauugugauuaaaaacugcaugguacugguacagugacagacagguagaucaauggaauagaauugaagacccagaaaugaacccacauaccuauggucacuugaucuuugacaaaggagcuaaaaccauccaguggaaaaaagacagcauuuucaacaaauggugcugguucaacuggaggucagcauguagaaggaugcaaauuggcccauucuuaucuacuuguucaaagcucaaguccaaguggaucaaggagcuccacauaaaaccagaaacacugaaacucauagaagagaauguggggaagagccuugaggacaggcacagggggaaauuaccugaacagaacaccaauggcuuauguucuaaaaucaacaauugacaaaugggaucuuauaaaauugcaaaacuucuguuaggcaaaggacacugucaauaagacaaaaggcaaccaacagauugggaaaagaucuuuaccaacccuaaaucugagaggggcuaauauccaauauauacaaaaaacuaaagaaguuagacuccagagaaccaaauaacccuauuaaaaaugggguacagagguaaacaauucucaacugaggacuaccaaauggcugagaagcaccaaaagaaauguucacuauccuuagucaucagagaaaugcaaaucaaaacaaccccgauauuccaccucacauuagucagaauggcuaagaugaaaaacucaggugacagcagauaguggcgaggauguggagaaagaagaacacuccuccacugcuggugggauugcaagcugguacagcuuaacagaaaucagucuggcgguuccucagaaaauuggauucaucuauaccacuccugagcauauauccaaaagaugcuccaacauauagcaaggacacgugcuccacuauguuccuaacagccuuauuuauaauaaccagaagcuggaaacaaaucagauguccuucaacagaagaauggauucagaaagugugguacauuuacacaguggcguacuacucagcuauucaaaacaaugacuucaugaaauucuuaggccaauggauggaauuugaaaauaucauccugagcaagauaacccagucacaaaaagaaaauacaugguaugcacucauugauaaguggauauuagucuaaaagcucagaauacucaauauauaauucacagaccacaugaagcucaagaagaccaaagugugggugcuucaguccuucuuagaaaggggaacaaaauacucacaggaaggaauuauagagacaaaguguggugcagagacugaaggaaaggccauccagagacugcuccaccuggggauccaucccauauagagacaccaaagccaggcacuauugcagaugccaagaagugcuugcugauaggagccugauaaagcugucuccugagagaaucugccagagccuaacaaauacagaggcagaugcucacagccaaccauuggacugaguagggguccucaguggaggacuuacagaaaggacugaaagaagugaagggguuugcaacccauaggaagaacaacaauaucaaccaagaagacccccccccaccacccagagcucucaagaacuaaaccaugaaccaaaggguacacauggagggauccaugacuuuagcugcauaugcaguagagggugaccuuaucagacaucaaugagaggagggguccuggauccuggggagguuccaugucccaguauaggggaaugccagggcagggaggugggggugggugggugaguaccuuuauagaagcagggagagggagaaggaugggauaggggguuucuggaggggaaaccaggaaaggggauaacauuuguaaauaaauaaaauauccaauaaaacaaaauuuaaaaaaggaaagaaaaaaaagacuccuacacuuucaagugaguucucucuuugcuuccuguuuguggaucuagacaugugugaaaucucugcugcuguuccuguccccuuuugccugguacuuccauucuuccaucauggauucuaacccucucacuguacucuaugacuaaacucuucuauaaguuguagaaagaaaaagauaccaugacaagacaacuggcaggagaaagaguuuauugggagcuuacauuuucagggcgaguccauaaccaucaaggugaggagugacaggaaacaggcaaguauguuguucagagcuugcaucugagacacaagcaugaggcugagagagggaagagacaagugcugugaauggugugggcuuuugaaaccuuaaaacccacccacagugacacacuuccacuaacaaggcuacaccuccuaguccuucccaaacaguuccaccacuaaggaccauguauucaaagauaggugccuguggaggcuuuucucauucaaaccacuacaguggccuugaacucauuaaaaauuucuauccauccauccauccauccauccauccauccauccauccauccauccauccaucuaucuaucuaucuaucuaucuaucuaucuaucuaucuaucuaucuaucuaucuaaauuugagaggcuuucaguauguagcccuggcuaaccuagaauucaguauguagaccaggcugucuggaacucaaagaaaucugccugcuuuugccucccaacugaugggguuaaagccaugcaccaccauguccacccuacuccauuuucuuuaaugcguaugucgucaauaaaugcauguguaugcacuguguacauacaggagucugaaaaaggccagaaggcaucaaauuaccuggaauuggaggcaagguaagccaucaugcaggugccaggaagugaacccaguuccucuguaagagcagcuaguacucuuaacccuugagccaucucucuagucccaggcucgaacuuuugauguugaucugccugccucugucuccuuaaaugcuaggauuucaggucugugcugcacaccucaggcaauugaaguguucagagaagggauggggaaguaagagcuagagaaugcaugggaaggauacugucucaaguuagguagaguuugagaaagaaaagucuguucaugagaaggaggguucagaaauuguaacacaaaaauuggcaagcuaucacaaguaagguuaggugagaagcuuuagguacagguaccaaacuccaacuuggugaaccaaugcuuuucauuugaguugcuuaauaagaauguguaagggguuacuuacaggagcagaaaugacuccaagacaacuccaucagcaaaacuaccccaacaugggacagcucacaaaagccgagaauuuggaguacaaugcauaggcugcacgcagcucaagggauuggagcaaguccuuuccagguggcucaguuggucuacacuucuucagggcagcucagcugcucucagcuucuuucagaagcuuugcaacuugucuugccugaggagugugagugacuuguagaagucuguuugucuuucuuucuuucuuucuuucuuucuuucuuucuuucuuucuuucuuucuuucucucucucucucucucucucucucucucucucucucucucucucucucucuuuccuuucuuuucuguuuguuuguuuguuuguuuguuuucaaaacaggguuucucuguauagcccuggcuguccuggaacucauuuuguagaccaggcuggccuugaacucagaaaucugccugccucugccucccaagugcugggauuaaaggcaugugccaccaugccuggcagaagucuuuauuuuuaaugugggagggaugggcauagugaaucuguauguuuuaaggacuuccuggagcuguauggaguuguuuauguucugucuugaggaauuucuuugccggaugggaugucuccaccucagaggaaaaggcuccauguggaugagaauagaagaacacuauuugggauuuaggaguguugcuacauucaggggcagaggagaaaguucauguggggaaaugugccaccaccucucaagugcuagaauuacaguuuuccaccaccacaccccagggguuuguuuuguugaaaccuuuuugagugucucaggauguauuuuucuuugcaucuguggaagauaggucaguuauucuuccauuaaauugagguucaauugagugcccuugacagcccuuuucugggucuagagauguuaucuagagauguaguccuccccacagaaggcaaggucugguuuucugaccccuuuguaguauccauagcacuucacaaaaaucagaucuaaagggucaagucuuucccugucccccaggccuagagaguaaagcuuuauguuuuucugaauuuuuuauuaaauguaagugaaaauuaugacuaggauuuuaguccauacacacggaauuaaaucuugccuaguuuaguacagacaacucuugguuuuucaaggccuggaacucacuuuguagaccaggccggccucgaauucagaaauccgcccaccucugccucccgagugcugggauuaaaggugugcaccaccacgccuggcuguacagacaacucuuaauguagaaggcaagaaauaauauuucagaaauaguaaauuguaucuucucuggauuuauuauucaaaacuuuuaagauggaucuuugcauuucaccccuuuaauguagcccuuuuuacagaaccuucgaagccauucucagagcuuuauaguucaugauagugaagaggagaaugcauauuuucuguuuuccaguaaguguccaggcacuucauuucuuacagacagauuuuauguuaggacaaagaucauuuggguuuuaucacuuaagcaaauuuuaagggagaagaguuuuuaaaaaaucauuuuucaaacuaaaauauauaugagcaaauacauaguuuuauuucuuguuacuaauggcucaugaacaggcccagugaaaggcaguguugccauggcaaccgaggccuggcuguuaauucgaaauucugcucaggacauuuaaauguccugaaacuguaaguucucagcuuuuacaauuugcugcuucaaggaaauagcuuuucuacugugaucagaaacaauuuucagucuucucacuguagaauuugaaaacaaaacuugaacccaacacuuuguaggaaguauuccuggaauaccaaaguagaauaugggugguuauagaauuguuuggucaguguaugaaaaauuacauaugcauaugaaaccuaauuagaacaaaagauaaaaguauugacauuuaguuuuacuucccaguugucaaacuauaucuaucaucuugucuaaaugauuuauuuuaucuaaguuaucuuuuaacacuuaaucuaaaucuuuauuugcaaaucuuaagguuucuugggaaaacuuaucugccgcuuaguuuuuuguuauuccuguuagguuuuugagacagggcacacacacucacaggcacagacagacagacaggcagauagacacacacacaaauuaaauacugcuaguugggacagaucuccccguauagaacaagcugaccuugaacuuaggacaguccuccugccucugccucugaaguacuuggguugcaccacacuuacccuaacacuuccuguuguuucugugguucuugcuacugagugccagaguucgaaucccagcccauuucucccugugcuacuguguuaaagacacgcacuuuccuuuuucugcaugucucagucgccaggguguuuaaaucugcuccauucucaguagcuggacuuuuccccagagaagccgcuuucuuccccaaauuaguuuuauaccuuacuguuuaucaccuaaccuuuugaaaauuuaguuccauuuuuauuuuguauuaucgaauuccccuucaauaaacacccuaugccaauuucaguauaacaaguuaaugcucauguauuuuuagccaugucacuuagcuauaaauuacuuuaucugaaucuuaccacaauucacugaaaugaccuugaaucuuuaugaguaaaaugugagagaucugacuuucagaaucaacaauuuguccaauuucacaugacuagucaguaaguaguaaugaguaucuuguuuuuaggauuuuuuuaaaauuccauaucacuuaugagaguauguauaccugugugugagugccacuggaggaaauuccauaucacuuaugagaguaugugcaccugugugugagugccacuggaggucagagggcuccagccccugugcuugucugaaguuguaauccugauaauauguguugggaacuacucuuagguuucugcaagucugguacaauguacuauuaauugcugaaaccaucucuccagccccagaucuuuaaacuuguagaauaauauguuuucauuaugccauuuuauaaaaaugaaacaguauucaaagauaaaagaucucacugguugcccgauauugcugugacugagaacauagaaaauggaagcaauguggagauaaaugcaucagaccucacaucauacauagcuuuaugcaaggaagcagugagggggaggaauaagucaauuuaauuaauucccaaagaauaacugaaaacacagggucaggcuuagaagcacuugcugccgagagugaggagcuugacuuugaguucuuccauccacacaguaaaaagagagaacuaauacacguaugcuuuccuuugaccccugauucaugucuugucucucuccccauaaauaaauaaauguuaagccuggguauaaauaaguuccaaccucucccaucuuggguuagagcauacauuggcagagcaguugggugauagauagcuccaagacacuaauucuuguacaacuuuuuucuagguuaauggaaaaggcuccuuguggugcguugauccagaauauaagcccaaucuuaugcaggccuuaaagaagcagccuuuuucuucuccacaaagguaagggccucuaugugauuuagauuuauuaugugagcuggagaaaacaaagcuguaaguuuuauuuuaguugucuuauuuuauuuguguguuuaucuaauuguacagggaaguauuuacugauaacauugaccuaagauauuuucuucuugguucauuuuuuuuucuagaaaacaaaaugcuggguaguugaguaucaauucucagaaaauaagucaguguacuguauuauaaguaguaagcuuaauaaauuguauaacuucaguugcaaaaacauuaacucauuuuaauuguuuguaugcuaacaaggacacaauaaauuaaauacauauuuaaaauauuugaguaagaugauucaucauuuguaaccauaacauuuuguaagguccaugauucgcugaagaacgauacccagacucacauaguaugcaagagcaacgagugcuuuauucuacagaaguccagcaugcuggggucuaccauuuaccaagauggacaugcccaagugagcucacaggcccaagugaaagcacaguaggggaauucuagggagggggcaggugacauuuaucuuaauugauuggcucuauaucuagggacauucccgagccacugcuggggguuguggggacuggaaacuguugcuggggaagccuggaaacuguugcugacccauuguccuugucucaggacaggugguggggcagcuucugauuggcugcccaaggccugggguuuuuccaguaucucaguugccuggacuuguccaguucuuggaaacagagauuuaggcccagucuccugaccugccagugugaauccugucauggagucagccugacucuguccucccacuguugccuaaaucauucccccucagucaugggccauuucgaauccuugagauguuucuguggacugcuauuguuguuuuagaaucauuaauugaacaguggaaaucuguuccuuaacaaaccuaacugaaggauugauuauguagggauuauaagucaaggccaaccucaguagccuaagagggucagggcagaggccauggagaccuguugaagagggacucaaacuaacccugagacuguuguuuuguuuguuuguuuuauacugucuuucugauuaaggccguggauuuuuuuggccaucccuuaguagucagcauaaaaacaacauuccuuaccuaaggcagcuggaggaacaagaagucuaggccucuucuguuuuguaagacugcuucugccagggaggacagggcacccugcagggccgugauggacuuuccugucuccuguauaucugcaucuauagccauccguagagccuuguaauuuuuauccucaguuacuaggacugagacuccuacacuagcagcuccugccagcccuacgcccaggaaagaaccugguaacacaguggggguggccauucuucuuacaguugguucgaugcagugggaccucacuggggcaaaagcgugguggguccugaugagggagcaauggugggcugcggcagagguuggggggugguugguugggccuuguuggggccucgggacugugggucucaagaggcuaccuuagagcaguuagacauuaaacaggagucccaagucauaggcagagauguaaagucuuagucccaaugucugaaguguccguguuggaauaugccuuuauuaauuaagauaaauuuaaggguugguugucuuuggugcuuaguuuguuuuuucaaaagucugaaagguuauuaauuuucaaauacauacagaggaagaaaacuaaaaugaaaucucacugaaacaaauugagaauuuccuauuguaguuuauuugaauucuugagaauuguuaacaaaagguuaugguugaauguuguaaacaaccaggagagugaaguugcaaugucagcagccucacuucugggacauuaccucagcagcauagaaggaaccaggaggauguguauccuuaucaaacaagaguuuuaaggaagugguuggagccaggaguaguauugcauaccuuuaaucccagaacucaggaggcaaagggaggcagaucucugugaguucaaggccagccuggucuauuuguugaaacccugucucaaaaaaaaaaaaaaaaaccaacccaacaccaaaaagagagagagagagaucacggcuuuggaauugaguuguucuuuuuaguuaacauuggugccugugugcuauucugauuagcaguuuggagcuaaaagaaguaucguuaauaguugauuuauuuagcuaugcucuucauuaaagauaaagugggagacuggcacuguuuguaagacaucacaaauauguuucacuaugucuuuauuuuuuauuuuuuuuaaauauauauuuuuuaagauuuuuauuuauuauuguaucuaaguacacuguagcugucuucagaugcaccagaagagggugucagaucucauuaugggugguugugagccaccaugugguugcugggauuugaacucaggaccuuuggaagagcagucgguguucuuaaccacugagccaucucuccagcccucacuaugucuuuauuuacauugguuaaucuuuagcuuuaucauuauaauguauuucauuaaauacauuaaugcaaauuaauauaaaauaauaaccuuucagacuugaaaaaacaaacuuuaaguauuauacaaaagugauuuuugccuuuuuuuuuuuaaaggagauugcauaacagcaugggguuuguuacuuauuggcuuuaaaacauuuuaaagcuuuuuauucuguuuugcuguuuccuucugagauguuuuuguguaacccucccauaauuuauaacuaugggaaaaaggauggcauuuauguagaaacugaauaggaauuaauuucacuuuaaaggauuauucucuauaaucacaaagagaauccccuaaccccccaaaaguuuucauuuuuauacuaaaaaucucuuggaauuucacuccuauuagcguuauaccaaauuuaaauaugugauauaaaaacuaaauuuuuauuuauucauuguucaaggcauuuaaaacacaucaauuuauaauugauauaaaaauacuaugugagaaaacuucuuuguucuaacggugaccauauaauuauuuugagagucgcccuuugcacacuuccucccugagcagacucucuagccuucgugcguuagcagagggagcgaggcagaugcugcgugcggguuucaggguguguggguuaugacuaggcucugcucuguaggagaugagacgauagcaaguaagcagugugucuucucuuccguuuucagugcugcuuuaucaccucacugcuuaagcucugcucucaagcaaagccaagugcaaacucuccaagguaagugcgagccgccgugcugggucacggagcauuguuaaugagaucuaggaguuguaggagaauaagaaauaaacuucuggagaaaaaguaaaaguccucuuuuaccgacauuuggugugguaaaugcauguuuuccuccaauaacucauagugcacaggcauuuuauccucuucuucauugguuuuauguauauuuuuccuugaauguggcauuuaauuucuuaguaauauuuucauuggaguuacuuuuuccuaauauuauguggcccaugauaaugcaacauuuaugaaaaaguugaagaagaaagagaacaauaauauuuugagacauaguaucuacuauagcugcaggaguacuugugaccuugugcuaaagaauuuuaccaucccauagauuaggauauaguucagaauauuuuuuaaagauuuauuuauuuauuuaauguauaugaguacacuguagcuguacagaugguugugagccaugugguugcugggauuuaaacucaggaccuuaggaaaagcagucagggcucuuaaccacugagccaucucaccaacccguucagaauauuuuuuacaaguuuagacuaaagggcuuuaauuuggacuagugaauuggcuucuuauaaaggaauuuuggggcuauuacccaccaccaccacuuuaauuuuuauggcauuuugauauuuaauggguucuggcugaucuucccuaacuccuccuguccaccauugucccgcccccaccuaacucuuccaucuccaaugcucuaacuuucuuuuuugucuuuguugguugauugguuguuuuuuauuguuguuuguuuguuuguaagacagucuaugugacccuggcuggccuagaacucuuagguagacaggcuagccccaaacucacagcgauccaucagaugcugcugcuuaagggcugagauuacaggcugugucaccacacccugcucauccaccccacacguguuuauuuuauuaccgucucuaucgcucucccuucucagggggcccuuaccaguguccccacaucuaccugucugagugcucaccuagguacgcauaugugacacgcagaggcugagcuccacuuggagagaacacgcucucucuauccucgugggccaggguuaccucacucugcaccuccaucucuucuccucagguugcacgguuuccuguugacugccgaguaaaagucuguuguguguguguacguuucguuauccuuucaucugccuguggacaucuagcuaaugccacugcuuugcugugugagucaugaacguacagauguacgagcaucucagaguaagauauggagaccugagugcucuagcugggucauacaaauuucuaccuuuagucuuuggaaauuuuccacacugaucuucauuguagcugcaggagugaauaauggugaccccuuuuccacaaucaccacuugucacuuguuuucuugaugggagccacucugacaucguuuagaggcuuuuuaaaaaacacaaaacuaacagucucauauagcccaguuggccucuuaacuugcuaugaccuugaacuucuacccccaucuccagaauauuggcauaacaggcaugcagcagcuuuauguugugcugggggugaacccagggcuucauucgugcuggcaaauuuuguaccaagacuacauucccagccuuccuuggcaaguuguuuuuuuguuuuuuuguuuuuuuguuuuuuuuuaauuugguuguuugcuacuuaauuuuuuuaaaaaauuccuuuggauauacucggaacagauucucuguuguguguaguugggaaagguccucuuccacccuuccucauucagaaucagccguuagcuguuacacagaaagcugucugauuaggagagucuccauuugucuguuguuggucuuacuuccuuugugacuguccuuaucagaaagucuuuaucuaugccugcaucuccaggguauauccuacuuuuuccuccagcaacaccaauauugagggaauucuuuuguguuguaaaaacaaauccagagauguauuguuucuuucuggaggugcuaagacucaaagccuugugagcuuuagcaagcuccacaccacagcacaucaugucagaugagcagagaugaggcacuugcaagcauccuacggaggaacagaccugugcuccugugggaaaacaggcuggaaccacaagggucuccucuggaagaaacaaaauuugaaugcaaugaaacaagagcaagaauagauucuaagaacuuccuagaauucacaaaaacuguguugggguugugucuuacugucuaugguaauguugagcgugauccuccagacccagagucugcacacagccuugguugccagcagcggcuccuuccuugcucuucuugcuugggcagaugaggguuccuucccuagccacagcgaguuaggugaggagugugggugauagauagucuagacugacacagcauuuuugagacaggauuuuuuuuuauuguguucaaggcuagucuggaauucaugauucuugugcuccuguuggaauacccugugugaggucauuuuguaaacccugugaaguagcauacaccuaaucuaaacuccagaggcagaggaucaggauucuuaggcuagucuaugugacauagugaggccugucucuaaucacagaaacaagcaagcaaacaaaauacauaguacuggggcuggagagagagagagagagagagagagagagagagagagagagagagagagagagagagagcgcacagucaguaagaugcuuccuuacaaagcccugagcaggagcccuagaacccauacgaaaaagccaggugccuauaauuccaguucuagggaggaggagacaggguacccugggcuggcuugccgauugggcuugccuacuucacaaguucuagaccaaugagauauucugucucaaaaauuacccccaaacaaaaaccaggagaucugauggccuugucugggcucugcaacaagcaucagagacacagauguacacagacaugcaugcagggaagacacccauauacauaaaauaaaauacuucuguauacaaauugucaguaagaacuucuuuuguacuuugacuauauggguuuggcagcuuuuuuuuuuuuuuuuuuuuuuuugagugaaaaagaaaucuaauuguagccuuaauacucauucaaggaaaaugagauauugaaaauuuucaugcagucacuauaaugaaccguuaugaaguaaguaaggcucauugugucugaaauuuuuugcaccaauguguaggcgugaguuuuauaguggaaagagaagucuuuccugaaaaguccauugacagugaguuuagaaauuggcaggcaugugguaguuccaugucuuuuaacaaauuagcaaguucagagccgggcugcggugccacaggccuuuaaucccagcacucgggaggcagaggcaggcggauuucugaguucgaggccagccuggucuauagagugaguuccaggacagccagggcuacacagagaagcccugucucaaaaagccaaaaaaaaaggaaauaaaugaauaaauauuagcaaguucguuugcuaugucaauuuuaaguaaguaauaacuaugugguuuuuguauugaauucuuauuguucaaaacugugauucuaauauaguauacugguauauaaaauauauuuuuauauaaaaauaugccaagauugccuuuguauuuugaagagccucguaaauuuagauagauguuccauaacaaagcuacacaaugaguaucaauaacaaaaagagugaccuggcuucuacacacaugugcauacacaccaguauagacaugagcauguauguauguauguguacacacauaagaccuaguaguucuuauaggcguuuguauaaguauggcugaacaugaucaauauuuugauccuacaguaacuucauuuagcacuuaaaaguucaggucauagagugaccaguuaguuacauggguuuuuuuguuuguuuuuuguuuuuugggguuguuguuguuguuguuguuguucuuguuuuugguuuuucgagacaggguuucucuguguagcccuggcuguccuggaacucacucuguagaccaggguggccucgaacucagaaaucuaccugccucugccucucgagugcugggauuaaaggcgugcgccaccacgcccggcucaguuacauguuuuuaaucuuucaaauauuguauaauaaauguaaauguauuuuauaacaauaagcuuauccaggguaaaugcuaaaaaaacaguauuaugcauucuagcuaauuuaguuuagagguaacucuggaaaggcagugauuguucacagucguuaugaaugaaggaaggcaaucuuacugcuugcaucucucuauuaucuuugacauaauacccucaauaaacuguucaaaaucuuaaaggaaaacaaauuguaaaauaacaaguaauaagagcuugggaucuauauagcucaguugguagagugcuguucuagcauguggggauucugucuccauauaaacugggaauaguaauacacagcuggaaucuaggacuucagaggcuaaagcuggagaauccagaguucugugucaucuucagcuauaugagacuuuauuucaaaauuguguguguguguguguguguguguacaauauauauauauggggugguauauggaggugugcuguuuuuuuauuuuguuuugaaacauggucucucuaaguagcugugacuggcuuggaacuugauguguagaccagguugguuuuacccuugugguugugagccuggccuuccgucagugggugagccuucuuuccagacgcagguugauucugaaagagauguuccuuugcuuccucaugcugggguugaaggugugugucaagacgcugggccggcagcguccugaugcugaucacguuaacugugcagagcuugcucucaggaagaacauuaaugcugucucuccucuccguuuucagaaucugacauugaugcagccacugcaaugauacuuuuaaauacuucaauagaacaagagauuuuagaauguaagcagucauccuuuuuaaaguaaauguuauaaguguguuuucaagcuaaugauauaaaauauaagaugaucaagugccauaacagaauucuuucuuuccucuaaauuguguuuuaaucugaaugacucgguuucuuuuguuugcuuuuuaauuuuauuuuacuuauucauuucacauccugcccacugcccccucccggccacccccaaccacaaugacucaguuucuguuucuguggagaucugagaaagcgcgguuaaggcugugcaaaaguauugauaaaucaguguagggaggaaacgcuuuucagguaaacucgaagagcuaaaagcaaagacgaaagcucaggucagucccacggaccuuuguggagaagugauucucagggcuucugcccucugauuucaguagcgugcgcgcacaugcacacacauauuugcaaaauaauuuuuuacagguuauuuaaauuuuggaguaggaguauuaagguauaaauugcaaagucuacuaagaaaagauggacaaauuuaguuaaagacaauagaguauguuugagaacaacagaccagcauaauugggaggguggggguuagugcuggacccccauuaucucagcaccuggagacugggugagaagaucagggguucaggcuggucaacaagcuugagaccacccugggaggcugcauggguuuagaaggcuugccuaccacauaccaggcccugggcaaguuuaacccuccaagcaccacaaaaacggaagggaaguaaggcagaauaugggagaauucuucuuaacuauguauaauagacaaaagcuuaauauuaugccuguguguugaagggugcaccuaguaagaaacaaacaaacaggacccacaacugccauucuagucuguggggaagaggaggcagagacugagccagaggcagugggaacguggugucuucagacacggcaguacugaaaaggcucuacagguucaaaacagacaaagcgcugcacuaaggauaaguagacaccgaggcccacuccugaucaagaagcaguuuccugcuggaaagggaaaauauguuaucuccaaccuuaggccucaugccuggggguaguguuuugcuuuuauuuuuuauuucauuuuugucauauuguauuuguuugguuuaguuaaucuauuucaauuuucaguuuuuguauuuuguuuuuauucuuuggggguuagagagagagggaggaagaauaaaguuagguggggagguggguggggaggagucaggaaagggaaagaguguuauaaaccuuuauggcacuaaaacauuggaauaaaaacauuuuaaaguaaaaaaaaaauucaggacagaagaaaaguuaguuggauauaugaaagugaguuuuaaaagaagaaagauggaggaauaaaaacuaacuuuuaagauacuaucuuucaaauguaaaugauugcuauuauaauaugaaaauaguuuguuuccauacacuucagggcuguuucagccaugcgucccaggguuaaucugacccuggcugaauuugaggcagauuucccucccuuuguacucagagcuuguguuugccaucccuccuaggaacucuguguguguaacggguauccgacaaacuugauugcuccagcguuauuugucgcagugcaaacuuagaaacaauguaaacacccacaaggacauuguuaagcaguggugugggcauacugagacauucuuugcaaauaguucaaaguuuuuuuucaaaugguuuuuaaauguuucagacuaauaaguguagauaaaauaguauauugggggaauccuagaaaacuacuaaugagcucuuauuacucaaaagugagaguuuucgggggucugaucuuacaagcaaauaccucugacuuguugauacaaguuuucuuucucacaggugagaagccacugccucuuaaaacaucacugcagaagaagaggaguuacggcagcgcguucagugcccccggugcugugcgacugcaggagagcccgucuccaaccgccggcaucgacccaaaagccgaccauaacuacagugccaacagcguggcggcccagcgcugcgcauccagggcgagcaugucuucucuguccucuguggaugagguguaugaauucaucccaaagagcagccacggcgggagcgacgguagcgaaggcuuccacagcgacgaggagacggaugcggaggacgaggaggauccucugggagacaguggcuacgcaccgcaagcucguggacacaguacucugaaagggcagccaggcaaaaagaucccaaaacaguccugucaagagauugaugaggagcucaaagaggcagccgggucgcugcuccaccuugcuggaauccgcaccugccuugguucccugauaaguacugcgaaggcacagagucagaagcaccgggaaaaguagacaugcgcagagugugaaguuacucuaaaguuacucuaaaguuacucuucuacucaacuuuuacagggaugucagagccauagcggacggacggacggacggaccucuucagcugagggugggggagggggccacuuguuucuuucuaagucuguuuugguugcuuuucuuuuuuuuuguuuaauuaaucaguugcucuuaggaucaugccuaauuguaaaucugacauaaauggccccacaauuuaauuucugugaauaagugucucccagauuuggaaaauuuuguauaggagaauucucagccucugucuuaaacuuacaggaaaaaaagucccuuuuuuuaaucgguaaaaaauugguaacucggacuuuucauuuuucuucccauucugcuauuaacuaguuacuggcaucuuucucacaugcuucucuccugacacacugcagaaggguggaauggggaucuuuugucuuuguuuucagguuacucuuuguuacagcaugagcauagccuuuugaauuggaaagauccuagaugccuagaagguucucugguuuguagagaauauaacugcucuaaggauuaggaaaggccauuuggggauguggccaucuuaagacuaauuccuccugcaauaguuaucuuugaaauguuuuuaccucgcaguuaaugcauagcuucacuggggccuuuaccuuuucccagaauacucugcaaguguuuaaguuuuagcugcuagcugucuuaguuaaguaagaauugucugaugagaggauacagccagagcgugucauggaaugacagucaucgugacacacuuguaccgaaagagauccuugcauuuguuuucucagcguacuguaaugaagauguguuaugacaucauaaguaaaggaaagucaucgagggcaagacucuccaaacuuuguauaauugaaauuaaauguguaaugaauuagauuuaaaacauuauuaaauguucccauuaaggaaaauacagagauaaauaucuucagggauuucaaaauauauguaaaaauuggaucuuacacaaaacucuuugagaaggcaauguaauaccuguaugugccauuaauccacgcuaaaagauuuuuuuauacuacuauuucaaaagugcauuggcuaagauauuuuaaguauuugaauggaacugcuuauauaagucaguuuucauaucacuuacaguuugauuauaguauuuagagcagggauacuaauacuauaacucacauauauauuuuuuuacaguggugagagaaacuuugggaaaguuuagucuuauuucaugauacguccuguauucuagacagcaaccuuugaauuuuucucauuuauauggauauauauacacuugcuauaugcaacauacauaggcucagguuaguuuccugcuuucaaauguuuuuaugacuauggacuuuuuuaaagagacaaauguuuuuauuuuuacuucuaauuucuuucugggcaauacugucaaaugagaagaaaaacagaagcccuguuucuuaauugacaccacuuaagcuauaacaguauugauauacucccguuuccauguuaguuguaauuaaaucuggauagccgacuuaauggaauuggugcuacuaaaauauagacauuuuucuuuuauugauaaugcaggaugaagaauuuggaauuuuucuaauucauaaaugucaucuuucuagaaaacaguuaaaugaaguuaguuuuuacugcagugaauaaaacaccaagcagaagugugaaguguggucuuaucgugguacaagucuuaaagagaugguagaguucaguggauagcagggaauugugaagcaggucaccacgcccuucuggguggaccugucacagggucaccacauuccgugcuucaccagcaguaugucucucaaggcccugugcagcgggcauguuguucugcaaauggaggaaaauggucugaaguaggaggaaagaguuguucucagcuccaagagaaagaccucuccagaauucguguuuaggcaguaacuuaaauuccuuucccuccuccuucaaauggccucuuacuuaaagcaacagccauuagcaaggaugaugcaugcccgugcacucaagacuaauaagcaguguucucuaacaccuugcacuuggcucucuuacaaggauucgauuucucacuuuucauuugcugcugugucuaagcauccuccuucaaggggagagagagccuuugagaucuggucccuugugauguucuuagagacagauuaugcuccuguuuggugugcucagauugaagccuggcuuggaaccauccaggcgacgaauuguaugggcuagaaauucccaauagauaacaagcuuuguguaugaaguaaacacggcuuagaaauccagggacagcccaggucucagugauuuaaagcugguguuggcuaagguauacucugccuuacaccgaaacaagaauuugguuggaacgaauuccauuucuaagggaugccuaaaagaaguuguguccuacuuagcacuguuagcuucauuuuccacuuugccaagagaaucaguguuucuugaguaugacuuugaaauuugugcaauauauuacuaaaauaguugauuuuuuuuuuuuuuuuuuuuugcuuucaaauuuagaacgaaacauugccuagaucaguagaaaagcaaggggugugucacccccuuuccuuggagccuuuucugcucucauagccagcucuacuucucuugacugggauuccuuuguacauuguaaaguugagcauauguucucagugcuuucugaggcauuauguaaaggguucauacuagauggucaguuagauacauguuagcauuagcguaguucaaagcuggagcaggcguugagggaaugcuugugucuuguagacuggaggccuuuucaguagcuuaggcuguugucccagauggacagcagcuuaaugccuuuugaaaacuauauaaagcgacuuuugaggcuuucagguuuacauguaugucguagguauuuuuuuuuaauuuugaaauguuuaaguuuuaauuaaaguuuacuccaguauguuaaugauguagucaaauauuuauugaaaggcaaaauagaauauuuuaauguuaucccugccauuuuucaagaauauucuuugcaucuaacugccagugccauugucaaacuuguuuucaaaauuguuguacuuuuuuauuaaacagagugcuuaauuuuaaaguauuauguugccaucauauaguguauaaaauguaaaauugccaauucauuguaccuauuauuuauuuuuaaacuaaaguauaagaauaccuuuugauugaagaaauuuguuauuaaauuguuuuuuuucugauguagcauaaaaucuucugaguuuaacugccaauagaugaccagccacaagugaaccacuucucaguugccagccuugcuuauagcagaagcaacuuacaaacauuuaguuuuuguaucuaaucucugacuauuaaaauguuuauaaaguuuauuuuuaccaaagagaugcaauucauuaugauaaaguugcagaauaaaugucguuuuauaacacuuu

SEQ ID NO: 8783 - RNA, 5049 nt, Mus musculus
ugagauggucccuuacauuauacagcccagguuagccccagacucacggcaaugcuccugccuccucuuuucaagugcuauaauuguaggcuugggccacuacuuuuugcuaggcuucugacaauuuuaagaugcuacucaucugucuucuauuagauaucucuggacagaacaccaugaauuaaauuaguuaaucagcugauugucucauucacgcacacaggccuaugcuuaugccggguaggugaguagguagaccagguuguuacagaaaauaggaugagcccuguucucuaggguucuaccucacagcagcacucacuggucaguuuaugaucuggggaaaaaaacaacaacaacaaaacacagaggaguucucuuaaagagaucaucaccauacuauguaaaugcgaaugggaagaaaauaaaguuaaaggacaagggcccucaaaugaacaauaauaacaauaacaauguaagagcccaguuucaagggaaaccucaccacugcacguucaaacccuaaccaaaaccaucugaauaaggggauucuaggaccccaguuugaaaacaagaugaguaguucacucuggaccugucuagccaugugcuaaauucaggaaggaggaggggcaauuuuguagaacuuuuguuuaguuagugagagagagagagagagagagagugagugcuuucuugugggcuucaccccacauguccaggcagcaauucugugcaagcgaggaagaagagcaccugucccagguggacaaacugcucagcguaccucaugaagcaagcagugcacuggacagacauccaucugucuccacacugccauaaccguagccuacacugagggggugcgggcugaccucagagacauuccccuuugugacaugccuuuugugauccgugcagccugcuuaggcagaacaaccgaaggaagagcuaugagaaaacaucaaggagguccuaaccgucucagaccgaggagggaaucccacaccaccacccccuuuguuucuuggagacggacagacagucgcauuuccuacuggcuucugugcugagguucccaccaguccagcaucagccagcauaaggguuaaacgcuuuagaauucucauucacugaaggcugguucuuguugccuagugacugcugcgcggcucccugcugucauucaccuugucuccagaguuauccucuccucucauaaaggagguuaugauuggacaaaggugacaucauagcagaagaaaugcauugcuuugucaagacaaccccaaucagaugacccacgagcugguggcagcacguucagauuccuuuguuuuagugucuuucacacugagcuaacacacgcuugggcauucuccucucaaauggacauuucucggaguguuaguguuguagguguugcugauggauuuuugcccauaaaaauauuccuuaagaucauguggauucucuuuacacccauuuaaucaaugcuaguagcccagccaacacggucccugccaaggccuuggccagcacucggggagcugcagaucacaggcagcaaaugacugccugcagcucauuaucgcagcccuggggcgcagcgcagaguccugugagaggcagcucuccucggugcuuaugugagaagugucuaaagugcuuccgaagcauccaccucaaggcuggcuucagaauacagcucagggcacacacaggaggcaucuaaggaggaacgccagggaaaaauagugauuaaagugaaagaccuaccuacuucuaaaaccaagcaguuggacacaucucacacuguuuagauaagaaacacagcucuuugauuacuucugcauaugacaucucgaauguuggugcugcucugagaaccgagccuuacacuccuuauuuuauucugcaacucacaccagguacaccaaacacacgcguauuucagcuacugaagacacugugcgauugcaggguuucuugcagccucauugugcuuggcugcugaauuaaguccuaaguuaaacgcucucucuucuugguaaauauuuaguauacagcauugucacugcugguauaauuggauaauugcuuccaauuaaugcucuauuucagaagcgacaacuccauaggaagcuuaguugagcuguaacaaaggcagacccccaugggaaacugaagagaacaaauuccguuuuguaagcaacuagagagacagagacagagacacggggcggagggguggggguggguaugauauauucucuacagucccgauuauaacauccacgaauaaugaagugcauguugucgguugaaacccgagaggacgacacuccgcucuacccaaagcuggcuguaaguagcugaacaucacuauuucuugcuugaauaaccagcuuguucuuaaugagaauuaaagcuaguccugaggacauucaucuaaaaccagggaaagagcauuuacacagaagccaggacacaggaauauacuuagaauuaucaagcauuuuuaggaaaaaaauucauaaaauuuccuuuaaaaaucagaucgcagguagcugugcugcauuccuuuuaucucagugcucugaaggcagaggcaggaggaucucugugaguuagaggccagccuggucuacagaguggguuccaagacagcgaggacuacacagaaacauuaggucuugaaaaaccaaaccagaccaaaccaaaaaacgaucaaacaauagaacgacccaaacaacccucccuaacccucaaaaagucauucagauugggagauggagagaggucuuggcaguuaacaccaccuacugcugucugaggucccugguuuacuugccagcuccuagcucacaaaacaccagguaacucauuccaaggguccaaagcccucuccugcccugcagugagcagccauaugcacaucuguguagagaagaauacacauacagaaauaacaagucuuagaaaaaaugaagacagggacuggaaagauggcgcagagguuaagaacaccugcucucucccagaagacgaggcuucaguucccaggaccagagagaggaaguggcucacaaccauccuuaccucccaugcuaaggcaucuaucugacccucuuuggauccccacgcaccaggaaugcuugugguauacugugggaaaacugauaacauacgcuuaaguccacuaugacuggauagccuuugagcuuggugaaauaugggagacucccuuccggucagcagggcuucuccuucucugaccuuguccagggaauucuaagccccuacacuagccucuaccugaggaaugucacguugccucaauuaguuuaugagaucaauuuccuuucuccugacaaaaccuguucaucgagccccugagauucccucaauugcuuccccaugcugaagagguauuccagguacccuaagcccccagccaacaagugaccuuuguccauccuggaugucccuacccucagucccccaaaaccuuaugagccuucaaucacccuaaguaaaguugaucugccuccugacaagcagucgcaguguggucauucugacaaggggucccaaguauggccauuucccauacguacucgcaggguuuccaaaccuaucccuaucccuaccuaccucacuguuucugcuccccuugccuuugaggacugaauugguagaccauccaccagcgugaggaggcccacaguguacauucauacaaacacucauacacuuaacauaaaaucaaccuuuaaaaaagagcguagaagggcuggagagauggcucagcagcugaguguguacuuccacaggaugugaguucuagucuucauggccacauggcaaguuuguaacuccaaugguuugaagcccucuucuggcuuccuugggcaaugcaugcauguggugcauagauguacaugcaugcaaaacauccauacauacaaaauauuuuuuuaaaaaaugcuaaaaauagggaacagagcagaauuccagacagcuuucuucuuucuguacauuuuguucuuucacccuccugugacccucagacagacccuggcccuagacaacugccuuucugguuucuguuucaacguggcccgacuucacauugucccguguccuaccuuuuaaggacgaauguucugcugugcaucuccccuuuucccuuuacucaccuucugauggacgacgugcugucaucuagacgugguucuguugaguagugucaccgucaauguugccaggguuuuagggcagaagcccugguuuugcaagucucaacagaugacccuuaccuacaucagacauuaaaggcacaauguggucagauuaggaaaaaacagggaaauggguuuagugacacccucccaagucugucuucaagcugcugacguugagaucuuacagaacgagaagugaagggagcuggagcagguacuccgcgggagugugugauuuugcucagcgagugaucgaucacucaucuuggucuacuucugcaaggggaaucugucaaagucgguauuacugucaucacugagaacaagcugguuccuaugggauagaaagucuugcucugcggaaaagcaucgcugugauuccugucaucuuguuaggcuugccaggaagcugaagagcaacucagcucuuucauaaaggaaagcgggcaguaauagaagacucagaguggccaaacggcguugaucaggcuagcgaagggugccuuccauccuuccacacucuugaguaugugccacagggcucgaacuggaucacauaauaaccuuauuuuuauuuucuugagucauguucacauugcuuuucaaaguaaccauuuguaauuauucaagaccucuaguucuccuacauccucauacaaaugccaacaaucucacucucacucacguguacacacacacacacacacacacacacacacacacaaaguaacaaaacuucagccuagaggaacggcgauagcccguaagccaagcuuugacguggcugcugcaggaagauuug

SEQ ID NO: 8784 - RNA, 5638 nt, Mus musculus
ucuuuucgccucugcaaucaagcucucccaauaaacgugugcagaaggauccuguugcagcgucguucuugcuggucgaguccggugcgcgcaagaaguggugccagaaacccgggacaagaaacaucuucaggcacgagagaagacccccuacuacagggaggauucagaacugcaucgcggggaaggagcgguuaauagagguucccguaaaacagacugcugagaaggauccggcguggauucagaacucuucagcuggggagcgguguuaauaaagguuccugcaaaacagacugcugagaaggauucaacugcauggauucagaacucuucagcugaggaacggugguaccgguaaguguaaagaaauuaauguaaaucucugagaggcaugcucuccuacgaaguagauccauuaauagucgcugggauugugcugcuugcuuguuuucuugccuuaauuuuaugcuauugccuuaauugucaucgcccugggcacgaguguaucugcugggaauaauuucacguagauaacgcuuuaguccaggacgaucauggguaauggccagucuacgcccuuaguagggccggugcaagccuugcuuaaagaaagggguuuaaaaauuucagaaagcacagugagcgguuuuuugagagaaauagacagacuugcuccuugguuugcccccacugggucgcugacgcuaccuaguugggaaaagcugggaaaagauauagcaagagaggaaguagaugggaaagugaaagcagggacaaggccguuauggaaauuaauuaaggcuuguauccaggacaagaaaugugagcuagcuguuaaagaaggacagcgacuuuuacaggagcaacaggaaaguaugucagaaacagagagaaaugaaaaagaaagcgcgcgcagaaagauaaguaaagggagagaaauaaaaggagaaaaggaaaagaaaccaaaauguaaagauacaaaagauagaauaaaaauuaaagaacagaaaauuaagucaauuuacccuccucuggaggacuuugaguuauuagaauugucuagcucagaggauucggaacuaucagaaggagaggagaaaaauuuggaggaggcugcugcaaaguguaaggcagaaagaucugguccaauaggaaggaguaucagugcucccccaccaccuccgccuuauacagauaagaaaacaauuggcuauggccacuccuuuugcacuccuaaagggcugcaaaaaauaugucaggcuuuuccuguuuuucaggaucaugcucaacagcgauauuaugagccaauaucgcauaaacaagugaaagagcuagcagagucaguaaggaccuauggaguuaaugcaucauuuacucagucccaaauugauagauuggcucacaaugccaugacuccuuuugacuggaugagugugguaaaggcaugucuuacgaugggacaguaucuagauuggaagucuauauggcaugaucuguguuugagucaggcccgugcuaaugcuacugcagggcaacaagcauggagcuuugaaaugcuuacaggucaggguauauggacaaauaaucaauuaggauacccagugcaggucuaugaucaaauuaaucaggcagcagugaaagcuuggaaagcauugccuaaucgaggagaaguaucugguaacuugacaaaaauuauucagggaauuaaugagccguucucugaauuuguagcucgcaugauggaagcggcaggacguauauuuggugauucugaggccgcaaugccauuaauugaacaauuaauuuacgagcaauguaccaaagaaugcagaaaugcuaucacaccauggaaagggaaaggaauacaagcauggaugaaagccuguagagaaauaggaggaccucuuucaaaugcagggcuggcugcugcagucuugauggcacaaacaaaagaaauaaccugcuauaauuguggacaaacaggucauuugcaaaagcaguguacaaaggguagaaagaguagguuugaaaagacaguaccagguauuugcccaaaaugugggaaaggaagacauugggcaaaugaauguagaucagucagagauauaaaaggaaggccaauaccucaguuuaaagggcaacagccaaaaaacggagugaggggcccccguccccagggcccccaaauguauggggcauuccagaccacaguguccaugaggccacccagagaccgaggagagccacuccggguucagcaggauuggacaucugugccaccuccagaguaauucuuacaccucaaauggggugccagccuauuucaucagauuuuagaggucccuuaccaaaggauacagugggccuacuguuggguagguccucuucugcuuugaaaggauugguaauacaucccggaguuauagacucagauuaugagggacaaguuaggauuauguguucugcaccccgagguauuguagccauuucuccuggagaucgcauugcucaauugcugauucuuccuaguuugcauaacauguucccuaguggccgggacucgcgaggagauaagggacucgguucuacaggaaauaauguggccuacauaucuuuagauuuggauaaucgucccacuuuacaauuacaaauagaaggaaaacccuuucaagguauaauggauacaggagcagauaaaagcauuauaucuaguaaaugguggccugcuucuuggccuguuaaucaaucgucacauagcuuacaaggauuaggauaugaggcuaccccaacuauaagugcaaaauccuuacaauggaaagauaaagaaggaaggacagggcuuuuucaaccauauguacucccuuugccuguaaacuugugggggagagauguguuaucagcuaugaacuuuguauugacuaaugauuacucucagaaaagcaaggaaaugaugaaaggaaugggauauauaccuggacuaggucuuggaaaaaauuugcaagguagaauuucaccaguuaaagccacuguaaaggcagacaagaaagggcuggguuuuuucuaggggccacugaagagccuuugcccauuccguggcauacggaggacgcggugugggugccucaguggccuuuacccucugagaaauuaaaagcagcuaaagaauuaguacaagaacaauuagaccugggacauguggaacccacucaaucacccuggaacaccccuauuuucguuguaaagaagaagucagguaaauggagauuguuacaugaccuaagagccauuaaugcacaaaugcaaguuauggguccuguacaaagagggcucccccuacucucagcucuaccuaaggauuggagaauuauaguaguagauauuaaggauuguuucuuuucaauuccauuaaauaagaaagauaaaccuagauuugcauucaccuugccuucuauuaaucauauggaaccugauaaaagguaccaauggcggguuuuaccccaaggaauggcaaauagcccuaccauaugucaguuauauguaggaaaagcuuuacaaccgguuagggaugguuuccccuccuuaaaaauuugucacuauauggaugacauuguaaucuguggaccugaagaagaaaguauacagcaagcuuauggcuugcuuaaugaaacuuuaaaaaauaaugguuugaguauugcaccagaaaagguacagcagucuaauguuagucauuuucuaggagccacuauuacuuuacaaugugucaccccacaaaagauuaguauuagaaaagaccaucuaaagacacuaaaugauuuucaaaaauuauuaggagauauaaauuggauuagaccuuauuuaaggaucccuacuucggaauuaaaaccuuuauuucaaauucuagaaggagacucacauauuaccucauugagacaauuaacaccugaggcuucugauguucuuaggaaaguggaaaaggcgauccaaacagcacaguuaacucguauaaaugagcaagaaccuuugugccuaugcauauuacgcaccaucaaucugccaacugcuguguuauggcaaaaugguccuuuaguauggauacauccacauauauccccuaauaagacuauagagcauuaucccaccaugguagcaaauauggcccacaaagggauaaaaacuucaaucacucacuuuggaaaaaugccugauagcauaauugucccuuauacugucgcacaaaugcaaauauugugugcuacuauagaugaaugggccauucuuagaugcaguuauucugguuuaauugauaaucauuauccuaaacauccguuauuacauuuuauguuauugcauccaguaauauuuccaaagguaacggcuaauaccccuauaaagggagccauugauauuuauacagauggauccaaaacaggaguuggaaguuauguaaucaaugaaaaggcuguaagguugcaauuuacaccaggagccccucaauugguagaauguuuggugguuuuagaagucuuuaaaagauuuccuaugcccauaaauauuaucucugauucuauuuaugugguuaacgcgguucuagcauuagagacugccggaaauuuuaaacaguccaguccuguaucugaaauuuugaugaaaauacaaaauuguauuuugaugcgugagcaucccuuuuauauucaacauauuagagcacauacaucauuaccuggaccuaugguuaagggaaaugcaauugcugacucagccaccagagacaugguuuuccuaucacaaaguuccauagaaagugcaaaaaauuuucaucagcuuuaucaugucccugccucuacauuacgacaaaaguuuaagcucacaagaaaagaagcccgagauauugucuuacagugugguaaauguguagaauuuguuaaugcaccuuccguggguguuaauccucgcggauugcgaccccuagauguuuggcaaauggacguaacgcauaucccaucuuuugggaaauuacaauauguacauguauccaucgauaccaguucugguguccuacaugccucucccuugacaggggaaaaagcaguucaugucauaucucacugcuuagaggcuugggcugcauggggcaagccccuaguguuaaagacagauaaugguccugcauauacuucuucuaaauuuagccaauuuugcaaacaaaugcaaguaaaacauauuacuggauugcccuauaauccacagggccaaggcauaauugagagagcccaucgcacucugaaacaauauuugcaaaaacagaaagggggaauagaggcuaugacgccaaagauggcucuaucccuuacaauauuuacucuuaauuuuuuaaaauuggaugaugcuggaagaucaccagcugaaaggcacggacaauggccucaaucgcccaaugaaauggucaaauggaaaaauguccuugauaauaaaugguauggcccggauccuauuuuaaucagaucccggggagcuauuuguauuuucccacagggugaagaaaauccacuuugggucccgacgcgacugacaaggaccgugaaagagcaagaugaaccccaagaugauucuccugcuccugaugauugagaccggg

SEQ ID NO: 8785 - RNA, 1855 nt, Mus musculus
ugauaucccaauuuauuuacugaaagacaguuaauucacaucacuucucuuucucuucucacccucuuuuguucccugcuucccucuucuaccucuuccuuggcugcucauccuguugccuuccuagacuuucaguuccccugacuuacacugguuccuaggagucacaguguuguaaugggaaggagggcucuuuguuauaaauaaugugagcaguaagcagaucaacggaacugacgcugaguggacggugucaagccuuuuuuagcaguuugguuuugaacacccgguagaacaaguuuggcccaauaaaaaaaagcagaauuccuucccuuuuaagagcucuaaagacacugguuacuuuuaugcagagggguaggggacagugcuuuuugcccaagugauucagagggaaggaucaccuggcugagaagggagcguugccuuuuagguguuucccgcaucgcguccacgugccucuaugauguguggagaaugccagggagaggcaaagcgggcggguuuuuuucggaaagcuagaccagccucccuccuuacauaggcucguccucugcauugcauccgagcuucggugauuugcuguuuggagacugcagauuugcauagagccccuugcuucaccagcgugugugguuuuucaguucuuuuauuuauuuuuucuuucuauuuuucuuuccuuuucuuucuuucuuuuucuuuucuuuuuuuaaaauuuucuccucuuccgcucuuucaucugccccugcuuuuccuccgcucgcuuuccccaguucgaucccugcugucuucacgagggugcccacuucccucugaacccaucgucgggcguagugucaggaggcggcggacucggagauugccucuggagcaggcgaugcgcgccgcugcucugcgcgcugcccgggugaggcuggcgggagcuggagagcuggccagggcugaauggagggacagggugccuugcguccauggggucugcuucuuuccugaaaggaggcuggaccggcgaaguggucucccaguuccccgcgcacaaugcuaaauggauuuaccuaguggauucccgguggauggcugucauguagaagugaagacccuccgggaggagcuuuaaacaauuuccaggcuccccaaccccggcacacacucucgcccgaaacucuuggggaguaucucuggagaaccuggagcccugcaaaccuggaagcagccacccuuucugcgcuugcuguucuucgggucugcuuuuccggacaaguccuccggccagcuacauucaccucggcuauguuucggauuguuugggguacuguuguagggcacugcagacuccaggacccugagaagacuguccgaaggagggagaggauggcugcccuggcgcgguaaggcggccaauccagcagccaaccgcgagccgcccgauccccggcuuccucuucucuucuugugccccaaacuuugccucccgcggcggcugccccuuggcgggcgccccgccauguaccagaggaugcuucggugcggcgccgaucugggaucgcccgggggcggcaguggcggcggcgcaggggggcgccuggcccugaucuggauagucccgcucacccucagcggccuccuaggaguggccuggggggcauccaguuugggagcgcaccacauccaccauuuccauggcagcagcaagcaucauucagugccuauugcaaucuacaggucaccagcauccuugcgaggcggacacggugggucugcaaugccaaguucuugcggguuauccucuugcuuccccucuucaacccugcacuugaucgcggcgucucggcccuua

SEQ ID NO: 8786 - RNA, 959 nt, Mus musculus
caugccaugccagcuagcacucugcaaagggcagccagagagaagccccugccagcucucaaagcagagccuugugcagcaccucagccguccuugcuuccuagaggugcucauggcugcucagcucaaggucagauguuugcccagauuaggauuccagucuccauccugguauaaccacaccccaaaccuucuuuucaauacccccaaggacaggcacucgcugaaaugccagaacauggacaucagcaggccccucgacgcucgagccgucccacagcuucagucaccucagcgagugcuccugccucuccaccagaccccacgugcacccaguggcccugccaggccccugcccgccaguccugcagucaggcaggcccagggcauccgaaaacccaguccuccucagaagccucugccugcugauccacugagcaggacuucucggcucacuagugccuuggugaggaccccagggcagcaggaaccugggcaccgcccagcccccaucagaccugccccuaagcaucaaguacccagaccuucccacaaugccuauaucaagugagaagccagcccagaccgguccucaacagugaagacagaaguuuguacuaucuucaacuccauuggaguuguuguuguaccaacuuuccgaguuucuaaaguguuuaaaacaccauucucuccagacccuggagccacuggcaucggugcugugcuguggugcuuuguguacuugcucaggaacuuguaaguuauuaauuuaugcagagugucuauuacugcgcagggcgccguagcaggcauuuguaccaucacagggcuuuucuacagaaggaaggcuccucgugcuuuuguuuuucuggaggacuugaaauacccugcuugaugggaccuaagaugagauguuuacuuucuauucaaggccuuaucggaaaauagcuccccaccuu

SEQ ID NO: 8787 - RNA, 25422 nt, Mus musculus
ccacacuuuacuaguacacuuuauuaacugucugauauguccaaaaggucaauuuaccauguuaucauaauuuggggauaaaauacuauguuaugucuaugaaagauuaucuucauuugucgggagccuuaaguugggcagcauuucucuuauacuucucuucgaucucucugauguuuuccagaucuucagacaugaauucuucguacucucugucggcuuuagcauuuuccucuucaagauguuucuaguggaaacaaugcacaguuuuuaauguacgaacacaaauuuguuucaaguguaauauuuacauauaagaauggcauuuauaggggcuggagagauggcucagcaguuaagagcacuuacugcucuuccagaggaccugaguucaaaucccagcaaccacaugguggcucacaaccauuuauaaugagaucagaugcccucuucuggugugucugaaaacagcuacaguguacuuacauauagaaagaaaagaaugauauuuauaaauuuaaaaaagaaccaguuagaugaaauaguagaugacuguaaucucaacaccugaaaggcugaggcaggaggugcuacgcauacuccagugacgucugcuugacaggccaagaggccugaaagcauucacgaggaaaagaguuucaaggaaacuaugccuccuggaaccuuggcauucucauagccuguaucccugcguuagaauggugaaugugcucuuucaguauuguuuuaucauaagugccuuuaaagauugaauucugacauagcuaagccuccaucaguguuccaauguccuagaacauccuugaagcuuggaauuuaguaggaauucaguaagaauguuaccuauucaguaacauucaaauuuacuucuaguagagauggugaaacuaauuagguguuacaaagaacggagcuagaguagcucagggcuagucugaagagugauuacuuaggacaguagacagucucacucaaacaagggaauacacaauggccuagccgaauagguggguuuaccaugaaagaguuagggaaucccccugagucaggucucuucacuaggcccaaagaaacagcauaaaucagguauuuacuaagaacuucugguggugagcuuaacaauagacuagcauuacaccuggcucccuucuuagugguaaacacggccugguccccaccaucuuuugauguuuacauuccuuuuguuuucugucacuguaacuuggcggaugugucccgucugguuucuuguuauucuucuguauaaaaaguuugaugcucaauuugaaaaauuacacucaaauucaacacgcucucuugugucauaucuguauaucauucgcugacuccuucccccaccuaccaccagagacccguuccacgcagauaggagacccaaaaaagggguuagucugcggcaaggaggaucacaguucaauacuagucugggcugccaagcaagaccaucucaaaugaaaaaaaaaaaaaggggggggggaaauucacgucuggccaccagcucugugauucccugugcacaguggucuggcuaguagaacaggucuacuaguccagauucaaaguggcacauuuggaagugggaauugcaaggcugaggaaaacaaagacauagaguaggcccugcagaauguguucacaaccagcccaguugccuugugaugcauaucaucauucugcaacauauaacuguauuggcauauugggacuugguuuuaaguuucauauuuacugcauguauuuaugauugugguuaaaauuuuauuuauuuugaguauuuuguguauaugagagcuguaucugcauguacaccuacaugcaugccagaagagggcaucagaucauagaugcuugugaggcaccaugugguuguugggaaucaaacucaggacugcugcaagagcagacagugcuucccucccccccccccccccgcaccccccccccccccccgagacaggguuucccuguguuccccuggcuguccaggaacucacccuguagaccaggcuggccuugaacucagaaauccaucugccucugccucccaagugcugggauuaaaggcaugugccaccacugcccggcugauggugcucuugcuagcugagcuaugucucuagaccauugcuuuuuaagagggagguuucucuguguaauagcccugacucucuugaaacucauuuuguagaccaggauggccucaaauucaaagaucuaccucuaucugucucugagugcugagauuaaaggcuuauuauuauuauuauuugcuuguaauuuguauguagcccaagguggccuugaaguccuggccguccuguugcuucagguucugaaguguuaggauuaccaccaugacuacugauugcuuggcaucucacaguuugcucguguugaucuguguuuuugagacagugucucccucuggaguucaggcuggucuuaaaacugugguccugcuggcugggccuaccuaguuuucagauuauaauccugugccauuaauuaugcguagccuuaagcuaaagaucuugacaucccaagcacuggaauuacagggugugcuacuauguuggcuaagaaguccuuaauuuuaauuaaauugaauuuauauaaaauuucuuuuugcaccuaauuuaagcacauuuuauaaccacugaguuguaaagacagucucauagucuagccucaccugaugcucacagcccauguggcucuuggcucugugagaggcaggauccgcccccagagagcaguuugucucccucagauugauccuucagcacucccuucucuuguuccaaugccacuucagugcucaugcaucuacuucuggacucuuugagacaggcuggccguuaacuaacagaaacucuccagccuuagcuuccuaaaugcuaggauuacaggcaggggcauccaugacugaccuacuccucuucccuccgcuuuguguguaaaugugccaacacauuuuauaaaguauguaagcggccucuuggaacccugccacaccaauacgcaagauccuucuaauaaauuacuaguucucaugaaacuaagaauuguaauuuaguuccuauagaaacaaaguauaaaaugucucuuagaauuuaguaaacaccuccacccuuaccuccaaagacccuacauguguggcgaccaucuccaaaagacguuguaaguuguuucccaccuuucuucuuucuucaguuguggucugcacaguuaacugguuaucuauagaauuaagauuuaaaaaaacaaauaaacaaaaaaaccuguugcuuaaugucuaagaauaaaugaaugaaucagcacagcauagaacauuuacuugcacuaucccuuuccccugagaaauauuuggugaauguaaaaaaaccauaccugguagaauccaugcaaaugucauauacagacaugccagcagcuuuaggucauugcauguguggucagcugcccuggugcugaaaccuucuauuccauuucuaccuguuagcuugugugaggcuauuaacaccuggcuuuggaggccucuuaauuugaagaguuccauauuuacuauacugcuuauggauuucuuaacaauuuaaggugugucagcugggcacaguggaacacaucaaaaaggcagguggaucucugugaauucaaggccagccugcucuacuuaaauucuucaaaucuccucauucuuuguaccccaaauggcuuuauaauaggaauuaaagaaaaaaaaauuaguuuuuuucccuccugcuuuguuuugacuucagagugaugucagagagugugcauggacaaucagucaugacagagccuuggcugagaugaacaaccuggucagguucuuaccuucacuguuuguugguaaaggucauccagcuuuugaaucucuuccuucagcaucuucacaguauucuugcuuuccauuuucaugguguucagcuuggauaaaaccuugguugaaaaaaaucacaacuaacacaaaacaaaaaaguuuuucucuuuaacaaaaaaaacuguauauuuuuuuuauacagaguauuuguuuauuuacuguguauaggacuguauugcuagcauguaagucuguguaccaugugugugcuggugcccacuaaagaaagaagagggcaucagaucccuugaggcuggaguuaacagacuguuguaagcugcuacaugggugcuggaaaucaaacuugggcccuuucuaagaccaacaaaggcucuuagccgcugagucaacucugcagcccuaguuuuucuuuuaaaaaauuucauuuuuaaaaugauucuauuuuauguauauaaguguuuuaccugcauguauguauguauguguaccaugugcaugccugguguccacguggucccuagaacuagagcuacaaguaguugugagcugcuaucugggugcuggcaauugaaccuggguccucugcaagaacaagugcucuuaaucacugagccaucuuucuagcuccacuggcuacauaauauuuuuuuuuaaacacagaugucaaaacucacauuaggauaaagacagccucuuucacagaugcuguugagaaaacuguagaaaaaaaaaaaaugaaaccaaguccugagucucacccuacaugaaacuuugaaaauggaccaaaaacuugcuggaacugcuagggaagacacgucaacuauguucuccaucaauaaccaucugaugcaaaggcagcaaaggcaggaaaugcugaaaggacuguaguaggaaauaacuccaaggacugacaaacggguuacaaaaaaauuaaaaaaaaccaaucagacaaaacacauaacagcagaaacaaccccgcaacugaagagacagcauacagaaugugaaauccuugccaacuauguaucagcuaggcgucuacuauguaagaagaaacaacagugaacaccacauccaaaaguacaugagguaguaaagguaguucuucaaggacgaacuaaauagccagugauaucugaugaaggguccuacauccucagccaucagggaaaugcaaauucaaagugauuugugguuccaccuuacuugcucagaaugacuuucauugagaaaggacaacacaugcaggcaaggauuuggggaaagaggaacucuagugagaauguaauuguugcagcuacuauggaaaucagcaugaugcuuugucaaaacuacaacgggguaggacagauggcucagugguuagagcauuggcugcucuacagagaaccuggguuugguuccuaguacccacacaguggcucacaaccaucuauaacucuacuuccagggaaucucacauccucuucuagucuccacagguacauacaugcaugguguacauacaugcaugcaggaacaauacuuacacacauaaaaaugaaagugaaaaaaaccuuugagaacuacaaccagaaaucucauaugaucuggcuauuucacccaagagacacuaaguccuaccacagauauacuuuggcauucauguuuacuacugcauuauucugcuuuauucacaauaguugggaaaugcugucauucuagaugucuauccucaaaaaugacagacaaguaaaauguuguauauguaugcaauauaacuuuauucaucuguauuaaauaaaaucauggggcuggagagauggcucagugguuaagagcacuugugguucuuccagaguaccagaauuugauucccaacacuaacaccagaugguucacaaccaccuguaacaccagcuucagaagggucagacaucucugaucucuaugggcaccugcacugacaugcacacauacauacuuaaaaguuaaggcaagggccugaagacugcagguuacagacucuccugugcugagcaagacccugucuuaaauaagacaaacauaucugcuaaguacauuucagggguaauuacugagcuuuuuugugucugucagugauugguuuaaucuuuuuugugaugaccuuuagguuguugucuaaggucauaguaaccucgugguaauuauguuuaugcucugcuaauucucaaguccuaaagucaucuggucuuuaauguuugaaacacuguaaaaucuguaaaauaauuuguuaaugaaaucuuuuuugagagccaauucuuuuucugguuacucauuuuuacuuuucauuuggagucaacuuugagauuuuuauuauuuaugcuguaauccauuuuaccaguuuucuaauuuuuucaagaccaguuuuuguuauauaagccaggcuggucuugaacuugcuauguagcucaggcuaauuuugaacugaggauucuccugcuucagcuuucagagagugcugggauuaccagcaugcaccucuggguggagcucaucaguuauuauuuacauaacuuauguaucuggguauguuauaagcauguuuguaucaugugcucacagugcucaaggaggccagaagagggugucagaugggagcugaacguaaguccucuggaagaacaacaaauacuuguaacugcugggacauuucuccagccccuggaccgucugucugccugccugccugcugucuguccaucugucuggaauaucuaucuggaauaucuaucuaccuaccuaccuagcuggaauauauaauauguaauuauuauguagaauuacuuuauguauauaaauguuuuccugcauguagguaugugucauguacucaugaaaaucagaagaacuggagccaaagguugugagccacugugugggugcuaggaauuaaacucaggucaucugcaggagcaaccaguguucuugaacaaaucuuuagcuauaaauauguguauguacacacacacacacacacacacacacacacagagguuuuuuuuuuuuuuuuaguuaugagcucauguagccuaggcuggcuuugaacuuuuuauguagcccagggugaucuucaauacuggauucuuugccuuuaaagccagcauuacaaguauucacugugguauucagguuuaacucaccaacuuaaaaaaaaaauugacuuuuguuuauauuguguuuucucauaauuuaaauuaacuugcuuuauuucuaaccacagcucauguuucauuuuuaaauuuccuaucuuucauuuuugugacauaggguuuuacucuguggcccagcuuggccuggaacuuuggccucugcauucaaagugcagggacugcagguacaagggaacacuauucuggggaugaaaccagggcugcagccucaugcuaaggaauuauuuaccacaaggcuguguuugcaguccaugaugucagauuccauggagacuguuaacauugaaaacagcucuuuguggaucacuuggauagcuacuuaugaaauaucacaguuuauuuaaagauuaaaaaaaggaacaacuuucugcuuugagacagggagauacaucaagucuuggcuagaauaguucuugaagaacugcauuagccagggcuucauucguugcuuugaguuacugaauacaguggcuuuggugucucacagcuacagaaggcaucaugucucagguguuugagagcagaaaucccugucaguccugcuccccagccuccugagggccaggguggcacaccugugauaccauacccagcagaaaacuauccuaaaaacacccacaggcauuuggcucauuccaagacauuacagucauagcugacuagcuccuaagcauuaauggcacauuaagaagucggccucaaauccaccuaaauauaaaaaggacacagugugucaagaagcaagugaagagagcugaucuuauucuacuuuaucauggugguaaaugaacacucaacuuaguucuuuuauauguaccagucaagguuagcaccaacuuucauuuuucauaauuuuaauuaaaauugaugggagguagaggcagaugaaucugaguuggaggccagccugguuuacagagggaguuccaggacagccaggacuacacagagaacccuugucuugaaaaucaauuuaaaugguuauuguucagaaaccccaggucacacgcaguguuaugcuuuagucaccugugccagaaaccccaugucacacgcagugucacgcuuuagucacccgugccacacuuacuuguucuaaaguauccuccagagcccucuuuuuauucagagcuuuguuaauuuuuuucuucgcuuucauucaagaguucuuugagaggugccuagaaaaauacaucaaaugguuaaggagauauccaauuauaaacuucucccaugaagcuugucuagauuacgauguaagucaguuuuggggaaauaaaauaaagccaugauauuuuaaaucuaauacauaauauaccaaugaggagaaaauaccuuugguaauuuugaagauaagguuuaggggaaaaaaaaccaugucucaaccuucauccucccacaggaagggaguaugugccccaaugccugacacaugucuguguauuaugugucugcauguauguacacaugacugcagguaccugcugaggccacaccuauugggucggucucccaauagagcuggauuauaggugguuaugaguugacugaugugggugcuggggauagaaccugagcagacaguacacucucuuaacuacgagucaucucuccagcccauuucucuuaauaccuugcaaagauuuagucucauaauucugguaggauuuugauuugacuucuaaucuacugaguuuauuuccacacuauacuucauuaguuuucauuguacauuuuuaaaauugagaauaccuacuuuaaaauaacugaacuuagugaauuuaguaugcuuacaauguuauaaaaaugucauuuguacuuuuaaacuauguuaugacuuaaaaaagaaaaugccacaggccauuaugcaucaagcaaaucuuuucaaauuacuguggacuucuaauuuugaccgguuccuuuuuuuggugcugugcaucaaacccaagcccuucuaaaauaagcaugggcuuuaccacugaacauagcccagcuccugggacugaaggaacaagcaggugugaauucguugcugcaggugcuggacuuugaaucuguaaaggccauguacacucuaaccacugacccaucucuccagcaugcuguuucuacuuuaaaaauauuucuagagccacaauacuuuugaugaaguaaauauucagugaucaauacagucuguaacuaaagugugauaacuaggcuaugguuagacccauggaucaaaagaagauuauagcugcauuuuccaguaaugagauuuuuaacaaaaaugacaaggggauccuguaauccuuucaaccaugguucagaaucucuauaggacaaaagauacauuucagagcuuaccucacacgauaugagaaauuaccuucuaauaaagcaaacuaaauaagggcugaaauucuaaugcacuuaaaccuaaacaugguaaaauaaagugcaaugacuuggaaaaacaauauuucuagagaugaaaguaaucucucucccuuuaucagcauauucuuuguaccugaauaaucuuuuacaagacuacuugauucagguaauuauuuauugcuguggcaauaucaaaccauucaaggcaguggcgaaugaaggcugccuggcaccguggcuacugacagaaauccauguacccaguuugacaacaaauggcuucuagaccaguuagcaacugaacacuuacugcaugcacuuuccuuuccuaauugaauguaaauccaaacugaguauaauguaacccuuucaacccagcaucucggaguuuggggcuagucuaaucuaaacagggaguuccaggacagccagagcuacacaucgaguccugaagugaauacuacacggggagaagcugagagcuguggcccaugccugcagcuccagcaaucaggaagcugagagaguagcacugucgugaguugagaccuggcuggggauucacagaaacauuacugaaaagggagugggagggggugggaucuagcuggcuugacuuaagccaugucuguucaugaauaaaccgccauuucugaggaggcagggcucugcuuggguauuuuaacucuagcacacagcuggucgucaacauaguuuguacacaacagauacauggcagaugaauaauucucccauccaaguaccaaccagagcugcccugcuuagcuucugauuagaugagaucagcaguuucaggguggcuuagccauagauuagaugaacaguucucaagggaaaaaugcauagccucugacucgacauuuuuuaauucaaaagcuaaguauuucaaagguggcauuuuaguacugacaauaagacuauaacauggauaauuuaaacauuguaauauagcaauacauuuuuuuucuucucaaaauuaucuccuuggcauuucuucuuguuguuguuguugauuacugacauuuuucuuuucugcuuuuuuugacuuaaaaaaaaaaacaaucugccgggcgugguggugcacgacuuuaaucccagcacuuuugagacagaggcaggcggauuucugaguucaaggcaagccuggucuacaaagugaguuccaggacagccagggcuaaacagagaaacccugccucgaaaaaccacacacacacacacacagaaccaaaaaacaaaaacaaacccaaucuauuauacuuuaugccuucauguguguggcuguaccuagaacuuuucccacagauguacugcaaauauuucaccucucaagaucucacuguagggcuacccaccucucuucagucuucuggccagagggaauagcuguuuaccaaccugaaggacuuccaguaaagcaugcacucgccauuugcuagcacugcucucucaagaggggugagagguaacuugagaacaaagguuaccucagacuguugacacuacaguccugauaccuguuuuacuugcaguuagcuuuccuuguggacaguuggaugaaguaaagugggcacagaggacaaggcuuucuaaguucaaaaguuaccuaugagacaagaguucugcuacucagaagaaagggagagcagccagugucucaguucugagucuaguucuaggucguggagagacucaauugaaacacauacuuacauacacuugaguccuguauuugacagggcaguuggcacccaccucaggauuaaacuuaauuucaaagucguaaccuuuggaauucucagcaccuuuggggauaagcuuuaauuuucuagccaacuugugguacuuggcuagcugcgcuucaaucugguaaagagaacacaacagaaaguuaacgugaagcagccuaaucuguguguuggcaagcagcacaccacugucccuucauuaacuccgugucauuuagaguaagucuaugcuuggcucucaacuacaaucuaccuucucaaaccuaguuagaaauauggaauaaagcuaaaacuuagacuugacaauauguaaaauacuuuaauuaccaaaaauaaacaaaacaagauaauuuacauuucaaaccauuaacucuguugaagauauuuuaguaguucauauuucucucuguccuuuaauguucuaggacugaguugcauuaccgggaagguagugcaacugauacacugaugcugcucuuggguucccagcacaguaggcuuuuucacacggccagacuuggucacuuccuaggccaccacuuaccuacuuccuacauuuuuuuccccuuucggcuuauucaugcaaauaaaucacuuauucuucuuagcuucauagacucaauguuuacuuaguccagagauuuauaaccuucccuuucuuacagagcauuugagagauaagguucccugaaauaacucacuagagauucacugacauagucuaacuccacuucaguuucuaaagaagcacauggaggcuaugaaagguuagaugaugcagacuacaugugcagacaguggcaaacugcagguuaaagcucaaucagugcugaucaaauucuaggcucaaagccuuuaggugccgccuccuuuucucuguuuuuauggauugaacgugguacccugagcaugcuaagcuugggcuccaucacugacgaacaucccuguuaguucuuaccgauauguauaugcacaaggcuagagcuuguccccaagggucaggaagauaaggggauauagguaacaacuuaaacugaacagcuugcuuacgcuaugcuacaauuaccaacaugauuucccccuccccacaauguguugguucauuaucagaaaacugaguuuacuuuaaauuugacugacauguaugaguguuuuacuugugaaaaaaauguuagcaccagaaaaauugaucagucuauccucugagcuccucuugguuacacagaccuauccuguggucagcugugcucagagugugguaucacucaccgccucuuugccucuggcauauuucaauuccucauuccacaucuguugcuguucagcuuuauaguuuugaacauuugcuuguaaugaagcuuucaguuuccucaaugacaucagacgguucuugagagaacguauuaguuauuuucaccaagaagcauucuguauuuuaaagaaagccauauuauuuacacuuagaggaagucaaaagaacuagaaaaauaacuauagaauuauuauuauaacuuaauaauuuaaagagcgacuucaaacaguuuagaauaggaaaaaccaaagacaauguagaagcucaaauauuuaauaucugguuaccgugcagaacaaucuggaugcuccacuaauaaaacacaagauaaaguuaagaugcugcuaucagggugggagagaugguucaggguugagaacauuggcuguucuucacaggaucugcauuagaucccuagcacccacaugguagcuaaccaucuuccgaaucuugaguucaggggauuccacacccuuuucugauuuccagaggcacuguuaacaugugguacauaaauauguaugcaggcagaauacgcacacacaaacacaccaaaaacaaaacaaaacccauauugucaucuugcuauuauaaaaucuuguaggcuauucuauacucuauaagccaguuuguuaccauucuguuuucaccaacuaaaacccagggccucuugaaaacagugcucccugcaaguaaauacuccagggaccuuguucaaaagauauguaaacaggcaggaaucuuucaucauauccugaacaccguuaguccacgguugauggaccacagggaaaaacaaagcaccacagacaucaugcaugguuucauugaaaggucuguaauauguaaaaaaaaaucuaaccguuaagagcuuauuuguuagcccaucuaaaacaccuuccauaagaguccucugaagaaggcucacgagccuaaagagcuguccagugauuucagaaacauguuuacuaaccgguucucuuucucuuuccuccuccagucuugcaaucuguucauuuagugcuuugauuucggcugugagugacuccagcuuggacucaucuaccuuguacaaguccucugcagacaaagcccaaucaccucaucagaaucgacucacaacgcucuccagguuuucagcagcuuguucccucacuuccccaaaccauggauguggcagaugcugccuuguguacuggccagcuuccuuuuucuccuggaaugucccguugcucuuagccugcuuaagcuuucuuccaccguaccuguugcuguuugccuauaguuccucacugaauuuccauuccuuucuaccuaacagaauaugaguucccgaggccaagguuuucuguucuucauuacucuauguuuggugccugacacuuggguacauaauauuugaguagauucauuuauguguuuaauuauauauacacgccgggcaugguggcaaaugucuuuaaucccagcacucuggaggcagggacaggcagauuucugaguucgaggccagccuggccuacgaagugaguuccaggacagccagggcuauacagagaaacccugucucaagaaaaaaaaaauuauauauacacauaucaaguaauucauaaauuauguccacauuagaacaaaaugaauuuuccuuuguguguguuauguacacuuaugugucaugagucugcaugugugcacauagaagccaaugguugagguuguguaucuucuccagucauuaucaucuugugacuuuagauaaaucucucugcaaaccuagaggucccugauguggucagauuggcugguccgcaagcucuagggaucuaucucaagcaccuaccucccuagugcugagauuauggacacgugccgcacuugugcuuuuaugugugugggauccagacucaggauccaugcuugcugaggauauacuucacugacugaaccgugucucuagcccugacuuuugccuuccuaaaucaauccaucuacuccuugggcucuccuugucacccuuuaggaugacacaauccugaaaauucuaagggaaugcuucugguuucccucucaccuugggugucacaugggugucagggugacuuucccauaucacugcauaacacugaauggaaaguaauuuacagggcugaagauauggauggcuuagugguuaagagcacugacuaaucuuccgaagauccuaaguucaaaucccagcaaccacauguuggcucacaaccacucauaaugagaucugaugcccucuucuugggugucugaagacagcuacaguguacuuacauauaauaaauaaauccuuaaaaaaaagaaacgaaaagaaacgaaacuuacuuggaaacuccauggccugcuuacucccucccaguuucaauagagagacuuuacauacuuucccuaaggagugcuguaacuucuaacauauuaaagcauggacaaauaucuuuuguguucccaacaaagaacauuucuuauuuuauuuugugucuuuugagacaggcuuucucuauguaguccuggcuguucucaaacucacuuugaaaaccagggugaauuugaccucagcagucguguuccuuuguaucuugaguacuggcauuaaagucaugugccaucacugucggccucauuugguauuuuauuacaaugcucucuugugugcaaagcuuccaagagaugaugacuucuuaaguccacauaaccaguaaggguuaagacucaggccugucuguaacaguuauuuuuuguuuaaccauuacuuuucccccauuaaagaacaauuuguaggaaaguagcucaugagaaaucaggccuggaaagauaagcaacagcccagaaugaagugacagagccacagggggacacucacucagcuucgccugcagcucggcauccuuuucuuugaagcugucggcccuggucaugaacuucucauagcauuuuuuugguguagucaaaaaaacaacugauuggguuaagcagaugcucaaaaacaaagacaugucucucuacuuuguuucauuuuauuuucagacugaaaauucagauuugaaugaaaauuuaagccaagaauaguaagcaguuauauaaauuucuaaaacaaaaaauuaaaaacuugucacuaacuaugcuacaaagauguacacaauauaucaccucuaaauaggaacagggauggaaauaucuaguuuggauagagacaauguuuugaagccaagccagaaacuuugcuaauaaguauaagucaacauaaaauauacaaaucuagucuucuuuaagaagaaugcuguagcuagagagacccaguggcugagcacacuugucucuuuugcagaggaccuggguuccggcacccacauggagccucacaaccauucacuuaucaguucccaaagugcuucucuguauagugucaucugacauacuggcuuagauggccaguagcucucacugcuuaaccuucaggaugaaggucaagagggacagcuguacauagaaauggagguaaaggggcaggagagauggcucagcgguuaagagagcacugacugcucuuaccacaugguggcuuacaaccauccauaaugagaucuggcgcucucuucuggagggucugaagacagcuacaguguacuuacauauaauaaauaaucuuuaaaaaagaaaagaaaaacgaaacgaaacagagguaaaaaaugaguguggucugaaaugcacgcugugccaaggaugacacucccugggauccuugucaaugcugaggacugcgcaggccucuggauacgugaggcaagugcacagacgugcacagacgugcacagacagacagacagacagacagacacacacacacacacacacacacacacacacacacacacacacacacacggcacagacacuaggcuaaucaguuaaugugucuuugagccaucucucaggcauuaguaaaagaugagacuaagaugauuaccacuuuucauuuugugagaaaggcucuaacaaggcuaaggcuacuguacaaaguuuuacucugagauuaaauuuacucagaguuuuucucugagaggccuauguaauaacauuuaauauuuggcaacauguacaauguaaaguuuauucuuuagcugagguuuguauuuucgaauacaggugagauugucauaccuucuggguucuaacaaagccuacggaccacugguaugcaugcuaacuacuucucuccucagcacucgugaccuucccuuuagcuuccugugugugguucugggagugugccacagcaagugugccaccauucccagcuggauauuguguucaucucaacuacuuuuggaacuggugacugagcuaagugacaauauaucuauauaucuaacuacaaaacaaaacaaaaucaacacagacccuacgugaaguauuuuaagagccaauacacgccgguccugcuacugaagaagccaagucggaagcauggggagcuccaggcuugcuuugaguacagaguaagcuuaaggccagucuggauaacuuaagaggacuuuugccauaaaagaugccuuguuuccaaauaccagcaauuuccuaaccucccccacccccccauuauguccuguaugacaagaauuaaauuaauguaagauacaggaggaaaaaauaucuuauccauaacauauauauuaguuacaaugcaugcaugcaugcauacauacauauuuuccuucuuuuuuccuuccuuccuuccuuccuuccuuccuuccuuccuuccuuccuuccuuccuccccucccuucccuuccccuccccuccccuccccuccccuccccuccccucccuccuucuacaucucacucucucuuuugauuuugaaacugggucucaccauaguccugggaagccugggauuuccuauacagacuaagcuggccuggaucccacagagaacugccugacucugccuacuaagugcugggauuaaaggugcacccugguuguguuuguacuuuucaguuaacauucauucauucauucauucauucauucauucauuuauuuuuaugugagugcacugucgcucucuucagacacaccaauagaaggaaucagauccccauuacagaugguuguaagccacugcaugguugcugggaacugaacucaggaccucuagaagaacagucagugcucuuaacuguggagccaucucuccagccccucagcuaacauuuuacaauuugugugguuaguaauuuaaagaguuacagugucacuucaauaauaggcacacuaucaaguguauuuuuuuuuuaagauuuauuauguaaguacacuguagcuuuccucagacucuggcugcacucacuagcuguagcuaucuuuagacaccccagaagagagcaucagaucucauuauggaugguucugaacucacaaccuucagaagagcagucggcgcuuuaacugccgagccaucucuccagcccaauuguaucuuuuuuaaagaucaauuuacuaaaaccauuuuuuggguugauuuauuuuuguauguauuuuguuugagaaugauuguucauuucauucauuccagcauuugcaagccagagguagggggacuccugugaguuaggagucagccuggucuacauagagagcucuaggacagucaaggacauauagugagagccuugcaacuuuaccaaggucaccuuugauggcaucuccaaaaccuagagcuaccugacccccgaccucuggaaagagacuguacucaccaagucuucuuaucaggaauucacugaccaucuugugaaaacccacaccagagcagaaccucuguucagaagacccaggcucuggcuauggcuacuugauaagaguauuuauccaagaaaaaauaaagugaauaaaguauguauaaaaagaaaaacaaacacagaaaucuauuagaaagcaaaggaaaaguucuauagaaggauaauuuuuaguuaaauaucaaagcaaccucuuucuauaucauuuaugguaacauacaauauaccuuauuguguuuaauuccaucuucaguuucuucuccccagagcugcccaucaucaaauaaaggugagcuuucuuucauggcaguaugaaucuaauuaauauacaaacaacacauuaaguuggcugaguugaugauuugcaaaauucacucaguauuuucuagaagcauuuaaucauacaacuuggaguucuaaaaaagagauuauacucaagucuuaaauaugacccuuaauauuuuaauaacuaaauacacugagauuuagaaagaauggguucuguguuuaguucugcuccauagagggaaauaugcagaugcuugugcuguuacuaauacacugagcauacauacauauugcuacauuuauuuaugugugggugugugugaauguguguauguauguauguguuuguguguguacacagaugugugugugcguauaauacaccacgauuguggagaccacaggacaccuugugggaguucaugcacuccuuucaccaagugggcucugcagacugaacucacaccucacaccaucaugcuuggcaauacgugccucuaccugcugagccaacuuguuggcacuacauacacauucuaacguaacuccaagaaugcaaaacagaacagccacauacaugguaaaucaauucauucucuuauaugaacucaauuuagauguucaaaugaauuaagugaauauucauacauucaaauauaaauuuuauucuuuucuuccccuuuuuggggaggcagggucuaugucacucuggcuacccuagaacucuguauguagaccauucuaaccccaaacucagagaucagccugccuuugccucccaaaugccaggagucaccacacccagcucuuaaacuuccaacuuuagccacaaaugugaacuucagauugaacuuuacaauaugaaauuuuagaagcacuguaguuguuuaaauuugaaauagguaagaaugugcuugucuguaauauuaguacucaggaggcuaaggcaggaggaagaggaguccuugccuaccucucuuaucaugcuaacgguuuacagaacuucaaaucaaaugcaauuugaaaauugaagcagauuuucagacaaguugcaaaauaugauuggugagaggaauugaaaaccuuugugaggaaaagaaaagaaaagaacaaaccccaaaucucuaaagcuaacauaagaaccaucggguaaauaccuugaugcagucacaccaaggcagccucgauguaaggccacgugugaggggcucccacuguauacauggggcucuuggacagugugaagggauaucuaugagaaaccaggaagaaaaaaaaaaggugccaucacauuaggaaacauaccagcuacacuagaaguuacauuuuaaagccguacauacacuggcauaguccuagcuuguagugaagauauuugagucuuuucuggugaguuuacucaucuaggauuuugugaauuuauucaauuccacagauuacuuugcacuuacaauuccuuacauugcaguguuuaauaaccaagaauaguagccaucuccuuaaauacucuuauauucuuaaauucaguguacuucuauuacacauuugugauuaucugucacuaaaucuaguuuccuccuugauguuucuucuuccuuuuuuguuuuuggagaugguuucacucuauaguccauaguucuucuuccucaguuuccccaaguguugggaucacagguguauggugccauauuuggucuguguguguauauuuguguguguguguauauaaaaugcuuuaaacuuuaucucugugcugcuuaguuuugucaauaggacauaaacuagaguuauuuggaaagauggaaugucaguaaaggaauugccuccauuagauugggccaugggcaugucuguggaguacuuucuuaacugaugacugaugggagagggcuuaguccacuguggguaguaccgcucuugggcagguggugcuagguuguaggaaaaagcaaacugagcaaaccacagagaacaagccaguaaguaguuuuccuccaugguuccugcgugaguuacuucucucacuuuacuuagugaccgauguaacaggaauaugugaaccacauaaacccaauuugcuauguucuguguuuuacccaaguaucagaaaaccagauuaagauggugucacuguuuuuaccaucaagaccuuacuguuacgguuuuguuacuacaaacugugguaaccaggcugccccuaagucauguuuuuuugugacagaaucucacccggaagcuuuggcuagccuaauauucaccaugaagaccaggauagccucgaacucagagaucuaccugccuugaaaggcuugcaugaccauaccaggcuauacuucauauuccuuauuguuugagucuuaugaucuauuccccaaaguucuguaauauuguacugcuauggucugaaugauucugcagaauucauguuggaaaauuagucuccaguuauauuuuauuuuauuuuuuauuuuuuuuuaaagauuuauuuauuuauuauauguaaguacacuguagcugucuucagacacuccagaagagggcgucagaucuuguuacagaugguugugagccaccaugugguugcugggauuugaacuccggaccuucggaagagcagucgggugcucuuacccacugagccaucucaccagcccuccaguuauauuuuaaauuuuuuuuuuuuuuuuuuuuuguuuuuuuuuuuuguuuuucgagacaggguuucucuguauagcccuggcuauccuggaacucacuuuguagaccaggcuggccucgaacucagaaauccgccugccucugccucccgagugcugggauuaaaggagugugccaccacgccuggcuccaguuauauuuuaaugauacagagaugagaccuucgggaggugacugucacagcccgcaugaaugaauccacuucuguauuaaugggcuagugaaggagugaccuuguuagaaauguaaucucuuugauacauuuguucuuucuugccauauaguaccuucuagcaugucacaaccuaccaagaaagcucuuccucauuagagggugaguagaugcugaacccauguuuuggggcuuccugaccaucauugccaagaguuaagccacucacucauguguuucaagcccacagauuuuauguaucagguagacuaauaucuauauguaucuuacaauauauauuacuaaauguauauguacuuauacacuuguaauuuugugaauaucgauguuuugacugcaaugcauguguaacauauguguguagaggccagaagaugaaucguuauauaugauugugagucaccacgugacacccuaaccugaauccucugggagaucagccagcacucuuaaccacugagcacuuuaguucaaugacuccuacauuuuaugaguuaccaagcagugguguuuugcuacaggaacaacaaaagugguauauugcaguauauuuuccuuucucuucaauuuauucuacaaauacugcucaucuuaaaacuaauccaaacuauucacaagucuucaguuguuucuucucugugacuugguaaggucucuagacuaauggaaaacauacccaaguguuuuaaaaauucuugggacaucuucuucacauuuuguaucaggaaguucauaugaugggcacagaaagccauaaagaaaggcgaagcucuuuaggaagucuuuaauagauggagcuugcagagacuucauggguacacuauauacauaaccguuuucuguaagaaacuacaaacaucuuuaugaagcauugaaaguuuuggacuagaaaaaauauuggcuguauucagacaauuuaaauuauugaauaccucauagaguugucgaauacacugcugaaugaaugcuuugccauuaagugguuuuggguacuugauuuuuucagaauuggaaaauauaccaaguugacuauuacuggauucaugucugcuaguccuagaagcauauuuuaaaaagugcauauuauuucaaggcuauacauaacauacacaugaggucacaggaguuuguuucaggcauagaaagagguagaaacaaaccgugcucugggacuggggacacagcucagugguuuguuuagcacucacaguccucugugcgcaauccccagcaccacaaaugucaaagcaaaccaaacuaaauuucuuugugccaccaccauucauuauccuugaagguauguuuccagugcacagggcuucuucgaagucugcucaaugaccuaagcacucccaugucuacugacccauagcugcucuuguacuucuacucccuugccacuauucuagugaaaaacauuguccaggaguauuaaaaguuaacauaugcaaagaacuuaaaacaucuggccuuugugaaaacucaggaaauauuagauucuguaaauaucuauaucuaucaauccuuagaacugcucuaaaaagagauacugcaauuaucucccuuaaaaaaaagguuauguuuaaucugugugcagugugucugcaagugugugagagaaauacagacacagagacagagacagagauauggaggacagaggacaaccuguaggaggagggucucuucuacugucaggauccauaaugggacaagcuaauaacuagcaggugauaauccugaaguggccugccucggauuauauaaucuguuacaggugagccuucauuaagcaaggcaugguguuucuuuaacacauuucagucagcuuuggcucccgagugaauaacauagagaccugguauuuguacuaacacacugcuggcacuaagcugggcaggcucugagcuauucuaacucuguauggcugccuacugcccagacacaugguccuuuaccugcaaucugagguuugccuuggcucacccugguccaugcacauguucuucuggcuguucccuuccugacaucucuggucuacccacauggucucuucacaacuacuucucuggucucuuugggaccugagacugggaucagauuccugcacaauucuugccuucugcccaucuaauuggcuguucagcucuuaauuaaccaaucagaaaagaugaaaaacgauuuuuuuuacauaacauugagagcagagaugcugaccaagucaaccucuggauuacaaccagacuucugggcauaaaaaucggccucuaacuacacagugcacaaacucuauuacuuuacuacaccuggauuacaauuaacccacuguuucucaguuaauacuacuacugucuuucuuguucuaaucgcccuuucuguugcagauagcuaauuguauuugacauuaauucuguucuccugugagaggcguggaacaaggaauaagucagcacucgggugauuaccuguaaaccuucuucccaccuuaauuuauaaauaaaggcuagagcuggugauugggcgguaaaaagaggggaagauggagcugaagguuuugggagaaaaggagagggagggggcagggagggagagagagggagaaggggggagggagggggagagagagagagagagagaacacgaacgaacacgacugaggagaagaagaaggaaaguggggcagaagcaccuggccugcuguagugguagaucugaccaauguaggcgcacagcauguauucauauuaauaaaguuguguuuucauugccugggcuuauuuggguuggagauuuacugcaacaccuuucaacaaagauaaacaauccgguucacaacacaggcugcucccacuuuuaaaacaaguaucaaaauaaugucuauguuggaucgugucuccaucucugcagcaucagacgcuaugcacucggcccuagcuuccauugaggguuagaccgcauuuuauuguuguuguuuugucuugagcuagggguggagaggcaaacccuucagcacgcuaggcagagcauugagccacaccccuccuuguuuugguggcuugcauuccaccuaauuuuacucucaugauuucacugguucccaguccuuuuccguagcaggcuuuaagaugcagcaucaggacgggaacacagcacaccaaacagcuuucccccugucaguccccaccuguuagcaucaucuccucccgcuacaaacguugcagagccgggcagauccccaccccagcuuccucucaacagucagcuccagcgccgcggaccauuuuaacacagucagagcugaucccagcucagcaguuaccuuucgcucagcuucucaacgagacccagcgcccaguuuucaguaaacgacaccacugcacacgaaaacacagccgccaaaaccagagcguccgccuuggucaacccacggcgguuucaauuuuaaaguuuccgcccgcgcugacgucaggauugcgacggcgaguaugcaugcgcaaacgcucagcgcccgcccucgucgccggaaguguccgcaucggcggcucaacgcgcuccgggcuccucccaggucaucgucggugucggcgaccugaagggaguuccauccuauccgggaagcuggcgucuaggacgaguagugcugucgggcggagcggcccgagcccuccuggagucgaguuccguacagcaauauggccguguccuggaacuagaaagcgaggguuuguuuccgaaaggauggaggccaggaccuguuuuagaugaguguuguuuccacguggcgagccugggaggcggcgugacguuuccugacgguaggagaggcugucgagag

SEQ ID NO: 8788 - RNA, 2409 nt, Mus musculus
cagaccuuuuacagaucccggagugguuugcauuccgguagcauuugugccuguccaccaaaagccucaucuaucucucgucccaugcagcccuggaggaggacccaccguugcagcuccggccauccgccugcuccuccccuuuguggacagugaucucacacucaccaugucucaacuucggagcuugcuugaggucccuucacagcacgcaagcaggacgaaaagaaccauucaagccugcacagccgaaacaaacgugcagcaagccacccggaagaacccuccucauugucugacuggcagguccgcccggggaccuugauuggccagugagucuuaccccgccucaagguuaaauagagcuuccaguucugggucagaccuuuuccagaucucaggucugacuugcacuccaguagcauuugugccuauccuccaagccgugggagaggacacaccauuucagcucaggcucuucagccgccugcucuuccccuuugugggcagugguccugcacucaccaugaccuccuucguagcuugcuugagcuuucuucacagcacuuccccuucuucaagguggauagccuguuacugaacuuggaguggagguaucaaucuggcccaccgguggaaggaugcccaggauauuaacauuaaagaggauuuuaggaaacaagaguuuuguuuuguggcuucaugcugggcucaggaaaacugcagcuccuuuucaccaaaaagguaugaaacaaccuugggaaaaaaacaggaaacagaugacaaacuguagagcacuauuguuagccagcacaucuuccucaauggcaagguggagaaaaaccacaguugucuuaguacagaaaaaugaccucaucucauaggaugaauuucucuauguauguagaaaggggauuuaacagaaugacucacagacagugguccuccuaguccaauaauggcugagcagauucauugccaagggaaacuagaaaaaucaaggacuuguucaguucacguugcuugauaucucagcggaucuugaguacuucccagaauucugaagaaauaaguauuacuaaugccaguuucaaaacaaaacaaaacaaaugaaugaaugaauaaacaaaacaccuugcuaaaaaauguagggaaggaagaagacaauuugaaagaaccucccuguuuaauauccaguaaagccucauuaaaaacaaauaaaucaauacaaaggcugaaagaucaagcacaggucuugugucuucuaaauuaaacaacaaccaucuucauaccuucagcuucauugaauuaaaauaaccacagcaggacuuuuuaaauguuacuaaaucuaaaaacaaaaaaaaaaaaaaaccacccaggacaugucuggucaguacuuuuuuuuuuuuuaauuagguauuuuccucauuuacauuuucaaugcuaucccaaaggucccccauacccacccccccaauccccuacccacccacucccccuuuuuggcccuggcguuccccuguacugggguggccaguacuuuuaaaagguagaagggggauaacuacuuaugagaaguugucuccauacauacugaguaaggcauuuuuuuuaagauuuauuuuuuuaugucuaugaauacacuguugcugucuucagacacaccagaagaggguguuggauuuuauuacagaugguuucgagccacucugugcuuacugggaauugaacucaggugcucuggaagagcaguccgugcucuuaaccgcugagccaucucuccagcccgaguaaggcauuuuaaugugacugauuguaggauauccacagucucauaagaaacaccuugucaauuuuguaaaaguaaaccaaauaauuucacuggcaucuuugguugaacuaugauaauuuugaaauguggugccauugagaaguuagaaagaggggauaaacauugcuuauuccccaccccuaaauaaauguucucauaguagauuaugaauuuauuuguuaaacguauuguguuaugguauuaacaaauauaaaauguuagaaugaucgaaagacagaaauaguuuuaauaaagaaggauuuauguauagauuaggauggaaauuucaaaaaauaaaacaaaacaaaacaaaacccuacaaagccauuggaaguucuaaaggaauaagugagguauuuaaggcacuuagaguaugacacaugggaaauacaaaugggauuaaagucucugucuucagaucaacauuuaugacaaacugccuguaaucuaagucuaauucuauccucuguccagucuacauugaggagagucaaaauauagggaugagucccucaaagcuucaaaaggaagucacagucaguccaagcaaggguaucgaguaauguucacuaagaggg

SEQ ID NO: 8789 - RNA, 2409 nt, Mus musculus
cccucuuagugaacauuacucgauacccuugcuuggacugacugugacuuccuuuugaagcuuugagggacucaucccuauauuuugacucuccucaauguagacuggacagaggauagaauuagacuuagauuacaggcaguuugucauaaauguugaucugaagacagagacuuuaaucccauuuguauuucccaugugucauacucuaagugccuuaaauaccucacuuauuccuuuagaacuuccaauggcuuuguaggguuuuguuuuguuuuguuuuauuuuuugaaauuuccauccuaaucuauacauaaauccuucuuuauuaaaacuauuucugucuuucgaucauucuaacauuuuauauuuguuaauaccauaacacaauacguuuaacaaauaaauucauaaucuacuaugagaacauuuauuuagggguggggaauaagcaauguuuauccccucuuucuaacuucucaauggcaccacauuucaaaauuaucauaguucaaccaaagaugccagugaaauuauuugguuuacuuuuacaaaauugacaagguguuucuuaugagacuguggauauccuacaaucagucacauuaaaaugccuuacucgggcuggagagauggcucagcgguuaagagcacggacugcucuuccagagcaccugaguucaauucccaguaagcacagaguggcucgaaaccaucuguaauaaaauccaacacccucuucuggugugucugaagacagcaacaguguauucauagacauaaaaaaauaaaucuuaaaaaaaaugccuuacucaguauguauggagacaacuucucauaaguaguuaucccccuucuaccuuuuaaaaguacuggccaccccaguacaggggaacgccagggccaaaaagggggaguggguggguaggggauuggggggguggguaugggggaccuuugggauagcauugaaaauguaaaugaggaaaauaccuaauuaaaaaaaaaaaaaguacugaccagacauguccugggugguuuuuuuuuuuuuuuguuuuuagauuuaguaacauuuaaaaaguccugcugugguuauuuuaauucaaugaagcugaagguaugaagaugguuguuguuuaauuuagaagacacaagaccugugcuugaucuuucagccuuuguauugauuuauuuguuuuuaaugaggcuuuacuggauauuaaacagggagguucuuucaaauugucuucuuccuucccuacauuuuuuagcaagguguuuuguuuauucauucauucauuuguuuuguuuuguuuugaaacuggcauuaguaauacuuauuucuucagaauucugggaaguacucaagauccgcugagauaucaagcaacgugaacugaacaaguccuugauuuuucuaguuucccuuggcaaugaaucugcucagccauuauuggacuaggaggaccacugucugugagucauucuguuaaauccccuuucuacauacauagagaaauucauccuaugagaugaggucauuuuucuguacuaagacaacugugguuuuucuccaccuugccauugaggaagaugugcuggcuaacaauagugcucuacaguuugucaucuguuuccuguuuuuuucccaagguuguuucauaccuuuuuggugaaaaggagcugcaguuuuccugagcccagcaugaagccacaaaacaaaacucuuguuuccuaaaauccucuuuaauguuaauauccugggcauccuuccaccggugggccagauugauaccuccacuccaaguucaguaacaggcuauccaccuugaagaaggggaagugcugugaagaaagcucaagcaagcuacgaaggaggucauggugagugcaggaccacugcccacaaaggggaagagcaggcggcugaagagccugagcugaaaugguguguccucucccacggcuuggaggauaggcacaaaugcuacuggagugcaagucagaccugagaucuggaaaaggucugacccagaacuggaagcucuauuuaaccuugaggcgggguaagacucacuggccaaucaagguccccgggcggaccugccagucagacaaugaggaggguucuuccggguggcuugcugcacguuuguuucggcugugcaggcuugaaugguucuuuucguccugcuugcgugcugugaagggaccucaagcaagcuccgaaguugagacauggugagugugagaucacuguccacaaaggggaggagcaggcggauggccggagcugcaacgguggguccuccuccagggcugcaugggacgagagauagaugaggcuuuugguggacaggcacaaaugcuaccggaaugcaaaccacuccgggaucuguaaaaggucug

SEQ ID NO: 8790 - RNA, 414 nt, Mus musculus
uauggcuggguggaacaccuacauugacagccuuaugacggccggccaucauaggcuacaaggacugucugggccacuguccccagagaagaccuucguuagcauuaugccagcugaguuuggugaccugguaggcaaaaaccaucaagguuuuuuuuuuuuuuuuuuucaugaaugggcugacauuugggggccagaaauguucugugauuugggacucacugcugcaagacagggaauuuacaauggaucuucauaccaagagcacuggaggaacccccaccuucaaugucacugucaucaugacugccaagacgcuaguccugcugaugggcaaaggagguguccaugaugguuugaucaacaagaaauauuaugaaauggccucucgccugcggcguucccaguacugac

SEQ ID NO: 8791 - RNA, 1197 nt, Mus musculus
cugaggcugcggcucagaccuccaggcagcuccguuggcugcuugaagugcaagauccgacugcagugugggaccacugugccucggccuccccaggcggagggaggacccggacaauggcuguugcucacgagauggagauggagagugugaaucugaacauggagagaaagggaaaggaagaacuggaggaggagaaaaugaaagggaauggggaagguaaagacuuccccaggagcagaaagguccacaagaucaucuccaaguggaugcuuccugagccaguccgaagaacauacuuagagccaacugccucccgccgccccuguucaucauccucaucagucuggcugagcuggcuguguuuauuuauuaugcgguguggaagccacagaagcaguggaucauccuggacacggggaucuuggaaagucccuugacauacugcucugagaagaggggggaagccugcagguuuaucucauacaugcugguccaugccggaguccagcacaucguggggaaucuuuuuaugcagaucauccuggguauuccuuuggaaaugguccacaaaggccuccgaguagggcuggugugccuagcaggagugcuugcagguucccuggccagcuccaucuuugacccccuuaagucucuugugggagcuucaggaggagucuaugcauugaugggaggauauuuuaugaauguuauagugaacuuuagagaaaugauuccugccuuuggaauugucagacuacucguuaucauucugauaguugcgucagacaugggauuugcucucuacagaagauucuuugucccugcaaaugggucuccgguguccuuugcugcucacauugcaggcggauuugcugggauguccauagguuacucuguguucagcugcuuugacaagacccugcucaaagaucccagguucuggaucgcaauugcugcauauguagcuucucucuuauuugcuguguuuuuuaacaucuuucuguccccagcaaacugacuugccucuaugauaagccaguuaauauaaaagugucaaaugggaccgggugugguggcacacgccuuuaauccgagcacuugggaggcagaggcaggcggauuucugagccagccuggucuacaaagugaguuccaggacagccagggcuacacaggaaaacucugucucaaaaa

SEQ ID NO: 8792 - RNA, 47355 nt, Mus musculus
agcgucuuccuggccggaguuugcgguuuuagauccuccccaggaccugccaagaggaccagcucucccaguugcugcgggaggcuugcaagcagccaggauggucucgcccugauucaguucagauacuguacuuuuaaguuuuggcaaaaauugccugcgguauucucugcucgcacaacuaguuuugaucuuuagucuacugaauuaguuguucgauggcacagcuccacuauuagagcgacuucuaggaucccuuagcuccagguaauauucuagggguuugcuuuuuuguuagaaaguuuacugaaggugagacccaaagacaguucuaggaggaaagcuccuccaagaacuccagucaccauuauccugcuccccccuccaaaugcuccgcaucaaaggccagguacuuuaccagaccccagagaacaaaagaggucuaauguccaucccaacgacagaccugggguccuaggcugaguugugaagccagugccccuguaacuaaguugcugcucacuuugcucaucauccucaccagguccaacgcaucccuuaaaaugaucuuuccacgaucccucgguggaaaaugaaucgcccuucaaggauauccuaagaaaacuucuggcagagguaggacagaaagcuggggugaggaacggcgcccagguuauagaaccuuaagguacauaacaagcaagacuagauuuacuuggugaggaaagucgccuggcugucugcaauuacuuuauaaaugugagagcuuuguguggcuugaaguccuuugaugguuacaggaaucucuguugcucaccuuguggaggacuugaccuuucuguucucacagagagcaagcuagcauagcccacaccaaccaagcagccugggaauuggcaaaagcagucugcacuaggcuguuggggaggcuggggguggggguggggguggggggguggguggcgcucacuucuuggauucuagaacugguuggagagcugaucauugaaacucaagcacugcuacccuuuagacuuucuaaggaaacccagauuaguacggaguuugccucuaccugcuaugugagauucauuucucccuugucagcugacuuaggcaauaaaggaugugcuuauaaacacuuuaaaaauagaaucaugaaaccacgccucgcccugcccugcccccuuggaugagcucauuacaccacacauauuuugggaagugagccugugaguucccugcaggaggcuccccaguacaacuguacuuuaauaaacuagaugcuuuugcuuuaagcagcugcugauuuuauguuguggggugaauuuaaaauuuuacuuuuagacauuuuauauuuugcuuuuguuuuuagauagggugguuuuuuuguuuuguuuugugccaccuugucuggucucagaacucacucuguagccuaggauagccaugaaccaagaaacuugcuucccaagugcuaguguuaaaaauauacaucacuacaccuggcaacuuucagacauuuuuaagucuaacaaaacaaugaauuuaccagccucaaacagacuguaaagagaauacaacugcaaagaaggaagcuggcuagcucuuccuggauuucuuuucagacccaugcuagcaaaguguguguuuaccuguggugguggugguggagguguagcugggucuucaaauaucuaggacuguagguguggacaaccacacagggcuaaauaacuauuaaacuuugcagaugagaagccugcguguggagauccacuggcuaaggcuccgagagucuguuuuauuuuaugcaugcauguccguaugcauguauguguugagacugaggcucaugcuguagcccaagcuagccugugacuugauauugcagccagguuggcauuggauuccuaugagguacuucuguuuccacccgccacaugcugggauuacagcuuuaggaaggucuccacagggcacaaacuuccaaccuggcugggcugcagacugcugcugcaguucccuggaggaacuuuucccucagcuggggcaacaaugagcuuagacucuguaguuagaauguguuagaaauuguuuccuuauuuacucauucaggaaagaaaaugauuagcaacuaaccugacaauccucuaaucuaugaauuaaaaauaugucuguaguuuaguauauucauaagguacugcuuuccagucuucuccguauguaccaaacuauagccaggaauaagacaccauuaccuagcaacucuuauaaaaaauaaacauuuaaaugggccuggguuauaguuucagagguucaguccauuuucaucauagcaggaagcauggcaacaugcaggcagacauggugcuggaaaaggagcugagaguucugucuugauccaaaggcagacaaaaggaaacugucuucugcacugggcagagcuugagcguaggaccucaaaucccagccccacagugacauacuuccuccaacaagaccacauccauuuuaacaaggauacacucacuuaauagugucauuuccuaagggccaagcauucaaauacaugagucuaugggggccaacccuauuagaaccacuacagguggcaaggaucuguaauccuagcauggggagguugaggcaggaagaucaaaaguucaaugucaagggcuagaggcacagcuuaccaguuaaaaauaguuacugguaaagucauuguuuuuaauagcuggguaguaucacauuguguaaauguaccacauuuucuguauccauucuucuguugagggacaucuggguuguuuccagcuucuggcuauuauaaauaaggcugcuaugaacauaguggagcauguguccuuauuguauguuggagcaucuucuggguauaugcccaggagugauauagcuggauccucauguaguacuauguccaauuuucugaggaaccaccagacugauuucaggagugguuguacaagcuugcaaucccaccagcaauggaggaguguuccucuuucuccacauccuuaucagcaucuuuugucaccugagauuuugauuuuagccauucugacugguaugagguggaaucucagaguuguuuugauuugcauuucccuaaugacuaagcauguugaacauuucuuuaggugcuucucagccauucaaguuuccucaguugagaauucucuguugauaggauuauuugguucucuggagucuaacuuagugugugagguacaaugugugcuuugaacuuuaguaaacuuucuuuuaugaauguggcugcccuugcauuuggagcauagauguucagaauugagagcucaucuugguauauuuuccuuugaugaauauguuuaucuuuuuugauaacuuuugguugaaagccaaucuuauucgguauuagaauggcuacuccagcuuguuucuugggaccauuuacuuggaacauugugcagcuuuuuacucugagguaguauagugucugucuuugucacugaggugcauuuccuguaugcagcaaaauguuggguccuguuuacauacccaguuuguuagucuaugucuuuucauugggaaauuaagcccauugauguuaagagauauuaaggaauagugacuguuguuuccuguuauuuuuguuagagguggaauuauguuugugugacuaucuucuuuugaguuuguugaaagaagauuacuuuuuuguuuuuucuaagguguagauucccuccucuuguuggaguuuuccuucuauuauccuuuauagggcugaauuuguggaaagauaguguguaaauuuggcuuugucauggaauaucuugguuucuccaccuaugguaagugagaguuuugcuggguauaguagccugggcuggcauuuguguucucuuggggucuguauaacaucuguccaggaucuucuggcuuucauagucucuggugagaagucuguaauaauucugauaggucugccuuuguauguugcuugaccuuuuucccuuacugcuuuuaauacuuuuuucuuuauuucgugcauuugugacaggaggaauuuuuuuucugguccaaucuauuuggaguucuuugguguuucaacauaauaaagcucuuuacaugcagaacacauaaguuugucagagccuggcauacccuuauaaggcacacagucccauggaugggagucaaggcuuucugcucuguaucccaccccuuaguuuugaccauauuccucuggcacuaaauauguuaauuucauccccuagcacacacugugccccuucucaucaccauaagaaguguguucugcagcugcugguuggugacucauccauucagccacacucugcaucuuaggauagaucaaggauguccaucagacucaugggaccacagagagcaucguuagauucugcuccaccccuguagcucacuaagacuucauacgucacuggaaaaugaaagacccuagagcuugggcucucaccugcccaccuguggggaugaaagaacaaaucuauuugggaacauauauaugacaaaguuauaagccugugaggcuuuguccucauccucugcagcucugccugggacugacuauagcagugagcagacaaggcccaaagggacagucccucugccauccuacuuuuaccuuuuccuucaugaaccugucagcuuuugccaucagugugcagagcaggaagaaguacuggaaagaggacuuagggccucagcagagacuguugagucuugagguuagaagggaaguccugagggacugccgcaugggaauggaaggguguuucugaauguacucagcuauggcuguugucuggccaugaacugggcuuguggguguggagagaccaccuguuggcagcuaaagcuaaaacuuaagcuuuuuaaauuuuaagucgacuuuugagacauccccaaauuugagcuccuuguaccgcaucuggaaaaugggaacuauugcuguaucuucuucauucaaacucucaaaugcaaacuucuuauucauggccuucuaaaaugaccacagagggcaggcuguucccaggacuguggaggguucauccucagacuggaauuuagcuuucauuagucacguuuugagaggguagaaaacauuggugauaguccuccuaaccucugucuccucacacagccccuccuggauuuguggagauucugcaucuucagucauguaugccuagccccucuucuuugccuacauuuccacacagccuucucugaccuucugcuuauagcaccugcagcuaaggcacauggacaauaguguuggccaugcaugggaccuauuguccaugugugauuggguauggggaauaacuuuuuaagaaaagacuauacaacuugauccuacuguauaugcaagcauaaauguucauugaaggggggaaaacaacaacacaaccugaaucugcccugcaaaaccaauugcauaggaagccccuaccaaacuggcauucuuuaugugcaacacaagaguaaaccuuugugauuauuucaacagauccagaguuugguuuguuuagccuuuugaguuucaguuuuugguguugauuuaaaaaguaaucuuuuuaaaaaguuauguaugggguauuuugcuuucauguaugucugugcaccauguaugugaggugcacauagggaggccagccgaagacauugggauccuggaacuagaguaacacaugguuacaaaaagcccuguaguuucuaagaauuaaauucagguccucuggagaaauaccuagugcucagaaucacugagccaucucuccagcccugggugcuuuguuuuaaaucaagagagugaaauuuaaaauuaaaauugauagguuauuuuuccaccagugaaaugaaccaauucaagccagauuagauuauauuaaaagcaaguuuauugggaagccacucuggggcuagaucacuggcccuggggcaggguaugccagguaaggacugagggaugcugggagaaccuggagaccaggucugcuuugauauguaaaauaugcaccucaguuccuugucccagaguucuaucuuuccuuuccuauaccauguguaccuaugcaucacaauucuagacagugaguaauuuauaaaaagcuucauauucucacaguggagguguugaguggcugaagauguggguccuguaccugcugaggguuugguauguguccaguaccugcugagggucugguguguguccugugccugcugagggucugguguguguccugugccugcugagggucugguguguguacuguaccagcugagggcuugguaucugcuuccaagauagcaagaugggucccugucacccagccugucagccuaacucuaaucucugggguucacaaagagaaaaccaauuccuaaaacuguccucuaaccuccacuucuacuggugcauugugguauaugcacauacacaaacaaacuaaguguaacagaacuuggagccuuccuacugcuggagggaguuaaggcuguguccacacuuggugaaggaagagcgacaagcaggccaaacacugcaugaugccugcccaucacauuuguaaggccuugugaggauccuucaaggcuucacuucuaaaaaccuccccccgcuaucacuuucacauggcgugaagcaugugacuaggccaaagcaggccuggcaugucagagaaaugaguugggguccagcaagaugucucaguggguaaaggcacuugccuuccagcaaaaacagacucccucaagugugcucugaccucuaaaccuuggccaugaugcauguguacacauauacacaauaauaaugacaauaauaauauuuaaauaaaaaaaaaccaaccacaacaaaaaccagccauccagcuagugaaguggaaggcuggaaaucuuccccucugugcccucauguaccagagcaugggagaaacggcacagugugugcaaaagagcuaagccuguaauccugggaaacagacaccugaaauccuugcugcuggggaggugcuuuagugcagugguucgcaaccuguggguggagaccccucuggggguugaaugacccuuucagagggaucaccuaagaccaucagaaagcacagauauuuacguuauucuuuauaccgguagcaaaauuggagcuaugaaguagcaauaaaaauaauuuuaugguuggugguuaccacaacaugaagaucuguccuaaagggucacagcagcuuuaagaagguugagagccacuggguuagugaguaagagaauuugauauauguguuugucauuuuccuauuccucuaacaaaauaccacaaucaaggcaacuuagaaaagaaacuguuuaauuuaaugacacugugaaccucgagauuguguguuuacuguuauuaauaauaaaaaacccauuauuaauaauaaaaaccuguuauuauuugugguguggcucagucuuagcacacaccuuuaauccaagggcuuucugcucgaauauuauaaacagauucaaauaaagucaaccauaggucaaauguggaucaaacaaucaauugucagggagugaacauagaauuauuaagaaaaaccauagagagugagagucaggaaaacuaauagagaggugcacaggaaguagaagggagggacauucaguuugaagggcauucuuucugggaugucugcugaggaagaggaagugcuuuuucugccucucucuccccuaacagacuuucaccccagcaucuggcucuggagucuucauugguaaaaaaucuaacuauugagauuuuguuuaaaacaaacaagaacaaacaccaggggcccacaguuucagagugucagaguuuauuugguggggaacauggcagcaggcaagcacacaaauaggcauguuacuggaguagucgcugagaacuuacaaccaagaggcaaagagagacacaugcugcgaguggcacuaauguuuucaaacuucaaaccccuccccuaguggcucaccucuuccaacaagccaacaccucuugauccuucucaaagcauucugucaacggagggccaaauauaguuaagcaagugagugauggaggucauucucauucaaacuacaaaaccugcaaacuacaaagccugcagaccugaguucaaacaaccaacacccauggaaaacccaaauauggccacaccugcuuacaacuucagaacugagggcugcagauaggaaggguuuggggacuugcuggcugccaaucuagauacagauucagugaaagaccuugucucaaaggaauaaagguguguguguguguguguguguguguuucuaucacucucacacauaccagucucaaugcuuugcacauuugcuguggcuucucagucuugcccagcuucggcacacauccuuucuugauaaacuguuuuuauucugcgacuuuccacgucucaauuuuguucagagucacaggaaucuggaaacucugguaagcaccauccacauucuggagucugaaguaggaggagggagaucuuauaucuguucccuccauuucccacaucccuugcaugaaugugugugcacgcacaugaggauguuuguaugugcacguguucauguguguuagaugcuugaaugcacacuuuuacauacaucuacaagcagugagugcaugugugugggcuugcauaguuguggaggcacagggcugauggugagaaucuucuuuugcugcugcuugcaccuuauucauugaggcagggucucucaaccaaaugcacagccugcuagucuuguuagucaguuuguuuuggggaucuuagagaccgaaauuagaggugaaccaccaauaccaccugauauuuaccuagguuuggaaagauacaaaauugaguccuuaaaauugagugcuuaaccaacccuuuuuuuaaaaaaauuuuaauuuuauuguuaauaucuggcagaacauuuuucccacuuagaacagaaaugcuucuguuugagccaccaagaugugaacaaguuguaccaaaaggugccugccaccaccaaccaagcuacuccagucuccaugguuuuccugcugugauagacucuaccaagugagcugaaguagaccugauaucucuucagcugcucuucagauauucuguuuccacaagaaagugaugagucaagucaaauugccuuggcuugccuccuaaccaaaaugcuauggguuugggacucaagaaagauacacugagacaugcuguccuuuggggcaagaugauuauuagaagauuuaguaagggcauagacagacagacagacagacagacagcagcacagcagggacucugaugagaucugaggcccaggagauaaagucuggaauuccuuuccuauaggacuccagaggaaaggugugagaaaggugugagcuucaccggggacccaggccaugcugucucugagucccuggcuucugggaaagcaaagggauuucuggguaaggaacauguaacacacaucuaauaugguugagaagagauguggggugagagggugugucacagccagcagccccgaagcugucuguuucuccugagcaacaaggaucccagaaucaaggacugagaauggagcuugcagguggacaggacuugagcagugucugcucugggaguuugacaagaauuaucaccugggacauuuccuuuagcaagguguaggcuugcgaccacgaaacaggaguucuacaaaggcugagggguuacaacuagaaacuucucgccaagagaaagaacuugugugagcuacaucacugccccuauuuuccugguccccauaaucugggcaaaucacuuaaucucaccagaucuugcugucuuuguuuacauuaaagggaaaaaaaagugauuuuguuuucuuuuuucuuuuucuaauaucaauucuaacagcaggaggaaagugaaaucaauucuguucacauucauauugagcuuuugaaaaguaaaacacuuuuacuuacugguuaguuauguaauauaaagcauguaauuaguauauuaauuauauaauaauguacuaacccuguuuuaucuuugaguaguauaaauuuagcaggauuaagugucugagaguacucagcuaacacacaaagccaaaguucugaccccuguuuagugaccucaaaaugauguagccacuaaaaacaaacggucccagacuccagcagauaugaggccccugggcuuugauucagugugaaggagucacccuugacugcugcagaguaggaagacacccuugcucucucuccccacaucugugcacaugcuugcugucagucacagcaggucauucucccucucuugcugcuugaauccucacuggaagucagcccuuugaucugauccucccugcaccaaccuccuagcuaagauuccagagccuaguuacagggcuuagaugugugggcagggcugaauaagaugcaucuuuccggcuccaguuaauuaaaggagaggaacuuucugagguucccaccucacucccagaugcgauucaucauuuccguccaaauuuuaguuuuguuaugaauugauguggacaggucuucaacauaagcaaaggucuuugaggugacuuaacacacucaccuuauaaaugcggaaaacgggguagcacuuccuuaaguuagggagcucacuauaaguucaugcucauucucuuggaaguguagcucugauuggcuaagagcuugugguuauguagccauucuggaaaaugaaaacgaugacgcugacuuacucccagcccuuaugcuguggccagcaaaaccugccuuuacuauuuucaucaacuucauucugacuuucuuuacuaugcauaaacauuagcauuucauuaucuauaauccuaguuauagcuucuaaaauuaaccguguugggcuggcaagauagcucagcagguagaggcauuugccacugugcuugaagaccugaauucaaucucugggaccugcauaacagaaggagagagcagacaacuguaccuuuuucuuuggccaccagaagagugcuauagugcaugugcacacacauacauaaacacacacaaaugugcacauacauaaacacacacauacaaauguauacacacacaaauguacacacacacauauacacacacaaauaaacagaaguauuaaaauaaauaaaauuaacuuugcaaguaagaauugcaaguaugcuauuuuauuuuauuuuuuauuuuuguuuuauuuugagacaggaucuagggcuggagagauggcuuagggguuaagagcacuggauccuucugcagaggacuggaguucagguccuagaaacuacagggcagcucauaacugguugugacucuagucccagggaaacaaacaccuucuucuagcaccaggcaaauguggugugcagcuauacaugaaggcaaaauauccacacacaugugaaaaagauccaccaagaccaagacagaaagguggguucuggacugguagcucugccuuaccuagaguucaauacagagaccagacugguuucaaacuccuuauccugacucucucugccucucaaauauagaaacuaugccugagcccagcucucacugggcuauuuuaaaagcaacuugcucacuuauccaugcaugcagugagagucgagugugaacuguaagcuugucgacauguccauugcuggggauaacagugcacaaaacucaauagccuacagcuggaccagggauagagagauuggacaggcaaagagaauguguaagacuacagcaugagacacguguccugugagauacauucccuggaggauguagacuugaagagaguggaggguggggacuaaugugcuuguacuuccugagaauacaggaucuucugagaugcccucccucacacagagacaguauuuggagaugacaaggaccuggucaaagggcacugcauugagaggccugugucaguuccauuacuagucgauauggcauggcaagaaccccacaagaggcaaaggccuagaggugacuuaauucaguaacuucauuuuaugugauuaaacugaggcuggggcaggggguagggucuggggugggggcaccaugaacagauaggcucccaguacuagcaaacaacagaauuggggggcuagaguuauggucaugugugugguguucgagagaaccugaguuuggaguuccagaagccaugcaaacucugcaugaggugguaggugccuguaaaaccuagggcuacagagaacaugggaccauccugcaggcuugcugaccagccaguaaguauagaugaaacaaacugaggacucacuacagucccugucucauagaauacaguggagagccauaaagaaagauaccaggucucaguugguguccaguauguaugccauaugcacacaugugcagagaaagagagaaagggggggggggacgaggagaaaggagaaaggaagagauagggagaaagagagagggauggaagaagggaugaagagagaaagagagagacagaaagauugagagacagacagagagacagagucagaaaacaguagaagucagccuuugggacccaggaaucccaccaaauaccacuguaacagacugaugugguaagauguuccucuguggaauucccacuaacaugcuggaaaagaguccagccaaacaccuagcuuucaagguaccucacccccaccccauccugugcuggugaaguuuagaaaacauagcuucccauguugaaucccacacacagagaugcagguaucggcuugccuagcgugagcugugugcuuuggaaaagugauuuccuccuucuggcucuggacacuucauaggcaugcuugcuauuucaauguuaaagauuuaaaaguagauuguauaguuuuaaaaugucacauugagaagccauucgaucucucccaugcaggaacacaguagguugaugaugguugguuuuccuuucaacacaucagggcaagaguuacuaacagaaaccccagaucugugcguggagaaacugggucaguaauuuagcaggccaaagcuguaugaguaugguuuuucucuuuaagauaugaaaccuccaguuuccuucagagccucuuuuauuacauucucuuuauugcaucacgaggucugugggguuucauuuuuaccaugugaaguggauuaucccacugcaaaucucccuugaguucuuggaaaaauaugugagcuugauaagcaucaggacauuuuaaaggaaauacccaacuaagaaacggucagaguuugacaucguuugcagaggcccuggcaacauccuaaaaggucagguuuaagaucaugucuuuugugucucagggaccuccaaugggugauuccuguuucacacuaugaaauagcuaaggggaaaaaauggacuuuaauaucuuaaggccuuucaugaggcuucuuaagcagauaccauacagcaaagagaaauagcugaacuuaaaugaguauacuuaaaauagcuggcuuaaaacugugagcuaggggcuaguggcucagccaguaaagugcuuguguuacaaacaugaggaccuugaguuugagccccagcacuacccugugcguuuacauauguguacaugggucacaaaacuagaaaggggaugugguuggggagaaggagaucuucagggaggagggaaauagagaggguaaugaaaugcaugugaugagaaagcagaacacuuaauccccaguaucagcuggggaaagaaaggguacagagggggagcacacacugagaagggagcacacacuggggagggagcacacacugagaagggagcacacacuggggagggagcauacacuggggagggagcauacacuggggagggagcacacacuggggaaggagcacacacugagaagggagcacacacuggggagggagcacacacuggggagggagcauacacugggaagggagcacacacuaggaagggagcauacacugggaagggagcauacacugggaagggaacacacacuggggagggaaaugaaugagaccaaaguauaaugaaaaaagccaugauacaacuaauggcuuuacacauaaacuuaaagaauuaagauguaaaagagaaaagacacagcaaaauaccaauguggcaagaaugugcugaguacuuccuuaccaguggcuguguguuucuuucacagacuuggcaguguaaguucaagcucucaugauuuuaaguuggcuucccauuaaaggccagcaugcuuagcauguacguaggucucaucaccaucaccagcaccucccaaaguagaacucuguuugucacaaguguccagaggagugaagggagcacaggaagagacacgagccagccucccaggugaguguucucaucuucgaacagaacagaccuuuucccugucccuuggagaaagagaauaauuauccacagguuuuucacauuuuauugucccucaaugucuuacuaucaaaauuuacacacacacacacacacacacacacacacaccaacaucuccccaacaaaacagaguuucuuuuaaaacuuuugcauguaucugauugugcuuuugugaugguuugaaagagaaaugucccccaaaggcucauguauuuaaaugugugauccccaauuggugguacugucugggguggcuguggaauuucucguaugggagucuugcugaaggaaguacaucacuggggacaggcuuggggguuauagccuuacucaccuccaauuugcucucuauuuccuguaugugauugauacgcaaucucgaaacuuccuauuccuacccccaugucuacucaccauuucgaacaucuagccucuaaaacugucuuccuuaaguuguuugugcucaguguuucauugcaguaaggaaaaguaacuuauauagccuauuguugcauguguaccaccugcuugcagguccacuugaagaccacaagaaggcaccaggaccccaagagcugaguuuuugcaugguuguaagcaccuuuuguggauacuugggaccaaaugcccaucuucugcaagaacauaaggauuucuuuaccacugagccaccugaauuacgcugcaccaaaagguucuggacccuagugguucagaaaauacaaaaaugggcgucaaauaauaauaaugggugucaauaauguugacacccuugauaaaugaaaugugauacaguuuggggcccuguuaacuaaacaacaaaauaaaaugcuuacaccugagaucuacuaguauaauuaguuacguacuaaguguaauguguuuuuuauuguuaugucuagcacugagagaccucgagugcacacaucucuaauuggauggguuucuaaagguggaauuacaggaucaggaauacucuuaagacauaguugucaaaaacucaggcaacccugguuuagacacucauuuuaaccuugauaauuuuacuuaaucuuuuucaaguuugguuuccauaaaaugggguacauaguaacaucuucagggacaguuaguaacaguacagcacuguuaauaauaagaucaaaggaaaaguaaauuaccuuuaucuggauagcaagggccucccaacuuuggauaggaacacgugggccaaauaaaaccaccgugucaacagugaccccguguggcccuaucagaaauugguauguguaacaagcagugaucagauuguucacccuuucucuugguuaaguugugcuugagauccgaaaauaauuuggcauacccagaccucgagaaauggaaaaugaguccugaaaacucacauaaggaggucuaagccacugcuuuaaaugauaaggauggcagucucauuuggauguguauauauaaauaauaaacacggcagacagacacacagacagauaggugaugcauagauagacaggcagacagauauagacauacauacacacagaugagagacagacacacagacacacaguagucccucuuuacccaugauuucacuuucuuuuuuuccagugacccauaaucaaucucagucugaaauauuaaauggaaaguucuagaaguagagaauucauuuauuuaaacucguguguuacucagaagucucauaccauucugcaccacccaccauuaucuucucuggacgaaaaccaucugcuuuucuggagucuccaggcucuguacuccaccccauuagucacucaguucucucucgagauuggauuuuuaaaacauuaguuuuugagauuauaauugcaucauuuucccuucccuucccucucucuaaaccugcucauacccccuccuuucaaauccguggucuauuuucauuaauuguuauugcauguauaugugcauaucagauguuaugcacgacauauauuaugccagaugacaaauacaguucauaaauuuuauuucauagcacaccauauacauuuuaaacaauuucaguaucucuucuuggguucuauauguucuucucuauguucuuggguuuaacaaggaugauaaaauaugacguuuaaaacauuugaugguacaguuugggugucugucacuugaaaagccuggggacauugcugguuuguauuuguauuuauuuucauauuuggagaacuugcauauaugaaauauuuaaggagacccaaaucuaaggauaaaauucauucuguuuuauguauaucucaugcaaacagccugagaguuauuucauacaauauguucagugccucugcaucuuaacugugacucauccugugagcucagauguggaacucugguugucucacauccacuagcaagccacuugcuucauguguucauggugcucagugugcuuacaucaaguucaccaugacagccugggccuucugacuccagcaucagcucaagccaugagaacuuucuggaaugacaucuuguguuuugcuaugccaguuccaauaacucaccaaaauuccacaucugcuccccuacuugugguguaacaauaucucagcaacuucuauucuccuguaguaauuaucgucuuggagguuuacugccuucaccugcuaacguaggccuggaagcuucuagccucuguauaaucuaaucuagaccuagaauguuuucagcuucugagauucacugcugaaugugcucaccauuucuagcucauucugagcucuggcuugcuggcccaaagucuucuccuagcugaccaagucaaucgggcuucucucuguauugcucugcuuggccucaagccaacuuuggcaaccuucugacuccucauucucuggcucauucugucuucaccuguguuuagcuuguucucucuuugaucuauaucuguaaaacucucccaguaaaacugccuccuuccucucucugcacugcuuucucuugaguagcuagcuuccuauuccucucucuaacuuaugagaguuagcuauauccuacucugccaaaucuuucucugauuugucacuuugucugccacucaauuagacaucaaacauagugcuuccuucuacaaauuaacuuuaccuucauugcuuuggauuuuaugauacgucauauuuuaucauccuuguuaaacccaagaacauagacaagaacauauagaacccaagaggagauacugaaauuguuuaaaauguauauggggugcuaugaaauaaaauuuaugaacuguauuugucaucuggcauaauauaugucgugcauaacaucugauaugcacauauacaugcaauugcuuuggauuuuaugauauguacuaagggcaugugugucuguauuccagccagagggauuaaaggauguccuaagggugauccccacuacaacuagaaacaaguuucuucagccaauaacacaguuucgggauucacagugugaucaaauauccugcaacaacaccaaaggccugaaaguuucauauguagaauauuccagaauucagauuuuuuuggguuucauugcucaaucuguacauagauaucuaaagcuaauaacuucaaguggaaguuuaaaauuucaggagaaaauucauaaccacaauauuaaaauaaugaagcaacuuaaauacauaauuaaaaagcuuucaggauuucaacauguaauuugagcacuuuaucuauguauuuaucuaugagcacuaucucuauguauuuauuuauuugccugcuuacuuucuuagugugaaauugaacccaguguaccacacaugauaaucaugugcugcucuaucauuaagcuauaucccaagccugggaauaugacuucagcccuagaaacuuuucaaagcugauaguguucacacaucuauaaucucugugcuccuaugggaagaugggggcagagacagaagaauucugugaacauauggacaaggcuuucucucucucucucucucucucucucucucucucucucugugugugugugugugugugugugugugugugugucuguaugugggugugugugggugugugcaugcguguuuuagcacacugucuucugugacuacucauaugagacuccaagauuagagcuguugccaucuuucauagaggaggggcuuuaaguauuagacauucaccugagauuccagccaccccuuucuaucacucccucccaguaauauauaauauugccugugcugcauguggccuugugucucaggagcuucuagaguauguaauauguaacaauugaaugaagaaggacuauggagaacucaucaucuauucuaccaugaggcuucuggguaauaucacugcuuuggguucaucuaugcuccuuguaagugacucuucacacaucucuguaagucauaauaaacauauugggucacuaagacagacuuggauuaaauggaccuucagucuauuggugcccuaccuagcagcaaugcauguuucuucacauuugcccugguaaagcccaggcuagagagagagaguuugugugucugcccauccauccauccacccacccacccacccacccaugcaucuaucugucugucuguauaucuauagcaagcaugagaaccccaugauguagcuuccauaaagucaucauucgugauggcaagacuuugugaugauucagcuguuugaggggcacccaugcacccagcuucuugauauucaggguuaugacugucaacuuucucccaggaagaauggaaaugccucaauccaucuuacaaguuuuuguauggggaugugauguugugauuucagcaauucagucauuaaagaaagcaaaaaaugaaagcuagauguagugguacuuaccuuuaaucccagaacuugggaagcagaggcaggugaaucucugugaguuguaggccaggcugaucuauauagugaguuucaggauagccagagcugcacaguaagacacagucucaaaaccaaaacaaaacaaugacaaaaauuaaauaauaaagacagcaaaaacaggagcuggguaggagggcuuuguggguaaaggcauuugcugccuagccuggugaucugaguucaaucccugguacucacaugguggaagaaaagaacagacuucugcaaucugucccuuaacuuccacaugugccccacacacauaaugaauuucuuuuuuuuuuuagugaaaacaaccacaaaauggaauuaaauauuuauuuacaaaucaaauaugagucucauguccacaacaagaaucuuuuaccaggaauauauaaagaauucuucagggggaaaguauagcugaagguagagaacuugccgaauguacaaauucucggauuccugaccuucauggggaaauucucucucucucucucucucucucucucucucucucucucucucucucucucaauacucuaacucuuaaaagcaaagggccaacucuauuacacacacacacacacacacacacacacacacacacauacacauacacacaaauccaguucuauaaugaaagauaaaacaaguuguuuguuuuuguguuuugauuuuauuuuuagaguaaaguauggaaauuggcuuuuccccagagggaaaacaccaaggcugauaauuauauuaaaaggugcuuggccuucaucagggaaaugcaaaucaaaaaccugcggcacugccucacgugcacuaggaugguugauaucaaaacaaaacaaaaccacaaacaaacagaacaaacaacaacaaaacaaacugugguuguuugauagagaaugucgcccauaggcuuagauguuugaacauuugacccaguugguggagcugcuuuggaggggucgaggccuugcaggaggaaacguguuccuagaggugggcucaaagucuaaagauuugagccguuuaaggugcuuuuucucugccuugugcaugcaguccgagaugugaacucugagcauccugcuccaggcgcuguaccuauccacucugcucugccauuugagggucuaucuaucugaagcuguauguccaaauaacucuucuauaaguuaccuuggucaugauguuugcucacagcaacaaaagagacauuauaccauagaucaaaauuagcaaauauugucgagugugcaaaacaucaaaaucucauguauuucuuguggcaaugaaaaagauacagcuccucugggguaaagcauaggaguuccauaagagauuaaagcaggaccuggagagauuugcuguucuugcagaggacucuaguuuaauuguuaauauccauauuggguggcuugugauuucagcucugggaaauccaaagcgcucucuggccucugugggcauucauauacauaugcaaauauacucucugucacacauauaugcauacauuucaaacuaaauauuauauauuuuuuaguguuaaaacagggucugugguaauggcuagagaguuaagaacacauacaguucuugcagagaacuuaaguuuaguucaauugcaccaggugaagaaaggcagaggcaggcagaucucagagccucacuagacaaaacugugaggcacacuggaccuaaagauaaaauuggagagcaauagagguggaagacaccugauguugauauaugaccucuagaugcacacauucacacacaaaaauugcacaugaauguucuuagcuacucuaauuauaacaguaaaaggguagaaacggccuacugaggucucaaaacugagaaaccacauuuggcacaccgacucuauugagagucuggaaggacagcucaggaguuagaggacacguugcuuuugcagaggaucgcaguuugguucccagcacgcgugugcggaggcucacagucccugguauccccaauccuuccagagcucaugcccucugguagcacuuuugggcauugcacucacaaguacaaaacuacauaacggacacauacuuuaaaaauaaagaaaacugaaaacucuccucuguugugagguggaaugcaagaauauaguucaauuaguaaaacuuacaaauguagaaaguuaggggaaaucuaauuaaauuuugaauuagugaaaggaacaagucaauagucguacaaacccaauaaaguuaguagcacuuagcacuuuuaaaaagauaucuaacuagggauuuaaaacgugccuauuuaggaacaaaacaauaacuuugguagucugacuugagacugacuuccucuucaacaaaaugugaauaaagcguaacaaguuaaacgcuguauaauggaguagcaacacuucaccaggguucagugaggcacacagaaaguuaaauucagaccacguaaguauaugcaaaccucagcaauuucuauucuggccuucguauuuugcuuucuacuugauagugacuaccuaguuugaccuaaugggcuucccguuguugcggucucucggcgcgcaugcucauaagcccgcugaccuuuggcguuuacuuccugcugcccugauaauggcugcucgcggcgugggguuauugacccguuugcccguguguucccagagacggaaccgaaucccgcgcucuauuuccaggcuccucaguuguccagggacuauugcggcgagcaucgggagcgaagaacagucuucggugguugcggaaacaggugauggcgcuggccggggcgggcggaggccgagcggcccagucucccucccgccugucacuggagcacgacugcccaguacagcagugaaaucguuuagggaaggaacgcaguuggcgagugcuuuauaguucaacacggaaaccguucgcggugcuuguaacagucuugccucccagccggccuugcuccaucccugaccuuagcgcaucugccuuugauaaucuuucuuguuuuggguuauuagcgcugugcugaaagaccauaaccaaaagcaaccagggaaggaaagaauuuauuugaauuacauauuuugacccacuguucacugaggaaagccaaggaggaauuccaacuggucagaagucuggggcagaagcuugcuccucguggcuugcuuaaucugcuuguuuuauaauccaggggcacaaagccaagaugguaccaccuucaauaucaaucacucauuaaagaaaaugcuuuacagauuugccugcaacacaaucuugauagagccauuuucucaguugaaguucucuuguuucugaugacgcuaaaacuagccaguguaauauucauaggauguugccagaggcugacuacacuccagccuaaugaacagcugauuuuccugguucucagaacccuuugccuaugaaaugucuguuuauuauuuuggauuuuucagcgcaauccuauugguaacagucuugcauauugagccguucuuguaccccaguaaccuguggauaguuuuuagaauucuagaacagucgugcaagacuguauguugaaaugacugaauuggauuuagcagaagcagcuucuguugaaaauucauuaaauaacccaguaaauccaaaugcgguuucugccagagauucuguuguaauuuagcauuugugugauggcuuaaguuugagagcauuuuuauaugccccuugggacauaaaagaaaaccuguggaguagaacagaaggcauuauugcaacguuguuuuaauuucguuccuauuuucugugugcacaugugaguguugugucuguguguaugguugcauaugugugggcacguguguaagugcgugugggcaugaguguguggcucuuucaaacuguucaucgaggcaggaucucaaucaaacccagagccggaagaagugcuagugucaguucuugcucuggaaaccuucuagcuagugcaggugagccucccugccuaccucacauuuaccugagguccagggaucugaacucuggucuucaaacuucuauggcaguuauuuuagccagcgggccauccccucagcccugugacuccauuuuauagauaaaaagagcaagguaagccugccuuucaagcucaagcuuuaccaucuacagaguagcaaaagcagcaguaaagcucuccugacgggaggccuuugucuuuccuagcuauauugauuguggaccacauuuguaucauuaggauauguggugaggugugccuuuacauaaaaagagaaggaaaugaggaccagaaggaaaaacaguccaaaggcagauugacaggaaguaaaguagucuguccuuaacaugaagaagauagucuuccacacuguuaaguaaguaaacauaacaauucuauggaguguacuccuucauagauaccaaagugagguaauacagagcuggacgacagucuacuguggugugccugaaaucuuuacacaccuaagcaaaauuugaaggcugaaugaaaguuggccagacagaacgaaagcaggucggcauuccaacagggaauagaggcaagaaagcuuuuagcauguaauguguuguguguacagugugguauguggcagguguguaauauguuguguguacagugccguauguggcagauguguaauguguuguguguacagugugguauguggcaggugugugauauguuguguguacagugccguauguggcaggugugaggacagaaauggaugauuaaaggaggcacguggugccagcaaccuaggcuggggcauuuagacuucaguguacagguagaagggucauguuggcaggaaugugguccaaugauugagggggacaaaacagaagugccugaguccaauuauggaguugggcugcugcaauuccugaaaugaaugaugaagguuguuguggaguggauaggaggguacauguaaaagugucuucaacaucuagagcaggagggaguugggaggagggcacguguaagugggucuucagcaucuagggugggagggagaagauugguauuuuugcugguuugcucacuuguuauagggcugagaggccaaggcccagaguucucugcugugcccuaagagacuuggcuuugaacuggugcugaugagggcaguuuaggauucaacagcuugcacugucauaaacucaaucccccucuuucccaugaaaaugucuuggaguuugcuaaaaucaagauaggguauuuagaguacuuucuugguugggcucaaagcuuuuaauuuucauaugucaguuacaacucccauucuuuugagucucuggaauuuuguugaguaugcugcugucaaacuuagugcuucuuaauuuauagucuauccucucagacuuagaaaaugcacuuuuaacucuucauugacaguuaaguauuuugaggggaaagcgaguuuauuuuccuuuuauggucagugaauguaucuaacucgacuguaccuguccucaucccucucuuuguaaaacuccuugucucuagaaagguucaaaggauuucuuuuguagcucugguggauggucuugaauuucacuguguagcagaaggugaccuugagcaugggacccuccucccucuaucuucugauugcugggauuacagauauguacuuuucaugcccaguuuuguguuguacugaggauugaacucagggccuuguucuaucucuagcuuuagauuuuaauuuuauuucccugugauagaaugccuaauugauggcaaguagguaucaauuguuugagucagaucaagacuuuagauggaaaaaaucuuuacaguaacuuacuacagcuacauacaguuaaaugucuucagaccauuguuugauuauacuuagacuuguauuaauuuccuuuaggccuuuuaguauuacagauuuuacagguuuuguuuguguauuugcagaaguguugagugagugguuuuacguccuaauuuuugcagacuguugccagcauuggucuuggguauuccaaaucauaauuuuaauuauagucacagagaauuguaagaugggccaagugugguggcacacaccuuuagucccagugcuucagaggcagagacaggaagaucucuugaguuuaaggcuagccuugucuacauaaugaguuucaagccaaccagggcuugucaagugagacuugucaagaaaaaaaaaaaggaaagaaaagaaaaauuucuaugcacacacacacacauauuaaaagaagagagggcagacugugcagguaggcuagagaggugcuuuuggccaaguuugaucaccugaguuuggucccuagaagccacauaguggaagaagagaacuuacucccaaagcugcucucuaaccucuacauauaugccaaugcacagcugcauaugagcacacaaaaaauaaauaacauuuuuaaauguuugguuaggauaaaaugguuuuaauuacauguuuaaucuucauaaacuuuaucaacauguuuuaaauuuuauguguauauuagagauguuuuugucucauuuguaggcauugaagacaagacccuccaaaagaaauucucugaggugcagaaagagagaagagaacaggcccagcggacuguuuugauacauuguccaaauaauaucaaugagaaaaaauuucucaaguauuuaucccagcauggaccagucaauaaucauuucuucuacgagagcuuuguauguaucuaaacuuuuaccuuaccugggggugaugcuguggaaguaguuugcugcguuugaguguaugagccacaucucuuggcauugcacccguuccuucauuucuuuaaggaggguuuccuccccuugggugugagaaaagaaacucguauagcagugcuucaggauuauaguugaggucuagcucagucauuaucuagcgcacggaagacccucugcucaaucuccaggagugcagaaagaaaaagaguugucaggaccuuauaauggagugacucuguaaucugaagaucuuagagcagugguucucaacccauggguuucaacuccauuggcaaaccucugucuccaaaaauauuuacauuaugauucauaacaguagcaaaauuacaguuaugaaguagcaagagaaauauuuuuauggcugggauccccgaagcauuaggaagguugagaaccacugacuuagucuagugcuguagauauuggcagaaagaaauuugagcuauauucagugcuguauguuacacugaucuuuucaggguacuguaaaguucuuuuccuaauuuacuuguaaugagugcuguuagaauggcaucauuuagccgggcgugguagugcacgccuuugaucacagcauuugggaggcagaggcaggcggauuucuaaguuugaggccagccuggucuacaaagugaguuccaggacagccagggcuacacggagaaacccugucucgaaaaaccaaaaauaaauaaauaaaauaaauaguggcauuaucauuuauaaaauugaaaaugcaauauuaauaacaugauaauuauuugaggaugcuauguuaauguguuaaaaugucauugugaagcaugguuuuguuuuguuuuuguuuuucuuauguuuuucauacagggucucuuugcuguuguagaauuuugccaaaaagacaguauaaagucauugcagaauggaacacauacuccaacccagagcacagaggcugcaauuccauuuaagucacgguucuugaacuuaaggcugaagaauccgucuagccaaguaucuggacagccauuuguacagacaaccaaccagucaccuccuucaagcaaaaagcucuuugaauuacugaguuaugcagaaagcguaaguuuacauguguaucucagauuuuuuuuuuuucuuuuugguuuuucgagacaggguuucucuguguagcccuagcuguccuggaacucacuuuguagaccaggcuggccucgaacucagaaauccacuugccucugccucccaagugcugggauuaaaggcgugcacuaccacgcccggcuguaucucagauuuuuaaaugugugcugugcauuauaaaaguugugguacccugcuuuguuacuguuuaguagcuacaggguuuuauaagaugagaagaguuagaaguggaugcauagcaguuucugcuaagaagugauagaugcagcgauuaguaugugagauugucuugauaauugguauaugaucucaaaauuacuguaugguuuuccuccuaauuucuuuuagaguagugaauuguagucauaaggguccucguggcaagacagucuuguacucauagaaucuaucuauuccaucaagguguacuuuuuaaauguguauuugcuugacucauuuuuuaacaacucaaaguuuucuuagugaauggaacugguuuaagaaauucuuucugcuuggggacuggagagauugcuaaaugguccugagcucuuggcugcuuuugcaggacaaauugaguucucagcacuuuugucagaugccggacaagcacugugacucuuaacucccgggcauccaaucccucuucuggggcaauuuacucucaugucuauacacccagacauguaauuaaaagaaaccuacacuacagaauuggcugaaugaaaaaaauuagucucccuucuccaguuagagacuccccaugccgugaugcuccuuaccuuauagguaaaccacguguugccgaaguuugggguccuuuugaacaauguagaccuuuuuucucuucuuaaugcaauaauuaagugucuauaauguauuauaauguauuucuagguuugaaucuuuauccuaguauuuuuuuuuaauccugauugaucaaacuuuuagguagguuagugaucuuuacaaagaaucagcuuauuuaucuaaauacuguuuuggguuugauuuucugaguucuaaucuuuugcuucuagucuacauauuuccuucacugccauugacuuauuuuuuaguuagugcucaguucuuuacuugcaggguuguuuucaaguaaaggcauugaaagcugugacuuguaguuuaaauguucaacucuaaugcaguuuugaagucuuuaauagucuucuaaggagucaguggggccuuuacugcuugaauucuguguuucuuacccuuugacacuggggugccuucccgcucugcucuuuaugcuuguucugaccucuugucagaugcuuccuuccuuucucuuugcuaagacaauacuuccuacuuacugccuauaaugaaaacuuguuuuaauucuaaguuuguuugguugguuugguuugguuuuugcuuuuuguuuguuuguuuguuuguuuuuuauuuuuuugagacgggguuucucuguauagcccuggcuguucuggaacucacucuguagaccaggcuggccucgaacuuagaauuucaccugccucugccuuccaagugcugagauuaaaggcgugcacugccacacccggucuaaguuuuauuucgcuagcacuuuuagaaguaguguuaagaaucagcuuuugccaguugauggugguacuugccuuuauucucaguacuugggaggcaaaggcaggggaucucugagcuugacaccaccagccuggucuacagagauggcucaguggaaaaacugcuugcuguguaaaugugaagacccauguuuggauccccagcaucuacaugaaaacagagccgucauggcaugagccuauaaucccuacacugggauggcaguacagaaacagguagaucuccacagcucccuguccagcaaaucuaacuuaaacagugaucucugguuucaaaaagauaccccaucucaaaaaguaagguagacagcaguuguggaagaaacccaguguuaaucuuugaucuccauaaauacucuuguguauacuaguauaucacaggagcucaugugggcguguguguauguguguguguguacacaugcaaauacguuuuuaaaucuacuuuuaagacugagaagaauuuuucuuuaagguaaaucuuguuagaaugaaaauuacauuauuuuacagaaccuaaccagguaaauuagaaugaaaauuacauuauuuuacagaaccuaaccgucuguguauucugucccugucuuuggccagcuagauagaggagcagcugaacacucuccugaaggccuuccagcucacagaagagaauaucaggcuccgccaucucaccugcucucugauugaggacauugcugcugcauauuuucccagcugugucauccggcccuuuggcuccucagugaacacauuuggcaaauuaggaugugauuuggacauguuuuuagaucuagaugaaacuggaaaacuugauguucacaagguaauaaauaucucuuugaaccacuauaaaaaguuagaagagaagucuuuggaccuaauacaguuauagcuguuuuuuaauuuuagugaacaugauuaaagaaugcaauuuaucugcuagugauuauuucuagucuuucucuguguuggucugguguggggucacuuacugugcugcuucuacaugugcagaaaaauuggcuuccucaggguuuugggcacugacauucauguccacacgcauagguguguuucagauaucaguagguuuaaauuuucccugcugucuucuuuuguuuuaauuaccucuuggcuugaaucauccuguuuucuacuuuuucuaggugacacuugguuguccagcucucagcugucuggaaguuaucuuagagugcagucuggguuucgcacagucuuagaauuacuuuuucuguucuagaaugguucuuguuagcacagccuugaaaagauuugucucuuagaguuaaggccuacuucugccucagccuucuuguagcuguccuuucuuuuucccccacccugcuuaaaauuaaucaccccacuaucuuuuuugcaccuuuuggauacuuguaucuuuugagucuuccuguccuaucuaugagugacugaucugccaguucccccuguguccuaagcugagcagggcaggcgugugucugucugugguauccuaagcugagcagggcaggcgugugucugucuguguuguccuaagcugagcagggcaggcguguugucugucuguguuguccuaagcugagcagggcaggcgugugucugucugugguguccuaagcugagcagggcaggcgugugucugucugugguguccuaagcugagcagggcaggcgugugucugucugugguguccuaagcugagcagggcaggcgugugucugucugugguguccuaagcugagcagggcaggcgugugucugugcuuuaccucuauuacagcucuagucuugaagccagcaaacaugcguguguucacaucacugaaauuagcaaggaguacaaugacaucagagcuaaacaagucaguuucaguaagguuaacauguguuggaaauugguuuucuccaguuuugcuguuuugacagaaagucuuauguauuccaggauuuaggcaauagaaguaaaaauuaguaacuaugucccaaguaguguuuccuguugucugaaugucuggucugugugcuuuuuuuuucucauuagaauuucuuccacauguagugcuauaggaacagcaaauaugagaaccacucauggaguuagccuuuucuucaguuuuucugccuauauauaaugcaugugugcacauggggugcaugcaaaugugagugcuugauagaggucaugguucaacauggguggucaucuaggcacuuauauguaauuaucuguagaggccaggguucaacauggggugucuucuucccuaucuuugagacaucaucuuuauugaauucagcauucugauuggcuaaacaagcuguccaguagcacugguugucugcagacacguaccaauggagcugcuuccuagcccuauuuugucaaaguuuuguuuauuuacugggcaagcaucaguguauucaucugcgucuuccauaguaacauuguguuauuuuggugcaggguuuaugauuagccuacauguucucuugcuuuuuauaucauucauucuaagcucaaguaugcuuugguggcagucgguuucccagaucucagugccccuuacauaugacuaucucuugcugaggcugaauccagagcagccuaaugucagcucucuggucaucccuuucuuuccagcagccaggcugacucauuugucucugccuguguccuuccuaccaaugaaaaugcugacaagaccaucgagagcugaaguauggcccuuuauggcuuguucugauccuaagaaugaucuaggaagccggcuuacauacaaagcauacccacaugggugcagcaccauacacacaugcacagagcacuucacucacuguccuugaccuggccaucccucccagcuccaguccuccgccuugaagcccauugcucagaaccucagaacuggauuguuuugguuuugguuugguuuugguuuugguuuuuuguguggcaucaucuguaccuuuuccauguauuuuguauccuuugcuuaugagagaacaagucucacucacucacuccucuacugucugcucuucagguuaguggcuuuuuuaaaaaccaucuugggaugaguuaauuucaaauauauuuauuacuauuugucuuaaauggaugaucuuuuucuuuguucacuuuucuguugaccucuauguaagaaagccucugugucuuguuuucucuucuugaucugccauucuucugccuguaucccccccaccauuguguguuaacaggucuguugggguguuugcuggcuauguguguaauaagugagucuguggguauuaguucuuuauguacguacucuacugcaguauguauguuaaucuuaagucagugguuuuguagguuagugcuuguauuucacaaaacucaaaggcuaccaaauaucuuuaagucuaauuuagucugauugcaugugucucaguacugcuuugguuuggccagaaguuauuuauacucuuaaauucuaaaucauucuuucuuuaaaguuuaaaaaaaaauucucuucccaaaaaucuccucauaauuaucaguguuuucauauucagaauacagggaauuuuuuuauggaauuucaagugaaaaacguuccuucagaaagaauugcaacccagaagauccuaucuguaauaggagagugccuugacaauuuuggcccuggcuguguggguguucagaagauacucaaugcucgauguccacuggugagauucucccaucagggcucuggauuccagugugaucugacugcuaacaauagguaugaccugguaaacgaacucacuuagaugugacuguguucuuagcucaacucuuguuuacaaacaguagcucagagcucuuuuacacauacuucaauacugaaugguuucuuugguuuaauaugaacucacuaaaugggguguaauggcacauaucuauaauccccguacuggagagugugagucaggaggauuguaguuuucacuguuuuuaagaauguugcauuggcagugaauguguuugauauucaagcauuuacauugaauugaauauugggaaugcauagcugguuuggcuuugagacaggguuugauguaacucaggguggacuccagcuuccuuuauagcuagagcuguuguucagcuccuuguccccauaccccuaccucccauguagccugauuugcagguguuugccaccaugccugccagcauaaugcuuugguuuaauuaaauguaggcagaaacagugagauguuuagaucuguuccccaaugugucuuuuauuugacccuugugucuuaacuugggguuugcaguucuuauuuuuaacuuuucucuuuuaaaguauugcuuugaaaaguuccgaacuccuuuauauauauggcucccuggauucgagaguaagagcuuugguguucagugugcgaugcugggcucgggcacauucauuaacaagcaguauuccuggugcuuggauuacaaacuucuccuuaacagugauggucaucuuuuuccuccagagaagaucaccucccauucuuccaacucuagauucccuaaaguccauagcagguaagacuagaagugacuuucucucuuuuugacacuggauagacauuuacccuguagagucaaagcauauauauuuguaagucaucucauuuaugucuuuauuuuuaaaucuaaagauacauggauagaaauuuuaauucugauuccaaauuguaagugcuguguguauguuuucaccaucagcauuaaaacuggugcugucaagcuaggccuuauuugugucuauuggcaacuuguuuaucauagccuuccaagagcuggaucaucucacuuaguugaccuagucugagaugaaguugaaaaccaacuuagguccagcucuggaucugaucacaguucccagacuuuccagcgucugcuuuccagacugcacugugcugucugaaauggcuuccugauuuuguaaagauucucagcggacuuaaauuugaguuuaaaauuaguccuggauauauaguguuuuaaauucagugugcucuuuauguuaugaauaaauugaaauuuugauagcuugcuagaagagauggaaaaauauucuaaucuguaaaaggaagauaauuuagggggacauaugucccauugugcauguugcucuaagguaauucuuaaauguuuguggaugaucuucucuguuuaaaauaacccugaaaggaauuuuauuccuauauaaugaguugugaacuauguguuaguuuuuaaaaccaucugcuuucuaagcuacaauauccucugccagucuuuccuauauguucccauggccaccuacacuaugauuguucucauaagauauuuuuuuuaaaucugcuccuuuagucauaauuaaauguuugccuggaaugugcuuucucuucucucaaacuaaauuaucucucucugcuaccuucccuuaauucaaaucagaaguuccuggaaaugcaacagauauuaguauaguucacaacugaucuaagaaaaaccugaguugguugguugccagagaguuagcaggguggaguggaacuuggugucagguccuaauccugaaacagaagguagcagccuugccuguggccccuccucccuggcauccuucauucacaaaguauuuagugacuacaugugucagauagacaguuuccaauagcuaacaaacuagaaagguaagacauaagcaaaaugaagguagauucucaucaaugaacaacuuguaaacauuccuucuuauucugcuccugcuggguacacugacguuuuaaaacugagaagucaucuugucauggagcccuugggaucuggaaacuggaaaaccaacaauaacaacaccaaaaugauggaguauaucauuacucuguuucagucucaaaguccucagcccgagucaggccuccucuggccugcugugacccccuucucccagcauagaggacuccccuggcaucaucccacaguuuucuucccugcccuucagcuccugaguacuaauggagguuuuucauaagcagguaucugauggucucauucucuuccuuggaguucuucaacaucuuccugguaucugccaguaauuuuaauacaagaguaugguuuauaaacaaacuaauauauguguguugagagaugggacucuagcucaguaguccaucacuugaguagcaaauacaaagcucgaaguucaucucccucauagccucccucccccaaaguaugcugucuucauucuaaaucauuuaaaaauaccacaagggguuauuuuaggaauuccuuaguuuuccacuuaaagauauccaaccauugauuuucaaacugauuaguaguucucuauaacacauuguagguaugguugucagucaauucaaaguagaauuuacuuuuugguuacuuuuuaauuuuccgguuuaaaauugccaugaaagaacauuucuuaaauggaugucuuuuaaguaugagguagaaaucacuuugaggugaacuuaucaaaaugucuuuuuccuguucauguauuuaaaguuauggcauuaguacaugcugauuuacauaaggcuaguguuaauguugauuaaaaagucuguggcuaagagaaaaaaaacaauguuaaacucacagaacguaagacauuuuggaaacugucauuaacuagcugaaugucuuucauauuugauuucuucugggccucuuauuuagaacacuggauagucuuaccaguauguucucuuuaaaauaauuuuguuuucuugcuuguuuguuuaauuccugcaguacccuucagaaccucuagaacuuugcaaaccacuguucagugccuaggauaaggugaaagccuacauucucagcauugccuauucucuuucuccuggggccucuucucuugcucgucucggguggucgugcccucucuguaccugcucauucaccucuccccacccgugccugcugugcucucugucaugccacugucuauggagaacugccacaagaugagucaggacagcaaaaagacagacuguacugaguggcucucauuugccaggcuugccuggccuugcuuccugcccugcaggaagugguacugugugugccuccaugggcuggaugcaugucuacuucaggaguacaaugucguaaguguguaauguacugcaggaaucgcagcuguguuaucuggggguacuacccugccagcucuuaauggcauagcuugauuuuuaccuguuuauuucuuauguaaaagacaucauuacagaucugacauuuucagcguucuuugggagcagccacauuaguaauaguauguuugugaguugcucauuccauugaggagagcagcauagguaagaugaagagaaauauguagucaggaaguugagaaaauacaaacacaacccuagggguucuguuguguggguaauuuggagaaaugaggugguaguugaaggacaucauuagcgaaaggauaaaugugaaagauauuggggaguaagcaauaugagagguauguguuuguacauauagccaguuagaauaguauuuucaccuuuucucauuugaggcuguuacauauuaguuugagugaacuaaaagugggaaaauagagacaauaauaagaguuauucaucauucucuuacuuuauuauauaaaguugcaagccuucacucuguccagaucaccuuagaacauguuaagauaccuucuguagaucugugggguuuucugugggaaggggauauucaccuccauuccucuagcaaacucaugaugcauuccacugaccccugcuaccuuuauuucuccaaaggaaaaacguacagucucgucuucuuuaauagagaaaguaaaugugccaucucuaguucucauauugaugccuucccuucagucucagacgaaaugcgcucucugguauuuuggggcuauuccauguuccugucuuauucgugacaacaguuguuccauagcauagucaugaaucagcuguguaccaaaauguagaacugccuaaaagccacauucugaaugccucccagaguauugucugcaucagggacucaggcccaucucuacaaacauuggaccugcugacuccacuuucugaaaaucccacugauccauagcauuugauucuucugggguuugcccuuuaauuucaaugagucugaauaaaucaguuuuuucuuuucuagauuguacuuuugaaauucuguaaacuuugccuaacccuaggugauuaagguguucuuaaaguuucuuugguaacuuuuauguuuuacacuuuguccuguuauccauuucaaguuaguucuuuuuggcaugugaauguccaauuauucuuugcacuguuugcuuuuaaaacaagguacacuuucuccaucgaguuauuuuuguacccucaccaaaaaucaaugacaauaaauugcccauauuuguguguaccuauuucuguacugacauaugucuuuagacgaugucugucuccccuuugagcaguauugcaguacuuggauugcaguagcacuguaaugcuuacuguggcauaauauggcugcuacggguucauucugcucaagccugccuaugccugucuacaaaguuaugccaggcacucagaagauuugaugacuuacuaggucuaguccaguuaugugugccucuaauuaauguaguugacaguuucaugcauauguaauauauucugcucacaugucuucuucccuacuccuccacuacuacucucccuuuuucccaccagaucuucacccuacuuucauuuuaguagucaaaggugacugugccuaaccuaucagacaguguccauguuugggugauacuuaaagaaggaaaagaacaggaagagaagagaggaaaagaguagaaaaccaguuuaucaggcuugaaugcuaagauguggaaaaagcaaagauggucuuaccuuugaguuucaguauuuucuaugaaaucuuuuuagugaaaaggaacacugugcuggcuaguuuugugucaacuuaacacacaaaugaguuaucagaaagaaggggggccuuaauugagaaaauaccuccauaagaucuauauguaaggcauuuucuuaauuagugauuaaugagggagagcccagcucauuguugguaguucuauuucugggcuggugguccuguguucuauacauaaaagcagacugaacaagccaguaagcagcaccccuucaugacuucugcaucaguucuugucuccaauaucuucuguccugacuuccuuugguaauaaacagcaguauggaaguauaagcuggguuuuggucaugguguuucaucucagcaauagaaacucuaagauaaauacgucaguagagaaagucucuggguuuuuaauugaauguguuuauagaaauauuuuuaaugugacucuuauuuuucuuugcuaguaauuuuuuaaauuagaaacagauuuuuuucauacuauauauuuugauuaugguuuucccuccccaacuccucccagaugcucuucgauuccacacuagcccuuguccacagcuuuuuuuuugucucagaauacaaacaggcagcuuaaaaaauaagauaaaguaaaaacauacauacaaauagaaaaagcagcugaagaaaaagcacaaguaacacacacaaaugccgagacacacauuugcacaugcagaaaacacauaaaaacaaaauuggaaagcauaauauauaagcaaaagaucuguaagaagaaaauaugucccgacauugugagacaaaaaaccuccauagauaacacugaguuuguuuuauguuaaccaucuacuacuaggcuacuaggcuuguguacucagugagacugauuggucaucaauuggagauagcuucugguagacuaggagugggaacuugugucucauuucccucagcccuagguccccaucucgcuuaguuagaccugugcaggcccugugcaugcugcuauggucucugugaguccuuaugugauucaguccuguugugccuauaaggcuuugucuccuugcugucuuuauucucucugucucucaagauguuucugccuccucuuuggaggaguucccugagcccugaggggaggaauuugaugaagcuauguagaugaugucuucaggaauaggccuuauuaucaguuuguagagagcaaccaauagccuuggcaguaaccuggguuguuuagggguuuccauggggcccuuuguuaguaauguuauaagucagagacauauuccugggggugggggcacagcugcugaaagacagugaauugccaugggcuggccucaguuggucccucaacccugcgggagaaaucagguucccaguacucaggugggcaaggaguuggcgaaugacagacaugaacaccagagugcuagaucugaacguaauuucucaacaugagcaucagacuuauaauauagaagaaaaaaggaaguuaggcaaauacaucagucaagguacaucgagaugcaaaaugacuuuacacaaaacagagaagugcauacaugaaggcugacaggaaccaggcaguauuuacaacugagauaagaucaccccuaucuaaagucaguuauucacaggagccagaugaaagggcuaauaugcccaggugcaauucuagucuauuguuuaacccaccaccgggggucccuuaguaaauacuuaauuaugcuauuccucugggccuagugaaaaucauccaccaggggaguuccauucuacuaacccuuucaugggugguaauguguugacuuuguguuguuauagcuuugggcaugugguaaggcugcacacaguaguggaggauacacuggaauuuuauaggauauagacaugugccugguccugcaggauguaagcaaugggggucucagggaagggagcaacaaugacaaauuugggaucaggagacuggaaggaaggagacaagacaaaaauucuguucaagucucaguuuacucuagggaaacaaagggauuaaaaaucuacaaaccacaaagguguuugcccaggugcauggccuaaaccaguauuauugcuugguuacacaauaauguaaguggaaugucccauuguaaagaguccagaaaggaauguccucauuauaaaagguucggaaagcuuccuaucauaaaaugucccaagucauuugcgggaaugaaagcaagauaguggaagaaaucagaguguuuguuaauagaugauggcccagggacaagauggaggcugagaugccaggggcauuugggccccaacagacaugagcagaagaggaaaaggugggucccucuguuucuucccuucaagggcauguauguccucaauauguguuuaccaccucccaagaucaccaagcugagaauaagucucuaacccaugggccuuugggggacacuccagauucaaaugggaacaguagaacauauaacauugcaagggaaauaaugucgaucuuauuuuguuaaaaaaaaauguaaaaaaacauaaaagagagagaggauugaaggaaccuuaucucuuucuaguuuuccccugggaauuauagacauccacagucguucaaauuauaaagugucugcuauacaauagauaugguugugggucaaacuaggagagagauaaucauaggagaguggucuuuuuauuccuagacuggggcagucuggugacagacaucaugccuauaaucaaaaugcagucagguaaguuucaguagaggauggcuuauauuaggaaauagucaaacaggaggcagcugcugaucagccuugugagauuggaguuguuuuugagaaacaucauguaggguaccugguagauuucaugguacuuguggacuuagcaaaaauaaagaaaauuacuccaucuuaagauaaaugcuaguaggaaagugaaugccugguuuaauauauucuuacuuaguuuguuucccgaauuacuaaauuuugaucacucuggauuuccucauuugauaaauuaacaauuuuaaaaccuuuuagaacaacuaguuugaaucauugaaaacugccuguuuuuauaacuagaaaacucauuacuucagaagaugaguuaaaaucuuugaguugcuagacucuaauuuuaguacagugaaagaaauguagcauuguguccacuguuguguaaucauuucaaauccuuuguaaguggaguuguaaaaccuaugaacuaaacuacauauaacacaacuaaugauaguacauuggaauuuaacugggcuaauucacaguucugaagggggaaauaguuuacaggaugaaacucucuuucuguguauuuaagaugcugaagauagauguauucuagaggggaacaauuguacauucguccaggaugugaauaaaauucaaccuucuggaaacacagaaacauuagguaagucugucuccuuuuuuuuuuucuuguuccuuuuuuggguucugacagauuuucuucuaauuuucuuuaucuuuuuuuuuuuucagaauuacuaauaaaggaauuuuuugaguauuuuggcaauuucgcuuucaauaaaaauuccauaaacauucgacagguaaagacugucagcauuucuuaucaacugguugcugcuguauuaguguucucauuugauucauuuuuaaagcauuuuaaugaaugcuuagaucuuaguaacagucaugagguagaacugagaugggcuguggcacuugacugagcucagcauccauggagcugcaagaauaggaggcaacucuggcaucugauguugucacaguacauggucuauucuuaaugcuaaggcuauauccuuuaagauguggaauagcaaagcuggaguuuacauagacuuguuuaaacugaggaugugcccaguggaagaacuugucuuauuuuugagacaaguuuugucauguacacccagauuggccuuggacuugggguacuuuugccuccacaacccagugcugggauugcaggcaugugcuacuacccugauuccaagucucaaggacagauaggucugacugcuucccucagguucagcaguugaggcuuaauuuaguacaugccacuuaacaaagauugacuucauuuauauucucucucacucucccucccucccucuucuugauucagacccuuuucuuuuuaaguagaaguuguguuauaaaagaagguuuuuuaucgaugaccuaguccagauaccugucaucuaagcauugacaucaucauucauagaucauuaaucuaaguaauugucuucagagaauacuuguaaacuaugugggaaagggaacaaccuggucauaucugcacucaucuaaaugcauauguaccuaaaacuguugggaaauuaaguucuuuacucugugacuuauguuggccuuguguguuccuggcagcuaaguacuuacauaugugugucuucucuguuguggucugcagggaagggaacaaaacaagccugauuccucuccucuauacauccagaauccuuuugaaacaucucucaacauaagcaaaaaugucagucagagccagcuacaaaaauuuguggaacuggcaagagacagugccuggauuuuggaacaggaagauaagaaucagccuuuuucuucgaguaggcaacccuggggacuggcugcccuccugcugccaccggggucaggccacacaucucucucccggaagaagaagaaaaagccgaugagugaaaaagucaaaggcuuguuagcauccauaaaaaguaacagcccugacaguuccacagauaccaguggaaagagaacaauuaguacacaggcaugaugcagccuuuugaacuucugggaagaacugccacuaaauguucauaggccuuaacaguuauauaucugaugucaucaugcuuuuacucgaucugaaguucuggauauuuccuuccgaucagauggaguuuauuaaaauaucacuggcaaaaaauuggcaaaaggcauauuugaacucugcaaagugaaucguaaaaugaauuuuacagcaaccugguugauaauucugucacucucuaguugaaaaucauuucaaaacccuuucaguuaucuucaucuauaggugacgaaugcaauaaagcuccaaaauuugauaguacucucuaguaucuauuuucuauuuuucaaucaaaguucucuuauuagguguuuugucuucuaauuaguauauaaagcauugggcuuguaucccaucaggcuuucuaugcuuugucuuuguugauuuugguuuuccugccccuugcauacccucucucacuuuucuucccccacuagcccucaguuggguucugcuucauguaggagugacuguucugcuacuccuccucuuccccucccuguaagaucuuccccaaaagguccccagaguuucauacaugcuucacacauaaucccaacuuucacacaggagaggaaauguacagcucuagccucccgggucagagcuacuucaagcgaaguuccccguugccaguuagacagguuggguuugauuucccaaacugggucucugauacauaaaagcgcaaacacuuuagucaguguauucuguguuccaaucagauauguagaauuguggauauauuguacuuucaagucauauuuuauuuuuguuuucaagaauaaaacccuguuucuacugaauugugauaacaguauuucuaauauuucuucacuucugcuuuugagaucucucuguguaagaaaugguauauacacagagaaauauguuuuacauuuuauucuguagcuuuccuucugagauagagauggugcaguuuagaaauguauaaugguuaugagguacaaggaagguguuggccaaaaccugucacacagucaguguuuaaugacaaaccuuggagcagggacaagcacuauauucacuccuauucucuaugaucugugcauaugcagcaugcaguuaucuacgaauaugguccgugcugugccauuuuacacuccugagguucauguuagucccuggagucuuagcacuuagaggaugcucagcuuguucucagcaaugcuccugcucuugcuuuugacuggggacauuggaggcagaacaccaggucuuguguguccugggcaagcacuugucacaagauaaaucuuagccccuacuacucauuagaguucauagucuuuaauauuuuuccugccauucaaauuuuacccuuagagcuuguagugguaaacuuaaaguuuuuggacagaauucuaaugaguuggaugauuucgggaaaguauguuucugaagggagucugcccacagagcugugaucucacaucugaaggcaggccaguggcaguuuucuucuacagguauucagcaaaggcugcuuucauuuguucuugaagcucauuuaguugauaggcuguuuugaacuccuagccuagguguggcaguagaggaaggcuguguuugcaugucugaauaagaagagcagagacaucuguagcaaagccacaggaagguacaguagcuucacugugaguucucugcuucccagagcuuggcaucggaugggugaguagccguuaauguucagucucugcuaacugguaagagauuacuaaaaauguuauagauagcauuucugucugacaugauuggaucaguagggucgauagacagggaggggggauuaucccagggaaggaaaggagucaggagugaguguuagagaccaggacaucuacauugcugcuuaagaguugagcaaggcuguugugcugcuuugauuguuuuuugcuuguuuguuucuuuuuuuguuuuguuuuguccaauuugauuagaaccuugacauaucugggaagagggaauuuucauugagaaaaugcuucuauaagauuggccuguagacaggucugugugacaauuucuugauuaacuguuaauguggaauggcccagucuuuuggucagugccaccgugggccaguuguccuggauguauaagaaaacgaacugaacaagacacaagcaugccaguaagcagcagucucuugacaucugcuucaguccugccuucagguuccugcucaaguucuucccugacuucccucaccuguuguauacgacgaaauaaaccuugccuccccauguugacuuugguuauggugcuuaguagagcaauagacauaacuaagacaguuuugaaagacugcuaacugcauaaugguauuuuccaugguaacagcucuguaccagggcauaauuaguguuugcaguugaucauuagauccaaccaacuagacuuaguaguaaauugaaugccauaggcuccaucacuaacuuagaugaagguuggccuucagcuuugcaugacucuucauguuuugcugaagagacgacccucagcaguaaguacagggaucauaggauuuggugugaacucuuguuaacaaggacuucuuaguaguacauacuuggaagagaauaaaacaaccagaaauuauuuucaccuugguauagcauugggauguuuauuugaaauguuuagguuuauuuugguuuccauccugaauccaguuauuugcagauacagauggcagaagauucaaacgugagagugagccucaggaauucccauggaauagcuccacgaaaggucugcugcaaagaacauucuucaucugcagugucaagucccccaauuauuuacuuugccuguaaacgugaugcacccacccaccuuuacuuacucacuggcucuaaaggugaaauuugcuuuuuucuuuuucuuuuuaauguccauuucaugagaauuauguuaaaacguuuuccuucuacaacaaaacuuaaguuauuuugaucuucugauagcucuggaauaaggcaguguuucagaagccauguggcuguaggauggaagcuguguaaguguaauugaauguaaaugucucaucaugucucauuguuuuaaagccuuuuguaguugcuauuucuugcuugagaauccccagcccauaaagccuuagaggagcaaagacaggcagauccuggagauuggcagccagccagucgaacuugagagcuccagguccaguggcauccgaucugaagggacuaagaagaguggaagaagaagacagugacauugaccucuggccagcacacagguuugugcacccacaugcuugggcacaaauacccacccauguaauucuaaaagaaauuaaaaugcauacuugagaguugggaguggugccuaauccugcagucucgcacuugggaggcaguggugggaggauugagaauucaaagccaaccaggacucuauugagauccagucucaaaaacaaaauagcaaugaaagugucacauguaacuugaccuucuguauguacagagauggauauguguugucuacagguugaacuucaaaucacaucagugcucugaaagcuuuucacugcagaacauuucuaguuuugguuuuuggauuagggauguucucuguagucauccccauccaguaccuaaaauccgaagcacucuggucccagcauuuuggauuagcaaugcucaaccuguaccauaucuggaguuccacacgucuaaauuaaugaacaauaggugguuguuuucucuggcuuuauuuugcaguguucagcauugagcacuucccaugaugcaugcucuuuacucagaugagcacauugucagucuaaugugcacuguguccucugcugccaacacuuuacugugucacuugguaaggcccaaucacaaaacuucuccugugacaguuucuggaucugggcucagaggacugcaucuggggaugucauuaagcuuggcuguguuuauccugccugggcugagcaagaaggcagguuuuuauucugcucucuuaaaccugaccgcagaagguaguucucaaagcuggcugcugucucgcagggaagcaagcucaccaguaaucauauugaacauuauguugauaauuaugaauauagugaaaguagacugaaaaguauaaugggccugcagagauacuuuaugcguuuggacaauuaacucauggcaaaggguuuuaagucuauaacugacuggcuugccaccuuuguuuuauucuaaacaaauuccaucuguucucuuugauugcaguagcaugccaguaucacugaaauguaggaccuucuuaaucauugaucaccccugaggaacaggcccuaagguugacuaauaccaaccagucuucugguauuaguggc

SEQ ID NO: 8793 - RNA, 41319 nt, Mus musculus
auuggucggagaagugggaccucagauuuaccaaauaccuuugggcuccuguggcucaccugugugaugucaagcccugggcagcuagaggagacacaugaggguagguucuucuuccaucccaccuagcuguuccguaucgcuugggaaacuuuuucauugcuugaaagaagcuuccccuuucucugcuuugucugaauaaagcucccaggcucgcagggcggggugcauuacugcugcaccccggccaugccccacccuuaacucaaaucuccccgguuuuggcaaagcgauuuaaaacagaaacaaaauaaaacccaagguugcaucaguaaucuuucuuuuuuuuuucucuaaggccaaaaugaaagccccuuuuuuuuuuuuuuuagggaucuggccuuauacaaaauugaacaccaccauuaagugguuaaaacaaacuccuccaaagaaaaagauaaguaaaccuuccgaugcucugaggaauucugcagcggccuuggcgcuacucaacuugcaggaaaacucgaucugaagccccaaaccugcagcugagguggagccaggcaaagccugcggcccggcgcgggcaaggauuggcugcugggcaucgccccgcgccugcgcaguguuccucccgcccgcccaguuugccgccggccugggcacuaaggccuuuggagggugcgcgcgucagcuggccgggaagccggcgagcugccgggacaggauagugggccgagcccuaggccucggcuguccuucccgaaaagaaaagaaggagccgcucgccaguccccgcagccuguggaggccggugagggagacgccgaggagcaucgaggcucugugggcgccgccgccuuggccgccaugauggagcggaagugaacuucgggcgcaggcugccggcgacagcgcuucggucuagcugcccggggugcacggcgcugcggagcccggaccuuccgguccucgcgaccccugccucuuggcuccccucgcuuaccccaagacugagcggcuugaagaggcgcccggccugcggucccggcuuccagaaagauggcggacccggcggagugcaacaucaaagugaugugucgcuucagaccucucaacgaaucugaagugaaccgcggcgauaaguacgucgccaaauuccagggagaagacacggugaugaucgcggugaguggccccuguccccaugucacguggggucgggcaggacggugagcucugggacauggccggucgcaaagcccagagggagcagggagugcucgcucucccgagccggguuugcggguucagacgaccagggaggaaggagcaguguucaggagacuccgcgacgauucgaggaucacccccaccccaguacuaagcuuggcagcugggaggugucuuguuucucauucuggacacucccccaccuggggcucuggaggcugcaucccaggagcuaguuuagugcacgcucauccguguguguguguguguuuguguuucuuaaauguucucccucucaacuuuucauguaauaagugggaaauuggagccuguaaaaagaacuaguggcuuuucuuugaaauuagaguucucucuaaugucauaaguggauuuagauugggccaaauaagugucagaaagaucuagaauuucauucuuuaccguguuuuaacauuguaggaaagauagcuauagccgagacauaguguuguaaagaccuuacaauggggcuugaaucaccauuauuagauucauguuaauacagucuaucuugacagaaauugauuaugguaaucugagaggaagcaauacuccuuuguaguggaaaauguaacugagcugauugauuauuauuugagaaacuugaaaggguuuuuuauaucuagcauugcagguucucugaaaacagcauuuugagcucaagauuaaaagugacuggauaagauugccucaguauacagaacaucgagcuaaacuaacaaguaaauucaucauuagugaugaugccauggguauugcuauuaggauucaauuguuaaugucaguuguuacucgaaauuguuuguucuugaguaguaaucuauauuuaguauauuguuugagcuacuuaauuuagaaauagggcagagaggucacaggagacuggccauugaugagugaaaacauuuuagccugaagauaguacugaaguucucuagaggguguguuaaugugaagguuuucaaaguugaguuuucggaaauugaauguguuaguaguguauccucccgguaggguuuugguagaaaaaaaacuauuacugcugugugaagacuaucaggccaguucuuugggggguguuuuguuucguuuuguuuuuuucuuuuucuuuuucgagacaggauuucucuguauaguccuagcuguccuggaacuggaccaggcuggucuugaacucagaaauccgccugccucugccuccugagagucgggauucaaggccugugccaccacugcccagccaguucucuguuaguaaguccucaaggugcucuuguaguaaagaagggauguuaauugagcauaggaauccuguucuuuagugcacagaggauagaguggaaggugguuggguguauguugugccugcacuccuuaccggguuucaacuccacuauuaguccccaaauuugaggcuacuuauuccuucccaucuaugauuaugcagcuuuagcuauacuucauuugucacuuguauuaagauggucuuaauucucugaguuuuugugcuuguuuuaaaaaaauuguaaauauugcuaagauuuguuuugcuuggaaugccagauuucaggauuuacaaaauauauuaaguugugguggcuuacauacuuguaaucauagcacuggugagccugagacaagaggguaguggccauaauauaugaaacaaaagauagaccacuacagaaaacacauuuauuuuagguccuuuccuuuggaaaaaguugccauaauuucuguuucaaaauuucuguaaguaauacaaauaaguuuaagugaugaauagaaacuuaggguagaugaugaaaugacuuaaauguguuuguuuauaaugucaacugaaugguaaucauaaucacuguucagauagaaaauaauuaaggagucugcuuuucuucuaaguuuagcuuuuaauauucuguccaaaauuuuuccuguuauccucagaaccaauuuuaauaaaacauuucuuggacauggagacuuucauuucguuccuuaaaucccuguauaagucaccaaauaggcuuuuaaaauucacuaaaacuugaacacagagacaaaagcauauaauacagauaauacauguaagaaaucaauuccuaaaauagggaugagauauauuaaauaucuucuuaguguccccaguguuuccuguggcuuuauaauaauguucuuuccccuauacuuuuucaucaucuacccuaaguuucuauucaucuuucccaccucuucuccauaaauacaaaagauguauguguguguauguaauauaacaugguguucugcuaagcaagccuuuggaucuugcagaguuaugcaugguuugaguagcuuuuagucuuauuugugauauaaaugcuugguaaagugccauaaaugcuaccacacugagugaaacaaauuauucccugaaaaucuuuaaauaauauaaaauagccuauuucaaugugagagcucacaaaacaaggagagagauagcaaauaaaaaugaauaucuauguguuucacugaacuuacugaaagugaaaaccucaaagcaaaaaaguucauagaaguauuucucaucagcgugugcaggguuaaaugucuuuuagucauaguuccuuauaugguauauuguucaggcugcagaaccaaagccagcuugcuacaauucauugacaguagaagggaauuaaaacuuaauuagacuaucuuuuccauuuccuugccucaaacaaaacacagcuuguacuuacaagccaguacuggcuugauauuaagcuuggauuaauugaaaaagaaggagucuuccucaccucaguguuuaagaaaaacccagugcgcacugcagugcagcaccacucuucagcaugccuaucaguagcacauuccugcuucaugaccaaaugugguuuggucuuggcaaucucacauggcagucauucaagaagucuaaagugucauguaguuuaguuaaacucauuccuuggguuuauuuaucucuugaaggcuaagucagauauggaugcaucuugugacuuagaguuuauaaaauagaguaauuuugaaaacacauagaacuauagguuguguaauguguauuucaagucaaaaaaugaauugaaaaaauguaagaccuguuacguagguuuucuuaauuauggauuuuuuauucucaaggucuugauuucucccuaggaagccagguucaguuaguaacuucaggcaguaucucuagugacauuugacuuacauaguaaaaugaaggauuuauuugugaaugauuuacuuuuauugggguguaugugaguuugaauguauaagcauguaugcauugggguccccguggaggccaggagagggaauuggauuccuaggggguagaguuauaacuauugugaaugcuaguaacagaacucagaccaauaggagguguucuuaacucuugaaccaucuuuccagucccaguaaauaccuuagaacugcaauccaaaaagaaugcuuugugaaauaaauaaaagaacaaauugucuuuuuaaagaccugcaccguugggauugaauguuaauguguuaguagcauguuagcaaagggaugcuuugagaauaaucagaauugaugccacuugaaauuggcgcccaaaugaagucauccuugcaguugcugagggaaacaacuggggcuuaaauaaauuaaaggugguuuuucucauuccauagaaauuuuagaaauaggcucacagugcugcugcuuccaagacccugacuauuagagucugucgugcuuaguugcucacuuuugauuauaauaguuaaguuuucaagaugaguacuacagcuccagauuugauuccaugaauaauugguaaaggaagaaccucucugaggccugcuagcagauaaccucuuuacaugaugcagaacugggucaucugggucaucauugcaaggggaccagacuuggcgaaaggagcaggaaaaagacagguuugggauaaguagccauacauaagaacgggguuuuuugguuuggguggguuuuuuuuuucccuuuuuucuuuuugagacaggguuucucuguauggcccuggcuguccuggaacucacuuuguagaccaggcuggccucgaacucagaaauccgccugccucugccuccugagugcugggauuaaaggcgugcaccaccacgcccggcuaagaacagaguuucuuaaacuuuccuuacuugccuaagaaguaauaaacguagucuuaugcugcuuacaguauaugaguauauaaaauauuggacauuuacugguaauaaaauuauuuuaaggcauuucuuugugauaccacuuuuuaaagauguacauaauuuuacuugccaaugagauggauguucuuguuuacuuuuaaauaaggaauuaaguuuuaggugacuauuugauacugcauuauauagaauaucuucaguaguugaaaaguauugacuacuccaaguugucuuuaauguaugugugcaguauaagcacacguacaaauuagauguaauuuaauucuuuaauuaaaaaaucagaauauaaaauauauauauaccucaaggaaagguagcugugaauugaaaaauacccaguaacaaaggugagauuaguaccagagguaugggucaguaguaguagagcauugacuucaaagauaagauuggaaaagaauaagaagcaaucaaguagagcggaauugucagugagucuaagaagauuucauuucuaaggugggcucaacccuggcaggaacaauguaauuauuuagaucagaccuucuaaaaagaggaaaagaaggucuaaguaggaauuugccugcucccuaguuuuuccuagaggaaacaauuggaucuccaaauauacagcagccaugacucuagggaacacaugauuuuaacaucauagagugcuuacuagguccccccaaccugaguaccagggguugacuaugugucaucaugcuuggcagacuccuuuacccagugaaucaucucgaugaacuuaaaaaaaguuacguagauauuaaaaaauaaucuacaaaauaugaugcccuuuucacuguauugacauuugcauuugauccuugcuccugacacuucagacuugacuucucuguuucuugaauguuauauaagcuucuuuugacugcaggcuccuaaacaucuuauuauccaugccuacacuacuuccucacauuaacccaacuggcuucauggcuaacacugaaaagagggccagugagucagcugcuuuuucuaagacugucuugacacucuugugcuauccucuaguguagucuuucaguauguaguuaagcuguggucacuuaauugugccauguguaucucacuguuaauuuaagcuccacuaaaacacaaucugucuuugucaucuuggcaucugcauuccauaaauauuuguuaaaugaaaggaugaaaagcugaauggaauuauugaaagaggacugaauuuuaauugauugaaguucuauuuuaauuuugucauuaacaacaguuuuuaugccugucaaauucuauuuuucuuauuugcaaaguaauacuaguauuaaaaauggacacuaguccugguggcgaaggccugaaauccaagcuauuuuggaaugggagccaagagaaucacauguucaggaccaucuuggacaauuuagugaaacccugucucaagacaaaaaugcuuuuaaagaagcugaggaaugcugagacuagaacuagaagugaguuguauggauagcaaggaguagagaaagaagacuguugucaguacuugucggaguauagccugcggugcacugagaguaaaccagaugguuugugugcauggagcuggcucucuaaagucucucacacucgagaugcauacaucgcaggaauacuguuucuaaaggugccgaggcaucguugucuuugaguuuaagaaugugcacucaccuguaauuugugaaacucuucuguuuucauuuuuuuaguccaagccuuaugccuuugaucguguguuccagucaagcacaucucaagagcaaguauacaacgacugugcaaaaaagauuguuaaagguaaauaugcguaacuagucaaacucaauuuacuuacuguccuagcaauaaguaaaauuugguuugugaucuuucuguuuuacacaacauugcuuuuuuauuuguuuguuuguuuguuuguuuuuguuaaagauuuacuuguuuauaauaucuaaguacacuguagccguguucggaugcaccaaaagagguuucugggauuugaacuugggaacuuuggaagagcaaucagugcucuuaaccguugagccaucucuccaaccgcuuuauuuuuaaugccugcuuucaccuacauuaauuagaaaguuaaaguaacaaaaaucuaaauagaauuagugaacauuguacuuuucaguuacugugauuucauuauauauuguaccuaguggacacugauacagggauuauauuacaagcauauuuuugaaaagugauuucaugggagaauucccaagguacuauuguagaaauggaacguaugagaaugaagugacuagauaaauuuuuaaaaaauagaaaauaagucuuuuuuuuuuuuuuuucuauuccauuguucuuuccucaaaaccuuaucuuagagucauuagagaaauccugauggaacuuauuagggauugccaaggauuuaaaaaaaaaaaaaaaaguaguagcaccuacaagacuauuuuuuaguuuuguauuuucuaaaaccuuagaccucuaaaagcagagagggugcuagaauuuuguuuacuaucaaagggcucuuauuauuaaauagcuguuuaugauaguuauauuuauuuauuuauaguucuaauaaugcccauuaguuugcaacaaaaaucuuagauaccaaacauguugggcuucaguauaaaaaugaaugaggacuggagagauggcucagcaguuaagagcacugacugcucuuccaaagguccugaguucaaaucccagcaaccacaugguggcucacaaccaucuguaaugagaucugacggccuccugugguacaucugaagacagcuacaggguacauaaauagaguaauaaaucuuuuuuaaaaaaaaaaaaaaaaaaaggaaagaauaaaaaugaaugaguaagggcaggcaugguggcagaggucuuuaaacccagaacuuagaaagcgggggcaggccaaucucugugaacucaaggcuaaccuguucuaucuaccuaguaaguuucaggccagccaagucuaggcagugagacccugucucaaaaaagcaaagcagaugaguuaggauuaaauagcagagguaguguaucuuaguaacaagaggaaguuagguguguagaugagcagguuuagcccgaugaggaggacuauaacacuucacauaaucuccauacugaauauugaauguaagucaucaugaagagugaggaauggggagcugguuccaugaacaggcaugcagugcgugaauuggggcauguggaagcauuacucggcagcauuaagggcccaguugaaguuagcuuccagaauuuaauucacccauuugggauuuuaccagacaaguacaaaagaaauugaagggcaagagaauugaggauauuguccguguaauguuuauauugguguaccaugguaccuaaagggaaguuacagugugauagacugugaaagacagugaaaaaagaugguaggauuaaugggcaaacuggguaugccuguaaucuuagcucucaggagaaagaggcagaaggauugccauaaguguaaggacagccugggcuaccuaaggcauuccagaccagccaggucuuccuaugaagacccugucucaaaaaaacaaaacaaacugauaaaaaaaaauccaguagacaaaagaaaaaaaaaguucuuggacuucaucaaucaggaguagaagauuauggaaguagugugguuaguuaauguggaguuggcaaucauaucaggucugagcgugcagucagguucucaggucauacauuauauggauauuaaacccauccaaaauuaggagugguauugaugaaagauggugaaauggaugcuaaacuguucauaaaaugaggccgggcgugguggugcaugccuuuaaucccagcacucgggaggcagagagacgaguguauuucugaguucgaggccagccuggucuacaaagugaguuccaggacagccagggcuauacagagaaacucugucucaaaaaaaacgaaaaaaaaaaauuuuuuuuuuuuuguucauaaaaugagggagaauuaauuuguuauucuguaacugcaacaaagaggaacagugguguuauacuguguuauaagcaucaauaauuuuuccuaaagacuuuacauucuuugugaccuacuuugugugagucuauguggaggucggaaauuagccucauauaucuuaauugcuuuaaaaaguugugugugucuguccccgcccaucugucuguccauccaucccuuuauuucuguguguuuguuugaauguaugccauguguguacagguguucauagaggccagaagggauuguuggauuccuuagaaaaggaguuagagguaguugugagccacuacacauaggugcuaggaaccaaacaucugcaaaagcagcaggugcuaagccaucuccuugcuuuuuugagacaggaucucuccuguaguuuaccguuugggcugggcuggcuugccuucaguuccccagaacugagauugcaggcacaaaccaccaugccuguagcaguuacuuuacccauugagccaucucccuacucccccacccccacauacauuuuaaaaauaaguacaauuuaagauuacauuagcuuuuuguuuuuguugugcugaaauaaagcucuguacucuccacacgauaggcaaaugcucuaccauugaguuacauucugccuuuuuaaauaauaaaagauugacuuaaugaauucguggauacuuuaaauggacaaaucucuuaacaugagcuacagccacuuuguuguacaaguuccaucacacacugauggauuucauuuuguucaacuuaagucuuagcuguguuuuaguuuuaaguuuauagguaccuuaccaggaaucugcccaggcuugucugaaacuuauucacuagcccaggcauaccuuaaauuuauaccauccugucucagccucucauguagcuggguuuauagaccugugccuuccauaucugauauacuuucugcaguugucuuccuguuucucauaagauuauauuaaaaggaaagggggagguuagaaagauguuguauauuauaauauucauaaucauucauucagccauaaucauucaacaagauuugaguuccuccugccaggcacugauacugugaaugaugaggcugaaaaauguauaguaauacucaaugacaagugucauggaugcacggcugugagcacaggacuuuccuguguuuggagugguuguagaguuggauuuaaggaaguacuacuaaaacuucaauuagucuuacuaaaaaaaagaagaaaggggauaccuucuagguaaaggugccaauccacccuuggagaauuuucaagagaacaaugugcuacaugugugggagaggccauauauuaugaaauuguuacauuugacuauuuucaccagaccagcaaaaugagggaaguauggugggaaguaagaugaguaagagccaggucaggucagacuguaugugauuuaugcccaguauuaugugacuacagauuuguauuuuccaagagauuuaacaucacuuuuuaccuuaaaagaaaaaagaaaauuacugauuacuaguuaaugguauguaugcccugauagugugagguagaaaaguccugaaguguauauagaugucuacaguuuaccuugaaaugcauuuauagauaaggaacgagcagaugcaugacuaaaccuagcaguaaaaugguguuaguggcagagucuucaucauagaguaugcaccauagaacauauucuuucugcauucuacauugaaaauguuggcagugaaauuauaaaaaccaaaguugaguagacuuaaagauaagaaaaaugauuagagucaaccauaaguccaccaaccucaggucagaagucuuugaaaauaaaguuauaccauaucaaacauacauacaccccauguuugcaugcaccagauucguuguucccuaaacaauacaguauaacacuauaaagcacuggcauaaguuuaguaggaaacgaaaaggugauuuaaggaaauacgauuuuauggaaguacuugaguacccaaguauuuuaguagccucagaggccuugaaacuaguuccucaugcuacucuuuuaaccaauaaaaauguaaucacauuugccauauuagcauuuuguugucuuuuccacaccccagacagcauaaaugaaagugagugcuuaaaaaauguuucaguauuacauaguauugcacauccucuggaauuagauaaaacauuaaaaauuacacuuuaaaucucagauguguuacauguaugcauuuauuaucccaguguuaugcaaccauauauugucuggcaaguauauuauguagauaucuaccuacaaauauuuacuuaguacccaauugugaaguagcaggauaauuagaucauaucaugagaggacauuuuuacuuuuuauuauuugaaaauuuuucauuuuauuuuacuuguuuggguguuuuguccaacacuugugugccugguaccugcagaagccagaaaaggcauuggauccccuggaacuagacucucaauugugagccaccauguaagugcugggaagugaacccuauguccuggaagagcagccuguaucuuaacugcugagccacuucucaagcccuagaaagaaccuuuuaaaaagauuuaucaaaauauugaauuguaugcuguauauucuugggccaaagaguggcaccauuuggagguguggccuuguuggaauaggugugucacuguggguaugggcuuaagauccucacccuaggugccuggaagucagucuuccacuagcagccuuuggaugaagauauguagaacucucagcuccuccuguaccaugccugccuggauacugccaugcucccaccuugaugauaauggacugaaccucugaaccuguaagccagccccaauuaaauguuguuuuuauaagacuugccuuggucauggugucuguuuacagcaguaaaacccuaacuaagacauaugcuuaggcaugugauuguuugaaagaucuuaaggacauuugacauagaccuauugagaaugguuauauauaaagugaauugaaaugggucuggcccuguuugcccugcuucuuuagaagcuagcauaaaugacuuaaaaaauuauuuuguuccccuuaaaaauaaaagguccucacuuuguagaccaggcugccucgaacucagaaauccgccugccucugccucccaagugcugggaucaaaggcguacgccaccacgccugucucgaagaaaaacaagcaaacaaacaaaaaagccgggcggauuucugaguuugaggcuggccuggucuacagagugaguuccaggacagccagggcuauacagagaaacccugucucgaaaaaccaagaaugaaugaaugaaugaaugaauaaauaaauaaauaaauaaauaaauaaauaaauggucuuugggaaaugugguguagcucaaggguauuuguuuccauacacaagguucaauccgcaguaccacuuaauaaaugaacuaaccagaaaugaaugauacuccaaauaaaaugggcacugaaggaugucgcucacuugccugccaugcaugagacccuugguucaaucccugauacugcaaaagagggagagagaaaggauauaacaacaacaaaaaggcuuugaaaggaaguuucagauauuuggaguuucuaaauuaccuuuaguaguaaguaaugaugccuuuuccuccuguacccacucugucaacaauugcuuuauagcccagagugagcuuuaacuccugauucuuuauguugagauugguggaaggggagagcaugaaucacacacaccacagaaggcuguaaugucuucucaauauguaccuugccaaagagcuuauaaaauggggacuaagcaugcaaauacaugaaccuaugagggggggugggacagucucauuuaaaccaugauugagucagcaauuaauuacacuugcuuguagaacuaauucauacauguauauuuuaauugauaguguuuuugucuuuuaaaacaguaaagcuuuagaauauauguauaaugaaauguugagcuuuauguugguaaguugaucuuaagcaguggaaauuuuaaaguguuuuuguguuguggacugguguuuacacacuugaguccaguugcccuuggaggccagagccguuggaucuccuggagcugaaguuacaugugguuaugagccuauguggaugcugggaacugaauuuggauccuggaagaacaagcgcacccuuaaccacugagccauuuaucuuaguuauguuuauuauugugaugaaacaccaugaccaaaagcaacuuggagaacaaaccguuuauuucacuuacacuuccagauaacaguuaaaagcagugaaggcaagaacucaagcagggcaggaaccuggaggcauauguugauguguagaggccaugggagaacacugcuuacuggcuugcuuuucauggcuuggucagcuuguuucuuuauagaacucaggagcaacaaucuagagauggucucgcccacaaugggcuggguccucccauaucaauuacucagaaauccgcccgccucugccucccaagugcugggauuaaaggcgugcaacaccaugccccccauaucaauuacuaauuaagaaaaaaauacagguuugccuacagccagaucuuuggagggauuuucuuaauugagauccccuucucucagagacgcuagcuugugucaaguugacagacaugauaaccaauaucccaucuuuccaugccuccuugaugauuuuauaagcucauuacauauuaaacuuuaaucacuucuuacugacuuuauaaugagagcauuucuuaaggaaaaaagacuuggaaguacaagauuuuuuuguuuucucauagauguucuugagggcuauaauggaacaauauuugcauauggacaaacaucaucugggaagacccacacgauggagguaauguuucauaaucuauccuuaaguauaguuuacacuauaagucauccacuuacugauuucuuguaguuaauucauugugcuuaauuuuuuaucuuuauugccuuuucucauacaaauaauacacauauaagugcaagauucaaauuagcuucuaagcuugguuaguaagcuguaccuguauuuuauauuacaaaaucuuagaaauuaguauaacuauaaagaaugugacauuuuaaaauuaaaugggaguuuuuuuuuuuacuauucuauaaugugagaaaacuuagaugguauuaaaagugauugucuccugaauaucugcugcacuucuuauaagauugucuauaucagccagggccacacagagagacccugucacaaaaaaaagaagaaagaaagaaaaagagaaagaaagaaggaaaacuuaguuuguauaugcuuauacaguauaacauguaauaguugaaacuuugaaauuauuuguagagcaauuucuaaaagaaaacaaacccagucacaaugcuuauccuauuuauuuuauauuaguaaagagucacgguuuuuuguuucaauuuuucucuugaaauuuguuaacaauucuuuguuuucuaugcaggguaaacuucaugauccagaaggcaugggaauuauuccaagaauagugcaagauauuuuuaauuauauuuacuccauggaugaaaauuuggaauuucauauuaagguaaauucuugugagaaagguuauauuuauuuaacuuaggauacuuauuuuccaaaauagcugcuuccuggaagucaaauuuaaaaaguuguuacagguauauaagguugaagaauuguuaagaguuuauaagccacuagaugaauaacaggguaagcuaagucuguucuuagauucuuucccuguagaaaaaaacaguuuaacuacaaagcuucaagauucccaccacacuuacugcuuguccauuguucuuguccguugugggugguuguaacagaaaugggcuuuucguuauuuaagcagcuuagugacucacacuuuggaguuguggcuagugugguguccuagucuagauaucuggcacuuagacugcauuguuugcagagagaacgagcuguauaaauuuaacagauugacuuuucuuucugcuuagguuucauauuuugaaauauauuuggauaagauaagggacuuguuagaugguaaguuaaauucuugcuuuaauaauuucaguaguaccuguugcucuucuaguauuaaauguucuuaguaacauagauaaauuucguaaagugauaacguuauacauaggauaacuuaauagcauauguauacuauuuuuaaagucaagcgacauuuauuaagaacugaaggauuagcuccuuguugcugggagggauugugaaccugggaugccaucauauugccacuucuuaagugauaaugagggcuuuaaacuaagaguuguagagcuuaagcccaaaguguuagucccaguuguucaaugcauuguccuucccuugggccuaauguuauuuagaaaaugggagugguagaaguuugaaauuucuguuuuguuuuuuuaacauuaguuucuagauuauucuccuaguauguuuacaacacuuugcuuuuuuuauaguaaugcauauauguauaaaauauauauuuuaaaaguucuaagguugggcugcuaagggaaaccuaccacuuacauuaguuauuuuauaacugauauaauguaacauuuuuuuuuucaguuucaaagacuaaccuuucaguccaugaagacaaaaaccguguucccuauguaaagguacuuaaaagaaugaugacuauagaaaacacuguaagagaauuuuuaaagaguauuaagaauacuuuaaaauuacuccacaggggugcacagaacguuucguguguaguccagaugaagucauggauaccauagaugaagggaaauccaacagacaugucgcaguuacaaguaagugggauauucauuaguacucaccaggcaugucugccuuacaucuuaaugcagucuaugaauucaagauauuucuagcauauaguaaugcuuuggggaaaauuauuagugaaggaacuauauuuauacuugcuugcuaauuucauugcagauaugaaugaacauagcucuaggagucacagcauauuucuuauuaauguaaaacaagagaauacacaaacggaacagaaacucaguggaaagcuuuaucugguugauuuagcuggcagugagaagguaaacccuuuugaaauuucuaguagauacuuaggcaugucuguaaacuuuaccuugacuugaaacuuauaugcuacguauuguugcaucuuaagaacuuguggaauuggauuuaguaaucugagaauuaauacuguugauaccaaugcuauaugauaauugaagucaauaaccuguucccaagugacugucauuuagcuauauuugauccagucaguaggguauuuggaauaagauguauguucuuauugacagccuguuagcauugccauuauaauuuuauuuuccaucucucucguauguugccuguauucauggugaguuucucugcagcauucugauuugguuguacuguugucccuugcuaucauggggauugguuuaagaccccucaccauaaauauaccaacauccacagaugcucacgucacuuauaaaaugauuaguguuuuugcauagacccuacauacauucuuuuguauguaaauacucucuagauaacuacuaacguacugagaccacauaaguggauguuaaauuauauuguguagagacuaugaccagagacaaaccauauauguuuaguacaaaugaaguuuguuuuggaauguuucucaaucuuggcuaguugaauccaugggaauaggagggucaacugucguuuauaaaaauuagaauauuuaaauguuuuaauauagacuucuguggccauuaugcuauuuugcgucuucugauguagaaugauguacccagucuuguuuaccaaaaaucuuauuauacacagcuuaucuagcaguuaguaccacuauuaauucuagaagccauuuaggcaguguacuugguuuucaagucacagguuagcuuauguaguauuagaacugucuuuuguuuuuagcaaauuaugacaucuauguuauaauuuaggugauuuccaguuccuuguuuuauaauguagcagagagauaacacugaaaacuacauauuuacaugaaaauuuauuauugacaaaagcacacuagaaauaaaauguaauauuucucuaaucacauuauuguucaacuauuucucugaucaggcuauuagacagugagaauuugaggauuccuaguccuuaguaucuaaggauucuuagcccuuccccuuuguaauuuuaaacuaguauuuauuuuuggcuauuuggaaaguugagagaaaauuaucuuaaacuuguaaguuuguuuuauuauguaaucuuacuuauagguuaguaagacuggggcugaaggugcugugcuggaugaagcuaagaacaucaacaagucacuuucugcacuuggaaaugucauuucugcuuuggcagagggcagugugaguauacaaucuguuaguucccuguuuuauggguaguaauuuauagaggauauacguguacacaaauguaaaacugaaugugucuucuuaguuuaguguuuauauagguauccuagcucccuucuugaaaucaaguagauuaaauuaaugaaauacgccaggcccaggaaagcauaucugaucacaaugcuugaggcagaaacaggaugaccaagaguuauacaacaacuauuauuguauaaaaccccacugguuuuguuuuguuuuuguuuguagaccuauguuccuuaucgagauaguaaaaugaccagaauucuucaagauucauuagguggcaacuguaggaccacuauugucauaugcugcucuccaucaucauacaaugagucugagacaaagucaacacuccucuuuggucaaagguuuguuguugaaauacaaaguauaaagacauggcauuaaaguuacuaaugucagcuacugcucaaauccagauguauuugucagagaacuagaucuguacuuuugaaucaggacauaggucauauaaguuagagauguauuuuagacuuaacgagcuuuaacuuuucauagacauuaaaauugagaaauguaauuguuuaauuuccuuuugaugaaaguaaacaucugagucagaugaugaaguaaaagcuuuucagauauaugagccuaugugaagcucacugaugcacuugaaguagcauacaugaaagagcuacuuaggaaaaucaauaacagccuuaccuuagacccauagugauagguaacggaugcuacugcuucaggauugcaagugaguugggaaaauaacugcauuuucuuaguuuugauuuuuuuuuuuuuuuuuaauguuaccaaagacugagugcugacagaaauuuauuuggguuguggauagauauuuuuuuaguuuuuguucuaagaaagaacuagauaaucuuggacaauuuguuauuuagcuauaucauauauuaaauacggaugucaauuaaaaauacuuucagucauaugcuucuuuuuuccguaaugauuacucuucguuaaugaugucauuuuuuuucuguaauugcaucacuuagggccaaaacaauuaagaacacagucugugucaauguagaguuaacugcggagcaguggaaaaagaaguaugaaaaagaaaaggaaaaaaauaaaacucuacggaacacuauucaguggcuggaaaacgagcuaaaccguuggcguaacgguaaucacuuaagcauugucaucuaaacuuucugauuuggggcucuuuuuacguacuugagauuuuuauaugcaugguaaaugaaaauaaagccuguuuucaguuuuucagcauguagaggucuucaacuaaagaucaagauuugucauuaaguuuuuacauuacuucagauaauaaguaagagcuguagaugcuacaguauaguauaguaaggugccuagauuaggaagaagucgguuacaggaaagcauggauggacuucaaagaagggguaagaucaagggaaauuccagaugcccagaucucagggacagagcuuugugguguaagcuauaauccuagcacauaggacgcagagccccaaugauuguguaaauuugccccugccugaccuuguaucaaauauagauaaguguauggguaacuacguauacaugcauacacauauauacauguguaaugcaaauauacuuauauacauuuacauauacuuauauguaaaauguagaugggaguagaugguagcauguaccuuuaauccuagcauuuggaaggcggaaccugcucuaaauggcaagagucuaccauucuaaaaaccaaacaaaaacucaguaucagagcagaaagaaaaguugguaagaacugcugacauugcauaaggaggaggaacaaagaaagauggugaagugggacucauuacccaucacccuuuauagaagcauuaauuucagcaauaggcaaaaauagaacuuaaugugguuuaguaauaaaguuucacuguccauguaggacacuuucagauuacuugugucuuccuacuccuuaaccaagauagagagaaagcuaaggaaauuaguggaccuuggaccccaagaccaggcagaucaucucugcucuauaccuguacucugcacaugccugcagcccugccuuccugccaagugggaacuuacagccuaaggcuuuuuuuuuuuuuuuuuaagauuuauuuauuucauguaugugaguacacugucgcugucuucagacacaccagaagaaagaaucagaucccauuacagaugguugugagccaccaugugcuugcugggaaucaaacugaggaccucuggaagaacagucagagcucuuaaccacugagccaucucuccagccccacagccucaggcuuuaagccugcuaaauggacccuuaucuccaucaucagcaaucccaagauuugcacagcacucagcagcaagccgaccucaccucgaugguacaccacugcagaaguccugagcuucagagcuauuguguccgccaucucuacaugggcuuacuguugauaggcuuuccugaacaaagauaaucggcaaagacgagaauaaggagguaguugauaucaaacauaugauaaggaucguucagggaaaccuggcaccacagauugagaugaaaugcugauggcugacccuaaagaaacugagaugagugaacaccugagaauugagaguagaaauccugcagagaaaagcagucgaaggaaaugaaaacagugaccagaaugagaaauuuacugauacugaaguacuuuuuaaaguucaaacaaaucugcagaaaauggcaguagggagcaccguuggucacacagcagaaggaaugugugggcaacugcagaggggagaacaccuguuaguguuagagaugcacauucauagucaccauuucauugccauuucaggggagacagugccuauugaugagcaguuugacaaagagaaagcuaauuuggaagccuucacagcggauaaagauauugcuauuaccagugauaaaccagcugcugcagucggaauggcugguaguuuuaccgaugcugaaagaagaaagugugaagaagaacuugcuaaauuguauaaacaacuugaugacaagguagauuucacauacuuguuuuagauuuguuuguuuuaggauacuaucgauaucaguauuuuuuaauuucaguauuaagguuccuugugaucuacauuuuccuuuauuucuguuagcuuuuagaaagucaagauauuacuggauuugguagaacaugcugaaauucuaguacuuagaagguagaggcagggggacaggaguauaaggcaagccuugaguauauauugauuuuaaaggcagcuugggcgauuauagaggguuggagaaucauauuaacaguaacuuuaaaugcugaaggguguggagauauagcuaagugguagaaugcuugcauugcauggggcuucagauuccauuaccagcaaagaaaauauaauuuuaguucuguguggaggcaguguauguaaccuauguugacuauuugugaguaauaguaauucauaauuaguccugggaaggaagccagguaauaguuugcuuuguuaauuggauacuuuaauauuucuuaggaugaagagauuaaccaacaaagccaauugguagagaaauugaagacacaaaugcuggaucaggaagaggugaguuaaauccccccagaaaaucuucaguguuuaucaucuaaagauaaaggaaucuauggguuauguaagcacuguaccuuuaaaguuguugggugugugcaugcuuaacuaucagugugcugugagauuagucuuugcauguguugaaacagacugcuuuccuccuuuagaugcuuuuuguuauuugguuuugauguuuugaguuuccuguuguauauauggaagagagaggacaguuucuacaaaacauuuauuuuugucagguguaguggcauguaaucuguauaaaucuguagucucagaauuagggaugcugaggcaggggaauuucaagcuugaggauagcaaggacuacauaauaagauccuuucucagaaacaacaguagggaaauuguggaccaugugacugcggagcuuuuaacucccuuuuacuuuauuuauuacacuauauaucgucuacucuccucuuaaauauuucuuacagauuugggggagacaguggccuggaauaauuguuaagacauucucccuuagagaaaaagauauuuacauauggaugauagggagcauguauacagaaagcugcauacauaauaguuuuuauauucacuuacugugguuacuuaucuaaggcaggccuuuccccacuaauaacuuagauauauaaauaaaugagguaagugucuuuguuaagcuuucuguugcuaugcuaaaaaaccaugaccaaaagcaacuuggggaggagaugguucauuuugccuuauaucacuuacagaagccagggcaagaaccugaaagcaggaaccagagcaaaagccaugcagaaguguucuuuacugacuugccaugguuugcucagccugcuuucuuacagugcucaggaccacuaccuucaucaaucaugagucaagaaaauguaucacaggccagucugguguggacauuuucucaguugauguucucuaguccaaaaugaaccuaacuugcaucagauugauauaaaacaagccagcaugcuagaucgugaggggucacgcuuagguugauuucuggguuccaggacaaccagggcuacacagaaaaacccugucuugacccucacccugaaacaaaaaauuccauuugggucuacccagccauuuggguuccaguuaauuacaguugcagucaaauugacaaccaaguauacuuaucacaguuguuaguaauuguacaguuuccgaugugacuuuuucugggaaugugaaugucagaugaauaaacauacuucuacuccuccauauugucuuccuacucccagucugugccaccuuucauuucauuucucucgugcucaucuuuuccuaugauuuagcuugaaucuguauuuuauuucacccaggauaguggagauaauugaaaaauagucccuauuuagugcuuuuugagagccugaagagauagaaaaggcuguacccuccagcagaaugaaacauccauuaucagaaaaaucagucuuaaucggugucuccuuuuggauuguugagaggucuugcuuuuuaguuggccuagaacuugacauugagcccaagauacccaacacagccuccugguguguacuacugugcccggugucuuauuauuuacuccagcauuguucuuugaggcaggauuugggauccgacaacuguuccaccccucacccccaauugaucaucuaccuugaccaaguaaaauuaauuccagagaaaagggcaugguucaacguaugaaaaggaguaaaucucgaaaagaaaaaacaaaaaagaaagagagagagagagagagagagagaaaggaaggaaggaaggaaggaaggaaggaaggaaggaaggaaggaaggaaggaaggaagaaagaaagaaagaaagaaagaaagaaagaaagaaagaaagaaagaaaagaaaagaaaagcaguaaauguaaucuauauaaacaaacugaaaggaacaaaaacacaugguuaucucacuagguacagggaaaaacauuucaguggaacaggacuucaagauaaauuucacggagagauuaagaauacaaggaauauaccuaaagauaauaaaggcaauuaacaucaagccuauagccaauaacaagugagguggaaagaaucuuaaagcaauucuauuagucaggaguaagacaaggauggccaugcuucaguaaucaauucaacauaguacuugaaguuuuagcuagagcaaaaagacaauggaaggagaucaagggaauacaaagugggaaagaagucagaguaucauuauguccaggugauaugauaguauacauaaaugacccuauagauugcaccuaagaccucuuacaguggauaaauacuaaaauauuuacuacacagaaaucaccccaugcucacucauucccacgguuggcggugagcauccaucggccucuguauucugacaacuuuuuaaauauucugucuugugcacuguaaggcauuuagcauucaugauuccuguuucuuaauguuaguaauagcuguuacuagcuauugcuaacauucccauauauuuccaacuauuucugcugaaaaguagcugaccuggaugguccuuugucuuuucuccaguucaaauuuaauaggccgacauauuucucugggccauuucucccaggccaaucuuaguuuccuaaaacaaauguaaguucuuuaaagauuauuuacucugauuucguguauguaugugugccuugugagccugguauccucagaaacuggagacaguuuuguucugggugcuuggaucugaguccagguguuccggaagagcagcaaaugcuuuaguggagaacuugaugcagaucugaaguuuuuaaagaacuauucuaauuggauuuuggauuuuguacauaguacuuacaagucuagaaugccuuugguuuuuuguuuguuuuuuuuuuuaacuuacaugacuaaaauuguccaugaauaucaugcagaaagaucucccuuuuucgugguaccaagcacucugcugucucuuuuuugcuacuaaauuaugccuuguguugcccuuacuuuccugggcuucacgcuuagauuuguuccuuucuaugucccacacaguguagcccugugccugcucguaacuguuugauccaucuguuacagcguaaaguagcagcaccuuucuuagugaaacuuuucauuucuguugcuugccuaaaucaugaagcaaaugaauguuuccuugcagguuuguuaaaauucuauuuuacucuuucaucuagcuucuggcaucaaccagaagggaucaagauaauaugcaagcugaacugaaucgccuccaagcagaaaaugaugcuucuaaagaagaagucaaagaaguuuuacaggccuuagaggaacuggcuguuaauuaugaucagaagucucaggaaguugaagacaaaacaaaggaauaugaauugcuuagugaugaauugaaucaaaaaucuguaagauaaauuuuguuuucuuaauacucaaguauaaauaacgcuaaaugauguuaguuaauuaagucacuacuauguaagccuaagauguggguaacauagguucuuaagacacccaggucucacuuucucuugucuuuauauacaaagccuaggugguagagcaacaguguuauaaaucugguuuccaaaaguauauugauuuguaaucaucuaaaugauuugccuauuucuaauguuaggaaaaauaauagcuugaaauagaagcuaccucauaauucauuaugggucaagaaucucaaaacaagaaauaaaugacuuuguaaggacuguaaugacuaaguagucuaucuguucuguuuucauucuaucaggcaacuuuagcaaguauugaugcugagcuucagaagcugaaggaaaugaccaaccaccagaagaaacgagcagcugaaaugauggcaucauuauuaaaagaccuugcagaaauaggaauugcuguggggaauaacgaugugaagguacuacuguuacuaaguguuauguaucauccuuuuguauauagcucacacucuggcgucagugcacuuuuagaaaccagcaggcuguugugauccccaugugggcucugggaacccaccucagcuccucuggaagagcaguaagcacucuuaacacagccaucucuccagccccuuaguuuugauuuaaguacaugaggagagagagaaaaccaggggcauagaaauagaauagucauagaauauucaguaagucccucauugggccacguugaagauuuucacuuaaaaauccccuuacugggcugcugagguggcuuagugugggcaaaggugcuucgcuccauaauccugaugaccugaauuugauucguggaacccaugagagagggugagaacugacucccugcauguugacauugaugguaaauaaucuuaaaaguaucuuuauuucugugugcauauuugaauagaacaguggugagucugcucagguggcugccuuuuaaguaaauuggccuguuguuacgucauguguguugauggcuguguguggaggcuagagaucaaucucagugucuuccuuacucacucccccuuucguuguugagacacauucuuucauggagucugcagcucagcuagcuagaaucuuugccgcagagaucccuggcucuccuuccugggugcuggggcuaaaagugaccaccauuccugcugagcuuuuauuuggguucuauagcccaaaacucaguccucacacuuggcaccaaacacuucaccccuggagcugucuaccuggucauacacauuauaguuuggaacaacugucuuaagcucagugacuugcuuagaccagcuggccaacaagcuccagagaggcuugucucugccuuccccaguccugagauuacaagugcauacuaccuugcuuagcuuuacaugacugucaggcagcucauccuucguggucuugucagacacuuuacugcucgcucaucuccccagcuuagcuguucuuacacuacagucacuuuaaacauggaaaggugaaugaaguucaagucacacaguaagacccugucuuauaaacaagcaaacaaaaacgggugagagaagugugggagaggggacuuccgccaaaucuaaggaacugauuauaaaucuggaauucacauaguagaaggaaagaauugcaaguccucccugugauguccgccugcacacccauggcucacaugcuuguucacacagauacugugacuucuaugacuucaguuauauuuucuagcuugggaaaauagacuugaacauguuuggcucuaacuuguucguucuuuugugugugugugugguaguaggaagguugugaggaaggagacugucuuacuggguucaucuuguagcccgggcugcccuugaauuuacagauucugauugccgcugccuccugaguauuaggauuaaaggugugugcuaccauguagccccugcuuuaacuuauuucauguuuuucucucagcaaccagaaggaacugguaugauagaugaagaguuuacuguugcaagacucuacauuagcaaaaugaaaucagaaguaaagaccauggugaaacgcugcaaacagcuagaaagcacacagacugagagcaacaaaaaaauggaagaaaaugagaaagaguuagcagcaugccagcuucggaucucccaaguauguguuucagauggcuuuucauuuugcugaaaugucauguauagauuuuauuaauauaaagguuuucagaaucauaugagucuguauuuucaguaauaaaagaccuauguguuucuuaguagagcugcaguauaacaacuugaaugauguaacauguacauacugaguguggaaauuagguagaacaagugacuuacugacaaaguggaugugcagaacugcagggacuaauaaaugugucgcuggcgcugaguaagguggagcccuacacuaggaagugugcauacaggguugauaguagcagggucucagcuuucagaugcuguaagcuguacagauaauggucuacucguccauguuuuaacugcauaaugugugugagauauuuccccacuucauauuaguauauuuuucccaaaagcaugaagccaaaaucaagucacugacugaguaccuucagaauguagaacaaaagaagaggcagcuggaggagucuguugauucccuuggugaggagcuaguccaacuccgagcacaagguaccgacuucugauucuuccuugcuuuuaauacaguuguuguacacauacuggaacugaaagaaaauaguaagaauguagaaaauuugaaauagcaaauuauccaccucaguguggcuuugaaauauuuuuuaaaauuaaggaguuauagaggauacauggaguaagccccagcuuccagacacaagcauauaggucaacacuuccaugugaacauucgugguucaaacauacaaaaaagaaaauuuguauugaauauaaauggcaguucaagguacuucccacaaaguuuguguguguguguaaauccuaacauucuaacuacacuuagaaacuauuuuauuucccauuugugguauuaauacaucagugguaacaaaguauccuaguguuauggagcuuagaagguuuuaccaaguuuuuuaaaaacuuguuugcucuaugguuuaucucaggaaucuuaagagucacuuugacccuuuuuuuuuaaucucuuacucucauguacaaaacagagaaaguccaugaaauggaaaaagagcacuugaacaagguucagacugcaaaugaagucaaggcaaguuugcugccuggugcacccugauguuuuuaauccguuacuauuagugaucuuaaucuaauuuugaucuuuucccuuccaaacaaauuucagcaagcuguugagcagcagauccagagucacagagaaacccaccaaaaacaaaucaguaguuugcgagaugaaguggaggcaaaggaaaagcuaaucacugaccuccaagaguaagugcugugcuuucucugcguugguagagacuaauucagagagguuggcucuucagacaagagauccugauggacaggcauccucauagaaaccuguguucagugaaaggagauuuuuuuuuucuucuuucccauguuuucuggcuucauauauagaguauaaaguggagaaaucugugauaauuugagguuuaaaaaaaauaaagaauguaagugauagcaaauuuugggagauggagauaaagguugggagaaugaaaugaucagugacuucagugaccaugugagaaauccugaaugacugagucugcccuuccuuuuucuacccuuaugagaucagaguaaugagauccugaccaguugacagaagagguugagcuuaugaaagcucaagcccaauauagcacacacacuuggaauucuaggcugaggcaggaagaggucagguuccuagucaggaauguguaguaacauccuauucuaaaaggcaggacgccuuaaaacguaaacuugaugacauucagacaacuuuugaggcuaagcuuguauucuguucuuuugucagccaaaaccagaagaugguguuggagcaggaacggcuaaggguggagcaugagaggcugaaggcuacagaccaagagaagagcaggaagcugcacgagcucacgugagugucacuuggguugaaguuugcagauacaaggcuguagguacugccacgggcauggcugucuucucucugccuugcucugauuugugacaugugcuugguuuugagugaaagcaagacuguaguccuguuucuaagaccgccugcuccuuucuuggugucuaauauuucagaguauaucauaaagacaucuuaaaaucugaugauaaucuagaauauuguaggauaugcuuccaaaacuauauuuugucaaauuuaguuuuucauaaaacuauauguuuuggucuuugguuuuucaaauaaaguuuugguguuugguuuuugcuuuuguuucucccuucccuugcccccauuaauguauaugaauggccugcccacauuuuuucauguuuacagugugcaugccugguacccauagaggucagaaaaagcugauagauccccuggaacuagagccacagacuguauugagucagccugugggugcuggggaucaaacugguguccucuaacuggcguccucugcaagagucacaauuguucucaacugccagaauagcuaccccuuacccuuaauuucuucagcagggauuuuucccccuuucuuuuucucauucacugugauuuauuggcuuucuaaagucugaguagguaaacaacucaugaugauauucuuccacaucagggccuugaauuuuaggaaauaauuuacaaguaaacugcagcaguuaggaugguuacaccagaagaccagucauagugcauugcauaaagguucuucugagggcugggaaugugccagguaugaacaaggcucuugaguugaagucccagcucugcagugaggguggggaguauagaauucugcugaauuucagcuagaguuuuauauaauggaaaauacuuuaguuucaggcaaauuuuauuaucaacaacuucuacuuaguaucuuuuuuggaugaauagcaguuuucucuguguaccauacuugaaaauaaaaguuauccuuauaugaauucuggcacauacuguuugaucucuuccauugcuauaugagcucuguuuugccuaaagaaacuagguaaugaaaaagagauagaaauacauacauacagauuucuugaaagguacugcaugggcaaacuguuguuuaaauauaagcauauuucuauuugaguuuaauaaaguuugauuuaauuuuugcuaaaguugggauuuauggaauuaaaguugaaaggauguaacuguugcuucaauuuaggguuaugcaagacagacgagaacaagcaagacaagacuugaaggguuuggaggagaccgugguaagaaaauguggaaacaggacuggggagcauguuuugguuuuucugccuuaaguauugugcuuguaaaaccgaucucuuuauucuuaauucaaggcaaaagaacuucagacuuuacacaaccugcguaagcucuuuguucaggacuuggcuaccagggugaaaaaggugaucucacagugcccagggcugcuuguacaaguggugcuuugcuguguguggugcuuuaagagcacauauguggucauguccacgugagucugugaugcccguguuuguguggaggaacguggguccucugauccuuaacacugcucacugcuuugucucuuugucucugacccucacacugcucacugccuugucucuuugucucuguucucucagagcgccgaggucgacucugacgacacuggcggcagugcugcacagaagcagaaaaucuccuuccuugaaaacaaccuugaacagcucaccaaagugcacaagcagguaacggagagagaacgacaagugggcacgcacugcaggaagcccugcagacguccugagccccagacuauuagaguguauuauguacuacacgcccuuguuucaguaagcaguuauauggagaccagguuccuuaggaaaguuaacagguuuguuuuccauuuugugagccugggucucauguacuuaagcaauccuggcucuccuucccaagugcugugcuuacaggugugaacuacugugcccgggucaggaguucauguuuuuaucaacaugcucuuuuaaacaaauccuuuuuuuuugguuugguuugguuugguuugguuugguuugguuugguuugguuugguuugguuugguuugguuuuuugagacaggguuucucuguguagcccuggcuguccuggaacucacucuguagaccaggcuggccucaaacucagaaauccaccugccucugccuccugagugcuaggauuaaaggcgugugccaccacgccuggcugugaaagcaugaaauaaucauauuuccacuauaggaguucaagguugaaauuucuuguuaauuuauuggauaguuuuccuuuuguaguuaaugcagucuuuuucuuuguuuuuuuucccccuguaaucugaaauauacaauguaauauagugagcgcuucauauuuuguacaagaacauguauguuuugcuauuuuuuaaaaaugcuuucgccagugugagguuaaggucucugcagcuuuuauuaguguauccaugggcuuuucaugugccuaaagagcagucuggagacuuagcucaguggaguguucaccguggaugcacgaaacccugcuucaguaccuaguaucuccauaaaaacuggacaugguaguggcuaccuguaaucccaaaugcaacauaaagacagaccagaggaucaagguuauccuucacucccuguguugggaggcgcuauaggauacaugaaacccugucucaaaaauauacccaaaggggcaauugcuuuaccagcuguguuguauuacugaaagcaaguauugucugcuagcacugugcucuacuucauugucuacuagguacagagggauuacaggccaggcagcuggauaacaaaauagugagaugaacagggcuaggacaacauacuggcuucuguccucagcgucacagacaccuaguguggugacagugccucuacucccagcauucaagggauagaggcaggauuaggacuuuaaggucaugugcuaaagagugaguuugagacuguucuagguacugacucuaagcaacuaaaugacugugugcuuucugagauguuacuaugucugauauauauguguuuuuacauggugcuaccuacauggaaaaauucaacagaaaaauuaguuuaacuugcuaaacugcaguuaugaaauacucauuuucuuaaaacaucuuauuaaaagccauugauauuuucucuguguaccuuuaguugguacgcgauaaugcagaucuucgcugugagcuuccuaaguuagagaaacggcuuagagcuacugcagaaagagugaaagcuuuggagucagcccugaaagaagccaaagaaaaugcaucucgagaccguaaacgcuaucagcaagaaguagaccggauaaaggaagcagucaggucaaagaacauggccagaaggggacauucugcccagauuggugaguacagcauacccagguaugguauguccuucagcuugaaaacaucaucuccuuuaucacacuuugccauggugguguuccugucuuuauuuucuaaauuccugaagagugauacuguugggaaagaaaauagaaacugagagagagccacggucacuugacagguaacuaaauaacuagacaagugaaggcuaggagacacuguccagggaaacaccaccaaaggcuuucagaacaaucacugguguagaaaagggauuaugggagcauguaggagaaagaacuugcuaugcaaacuugguggcucauguuugaucccuacaucccacaguggagagagagcugccucugaaaaguauccaucugugaguucuagccuagucccguccauguagaguuccaggacaaccaggacuacauagagaggcucuacuucaaaauuuaacaaaauagcaaauauuuugaaagauuauuagaggcaagagauuauuauauuguuucuggagaauaggagauaaccaaguaagagauaucuagaaaggaaaacacaagaaguuaauucacuaaacacugaggaaugguuagugaauagggagagaccuaaggagucacugcugucacugucacaccuucugacucugaccuucuuucuguuucacagcaaagccgauccguccuggacagcauccagcggccucgccaacucacccgggcacaguucguggaggaggcucauuuguucagaacaaccagccaguggggcuucguggugguggaggcaagcagucguaaacacuugacacauugcaggugugagucugugccugacuuuugaguuuuaacuguguguggaaauacugagcuacuuagcuuaggauucgaguuucacaguaggaucaggauuuuuuuuuuuuuuuaauauguguuguuuuauaaaugcaacuuggcaugauuucuuuuuuuuuuuuuuuuuuuuaaagauuuauuuauuuauuuauuuauuguaaguacacuguagcuguccucagacacuccagaagagggagucagaucucguuacggaugguugugagccaccaugugguugcugggauuugaacuccugaccuuuggaagagcagucgggugcucuuacccacugagccaucucaccagcccuuggcaugauuucuuauggucuauuucaugcuacagauaaucuauguuuaguuuuguuacuaauuuuaaaacuuggauuggaucauuuauaauaauuuuuuguauccuacacaauggguaugcccugguuuauaauauuaccuuuacuagaaacauaauaaaguacauuaauuuuguucuaauuuugcuucuauaaaugacauuugaaauaugaaguaucuuauauacucccucauccuuuagauuauuaugagaagauucccaaaacugggauuuuacaguuugaauguuuuuaaggaucuuacaguuacuuucuagaaagacagccuaaaauugcaucuuaauaaaaauuagcauuugguuguauccuugccaccauugauuauuaguuuuugcuucuaauuugauaggcccaaaauagucuacccuggguggccuggaggaagccgguuuacaugcauacacacucccuuuacauuucccuuuuaaacacuuacccguuuucaaucaccuauugggagcugauuuuucucuuuuuuaauuuuaugugagaguauuuugccugcauguauaucuguauaccacaugcauauagugccccuguggcccagaagagaguguuggaucccugagacuggaguuauagacagaagugaacugccauuuuggugcuagaaauugaaccccuguccucuggaagaggacccagugcucuuaaauucugaguuauccagcuccuacaaguugauuuuccuaauagguuucugaacucccccucuuuggugugugcacaggugugccugugugggugcgggauguguggaaauuagagggcacuuuaagaauguguucucuuuccacacuauggggcccuggggugaaaugcaggcuugucaucuguuucuggcaggaagauaacgaaugucauuugagggcuuucuuuauauacuacuauaacuucacauuuaaaaguuguggaacuaacauacuauaccuauuccccaugugguacuugauagcuuucuuuuuaauguaguaauacacugaacacuuuguucuauaucacauucaccaguaaauggcugucuauaguuuaugacauauuccagaagucugauuaacuauagaaaucccacagaaaugcugaaaauuuaaaauacuaaauaauuaugagaugguuagcucuuacuguuucugagaaauccuaagguugguuuauuuuaauuuugcuuggcuuugauacuuuguacauaggacuguuuugaguagaaauuaaaccagcaaucuggagagguuaaaaauguaauauuuuguuuguucugucuagugaaagguuuaagggagagagaaaaagugccugggauugaacguucugaguaucauuccagcucugcugcguucaugaacuugaacaaagcagcuugcuaaagucuguucucucugggcuggggagaugcuuccaucugccaagugagugaguuccagcugccacagaagccugaggaccugagucuggcuuggcgcacauggagaagucagacggggaagaagacaucuaucuauaaacccagaucuagggagggggagucucuggaacucagaggguucuggggucaguaaaauacucuguguuaaaaaauauaauggugaagcagaugacugcucuccagccucuauacguacguguacacacugcacacacguggaaacuuaacucauucuccucugaauccucuuagaauucacuauaaaaauaaauuauacauucaugaaaaauagguuauuugugcagcuuuaauaauaauaaucacaucuaacauuaauaaguguaauaucucauauccgaauuuggaucuuccucuugugccucugugugccauggcuuuguaccugcuagucaaggcucaagccacugagcuguaccucuuagcucuucucuauuucuuauuaauauccuguguaucuuaaguuuucuaaaccaaggcaugaucuaggacuuuuuuaaguuucuuuuaaucuagaacauaucuagggacagugaccuaccaaagacauccaguaucacaaauguaugcuaccuccuucuggguguauuuaauuauguguguagcugccauauuccuuuacccgauguagacugauuuaguguguuugggggggggggguuguuuuguguuuuuuuugugggauuuucuuuuuucuuuuuugagucagguucucauuguauacuuuggcuugccuggagccugcuauguaagccugaacucaacagagauccaccugccuuugcuuccugggugccggaauuaaaguugugggucacuauggccauaauguaagcauuuuugcuugagugacacaggagauagauuaguugauguuccuacacugagaaaugcaccccucacagacagacagacacauacacagagaguccauauccugucucugcccauguugaacuguuagccuccuuuauugguaaguuggaaacaguucuugagaauuacgugaguuaggacaucaucacuuagcaccgagcuugcacuaaaaagaagcugcuccucugccuuccuagaggagagaguuuuagagcucagaaguugguuucuccagauguuuuuauguuaaaauucauguguaaaucuugaacucauacuuuauuugaauagagaagaacguggccucuuaaauacaucuaguaucaucuacauagugaugauguuuagcacaugggaaggagugaaaaguguacuuaugaaguguaauuguuauacugcugaaucaaaggauacucaauuuuuauuuaauuuuuaaacuuauuuuuauuacuuuuuaaaaugauuuaugugucaugcccacagaagccagagacaucauucccccuggaacugaauugcaggcagcagugcaccuccuagugugggcacugaacugagguccucugccagagcagcaugcacucugacacacaugcucagcauccccugagccuuuucauuucuuagaucacuguaucuuaaacugugauggguggcugauaaacuugaaaaguuaaacucccugaagauacuuuuuaaaauuacuuuuuaaauguugaggaaaacauggauuuagggcaguggugauaguuauuaauaauguuuaaugacuuuuguuuccaguuuuacauagccucucuucugucacauggcuuuauuacuaaguccaaccuaaagauguguguguguauuagguuaugucuguaggcccacaagugccacggcuuauuuguggaaguuauaggucaacacugggugucaauccuugcuuuucaccuuguuugagacgggaucucuucugcacuucccguucuaacuauccugcagcuuccagauacugucuuguuuucaguccccauccugcagauagaagggucacaagcacgcgcuccuauccauccuugcuucuguggguucugggaguccaucucccagcacuucccugauuuuaucuaagacacacuauuugccacuaaucgcugcuaaguagugguccuuaacuuaagaacgccauguuuucuguuuaaagauugacaagccugcuuucccccaucacuccuucauucuucccaugguaagccuccugcucccaaaugcugcuagggcuacaaguuugggccaucaugugcagcccuguuuuguuauuaaacaaaauaauucauauaucaacccacauauggcuuuauuaacuagggaugaaaaaaaugaugggcugaccuuguaaacauuguucugcucauaaauaguucaaguuagaagacagaaaaguaaaagaaagcaaccaggagcuggagagauguacauuggaaagcacuugcucuuuugcggaggaccggaguuugcuuccuauuauccacauagugacuuagagugacccauaacuccaguuucuaguuccagggaauuccucuucuguacuccaugggcaccaggcaaucaugugguaugaugucauaccacaugugguaugaugaacauaaaaucuaauuaaaacauuuuuuaaagaaauuaaaucauuccuaucuuguucuuuauuucaaacaugaguuuuauaagaacuaaaauuuucucugcuuuuuuccuauuucagguguugaaaaguaauugaaguuugaagaggacauaaaaucagucuuucacuaacuaaccucuauuccuugggauuguagaaauuuaauuuuuuaauguguaaauuacuccuacccuguacagcuguuuccuacccacucuuguaaacucugcugcuucccaacacuagagugcaauguugauguccuagaagggaaacgacaguuuacaacugcggcccuguuuguuacacgguguguccuucgugucuucacugugcugaguaacuguguugagggacucugcuccuugauuugccuuucugugaguguguaaucuugguuuacauuacauagcugcuauugcuuuucauuuucccuuuucuacuaaaaugucuuuuuuuuuuaaaggaaauauggaacauuuagauuaaaugucuuaaauuuuacuacuuauaacacuacuugccacaaaauauaucaggucagucaguacuguauuuuaaaaaucccucaagcaagguaugguggcacgcaucucuacucccaggcagaggcagauggauggcugucagcuugaguucagccugcuuuccaggacagccagggcuauauagggagacccugucucaaaaauaaaucaaaaaauaaaaaauuaacuuaaaaauaaauuuaaaaaucccuugauauguugcugguauagucucugaagcuugccucugaaaacguugagcuuugagaccaggaguucgagacugaacaggcucuuucuauuauaucauuagcucaugagaugccuuuugaauacaaauaucuuacauaucaaaaauggaucucauguuaaauggauuuggaaguacuauaccccuucuuucuacuucugcacuuaaacauagcuuaaugugcucugcuuuguucuguuauaucuuccugcuaaaguaagaauugagcagagcuaaugucaucuuuaauauuaggaaauaaguggacuaagacauuauagaauuaaauaauuuucaaauguuaaauaauuguauugacugauaaauuuauagccucugaaaaaugagaaaaaaauugugaacaggacagaugaaguauaaauuuaaaacuacaugguuaauuuugcucugaaauccuauaggugguuuucaccuguuauacuaaaucauacacuauaauuuguuuaguuagaaauaguaaacuguuugcaagucacuaguaauucucaaaaaaauauuguuggccauagugaauaauuuuuaaauuagaacuaaguguguaccuauuuuuggcacuuauuuuucaaauaauuaagcucaaucaaguauauuuuaaggaucuauaaaagugacaggaagaccgggugugguggcgcacaccuuuaaucccagcacuugggaggcagaggcaggcggauuucugaguucgaggccagccuggucuacaaagugaguuccaagacagccagggcuacacagagaaaccuugucucgaaaaaccaaaaaaaaaaaaaaaaagugacaggaagggucucagcaccugcauccucagugcuuggggcagcuguagccggaagcaaagacccacaggaaaugcagugucuggggaucuuugauaaguagacaagcuuuugaaguucuggguuagaaucuggcuggcagaaucuuuggaaaaguuuuauauacagauauuuguauuauuaaauuuggagccauagucagaagacucagaucauaauuggcuuauuuuucuauuuccuuaacuauuguaauuuccacuuuuauaauaauuuugauuugaaaaauaaauuuauuuauuuuuuuaacagucaaaaucuuugcuguuguagucugcagccuuuaaugauuguguugcuuuuaugauugaaagaagcacuccacaaauugaagagagcgugaugcagcgagguguaagucgugguuagugacguguauggcuccugugcucaucgcugucucugcgaggcaucuggcugcaucuaaaggacauucguuccaaaugaaaauuugcuuuucuggcaguuuucauaauggaaaaaaaauucuccuuugucugaguauagaaguuuuaagauguaucauggguaucggugcuuguauaacacacaaugaauuguaacuagcauguuguuaagaaaacacauuguuaguuuuuuuuaaucuuaaauguuucuuuucuauuuauaauuucaaccuuucauaaaguauacuaagaauuucacaaauuucuuuucagugaacugaacucuuuuuugcaaugauaggccauuaaauauagcauucacacaaaauggacauuuuuaaucaccuagaauauugaaaauauuuuaauuugcagugucuuuuuuugugacuggauauauuaauguuccucugaguaguauugauaauugguucagaagagaaacucaaugaaauaagaauaguauuuauucauggugaucaauuaaauuauuugccuaauuuaaggaaacuaaauacuaugcauaacugaauuuauuugcaauucucaguuugauuugagguaacagaggagagucuaggucuaccuguggaauauguuguuuuauuuucaguguuuaggguuacauuuaaacauaguugguuugggaaaaugacauauaauuuuaaguuaaccugcaugcuguaaauguguuuaaauaaaggaaaaucuuuuuugaaauguaaugacacauuugaaccuuacuucaugacguauuagcuugauuuuauguagcugaauggccugcccugugugaauugggggggguggcgccguguaucccucuguguauauuuuagcaagaaguagcugucaaguggauuggcuuuuuuguacuuuggcuugcau

SEQ ID NO: 8794 - RNA, 13414 nt, Mus musculus
uacuauucuauaaugugagaaaacuuagaugguauuaaaagugauugucuccugaauaucugcugcacuucuuauaagauugucuauaucagccagggccacacagagagacccugucacaaaaaaaagaagaaagaaagaaaaagagaaagaaagaaggaaaacuuaguuuguauaugcuuauacaguauaacauguaauaguugaaacuuugaaauuauuuguagagcaauuucuaaaagaaaacaaacccagucacaaugcuuauccuauuuauuuuauauuaguaaagagucacgguuuuuuguuucaauuuuucucuugaaauuuguuaacaauucuuuguuuucuaugcaggguaaacuucaugauccagaaggcaugggaauuauuccaagaauagugcaagauauuuuuaauuauauuuacuccauggaugaaaauuuggaauuucauauuaagguaaauucuugugagaaagguuauauuuauuuaacuuaggauacuuauuuuccaaaauagcugcuuccuggaagucaaauuuaaaaaguuguuacagguauauaagguugaagaauuguuaagaguuuauaagccacuagaugaauaacaggguaagcuaagucuguucuuagauucuuucccuguagaaaaaaacaguuuaacuacaaagcuucaagauucccaccacacuuacugcuuguccauuguucuuguccguugugggugguuguaacagaaaugggcuuuucguuauuuaagcagcuuagugacucacacuuuggaguuguggcuagugugguguccuagucuagauaucuggcacuuagacugcauuguuugcagagagaacgagcuguauaaauuuaacagauugacuuuucuuucugcuuagguuucauauuuugaaauauauuuggauaagauaagggacuuguuagaugguaaguuaaauucuugcuuuaauaauuucaguaguaccuguugcucuucuaguauuaaauguucuuaguaacauagauaaauuucguaaagugauaacguuauacauaggauaacuuaauagcauauguauacuauuuuuaaagucaagcgacauuuauuaagaacugaaggauuagcuccuuguugcugggagggauugugaaccugggaugccaucauauugccacuucuuaagugauaaugagggcuuuaaacuaagaguuguagagcuuaagcccaaaguguuagucccaguuguucaaugcauuguccuucccuugggccuaauguuauuuagaaaaugggagugguagaaguuugaaauuucuguuuuguuuuuuuaacauuaguuucuagauuauucuccuaguauguuuacaacacuuugcuuuuuuuauaguaaugcauauauguauaaaauauauauuuuaaaaguucuaagguugggcugcuaagggaaaccuaccacuuacauuaguuauuuuauaacugauauaauguaacauuuuuuuuuucaguuucaaagacuaaccuuucaguccaugaagacaaaaaccguguucccuauguaaagguacuuaaaagaaugaugacuauagaaaacacuguaagagaauuuuuaaagaguauuaagaauacuuuaaaauuacuccacaggggugcacagaacguuucguguguaguccagaugaagucauggauaccauagaugaagggaaauccaacagacaugucgcaguuacaaguaagugggauauucauuaguacucaccaggcaugucugccuuacaucuuaaugcagucuaugaauucaagauauuucuagcauauaguaaugcuuuggggaaaauuauuagugaaggaacuauauuuauacuugcuugcuaauuucauugcagauaugaaugaacauagcucuaggagucacagcauauuucuuauuaauguaaaacaagagaauacacaaacggaacagaaacucaguggaaagcuuuaucugguugauuuagcuggcagugagaagguaaacccuuuugaaauuucuaguagauacuuaggcaugucuguaaacuuuaccuugacuugaaacuuauaugcuacguauuguugcaucuuaagaacuuguggaauuggauuuaguaaucugagaauuaauacuguugauaccaaugcuauaugauaauugaagucaauaaccuguucccaagugacugucauuuagcuauauuugauccagucaguaggguauuuggaauaagauguauguucuuauugacagccuguuagcauugccauuauaauuuuauuuuccaucucucucguauguugccuguauucauggugaguuucucugcagcauucugauuugguuguacuguugucccuugcuaucauggggauugguuuaagaccccucaccauaaauauaccaacauccacagaugcucacgucacuuauaaaaugauuaguguuuuugcauagacccuacauacauucuuuuguauguaaauacucucuagauaacuacuaacguacugagaccacauaaguggauguuaaauuauauuguguagagacuaugaccagagacaaaccauauauguuuaguacaaaugaaguuuguuuuggaauguuucucaaucuuggcuaguugaauccaugggaauaggagggucaacugucguuuauaaaaauuagaauauuuaaauguuuuaauauagacuucuguggccauuaugcuauuuugcgucuucugauguagaaugauguacccagucuuguuuaccaaaaaucuuauuauacacagcuuaucuagcaguuaguaccacuauuaauucuagaagccauuuaggcaguguacuugguuuucaagucacagguuagcuuauguaguauuagaacugucuuuuguuuuuagcaaauuaugacaucuauguuauaauuuaggugauuuccaguuccuuguuuuauaauguagcagagagauaacacugaaaacuacauauuuacaugaaaauuuauuauugacaaaagcacacuagaaauaaaauguaauauuucucuaaucacauuauuguucaacuauuucucugaucaggcuauuagacagugagaauuugaggauuccuaguccuuaguaucuaaggauucuuagcccuuccccuuuguaauuuuaaacuaguauuuauuuuuggcuauuuggaaaguugagagaaaauuaucuuaaacuuguaaguuuguuuuauuauguaaucuuacuuauagguuaguaagacuggggcugaaggugcugugcuggaugaagcuaagaacaucaacaagucacuuucugcacuuggaaaugucauuucugcuuuggcagagggcagugugaguauacaaucuguuaguucccuguuuuauggguaguaauuuauagaggauauacguguacacaaauguaaaacugaaugugucuucuuaguuuaguguuuauauagguauccuagcucccuucuugaaaucaaguagauuaaauuaaugaaauacgccaggcccaggaaagcauaucugaucacaaugcuugaggcagaaacaggaugaccaagaguuauacaacaacuauuauuguauaaaaccccacugguuuuguuuuguuuuuguuuguagaccuauguuccuuaucgagauaguaaaaugaccagaauucuucaagauucauuagguggcaacuguaggaccacuauugucauaugcugcucuccaucaucauacaaugagucugagacaaagucaacacuccucuuuggucaaagguuuguuguugaaauacaaaguauaaagacauggcauuaaaguuacuaaugucagcuacugcucaaauccagauguauuugucagagaacuagaucuguacuuuugaaucaggacauaggucauauaaguuagagauguauuuuagacuuaacgagcuuuaacuuuucauagacauuaaaauugagaaauguaauuguuuaauuuccuuuugaugaaaguaaacaucugagucagaugaugaaguaaaagcuuuucagauauaugagccuaugugaagcucacugaugcacuugaaguagcauacaugaaagagcuacuuaggaaaaucaauaacagccuuaccuuagacccauagugauagguaacggaugcuacugcuucaggauugcaagugaguugggaaaauaacugcauuuucuuaguuuugauuuuuuuuuuuuuuuuuaauguuaccaaagacugagugcugacagaaauuuauuuggguuguggauagauauuuuuuuaguuuuuguucuaagaaagaacuagauaaucuuggacaauuuguuauuuagcuauaucauauauuaaauacggaugucaauuaaaaauacuuucagucauaugcuucuuuuuuccguaaugauuacucuucguuaaugaugucauuuuuuuucuguaauugcaucacuuagggccaaaacaauuaagaacacagucugugucaauguagaguuaacugcggagcaguggaaaaagaaguaugaaaaagaaaaggaaaaaaauaaaacucuacggaacacuauucaguggcuggaaaacgagcuaaaccguuggcguaacgguaaucacuuaagcauugucaucuaaacuuucugauuuggggcucuuuuuacguacuugagauuuuuauaugcaugguaaaugaaaauaaagccuguuuucaguuuuucagcauguagaggucuucaacuaaagaucaagauuugucauuaaguuuuuacauuacuucagauaauaaguaagagcuguagaugcuacaguauaguauaguaaggugccuagauuaggaagaagucgguuacaggaaagcauggauggacuucaaagaagggguaagaucaagggaaauuccagaugcccagaucucagggacagagcuuugugguguaagcuauaauccuagcacauaggacgcagagccccaaugauuguguaaauuugccccugccugaccuuguaucaaauauagauaaguguauggguaacuacguauacaugcauacacauauauacauguguaaugcaaauauacuuauauacauuuacauauacuuauauguaaaauguagaugggaguagaugguagcauguaccuuuaauccuagcauuuggaaggcggaaccugcucuaaauggcaagagucuaccauucuaaaaaccaaacaaaaacucaguaucagagcagaaagaaaaguugguaagaacugcugacauugcauaaggaggaggaacaaagaaagauggugaagugggacucauuacccaucacccuuuauagaagcauuaauuucagcaauaggcaaaaauagaacuuaaugugguuuaguaauaaaguuucacuguccauguaggacacuuucagauuacuugugucuuccuacuccuuaaccaagauagagagaaagcuaaggaaauuaguggaccuuggaccccaagaccaggcagaucaucucugcucuauaccuguacucugcacaugccugcagcccugccuuccugccaagugggaacuuacagccuaaggcuuuuuuuuuuuuuuuuuaagauuuauuuauuucauguaugugaguacacugucgcugucuucagacacaccagaagaaagaaucagaucccauuacagaugguugugagccaccaugugcuugcugggaaucaaacugaggaccucuggaagaacagucagagcucuuaaccacugagccaucucuccagccccacagccucaggcuuuaagccugcuaaauggacccuuaucuccaucaucagcaaucccaagauuugcacagcacucagcagcaagccgaccucaccucgaugguacaccacugcagaaguccugagcuucagagcuauuguguccgccaucucuacaugggcuuacuguugauaggcuuuccugaacaaagauaaucggcaaagacgagaauaaggagguaguugauaucaaacauaugauaaggaucguucagggaaaccuggcaccacagauugagaugaaaugcugauggcugacccuaaagaaacugagaugagugaacaccugagaauugagaguagaaauccugcagagaaaagcagucgaaggaaaugaaaacagugaccagaaugagaaauuuacugauacugaaguacuuuuuaaaguucaaacaaaucugcagaaaauggcaguagggagcaccguuggucacacagcagaaggaaugugugggcaacugcagaggggagaacaccuguuaguguuagagaugcacauucauagucaccauuucauugccauuucaggggagacagugccuauugaugagcaguuugacaaagagaaagcuaauuuggaagccuucacagcggauaaagauauugcuauuaccagugauaaaccagcugcugcagucggaauggcugguaguuuuaccgaugcugaaagaagaaagugugaagaagaacuugcuaaauuguauaaacaacuugaugacaagguagauuucacauacuuguuuuagauuuguuuguuuuaggauacuaucgauaucaguauuuuuuaauuucaguauuaagguuccuugugaucuacauuuuccuuuauuucuguuagcuuuuagaaagucaagauauuacuggauuugguagaacaugcugaaauucuaguacuuagaagguagaggcagggggacaggaguauaaggcaagccuugaguauauauugauuuuaaaggcagcuugggcgauuauagaggguuggagaaucauauuaacaguaacuuuaaaugcugaaggguguggagauauagcuaagugguagaaugcuugcauugcauggggcuucagauuccauuaccagcaaagaaaauauaauuuuaguucuguguggaggcaguguauguaaccuauguugacuauuugugaguaauaguaauucauaauuaguccugggaaggaagccagguaauaguuugcuuuguuaauuggauacuuuaauauuucuuaggaugaagagauuaaccaacaaagccaauugguagagaaauugaagacacaaaugcuggaucaggaagaggugaguuaaauccccccagaaaaucuucaguguuuaucaucuaaagauaaaggaaucuauggguuauguaagcacuguaccuuuaaaguuguugggugugugcaugcuuaacuaucagugugcugugagauuagucuuugcauguguugaaacagacugcuuuccuccuuuagaugcuuuuuguuauuugguuuugauguuuugaguuuccuguuguauauauggaagagagaggacaguuucuacaaaacauuuauuuuugucagguguaguggcauguaaucuguauaaaucuguagucucagaauuagggaugcugaggcaggggaauuucaagcuugaggauagcaaggacuacauaauaagauccuuucucagaaacaacaguagggaaauuguggaccaugugacugcggagcuuuuaacucccuuuuacuuuauuuauuacacuauauaucgucuacucuccucuuaaauauuucuuacagauuugggggagacaguggccuggaauaauuguuaagacauucucccuuagagaaaaagauauuuacauauggaugauagggagcauguauacagaaagcugcauacauaauaguuuuuauauucacuuacugugguuacuuaucuaaggcaggccuuuccccacuaauaacuuagauauauaaauaaaugagguaagugucuuuguuaagcuuucuguugcuaugcuaaaaaaccaugaccaaaagcaacuuggggaggagaugguucauuuugccuuauaucacuuacagaagccagggcaagaaccugaaagcaggaaccagagcaaaagccaugcagaaguguucuuuacugacuugccaugguuugcucagccugcuuucuuacagugcucaggaccacuaccuucaucaaucaugagucaagaaaauguaucacaggccagucugguguggacauuuucucaguugauguucucuaguccaaaaugaaccuaacuugcaucagauugauauaaaacaagccagcaugcuagaucgugaggggucacgcuuagguugauuucuggguuccaggacaaccagggcuacacagaaaaacccugucuugacccucacccugaaacaaaaaauuccauuugggucuacccagccauuuggguuccaguuaauuacaguugcagucaaauugacaaccaaguauacuuaucacaguuguuaguaauuguacaguuuccgaugugacuuuuucugggaaugugaaugucagaugaauaaacauacuucuacuccuccauauugucuuccuacucccagucugugccaccuuucauuucauuucucucgugcucaucuuuuccuaugauuuagcuugaaucuguauuuuauuucacccaggauaguggagauaauugaaaaauagucccuauuuagugcuuuuugagagccugaagagauagaaaaggcuguacccuccagcagaaugaaacauccauuaucagaaaaaucagucuuaaucggugucuccuuuuggauuguugagaggucuugcuuuuuaguuggccuagaacuugacauugagcccaagauacccaacacagccuccugguguguacuacugugcccggugucuuauuauuuacuccagcauuguucuuugaggcaggauuugggauccgacaacuguuccaccccucacccccaauugaucaucuaccuugaccaaguaaaauuaauuccagagaaaagggcaugguucaacguaugaaaaggaguaaaucucgaaaagaaaaaacaaaaaagaaagagagagagagagagagagagagaaaggaaggaaggaaggaaggaaggaaggaaggaaggaaggaaggaaggaaggaaggaagaaagaaagaaagaaagaaagaaagaaagaaagaaagaaagaaagaaaagaaaagaaaagcaguaaauguaaucuauauaaacaaacugaaaggaacaaaaacacaugguuaucucacuagguacagggaaaaacauuucaguggaacaggacuucaagauaaauuucacggagagauuaagaauacaaggaauauaccuaaagauaauaaaggcaauuaacaucaagccuauagccaauaacaagugagguggaaagaaucuuaaagcaauucuauuagucaggaguaagacaaggauggccaugcuucaguaaucaauucaacauaguacuugaaguuuuagcuagagcaaaaagacaauggaaggagaucaagggaauacaaagugggaaagaagucagaguaucauuauguccaggugauaugauaguauacauaaaugacccuauagauugcaccuaagaccucuuacaguggauaaauacuaaaauauuuacuacacagaaaucaccccaugcucacucauucccacgguuggcggugagcauccaucggccucuguauucugacaacuuuuuaaauauucugucuugugcacuguaaggcauuuagcauucaugauuccuguuucuuaauguuaguaauagcuguuacuagcuauugcuaacauucccauauauuuccaacuauuucugcugaaaaguagcugaccuggaugguccuuugucuuuucuccaguucaaauuuaauaggccgacauauuucucugggccauuucucccaggccaaucuuaguuuccuaaaacaaauguaaguucuuuaaagauuauuuacucugauuucguguauguaugugugccuugugagccugguauccucagaaacuggagacaguuuuguucugggugcuuggaucugaguccagguguuccggaagagcagcaaaugcuuuaguggagaacuugaugcagaucugaaguuuuuaaagaacuauucuaauuggauuuuggauuuuguacauaguacuuacaagucuagaaugccuuugguuuuuuguuuguuuuuuuuuuuaacuuacaugacuaaaauuguccaugaauaucaugcagaaagaucucccuuuuucgugguaccaagcacucugcugucucuuuuuugcuacuaaauuaugccuuguguugcccuuacuuuccugggcuucacgcuuagauuuguuccuuucuaugucccacacaguguagcccugugccugcucguaacuguuugauccaucuguuacagcguaaaguagcagcaccuuucuuagugaaacuuuucauuucuguugcuugccuaaaucaugaagcaaaugaauguuuccuugcagguuuguuaaaauucuauuuuacucuuucaucuagcuucuggcaucaaccagaagggaucaagauaauaugcaagcugaacugaaucgccuccaagcagaaaaugaugcuucuaaagaagaagucaaagaaguuuuacaggccuuagaggaacuggcuguuaauuaugaucagaagucucaggaaguugaagacaaaacaaaggaauaugaauugcuuagugaugaauugaaucaaaaaucuguaagauaaauuuuguuuucuuaauacucaaguauaaauaacgcuaaaugauguuaguuaauuaagucacuacuauguaagccuaagauguggguaacauagguucuuaagacacccaggucucacuuucucuugucuuuauauacaaagccuaggugguagagcaacaguguuauaaaucugguuuccaaaaguauauugauuuguaaucaucuaaaugauuugccuauuucuaauguuaggaaaaauaauagcuugaaauagaagcuaccucauaauucauuaugggucaagaaucucaaaacaagaaauaaaugacuuuguaaggacuguaaugacuaaguagucuaucuguucuguuuucauucuaucaggcaacuuuagcaaguauugaugcugagcuucagaagcugaaggaaaugaccaaccaccagaagaaacgagcagcugaaaugauggcaucauuauuaaaagaccuugcagaaauaggaauugcuguggggaauaacgaugugaagguacuacuguuacuaaguguuauguaucauccuuuuguauauagcucacacucuggcgucagugcacuuuuagaaaccagcaggcuguugugauccccaugugggcucugggaacccaccucagcuccucuggaagagcaguaagcacucuuaacacagccaucucuccagccccuuaguuuugauuuaaguacaugaggagagagagaaaaccaggggcauagaaauagaauagucauagaauauucaguaagucccucauugggccacguugaagauuuucacuuaaaaauccccuuacugggcugcugagguggcuuagugugggcaaaggugcuucgcuccauaauccugaugaccugaauuugauucguggaacccaugagagagggugagaacugacucccugcauguugacauugaugguaaauaaucuuaaaaguaucuuuauuucugugugcauauuugaauagaacaguggugagucugcucagguggcugccuuuuaaguaaauuggccuguuguuacgucauguguguugauggcuguguguggaggcuagagaucaaucucagugucuuccuuacucacucccccuuucguuguugagacacauucuuucauggagucugcagcucagcuagcuagaaucuuugccgcagagaucccuggcucuccuuccugggugcuggggcuaaaagugaccaccauuccugcugagcuuuuauuuggguucuauagcccaaaacucaguccucacacuuggcaccaaacacuucaccccuggagcugucuaccuggucauacacauuauaguuuggaacaacugucuuaagcucagugacuugcuuagaccagcuggccaacaagcuccagagaggcuugucucugccuuccccaguccugagauuacaagugcauacuaccuugcuuagcuuuacaugacugucaggcagcucauccuucguggucuugucagacacuuuacugcucgcucaucuccccagcuuagcuguucuuacacuacagucacuuuaaacauggaaaggugaaugaaguucaagucacacaguaagacccugucuuauaaacaagcaaacaaaaacgggugagagaagugugggagaggggacuuccgccaaaucuaaggaacugauuauaaaucuggaauucacauaguagaaggaaagaauugcaaguccucccugugauguccgccugcacacccauggcucacaugcuuguucacacagauacugugacuucuaugacuucaguuauauuuucuagcuugggaaaauagacuugaacauguuuggcucuaacuuguucguucuuuugugugugugugugguaguaggaagguugugaggaaggagacugucuuacuggguucaucuuguagcccgggcugcccuugaauuuacagauucugauugccgcugccuccugaguauuaggauuaaaggugugugcuaccauguagccccugcuuuaacuuauuucauguuuuucucucagcaaccagaaggaacugguaugauagaugaagaguuuacuguugcaagacucuacauuagcaaaaugaaaucagaaguaaagaccauggugaaacgcugcaaacagcuagaaagcacacagacugagagcaacaaaaaaauggaagaaaaugagaaagaguuagcagcaugccagcuucggaucucccaaguauguguuucagauggcuuuucauuuugcugaaaugucauguauagauuuuauuaauauaaagguuuucagaaucauaugagucuguauuuucaguaauaaaagaccuauguguuucuuaguagagcugcaguauaacaacuugaaugauguaacauguacauacugaguguggaaauuagguagaacaagugacuuacugacaaaguggaugugcagaacugcagggacuaauaaaugugucgcuggcgcugaguaagguggagcccuacacuaggaagugugcauacaggguugauaguagcagggucucagcuuucagaugcuguaagcuguacagauaauggucuacucguccauguuuuaacugcauaaugugugugagauauuuccccacuucauauuaguauauuuuucccaaaagcaugaagccaaaaucaagucacugacugaguaccuucagaauguagaacaaaagaagaggcagcuggaggagucuguugauucccuuggugaggagcuaguccaacuccgagcacaagguaccgacuucugauucuuccuugcuuuuaauacaguuguuguacacauacuggaacu

SEQ ID NO: 8795 - RNA, 537 nt, Mus musculus
auuuuuuaaauuauuuacauuucuuuuuuuuuuuuuuuuaauuuuuaaugaccaaaacaaaaauauaccuaaaagcgaagcuucuggaaaaaccauuuguucuucccugucuuguaucgcuccucaaacuugaccuuggccucccgccuggccuugcgcuucaaagcugggucccugaacacauccuuguugacaacagucuuguccaaggggauauccacagaguaccuugugggcaugaggugguuguaguuauaaacuuucacaaaggacuugaucuuggaucgcuuggcgaucuucuucuugcccauggcagcugucacuuuccggggauagcggucaauuccagccaccagggcauggcuguaagggcgguccgaggugccaucgucaauguucuucacgaugacggcuuugcguccggaguagcguccggccaggaccagcaccacuuucccggguuucaugaacuugcccaucucgacagcaggcagccggcacccagcagaaaggaaaggagcaauuauuuacauuucu

SEQ ID NO: 8796 - RNA, 757 nt, Mus musculus
uucccagcuccacccaggcggcugcccgugaccugccugggcgcagggaacagaaagucgaagggcuaagaagaguucaguucaucaugggacuguuuggaaaaacccaggagaagccucccaaagagcugguuaaugaauggucacugaagaucagaaaggaaaugagaguuguugauaggcaaauaagagacauccaaagagaagaagaggaaguaaaacggucugugaaagaugaagccaagaagggccaaaaggaagucugugugguucuggccaaggagacgaucaggucaaggaaaacugugagcaagcucuaugcguccaaagcacacaugaacucugugcucaugggcaugaagaaccaacuugcgguccugagaguagcugguucucugcagaagagcacagaagugaugaaggcaaugcagagucuugugaagauccuagaaauccaggccaccaugcgggagcuguccaaagagaugaugaaagcuggaaucauaaaggauguuagaggauacauuugaaagcauggacaaucaagaagaaauggaagaagcagcagaaauggagauugacggaauccucuuugaaaucacagcaggaaccuugggcaaagcacccaguaaaguaaccgaugcucuuccugagccugaugcaggagcgauggcugccccggaagagggagaagaggaagaagaugaagaggaccuggaggcuaugcagucacagcuggccacacucagaagcuagg

SEQ ID NO: 8797 - RNA, 757 nt, Mus musculus
ccuagcuucugaguguggccagcugugacugcauagccuccagguccucuucaucuucuuccucuucucccucuuccggggcagccaucgcuccugcaucaggcucaggaagagcaucgguuacuuuacugggugcuuugcccaagguuccugcugugauuucaaagaggauuccgucaaucuccauuucugcugcuucuuccauuucuucuugauuguccaugcuuucaaauguauccucuaacauccuuuaugauuccagcuuucaucaucucuuuggacagcucccgcaugguggccuggauuucuaggaucuucacaagacucugcauugccuucaucacuucugugcucuucugcagagaaccagcuacucucaggaccgcaaguugguucuucaugcccaugagcacagaguucaugugugcuuuggacgcauagagcuugcucacaguuuuccuugaccugaucgucuccuuggccagaaccacacagacuuccuuuuggcccuucuuggcuucaucuuucacagaccguuuuacuuccucuucuucucuuuggaugucucuuauuugccuaucaacaacucucauuuccuuucugaucuucagugaccauucauuaaccagcucuuugggaggcuucuccuggguuuuuccaaacagucccaugaugaacugaacucuucuuagcccuucgacuuucuguucccugcgcccaggcaggucacgggcagccgccuggguggagcugggaa

SEQ ID NO: 8798 - RNA, 1644 nt, Mus musculus
uguggcaaauauauguuuguuuaauucuguaucucuuaugcgcggcggugggggaggaagcugugaaacuaacgugccaauguaucacgaaguccccgggauuuuuuuuuuuuuuaacgcauguaaauacauugaaacacuaaagaucacaaaauuccuuuguucuguacuacaauaacauuacuguagcacacaguuccauaaaccaguagaauauuauaaaaucagaaucacauuugcuauugcuacuucguccuagggaaggguagcugaggucagaaggcgagguugcaccccaaugccuaccgagcaucuuuacacagagaccgcgaaagggaaugaacucuuucuuccuauggauugucaacuguacccgccucuguugugaaacuugcccgcugaaaaucggugguugaaauugucagauuuguccuugggguuuaagccgcugagguggcaucugugaaucagagccugcccucauccuacugcacaagcgcagcgcagaaggcagcaaugcaguaccgccaagaaacaucacauaacagaaacccgggaacagcacaaaagucggucgaucaaacuauggugcacauacgcguggagcacaaaaaugaaaagccagucuccuuccuuguuuaaauugugccuugcugaguuucuuguugcuaaguagaugauaacuuugaagaaucgagggugagauuaguacuggaaauggcuuuauuguauauuuuagccacuucuagaccacauaaaaaggcagauucuuagguggggcucuuggcuguguggcuaucguuaagggagaaaaguacaaaugauacuaauucuuucagguauuuuucguguuuaagucuucuuuagcucuuaaaagacauagccgguaccaagaacagcggagcccagccacccgagcaggaggcuugaugcuccaccuccgugacucucugagcugucacaauuucuugacguuucuuccguccaacugcgcacuuugguagauuacaaaucacauuuuagagaaggugguagccauucuuucuucuugcuccguaugacuuuaggcucuaacccuggggcacauguagauccgagucuccucgcacugucuucugcacaccugacugugguugcacaggcaccugagcucgccuugccucaccucuaccugcaggcaucucaaccucugcagugcaagugacguuugccuggccuugaccuccacaagccuggacuuugcaggccagcccagcgacaccaaagggguccccaggugcaagaagcucuaaccuccagcuaaucaggagggaaacaccuggggcgucucugcgaccuccuugcccccggccuggguuggugacauuuccgacacuaggagcagcuaaaacgcaggauuugcaccgcaaccucuguccuguuuaugcgagccccgggcucccggcagcuucucggauuacuccuuugagcgcaaaaggaaagaaaaagcugguuuugcugggcgcugcuaggcaaaagcaucagggagcggugccccgcugggaggaugagacugccuggggcucccgucuuggccgguggcugcugucuaccagagggguuaacagcagcucccgccgcccgaccggcgcgaucgcuuccucu

SEQ ID NO: 8799 - RNA, 402 nt, Mus musculus
agagagagagagagagagacucgauggagucacaugauaaauccagggaaaccagauucugcaucagggugcagaucucaguuuauugcccagugcagaaccuuauauacaguguuugagccaaucccaagcccauaaauccucggccaaucauaucucaccacaucacuguugcuccaacaaaagcccugccugaugagguuacucagaaggaacauuggggaaguggggagaaagaaguauguccuguuagaucaccuguuaggacuucaacugggaagcagccaccacccuggccuagauuccuuuuuacuguuucacuaguguucugggagccaucuuaggucuaaugcccucacucuccgguccaccuuuuccuucacaaccgccacagcacacagg

SEQ ID NO: 8800 - RNA, 694 nt, Mus musculus
uggacagcauccucgccaccgcgucucugcugcuuuugugcucucccuccggccauggccagccuuaaggaucucgaagggaaguggcgccugcuggaaagccacagcuuugaggaguacaugaaagagcuaggaguaggacuggcucuuaggaagauggcugccauggccaagucagacuguaucauuauuugugauggcaacaacaucaccuucaaaaccgagagcacagugaagacgaccguguucucuuguacccugggagagaaguuugaugaaacuacggcugauggcagaaaaacugagacggucugcaccuuccaagacggugcccugauccagcaccagcaaugggaagggaaggagagcacgguaacaggaaaucugaaggaugcgaagaugacuguggagcgugucacgaacaaugccaccugcacucggcucuacgagaaggugcaaugagggcuuccucaucauccuggacaggaguuagcugccagagugaauaugcucaauucagugagcggucauaagcaacaaaccgcuucacuucuuugguuuuauuuuucaugacuguugaguucucuuuaucacaaacacuuuacauggaacuucaugucaacuugguuuacccaggaucauuccuuugguuaguaaauaaacguguuagugcuaauuuaaaaaaagaaaaaaa

SEQ ID NO: 8801 - RNA, 1546 nt, Mus musculus
cuuaugugguagccauagcuggagccuggguccucugaacagagacucugguguggguguucacuagaugaucaaugaauuccugauaaggagacuuggugaagacagucccuuuccagaagucaggggucagguagcuguaaguauuggagauggcaucaaagguggccuugacaaaguugcccaggauggcagugcagccucuggcugaagugcagccgucaucuauaccggcuaucaucaguaguuucuugggcacaggagcagagacaacaccagugccucugggggcagggaugagacacaccagcacagagccacagcggccugucaccuugcauggaacaguguggacuugucaaucuuguucccccaguagccucucugcacagggacgauggaaagcuuggccaagaugauggccccucagauggcaguggcaaccuccuuggagcacuuaacaccaagaccaacgugaccauuguaguccccaauagcgacaaaugccuugaaccuggucugcuggcuagcccgagucugcuucugaacuggcauaguuuuuagaaccucauccuuuagggauguacccagggaaaaggucaaugaucucagacuccuuaaugggcagggagaacagguagaucuccaaggacuugaucuucauguccuuaaacaggcacgcagcuuggugacagggaucuacuccuugucuucagcuauaccuccacgagcccaaggucucgaccagagccagggcaacagccuuaacaacagccucgaccacagccugacuuuauuguguagaccagguugguguagaauucacaaagauaugccuguguugucuccugugucugcuauuugaacucaugcaguuuuugccuuccaccugauuccggcugcaacacccaaccuagugcuuuauuucugcucuccgugagugcagagcauuaauucccacacgaagggacaaggccgaccugcugugccaagcuugggagaagcaauuguggucucugggaagucucugccaacuuggccauccuccgcugcacuggcagccuguguguaaccuggagcugauucuuccccuuuggcagccgcugugcuuugcccuggagaaucccaaaccuguguucugauuguaaagaguuuacaacuccuuuaaaagccuucuggccgggcggugguggcacacaccuuuaaucccagcacuugggaggcagagucaggcggauuucugaguuugaggccagccuggucuacaaagugaguuccagggcagccaggacuacacagagaaacccugucucgaaaaacaaaaaaacaaaaaaaaaaagcuuucuguauuaucucucugcagguuccugauccuuggcuaggaaaccucuuccccauuccucuuguguuguucugggaaacuuuggcuuugcucugauuuuguucuuuuuuuuaaauagaccugcuagccugacuuucccaccuuuaaccugggcguuuucaggcugcaaaccuagguucuaauuacuguaaacuggccgccauc

SEQ ID NO: 8802 - RNA, 7005 nt, Mus musculus
guuucucucucuuuuuuuuuuuuuuuuaaagaaauacgaacuuuaaugaaggcuauuucccuuugguauaagacauccaaaccaaaaauuuggcgaccauuccuuguccagaaagccuacauacagagugagcuugcaagguuucugugcuggcugcagcugcccgaaagcagaagguaggaucuaaaacuaucacaucauagucccacaacacugcucagccaaauuucugcucaguugucuuggcgaaaaagaaaaaaggggggagggaggagugggguacaacccuguccuaguuaaggccagggaguaaaaucccaacaguuguuuaaaaaaaaaaaaaaguuuggaaaagucaucgaggugauguauaaauguaguugauuaucauaauucugugcucaaaagucaguaaugaaaaacaaaaacaggaaaauaaaucuauagcccuaaaauguauacauguuuuuuaaaaaagagagugcaguuccagaccugcaaaugguauuggggauugucuacugcuucagucuuauugccuccacaaaacccacacugacuguacacacccuggaggcccaagucagacgcauacaccuaucccaaaggagggaggcuggaugggguuacagugagggcuauacuuuggcuguagacuauaacacacaugcaaacaugggaggagcaggcuugagaaauguauacagaccccuuggaaaggcauugaggucaggaggcacugagcaagauggguccaguccugccccuccccgcuaccaucaggaagaaggcucugggguaaucgcucuuuuugguuuuuggagacagguucucucuccauagcccuggcuguccuggaacucacucuguuguagaugggauggccucacaaauccuccugucucugccuccugagugcugugauuaaaggcgugugccaccauauucuggcuuggggcaaucucuuaagggcugcacauccgaaaggcagagcagauagcggccacuccugucccuauucucccuagacacaggaaggggugcugaauaggacagggcuccagaagccaagguggcaguaaccccuguccacacgugaagagccugagaacucugcauuaaguaucugcagaccuaugauagucaaaggcacaaaguuuaaggggaagcagagggagugggauauguuucgcgggaucugggguacccugaagacccaggaguaaaccagagguauaauuauuucccuucccccaaagggcaguugcuccacugggccuaucaucacagggcauuuuccauuauaagaacccacccuuuggggggaacggcaucagguuggcacaggcaggcccagacaagggaccacucugcauauuaauacuuuggugaaguuugggcagaggcaggaugcuaccccaggcuccuuacugaaacccucuuuuucucucucucaagugggcacuaaacccauguccucguugcucccaguucccacccaaggccagacccacaaaacagaggucccacaaguuagagaauaugggaaacgggaaugaagagcaucuuguuggagaagcugagaaggaucacacuuuccgauccacggguugcuguaggcacaguucgcugcccgcagagaugaugggcaagugauuguccaugugguagcugaucaggugacugacacucucaaagcagugauccuuuguccgaaccacaccuucaggguccaccagcagcaagugcuugggcugcccacucugcaggucagugagcacauacuggccagguguggucgugcucucucgcaccaagaagucaccauugagcugcagcagugccuuggccucccuccggcucagcuucccguggaaccagggcuccccuugcagcugcucagccaugaacauggacugcaguggggauggcacccgaaguguaucuucaaagggcuucaugucaaaaaggucucggggugcacugccauuaagagaaggauuugggggcccagccccacccccagccugccgggccuugucuagauucuggauguugacauaggaggggucaucgaagaguucucugccugggcaacguggcggaggcaacaucuguuuacggacuucauggucuccugcagcaugcugcccuauaggcaguguagcucccaaguggcuggacaucugggcacuaggcagagugggucgagcagccccuucccgaggccucauaucuaccaccccaccaagaggggguuccuucccuggaaagucauuguaguacugauggucagggggcucuucuuccuccucaucccaagcugagccaucaaagccagccauccugucauggggggugaccagcuucgguggauuccugagauacuguuugaagcacaacucaaaggccugcccgauggugcugaugacauccugagcaaacccuucaggacacuccaggauauggcaggcucucugauucacagggucuuuggcaacauaggcaacauaggcaacauacucagcuuaagucaccgccccaacuuucaccccagccugggccuccccagacaaacuuuauuacacucacuucuggccucacuaaccccugacccccuaccucgcuguccaauaguuucucuuaaagagcaguuguaacuagaaagcuugaaaaguuauuaauagucacaugugcauaauuuauuuauuuauuaacuuagaaauaagaguauuuauuugcagcaauuuauuaaguauaaguccucaagaauuaacacuauuauguggaaacaaguaguaacugaggacucuaauagcaaagaaauugacaugcacaauuuccaagaauauuaaaauauuaucuuaaaccauaacuguuuugaauauauaaagaaugagguuguauauccaaucuaucuuauauguaggaccuauagauugccugagauauaaaucuagcauggcauugcuuuaugaugcccaggcaaucuagaacaauuuauuaaaugucuaaaaacagccuucuuaaaaggauagcauuuuuucuuaugaguuguauaugcauaagcaauugcaaauuugagaauuaauagcaucugagggacgaacagucuuaagcaauuguaaucucugagauauaauauugacuauuaauauacaaauuaagguuugauuguucagcauuuuaaaacaccaucaacagcacacaacuuaacuaucugugcugaagcagggggaagcucaaaagaauaagcgugugaucuaauuuacaucuacuuauuuccuauacagggguuguuuuuaaacacaauaaaugggaugcaugcaugcaagaauuuauagaagauacagaagcaugcagaaaaacaauuuuuaacuuaccuuugagauauugauugucaaucuuauuuaaaaugaugguaugcaauauaucaauuauuaauauucuauaauaaccaaauuaauugcuguuuggaacaaggaacagacacuuugucagguuccuaagacacaauuuuuguuauagguuuuccaaaauacaugaauauauuuuacaauccuuuauuaguaguuuuaauagauuuaugaaacugugguuugaggugagugccaccucggccccucccaccuaccuuguaggggcccaacuuugcucucucaccaccauggcgagccuggagcaacucugaaaaggacucugcauuuuaacccucugcugagcccugcaucucugaagcaccgcugccacugauuguggcugaugguuugagccagccuaggcuggaaggagguuacaaaagaucuguaugauaagaacuucaagucugaagaaagaaauugaagaagaucucagaagauggaaagaucucccgugcucauggacuggcaggauuaauauaaucaaaauggcuaucuugcugaacgcaaucuacagauucaaugcaauccccaucaaaaucccaauuuaauucuucacugaguuagaaagaacaauuugcaaauucaucuggaauaacaaaaauccuaggauagcaaaaaccauucucaacaauaaaagaaccucugggggaauccccaugccugaccucgagcuauacuacagagcaauuguggaaaacaaacaaacaaaaacaaaaacaaacaaacaaacaaaaaaaccaaacaugcaugguacuuguacagcagcagauagguagaucaauggaauaaaauugaagacccagaauugaacccacacaccuauggucacuugaucuuugacaagggagcuaaaaccauccagugaaaaaaugacagcauuuucaauaaauggugcuggcacaacuggcaguuaucauguggaagagugaaaauugauccauucuuaucugcuuguaaaaagcucaagucuaaguggauaaaugaacuucacauaaaaccagagacucugaaacuuaaagaggagaaaggggaaaagcaucaaagcacaggaggaaaauuccugaauaaaacagcaaaggcuugugcuuuaaaaugagaauugacaaaugggaccucauaaaauugcaaagcuuguguaaggaaaaaagacaccgucaauaagacaaaaagaccaccaacagauugggaaaggaucuuuaccaauccucaaucugauagaggacuaauacccaauauauaccaagaacucaagaagcuggauuccagaaaaucaaauaaucauauuuuaaaaaugggguacagaguuaaacaaagaauucucaccugaggaauaccgaauggcugacaagcaccugaaaaaaauguucaacauacuuaaucauaaaggaaauacaaaucaaaacaacccugagauuccaccucacaccagucagacugacuaagaacaaaaauucaugugagagcagaugcuggcgaggauguggagaaagaguaacacuccuccauugcuggugggauugcaagcuuguacaaccacucuggaaaucagauugguguuuccucagaaaauugaucauaauacuaucagacgauccagcaauaccucuccugggcauauauccagaagauguuccaacugguaagaaggacacaugcuccacuauguucauagcagccuaauuuauaauagccagaagcuggaaagaacccagaugucccucaacagaggaguggauacagaaaaugugguacauuuauacaauggaguacuacucagcuauuaaaaacaaugaacuuaugauauucuuaggcaaauggauggaucuggaggauauccugacugagguaacccaaucacaaaaguacacucgugguaugcacucacugauaaggguauauuagccuagaaauuuagaauacacaagauacuauuugcaaaacacaugaaacucaagaaaagagaagaccaaagugugaauacuuuguuccuucuuagaauagggaacaaaaugcccaaaaaggaguuacagagacaaaguucggagcagagccugaaggaaugaccaaccagagacuaccccacuuggggauccaccccauaaacaaccaccaaacccagacacuaggcagaugccaacaagagccugcugacaggcuccugauauagcugucuccuucgaggcucugcuagugccuggcaaauacagauguugaugcucacagucauccauuggaaggaacacaagguccccaaugaaggagccagagaaauaccgagggagcugaagcggacugaagccccauaguaggaacaucaauaugaacuuaccauuacccucagaccucuuuggaacuauaccaugagucaaagaaaacauaugguggaacuuguggcucuagcuauauuuguagcagaagauggccuacucagucaucaaugggaggagaggcucuugguccugggaaggcucuaugccccaauauaggggaaugccaggaccaggaaugggaguggguggguuggggagcagggagaguggggaggggauagggaauuuucggaggggaaaguaggaaaggggauaacauuugauacaaauauagaaaauaucuaauuaaaauauauaaaauaaaaaaauaaaaauuaaaaacaaaaaagcauggccagaguguggggaguugacucuguuuguagaguuuguacaauguaaaaguaaagaccugacuuuccagaacccuuauaaaagaccaggcaugauggcucacaccucuguaauccucauucaagagaggcccacugagcagacagccacguuuauucagaacuuucagggcagugagagaccuuauuuuaaaagacaagguggagagcaccuaaggagcagcuuccaaggcuggccucugaucuggauccacacacucacacacucuacacauauguacacacacuccacauauauguauguacacacaggcacacucguacauauauacauuuaagauuauauauuaguuucuuucaguaaguacaagaauuugagucaaaguuuucuuaaauucauuaaaauagcuccugcuccuaugccaaaguuuuguauccaaagugaguuacaaguugcuuuuccauugcacugcagauaacugcugagauugucaccagccuccuguuuccagaauccucagcagccaggucuacuagauagauauccacuauucauucccaucauaucuacuaucaaucaggcaucacucauuuacugacacauuacaagagguguuaugcuuuuauuaugucuuaauguguugagcuuccucagcuguguaggaguucugucucuguaggcaugcacugggacuuacacaucuugcugugucuggguuagagcuuuugugccaauggugcugcuccgaugucacuguaaacuuucccuuucaccuuccaaggccucucucaugauagcaagcuguuuauuguggucauauacaaucaugugaccaaugugucugccagcauuucuacaaggugacggucuucacuuaaaccuuaccuucagucccuggugcaagccuaucuaaagucaua

SEQ ID NO: 8803 - RNA, 3411 nt, Mus musculus
uagauucaaaguuuuaauuaauuccauacugauaaaaaauaacuccaugacuucuguaaaccauugcauaaaugcuauuguaaaaaaauuuaaacaaauguuaacaacuuuaacaauucacuaaaguaaaugguuauguauuauaaauaugaccaucuggguuaagaagauuccauucacauaacauucucaacuaauuucugagaacaaaugaacacaaaggcuuccauaaguuaauccacaugcgcauccauacugggggaaggccugccaaccagguacacaagacucugacacuaccauauacuguuacuauucaacacuagagaguuagacgacaacaggcaucaggacaguggugggucccaguuccuagacccauggccccaccuccauuacccacacacgggccuuaaggcccucucuccccuucuuggcccuucccacccaggguagauccuagaagccucagcuccuaagaggucuggaauggaugggaaaaguggccccuucugggacguucuuugguccuccccugcacaccuguccucagagcucagccugauuccagaagagcagaugcucaggaaagcuccccgcaugggaugggacccagggugcacuaccgccugccuccccagccaucacaacagccccagaacugcccagccccagccuggaaugucagcccaggaggaguuaaccagaguagcuuacauacaaucuaaagcuuaauguaacuguauacaacuugaaauugucccgaugagcuaucaaucacaaacacuguccuguuaccacagagaccaaaagccugacaugggaaacaguucauaaauaugaauaaaaauaaacaaucuuaaaccaugguaacaguagcacaaaauacacaugaucuagguacugagcuaauaaaucauuaucacuauaauuaaaaacaaaagucacugaaaucaggucaauaguuaccuuauuaaguagugggcuagcuguggaauguugaagauccauuuccuuuaaaaugauauaggucuuuucuaucaguuugucuuauauuaaaaaaugcuuuuaaauuuccuacuauauuaaauacauucuaauuuggucacugauaaaaauguuuuauaucuagucacuuugcacuuaaaaaaugcuauuaaaagucuuuggcaaagccauggggaaggagaaccacuucgaggccugggcagaaccuguagguaggauaccuacccuguucuaggucugccaccaugggaggggucaccuggacagaugucuccucccuagauuuccaggaacagucccagucuuuaugguagagagcugaagucaccacccucgauacagucucagcagaauuugagccacagaccagaggccaagcugugagcagcagccacauucaccuuggaaacugaugggugaacuguagcagagcuguguuugcugguccugugaugaauucuauuacuaucuggcugugcagcucagguaccagaugugugccaagacuguccuggacucgugccucugggccccucuggaucagcuggaggugaggguggucacaggugcagcagacugcagucucagguucgcagccccuuguucagcacaagcuggggugccccaggcgacucagagguuacaaagcaccguugccauuacagacgauaagacaucagagcacagcuccuuccaguagaucuuggacuccucugaaugucugacucuuuugcuguguuuuucauuagcaugaaauugucuuucaagggagaagaaaaaaaccaaaugaaccaauuccuucacuucucuugcaaggcacaggcacuuggaaguggccacggaucacauaagugcgcgacagagcucuggauaucacucuaugauacuggaauauaaaacuccacacacaugugcaccugcacauguuuaggaaaauuaguuccuuccauaaaauuaagaacaucuaaauguauaugucuuucaauaaccacucucugcuuauaaauacuauuuguuugcacuuaauuuuaaaauguaaaaauucuagugcuucacuacuagauaaauguuccuuuccuaaauaguuucagaguaugaaaucuaacguaguuaccauuacuaugagucaaccacaaacugauaggaaacuucaaguucacaguauacuuauaaagcuucauguuaucgcauauuaaaaaacauggaccuagaaagcagcuuauacaauuuauaauaucuaauuccucgguucacaaagugcuuugacgaggcccgaccucccauuggccuggccacagcagccucaggacugggggcaccaaaagcaugccaccugccuaggggacaggcaguggguuugguggugcuucagagguucuucgauaauaccuugacaccgauggugggacauggcagggaagaaaauaauaugaaaggcuguuggacagugggugugagcucacauccuggcgugggguaccagaggcaaguuucgacacuguaguggcacguggcaugcccaggccuuuauacugcucaccagggaaggaaugggucuggcucuggucaccaugguaggggcuggcccuugcaguaggggcacucagggguacuggccgcacaugguucgcauaagacacggugcuggcagggccgcaggacagugccaugggcccgcuccuggcaggccacacacuguuuggcacggagcuggaagaucaccugcuucacuugcugccaagauucuucccauugccugaucuuccucuuggccucgucuagcugccgccugacccgugccagcucagcacuguuuggacuugcacuugaggaagccgaagggccggaguucagaaugggggaugggcuaggagagaagcugccagaaacaaagucccagaugcucccgggaacgccguucaaaccugucaauccaagguccuguucuucuaagucuuuaucuaaggacgcgauguuuaugucacuaagacgaagaucuaaggcagaaccuggcaaggugggaggacgcaugcucguuccaaagcgcggagaaaugacgacccacaacuuggugcugggcugacgcgagaccgggaucugccgcagccacugucaaugcugacucauauccuccgcagccagggccggcugucugucacagaggauucaaaccugccugguucgcgcuccgccuucgccagccgcccgcccugccggugcgcagcaguccccguccccccccccccccccccgccacacacacacacacacacacacacacacacacacacacacacacacacacucacgcuuugcacccugcccccagcaccaagccacgccccugccuaccaagguccauuugcuuuuucuuaaggucaguauccacuaucaucaucaucc

SEQ ID NO: 8804 - RNA, 139752 nt, Mus musculus
gcggggccgacgcggccaggcguggggccgggcucgcgaaccccagccgcacgccacgguugucgugcaacgcugcggacgcucccgcuaacugcgguccggucugcguauccgcgcgcacucgcguguccccggcgugaaccggaaccgcuugcggaagucgccgcugggagcggagcgcugaacaagaacacggugggaggcggccugcgcggcgccacccgccauggccgcggcggggugagcacugcguggggccgcagucgcggacucgggcuccuccgccgcaaaccaggggcugaggccguagcagcuggggucgcugucugucgguagcuguagccgccugcacgucgucgccguccauggcgcggccccgccgccgccgucgcugcugacccgggcccggagcgguuuccgcccuccacggggcgcgggcggccugccuuugcgcccgagccugcgcccgcgccccggggcuaccggucggguagucagcgauggggaacacaacuucgugcugcgugucguccagccccaagcuccggaggaaugcgcacucgcggcuggaguccuaccgcccggacacggaccucagccgugaggacacuggcugcaaucugcagcacaucagcgaccgggaaaacaucgacggugagcggcgccggccugggccucggccuaucccucuccucccugcaggacucggagccuugcugcuccgcugccccgggcuggacuggcagggaaugguggaaauuuugcuagccacggccggggaggcccaguagguccagggagggcguguggcaugcgugugcuggguugcgucuacaugcgugugcaccccagagaugacaugggaggcuccaggcagugugcuuuugguauguugccagaguuauguauaggauggcggagggguaguauuugcucuuuccaaaaggaaggggauugugacaguguucugacuggaguugcuuugcguucccccagacaacucuaccccuuuucccauuaaaaacuaaaccaggcccaagggaguaugcuugugacuguauaugcacaaauguauacauauguacuaugcgauuauauacaguccugcgcacacaaacacauauuuuauggguaugguugaaguaaaagguucaccucagaauguuuaaaaaagaaaauaccaggugacuucaaguuaagugaucuaguuuuagcaugggcuagaauuaugguccuaugaauuucagauucaucugggugacuuguauuuuuaaaaaaguuaaaggaggcauuauugcaccuaguaauguuuuaucauaauugguuuugcaguaucuuuuucaguauuguuuuguaaucaaacucauaucguacguugggcauaaaauacaguuuauaugguuuccaacuuaaaagauuagaaauuggaaaucuuuaggccuuguuuuuuguuuuuguuguuuuuacaaaaauccucacacaaauaaccuaguuaaauucacuuguaauuuuucacaugugaaugaauugauaauugguauugauccauucuuguugccuuugggaguauuccuuguaaugugaaaggcuacauuugagugguaaagaaaagaguuuucucguuguuuguugucuaaacaguguuagcauuuuaaggacagcagcuuuauuaaaugagugugauuacucauaguuuauaguaaauucugacacuacaugauuuuucuaguguuauuuaagauuuguguauuuguguguguguacauguguacgcacucgagaauguguuaccugugugugccaguugagguaagaggaaggugguguauccuuacaaucuggaauuaggugguggugcugggaaccuaucuuggguucuguggaagaacaagaagcacucuuaaucaccaagcuaucucuccagccgcacuagugcuaauuuuguguguccauuagcuugcucuucucuuuaggugauuuugaauugcagcuacacauuuacacauuuaaaaacguguagaagaauauaagaccucuuuuuauguaccauaauaaaacuguauuuuaaagggaggagugaagcaagaaaugaguucauuguagaagaugggaacaguguuggcaagcaaaaaguguuaaagaauacuuuaauaaauguaauuauacagguuuacauuaggccaguuucaugcagguauguaauguacuuugagcuuauccucuccgucccucacuacccucccauuuucauaucuuccccuuuuuauuaaucuccuuuguucccaaaacaauuuugcuucuaucuucauaccacuccacauaacagcauuuuauguaucucacccgugagagaaggcaugaauuauuugcccuucugagacuuauuuaauuuguuuaauauauuugucuaauauauuuguuauauuauacccauuuuacuucaaagacauaauugcaucuuuauggcagaaaugaauuucauuguauauaaaucacauuuucuuuuaucauucuucuauuagugggcaguggugcaauaagcauugaugugcugguauuuuuauauuuuuuucuuuguuuugcuuuuuaaauuuugagcaaauauccauuagagauauacugagucauaagauagaucucuuuuucagggaucuucauacugacugucacagucgggauguuaacacucucacuguccuggaacucacuuuguagaccaggcuggccucgaacucagaaaucugccugccucugccucccaagugcugggauuaaaggcgugugcuaccaccaugccuggcucaucuuuuucuucuuuuaggaauugucugucuaauucauuauaccaguuuuagauuagguagauuaguuuuugaucacaggugaugagguuucugaguucuugugcauucuagauuuuaaacucuguguacuguauuuaguugguaaagauuucucccaauuuguaaguugucucuucaugaagcuauuuucuugaguguucuuagacauuauuuaucuucaugagaacccauuuaucaguuguugguucuauuucuugagagacuggaguccuguuuagaaguauaugccugugcugggaucuuaaacauuuuuuucuacuuuguccuuacuaguuuuaugguuucaagucuugaaauaagaucuuugaucuguucagaguuguuuuuuuguauguaaugagacaugggucuaguuuuauucuucugcauguacauggccaguuuugccagcaauauuuguugaagagccuauuugcuuaaauauguauuuuucugauuuguuaaaaaaaaaguucuaugauuauauugguuuauagccaggucaccucugcuuuucuuuugauguauuguguucuuguacuaacuuuauaaugcuuuucucaucuucauuuugagucagagucuuuguagcucugggugucuuggaaguuacuaaguaaaucagacuggccucaaauucagagagauccuccucccucugccucuggagugcugggaacagcaagugccaguggugcuuuuaucacagugugcuggagcacagcuuagagucaucaccugcagcacuguuguuuaucacagugcucuggagcacagcuuagagucaggugcagggaucaccuccagcauugugcuugcucuggauugcuuugcuaguuggucuuuguguuucucugugaauuuuaaaccuuuuucccccuuuccuauuugugaagaagaaucuugguguuggaauuuuauccaaccuguagauuuuuuugauagcauagcuauuuucauaauguuguuuaugagcauaugagcacauuauaguaucuucaaauuauuuuuuaauguuuuaaaguuuucacuguagaaguuuacuuuggcuacccuuauuacaagguuuuuguuuguuuuuaauuaauugugaauggaauuauuuuucugaucuucucaacauguuuuuuauugauaucuaggaaagcuacuaauuuuuguauauugauuuuuuuuaucccaucucuuuguuaaaaguguuuuuuauuagcucuaacauuuuuuucugguggucuuuugggucucaugcauagauuauguuaucugccaauaagguuacucugauuucuuucuuucccaugucuaucuuuuaucuuucuuucguuauauuguccuaccuaaagcuaaaggaauaauauuggguaaggggaguagaguuggacaccuuugccuuauuccuuauuuuauuggaaauccuuuuaauuccccccccgccccaauuaguauaauguuggguaggguuuguuauauauauggcuuuuguuauguugauaaguucuuccuauuccuaguuucuccagaacuuuaauuaugaaggguugcauuuugcugaggugaucaugugauuucuguccaugcaccaacuuaugugauauauuacacaaaccauuucuuuuuaaaucauggaugaucuuuuggauauguucuugaauucuguuugcagaaauauuuuuccuuuucuuuauuugguggaguuuuguuuuaaaugagaaauaagaaacaccccuccugcuccuccacccucccccccaaaaaaaaaacaaaaagaaaaacaaaaauauucacauuucagacaaccaaauagaauaucccuaugcucuguaguaaagaaauggauaucaugguuguagucagcuguuuggcacuagggcuuugucuuaguuggacugacuauugcagugaugaaaacaccaagacucaaagcaacuuaggaaggaaaggguuuguuugacuuuccuauccugaaucacagcccauugaggaagccaaggcaggaccugaugaagaagccauggaggugugcuucauccugguuugcuccucaugguuugcucucuacuugcugguuuugugucaacuugacacaccuagagucuucagagaggaaggauccuuaguugaggaaaugccuccuugagauccagcugucaggcauuuucuucucaauuaguuaucaauguggggagggcccagccuaaugugggugaugccaucccugggcugguucuguaaaaaagugggcugagcaagauaagugaagcaagccaguaaauagcaccccuccauagccucugcaucagcucuugccucuagguuccagcuguauuugauuuccuguccugacuuccuccgaugaugaacuaugaucuggcagugucacccccccaaaaaaaacccuuuccucuuuggucuuuggucauggugauucauugcagcaauagaaacccuaacuaagacaugcucuaagauacaccuaaguucauuugugaggccuuuuuugagaaaaaccucuagaagaccacaaacuuguucuucagauguagaguaauuuacagcauaaagcugauaguaagguuucuaauggaggcuguaggguccucuacaguccauuuuuuauaaccaugcuaguuuaguuuagaccucuaaauacuaauuugucauaaaaauaguauucuucaucccaaguucaacagaugcaucuagaauuuaucuaaccagaaguuuucagcaaugguauuauuuaaagcagaaauauaagccuauucaguaguaugaauagguuuauuuaaaaguuuccaagaugcagcugggcugguuggcagugcaaccugcugcucucuagggcuauuuugguauugaaucauauaaugacaacagauuuaaguagaaauguguauagagucaauguguguuuguacauauuuaucuuugaauauuucaauuucuuuguuaugguuggucuuugguauccuuguguuccauauauggauuuauuuaacugcagaccacaaauauuuuaaaauaacuguaucuguacugaauacauauaaacucguuuugugucuguuuggcacacaugcuaauaacuaucuaaauaacaguuacuauucaguguugugcaucucuguguacagaggauguggucagcuauguacaaacacuuggccauuucuuggagggacucaaauaucuguagacucugauaucuagcaggauccuggaacaauuaccugcagcuacugagggacaacuguauauugucaaauuauuaguaaaauuuuaagauuaccugucaagacuucuugugugccaucacugucuuuccucuaucuuaaaaaucaucccaggcaacuacuaggauugaagauugauagcuuguucaugacucuuccagacuaucuguguuauuuuaaauggcagauauaugcauuuccccaucacacuccaaacauagaaagggacagcauuuguuccugguaugucaguaacuugcauuaagguagguaggcuuuuuugaugugcauugggaacuuacuaacccuuuauacuagugugugauuauuugagauuuugaaaguuguaggcaguuuaaccaacugccuaggaguugucuuucaugaagucauucagaggucaagaaaauaagacuucuuaccacugauaggaagagucacagcuguucucuuaauucuguacccaacacugcucugaguguaaauguaaguauggacauagucuaacaguuauagagaugaauaagaggauaauaauaggagaugaggaaggauggaaugcugguuuggaacacaggagucaugacaagauauaaagcuaacuuguuagcacacacacagagacccacacaaagugaauaaguguauaacagugcaacaguaguacaaauauaaaauguaaagcagagccccuccgcuucagaaugacauacacauacauacauacacauauacauauauauauuucaggauauauugaaacauugaauuuguuuugaaauuguuaaacuaugagguagaaagaaaaaaaaacuccuuuucuuaguggagaucaauuauaugacuucuguuugaaagugaucuuuuuaagugguaaaauguacaaagugaacuauaguuauuuuauaguucacauuaugcucugauacuucugaaaauguuuugcuuaaagccaguaaaaacacuaaggaucaaaaugagaccaauaugcuuaauaaacugaaagugcuuaaugagcaugccauuauuaacauggcaccaaugucugauuucuuguguuaaauguaaaauauguucaaagagcuauaaccagcuguguuugaacuaucccuagggagaggagguagaaacucgggaccagagucuaucuagauauaaauaugucaagggugauggggagagagucauaguaccauccuuuugcuuucuagugggcuccuuuagggccuuuaacucaggcuaaacuggauuucugaaagaauuuuaggacuagccagaaagcaagauggaagucuuacuaaagauacuuuguaauauuuaagcaugaggauuaagagaaagaggcacacagaaaguuaggguauaccccagaucauggggugggcuuuucaaaaaauagucaaagaucacuuacuuuacaguaguuauauauaggacuuugguggguuuuaagacuauaaucuucaaagaaugccuauggaaucucagugauuccuuaggugcuuguugaggguacuugacaggcuagguaaagcugaaaauaauaggcauguaggaacucugucuucacucgaaacaggucacuaguccuguuucauauuuccagaggaaugaggcucucuacucaaggucauaugcauuuaagccaugaguaugggucauugcuauuuuaauguuaaaauauuucuaugcaaaagaauauuaaccucaggucugcagccuucuaggcaaauguaaauugugcuagaauucuugcuauacaagaggcaagagguuuggaucagauuaucaucugaggcacuucuuugacuuccacugguuucauaauucccaugucuuuuuucauaaauauaugacuccugagggggaagcuagcuggguuuggaguuggacauagaaaucaccucuuauucuuuguaacaucccagugugaugaacacuauagucaauccgaauugaaaaacuuuuccaggaaaaacuauaacaggauggaguucaccuaggcagacuguugagauagauagaaggugaaguuaggauuauauuuuauuuucuucagagaaugggguuugaaauguguguaaauaugcuguauauuagauguuugcugucccuggagaggggcauuguguguaaagauaaguucuaccagucuuaucaggucguuaggcauuccauaacauuucuuuuaggaaugagucuggcuagauccacaguuucagaaagcucagaaaauaaauuauccacuguuucucaguuccguaaacgacuuguguuuguugcuguaacucccuaacuucggagaaaagugaccugccauaauaaaaaaugagaagucugacaacucacaaaugacagcucacaagaucuacugucagaucucuauguagcuuugaaauuccugucaguuucuggcuuggcuagugcaaaugagcgacuguuuccuuaccaggggcaacuuuuuuuuuuauuagacauuuucuucauuuacauuucaaaugcuaucccaaaaguccccuauacccucccacccccauuccccucucuacucacucccacuucuuggcccugggguuccccuguacugaggcauauaaaguuuguaagaccaaggucucucuucccaaugauggccgacuaggccaucuucugauacauuugcagcuggagacacaagcuccagggggguacugguuaguucauauuguuguuccaccuguaggguugcagaccccuuuagcuccuuggguacuuucucuagcuccuccuuugggcaucuguguuccauucaauagcugacugugagcauccauuucuguguuugccagggcccaucauagccucacaagagacagcuauaucaggguccuuucaguaaaaucuugcugguguaugcaauggugucagcguuuggaggcugauuaugggauggcuccccagguguggcagucucuagaugguccauccuuucuucucagcuccaaacuuugucucuguaacucuuuccauggguguuuuguucccaauucuaagaaggggcaaaguguccacacuuuggucuucguucuucuugaguuucauguguuuugcaaaauguaucuuauaucuuggguauccuaaguuucugggcuaauauccacuugucagugaguacauaucaugugaguucuuuugugauuggguuacuucccucaggaugaugcccuccagguccauccauuugccuaggaauuucauaaauucauucuuuuuaauagcugaguaguacuccauuguguaaauguaccacauuuucuguauccauuccucuguugagggacauuaggguucugucuagcuuuaguggcauaguguugcaaaaauggaugguagagcacaacuuccuguacauggaaaucaugucuaaaucuccuguagcacuucuaaaacauuggacacacugcaccauucagagaaugucagcaaggauaaaagguuuuccaaguauuucugauggacaacugauuuaauucaugugugccaagccuacagauguggaaaacuaacuguagcagcuuugcuaggauaucuucaaaacacaucccacaacaugaaagaaauggaaagaugaagaaaugauguaucuacucaaccauaucaacuuuggcuucuagaagacagaaggcaaacuguaaugcuauaaaauaacaaacucuuuaccaaugguuuucaaauuccacacauuaaaaaagucagcaaacauccuugaagaaauaaaggcuguaaauaagaucaccauaccaacaggaaacacagcaaauggaagggaugaaacacagacaaaagcccagcuuccuacuccacggagcccucugaagcugaacagcacaugccuauccaccugagcgccugagcugcuuaaggaggaggacugugaguuacagauaaacucagacuacacagugaguucuaaucuagccuaaguuacagcaaaacucuugccucaagugggucaauaaaauuaaaaucaagaauuagauauaauggugacuaaaauaacaguaaugaguuaaacuucuuaaagugauuuaaaaaucuaaaaauucuguaauuaaggaacaagauacuaaauguagaguaaaaucuuuucuugagagguaaaaagccagauuucauauccuacccaauaaccauaagcauauacugaaauuauuguuaaguuucucaagggcuaacuaagggguuagugauguguuuuauaaaaccaaugauauguuuuguagagugugguaaggugcccuggggggaguaccucagcaggcccaugcugaggcaucccucuccccagguaccauccauguacaggaaguugugcucuaccauccauuuuugcaacacuaugccacuaaagagaaugugagcaccuacugauugugcuaucugccaaugacauggcuauauucagaaagaguuuuggaacagucagacagaucucagggugcuucuguggaacauuguuacuucugagaggcagucugucuugguuuaccuuuugcucuuuccaaacacccuuuggcucauguggaagaauaugucuugacaucuuuggucaugaaucuguaaacagccucugugugcuggagauuucaaaaugaccauuguacauuggaaacuuguuuauuguauauuuuucauauauuuuagauguugaaaaaugaucaaagugucucauagaacauaguauaauuguccuuagaacugcaaguugaauaugguauauuucauugagcauggggaaguagaguagccuucauggaguuagagaguuccuagcugaagagucuuagagacaguggaucucuuaggaguugcuccucagcacaucacugagcagugucagcugugggacaggacuugcgagaaaaaguucagaacuuguuauuggauccugcugcacguauucucaccaguuugcacauuauggcucagaucaccaaaaagugacccauuuuggugcuuucaaaccaauacacaaaauccauguuaguuugaauaagaauuauuauccagagaauuuuguugaaaagcuguguagcauccuuauaaacuugucaggauuucuaguucaggaccuugaauaugaaaggucuuuugaugucugcugucauuugggcuugucauuaucucaagggauugacucuuuuugcuuccacauugacuuacaggguuguucccacaucagauguucaccagugguugggugagcauuauuuccuguuaaguuggccucugcagcuagcaauauagcaucuuucagaccaauuucccugagagagaacaagagagauucccaaauggaagucauacucuuuagauaaacuaagcuaaaaugugaucaaagucuacccccacacaggaaaugaugcuauuugaaucugaacaccagaagguacacuguugucagucuuggaggcugccugugacaaacauuaauuaagauucuuucaguaauucuuaacagaagucuaauaauugacuuggcuaacucaguuggcauagcaccuugccagcauuuacugguuuucagucccuaacacauauagagacaggaggauuagaaguucaaggucaucuucaacucaguaaauuugaggauagccugggcuaccaugucuuaaagaacaacuacuaaaaaauugacuuaaaaaaagaaaauugauuuaaaaaaagaaaguccccaguaauaaccagguucuaccaguuaguugcaggacugaugguaucagggaagacaggacagccaagugacuggccucagagauggcagaguagaaggcagagggaggaauugcugugccaguaguaguuguguugaggaauugggaagagaagaguuacuauauaugaggacuuuccaugaaagcugaaggcaaaaagccuuacugaguuucacaaggaacuggauuuaggagucguagucuugugcauacugaggugauuaucuccucuacuaacucagucuuucucugugucacaaauuaguuucucagaaauccuuuaaaaaauaaguucucuuuccuugucuauacauaauggaaauuugccacccccaaauccuugcuuuuaggacuacaaaaagccuaaggagucuuuauaucccaauaaaguagagaguugacucagaccauuucuuaaguggcaucuuuggaguaaagagucaaucaaaugaguggaggugcugagcucauauaacauuugacaaauguugucuuguguuucuugacuuugauauuuuaaggaacaugagccacuuacuucagucuucaguuuggauauuucugauauuuccuguggauugaauuugcaucguacauuuugucaguaauauggcaagagucucaucacaucaaguggccguguucccuguucauucagacugaggaucuguuuuccaaauauguagagaaguaagcuaggcuugaccuagaagauucuggccucuuguguuacagaaacauuaucuagugucuucccacacagcugugacuuuugacuucucagagcuuguuaaguaacugaggagaugcacaucagugguggagcaguuccucccucugccuucuacucugccaucucugaggccagucacuuggcuguucugccccugcucuucuguguucccugauucuaucaguccugcaccucuggggacuuucuuucuuucuuucuuucuuucuuucuuucuuucuuucuuucuuucuuucuuucuuucuuucuuucuuuauuagauauuuucuucauuuacaauucaaauacuaucccaaaaguuccuuaaacccuccccccacccugcucuccaacccacccacuccugcuuccuggaccugguauucuccuguauuggagcauauaaucuuuguaagaccaagggccucuccucccaaugauggccgauuaugccaucuucugcuacauauacagcuagagacacgagcucagaggcuacugguuaguucauauugcuguucuuccuauagaguuacagaucccuucagcuccuuggguacuuuagcuccuccuuuggaggccauguauuccauccaauagaugacucugagccuccacuucuguguuugccaggcacuggcauagccucacuagagacagcuauauuaggguccuguuggcaaaaucuugcuggcauauucaauagugucugcguucggugguugauuaugguauggauuccugaauggggcagugucugcauggucguuccuuacgucucaucuccagacuuugucucuguaauuccuuccauggguauuuuguucuacuggggacuuucuugcuuuucccccuccaguguguugugucuagagucuagagugaaguuucaggcaucucucacuggccaagagcuuaccaacuaagcuggcugaccaguaaagccccagaugucaaaccaccauggugguuuuguuuuguuuguagguaggcuauugaguucaagucuuuaugguugugugcaaauacuucagagacugaacaaucuccagugccucucugucugucuguaugucugucuaucuaucuuuguagcuggcuauuuuuuguuuguugcuuauuugcacuuuuaugguaaaacaugcuauaaaaaugagugugugacuauagaguucacuggugauaaguacauccauacuguuuuguagcuauuaccacccacuaugucuagagcuuuucaucauucaaacuuacauuccugcucaguuaggaaacguugguucuucauuccuccauuccccacucccuaaccacaacacuuauguauuucgucuuugaguuugauuacacuguuuaccucagauaaguggggccuaaaguauuugucuucuuguaacagguucagguguaauguugucuggauucauguguaacuuuacuuuucaagcugauauaaaucauuguguggaugugccacuguuagccauuauuagcuuacccuggauguccagcuuacuuuucaccauucagcuauugcacauaguguugccaugaaccaagaguguguacacacagagacaaagcuguuugagccauugcuuuuacucagaaguagaauuuugcuaggacuguuuuacuucaaaacuuugauucuuuggcaaauuuguguugccauuuaauguuaaaauugcuaagaauaaaauaaucaagaaaaauguauuucuguuccauguauuauauaaacaccaguauagaugacaguaaucuuaaagauuacauucauuuuccaaaauauugcuuuccaccuuguuaaugaagcuauugaaaggaaaauugagaaaacaauguagaaagggaucaucuguauacuacuauaugacagaacagugcuuauuuugguauuuuaaaguaguauuuuauauugacuaaaauauuuauuauuauccuaguggaauaucuacauaugauuauauacaguguauugcaucagaaagcaaaguuaguuauucacugauugauuuuuuuuccccuucagauguauaacugcuuuuauauucauacauguagaugcauauaaaugggacaauacuauggcuauauauuuucccuuuuucuuuuuaugaaaggaagaccucuaagugauugucuaaaacauuguuauuaaauaauauuaagaacaaaggauguuaguuacauaauuauuuuaucuuugcgauuuuauuguauuuuuacaggguuucuuaaaucucaggcuggucauuaauuuuguugugugguugaggguggucaugaacuucuguuauucuugcuucugccuuccaagugcuagaauuaccauuguacaccaucacagcuggcuuuuggagugcugcuaaucaaacucaggccuuagugcaugcuaggcaaacauucuauggauugcgcuauauccacaguacccauaauuaauugaaaguacugacuauacuagacuugagucauuugauuugaauuuuaaguguuuaaaaaccuuguaaguaauaacauaguauguuguuugcauuuuugagggcuuuuuguaauuucacuuuuagcuauuuuauggguuuccuucucuacccuuacuccuuccccaacacuagguaguagagaaagaaggcuauaggguaaagggggcauugaucuuugacuucugauuagggcccugaguuccuugggucaguguuuauuuucuguggcaggauaucuccaaccagcaaacagcaacaaccagcagaguccccagaauucuaaaugucacaugcucucacaaaaacuaucugcagcuugucaaaaccaugccccugcuagauagagcacaaagcagauuauggucugcugcugugggcagucugcaggagccccauaucccacacuugugauuaaaacaaaagcauauuccuauaacaacuuauguguuuaaagaaaccaaaguugucacuacagccuuuuuuuuaggaugcguucuuaaaagcagguuuguuuucagggcugaccauuugguacuggguaaccauuuguuguguucuuuggggaaaacuguuucuccuucugucaacauuccuuaguagccuguauaucuuuaccaggguucagguccugagguauuucuucugucuacacauuagcaugucuguuguuguuuuccuuguucagcuuauguuuagguagccauguuagugagacuuuggguguagcuucagacaucaccaggaaacacagucucagcaaacucacucguccucuggcucuuacaguuuuuccauaaccuucuucagaacuguuuccugagcauuaggugugggaguauuuuguagcuguauucauugggauuagccuccucuacucugcauuuuuuugguugugguuuucuguaauggucucuguugcaaagagaagcuugauuaaugaggagugaggacuacuauuaucuguggauauauaagacauguuuaaaccauaguuagggauuaugaugguuuauuaaagugacaguuguaauuucuccucuaagauccaugaccuuacuugcugaguaguuggcuagguuucuaguaccugacaugauuucccucugguugauugaaccuuauauccagcuagauagcuguuggucugggugcuacuuuuggcccuuaggauuguuaauggcaaauuauauuuaaguguguguguauguguguguguuaauguguguguguguauauauauauaaaugagcuaauaaggacaauuaaugaagaagauggccauaaauuugaaagagaucaagaacagguauaugggagaguuuggaguggagaggagaagauagaaauuauguuauaaucuuaaaaguuaaacaguuuuuaauaaagcaacuuuguuuaccuugaucuugugcaucccaagcugaggauuuaguccuuccucagacucugaagugcaagggcuguaggugugcaucuccaaaucuaacuugaaaggguuuuggccauccuaccaacggcaaucuauagauuuaaugcaauucccauaaaaaucccaacacaauucuucaaagacauggaaagagcaauucucaaguucaucuggaaaggcaaaaaacccagaauagugaaaacaauuuuuaacaguaagagaacagcugggggaaaucacuaucccugacuucaagcuuuacuacagagcaauagugauaaaaacugcaugguauugguacagagacagacauguugaucaauggaauagaauuugaagaaguaaaaccacacacuugucacuugauuuuugacaaaggcaccaaaaauauacaauggaaaaaagaaagcaucuuuaauaaauggugcuggucuaacuggcuuucuguauguagaagaaugaaaauagacccauauuugucaccuuguacaaaguucaaguccaaguggaucaaggaccucaacauaaaaccagauacacggaaucuaauagaagagaaagugggaaagagccuugaauucauuggcacaaggggaaauuuccuaaaaucuaagaucaauaauugauaaaugggaccucauaaaacuggaaagcuucuguaaggcaaaggacauagucaauaugacaaaucggcaaccuacagauugggaaaaaaaaucuucacuaaccucacauccgauagagggcuaauauccaacauauauaaagaacucaagaaguuaaucaccaaaaaaccaaacaacucaaucaaaaaauaguauauaguacuaaaccaagaauucccaacugaggaaucucgaauggcugagaagcaccuaaagaaauguucaaaguccuuaguuaucagagaaaugccaaucaaaacaauacugagauuccaccuuacaccagucagaauggcuaagaucaaaaccucaggugacaacacguguuggagaagauguggagaaagaagaacacuccuccaucgcuggugggauugcaaacugguacaaccacucuggaaaucaaucuggacguuccucagaaaauuggaaauagaucuaccugaagauccugcuauaccacucuugggaauauacccaaaagauggcccucuaugccacagggacauguguuccacuauguuuaauggccuuauuugugauagcccgaagcuggagacaacccagaugucccacgagagaagaauggauacagagaaugugguucauuuacacaauggaguacuacucagcuauuaagaaugagugcauccugacuuuugcauucaaauggauggaucuagaaaauaucauccugagugagguaacucagacucaaaaggacauauaugguauguacucacuaauaaguggaaauuagccaaaaacaacaacaacaacaaaccaaaaaaaaaucauacagaauacacaaguuacaguccacagaauucaaaaggcucaacaagcugaagugcuguccuggcccucgggacaguagaaccgggucugaggaacccaccuguggagagaguggggggaggggggcgagaaacacaaagaauagacagcaagucugauugaucaagcugucaaauuuuauuuuucccaggcagguuuuaugcccacagaagcaggauauggggaggggaaugacgcagaaucgcuuugugucugggggaaugaaccuggucccaagagcaggauauuggcuaaguaaaaguucaguaggagaaacagaacagaauggguggcuagguaccuguccacaagaucuauagcuuuuuguucuuaacuggggguaguacuuuccuacagaggccucaacuuuucccacaggaaucucuacuaagcuagaacuuuuccacuaaggccaagacuuuguaaguaagcacuuacggcugacaaggcaguuaacagucaaacagggucacucccaacaaagugcccaagugaggaggccucaguuccacuugggagagagaagaaagcaaucacaacuugggaggaagggagggaucugggagggaaaguggcgggggagcaggggaccuguucugguauugggugagggagaaggacugaagcucugaggggcuucagaaagaauguaaacaggcaaccucaggaaauaagagguugggggauucccccccccccccccccccagagugcaucagagaccugggaggugagagacccucaggacucauaaggagggaacuuugaugaaaugccugccaguagggagagggaacuuauauagcccaccuccagcaggaagacaggacaucaagugagguaugggguugccaucccacagucaugacucugacccauaauuguuccugucugaaagaauuacaggguuggaauuggagaggagccugaggaaaagaaaguccagagacaggcccaaagugggauccagcucaaggggaggucccaaggccugacacuauuacugaggcuauggaacacucaaaaaaagggaucuaucaugacugcccuccgaaagacccaacaagcagcugaaagagucagaugcagauauuuguacccaaccaaugaacaaaagcagcugaugccuguuguugaauuagggaaggcugaaagaagcugaggagaagggagauccuguaggaggaccagcaauaucaauuaauuuggaccccugagaucuuucaaacacuggaucaccaaacaggcagcauacaccagcugauaugaggcacucaacacacauacaguagaggacugcugggucugugcucauucagagaugaugcaccuaacccucaagagacuggaggccccagggaguuuagaggucagaugggguggaggguggggcuauccauguggagauggggugugguggggagggaggugugggaugugagcaguuggagggugggaggggagggacggggaguggaauauguaguguaaaaaaugaauuacaaauaaaauaaaauuaaaaaaaacccucaauucuauauugugaauauauuggcugcuaggauccccaaguaguaauuaaagccauagaugaaucacauuugaauuugucugaagcagcuauagaauauuccaugcccaaguagagcuuuccagaaauuagccagaucagaugugagucuuccacaccucaguucugcccagguuguggaccugagucauuucaagccauaagaccugguugguguccagggcuauacaacucacgugcuuuuuaggcuccucugaaauuuuggauugcagccugacuaauaucuaugaguuccucauguuucugggauccagcaguucuguggagcucaggcuguggcuuuucuuacugaggauacuaaauagggggauguauuuauccguaucgagcuguuugauggcuuuguuaucuuaugcaagggugcuugcuguaaaugacugcauuggccugaaaaauggcugcaaguugguuuuguuacugcauucuuaguaguccaauacaagaaaaauguguuaucuuaaaauucugcaguuuggaaaucugacuugagugucaucagacuaaaagugcaugugccucuguguguguguguguguguguguguguguguguguguguguguugggaagaaucuguuuucuugccuuuuccagcuucuauagucugccuguguccuuaggucaugauuuacuccugccuucaaagccugcaacuuccauuuuucuggugcauauuugcuuuucuccucccacuuuuuauucucaauuucaaauggguuaugcuggacauacucagauaauagagauucaucuguuucaaacuuuguucaccuacuacugucuuugcccauguuguauacacaucuaccuuauacacaauauguuccucaagaguuuauggaaagggugguggucucaaagccucauggaauuguugucacucacacaucuguuucaccccacaucuguuuccugguucccaugaagaggcagcccacucugagcuguagccuuagcacaucuccauuugcugaacuucucuagcacuugaguucuaagguggcagaagugccaaugggguaaugucggcugaccuuuaagaaagcaguugguauagaagcagguuuaugacuggguggcagaugugaguuaguuuuucuaugugauuuuuuguuuguuuguuuguuuguuuguaugccuguuuuugacuccuaagcccaaguaccuuguaugccauuuuuauccauuagcuggggcagugaacccucaccgcacaguguuccugacuucuggaguaccugcugcuugcuagaugcugcugcucuuucuccuagagacucucuguauugcguccugauuuucugccuacuuuuuaguucauuauuccugcacugugagaagccugaaaggcaacucaggaauaaauucauuucccaauuugcaauuuuccugucucugugaaaagccugauaauuaaauuuuuuaaaaguucucauuugauugaaaaaguaggcaacugacuuuuguuuccuaaaauaagccucuagaguagaggagaaggguaauugguuuuaagaaaccaaaucuuuuguaaguguaaaagccauuuccaucuauguuuaguuuguggguagugugcacaugcaguggcaugcauguuagagaacaaccaggggagugaaugcucuccuucacaauacacauuccugagcucagacaauaggcucagacugggcgccauuuccuguaccacguucugcugcuugaauguguuguuucccacagaguccagagcagugugggcucuguuagagccacaggguuaugcuuauaauucucacauggcaacuggccuugcagcagacugacuugggaguucaaauccuugcuaacagguccuguaccuguuagucaauucugacauaagccucaguuuugaaggggcuuugugacuucagcagucuggauaaagugacagggccaaaaugcacuuucgaguaaccauaggaaaauaaaaauaaaauuucuuugcuggaagcaagcuugacuuuaucucaaaguaugauuuuuuuuccuuuuagagaggggguguauagccaugggcuuuccacccauguccaaguuuaugaaauaacaacucugacaaugaauugaauuauuaugaaucauugucuaggccaaaagcucuggcauguuucgcuagcuuauaacucaguuuucauauuuauucuauucuaagucacgccacgugauugguuaccucuccuuaguuccauccaucuuccucagaauugggaggaaaucuccuucccaggucuguucuauccuagaauccucucuacuggauguccuacucucuaaucaugccucagcucauuggccagucagcuuuuuauugacaggugcuguuucuauacaguacacaggguuagucauuucaagcaaaggcaacuuugucucucugaauagcuuuuuacccaaauuuagcaugacugugagauguauuggugcaugugucagugaaaacacauuucaaagagcuaguuuauuuuggagucgaauaugagugaccauggccugcuaacuccagguuaccuauuuugauauuccaauaagauaaaggaaaaucuggacaucguuguugugcccucagauauuaucugauuauauucuuaggcuuuugauugguagaggcuaauggucugagaaguuacaagauuccagaaaguuuucaguuauuuguaacaaacaugacaugggucagauacagaggcgggcaauucaaagaaugguuguuuggggacuaaauguaaucuaagauaaauuguaauuagguucugcaccuacacccuaaccucuucacagucauugaagugcuacucaguuuuguggauguuugacuauaaagugugauuucccugccccacaggaauuuuucagacuuaguguuuggaggcuuaggcaagggggugaccaugaauuagaggccaaucugagccacaugagaauggccuagauagcucauguauuugaaggcuuggucccuaguuagugaaaauauuuuaggaagcaucaagagaugagcucuuguuggaggugugucacugggaucuggcuuuaagguuucaaaagcccaucacccuaggccuguacucuguacauggaacauaucuauggaccaguacaaagaggaggcaggacaaaaaauccuaaggcccaaggaauuguuuagagaaacuaugaugguguugaggcaacaagcagcuuuuauugcaaaggaauaaaagaugagguuuauucuguagagaaaauuaaauacaaaaugggaacgacucugcuauaggacuaagaugcuagcugacaauaccuauugacccuuugauuugaagaaaguagguuuucaggaugcugggucuggcuuuaucuguuaggcuuagcaugaggaugcaguguugaaggugaggguggggcaauagcuauuuagagggcuaaagauagcccaagguaaauugaaauuggacuauggaacuauacuauucuaaucucuccacaucaaugauauuccagucaguuaaucugcuuuuguagacauagcuucuuucucuuauuugaugcucuuuguuguauuucuucccaugguuaagccaugucuuaaauauuuugugaaaauacaauuccacauuuuaauauuuugucagaauugaaaguacacugcuggaagaguccaaaauuuuuaaaaggaggcuagcaaacuagcuuucuuagauugccuuagcccugagacuauucaagagaguaccuguguugguugcugaaguuaggcuauuaaauguguuuuguguaaaacauggauaaaaagaacuccacaucugaaaaacagugaaguauaugucucccaccaauuugaagaacuauuuuauaaugauguaacauaauuucugaaaaagcuaugaauaugauacuaguauuuuauauuccaguuguaccugucuuaucugaauaaucuggaaaaccuuaaugguuuuaccugguuacaguugucucacagcugguaggaacaaaccuuaauuucuugcucauaugcaugauggcaguagguacacuguggcuccagauaucuucuuuuaaggcccagaagaugagagcccuugcuggguuugagauaaaucucccuaugacaggaaggaauguaggagagccagagccaagccauagggcagggaugaggaaacauuuuuuaaugucuauugggcaaaugugcuacacugcuuaagguauuaagacaaagugagcucccgcucaguguggcugcuguggcugugaucugggccgugaguuagaagcccauucuuugaaaguacagauacuugaaacaacaaucuaguaaucacagaucaagauucaguuaaccuuaaacuguuguugacugccaacaaguaaggcauggaugacugagauccaugaaauagucccuugaaaagcucagucuacaaggacagaucuaaugucaguauaaaacacaguucuuuuuuuuuucuuccauuuuuuauuagguauuuagcucauugacauuuccaaugcuauaccaaaagucccccauacccacccacccccaauccccuacccacccacucccccuuuuuggcccuggcguuccccuguauuggggcauauaaaguuugcguguccaaugggccucucuuuccaguuauggccgacuaggccaucuuuugauacauaugcagcuagagucaagagcuccgggguacugguuaguucauaauguuuuuccgccuauagaguugcagaucccuuuagcuccuuggcuacauucucuagcuccuccauugggagcccugugaucuauccauuagcugacugugagcauccacuucuguguuugcuaggccccggcauagucucacaagagacagcuacaucuggguccuuucgauaaaaucuugcuaguguaugcaauggugucagcguuuggaugcugauuaugggguggaucccuggauauggaagucucuacauggaccauccuuucaucucagcuccaaacuuugucucuguaacuccuuccaaggguguuuuguucccauuucuaaggaggggcauaguguccacacuucagucuucauuuuucuugaguuucauguguuuaggaaauuguaucuuauaucuuggguauccuagguuuugggcuaauauccacuuaucagugaguacauauugugugaguugcuuugugaauguguuaccucacucaggaugaugcccuccagguccauccauuugccuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaucaguuggggcaucuucuggauauaugcccaggagagguauugcuggauccuccgguaguacuauguccaauuuucugaggaaccgccaaacugauuuccagagugguuguacaagccugcaaucccaccaacaauggaggaguguuccucuuucuccacaucgacgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauucuuucccaaucuguugguggucuuuuugucuuauugacggugucuuuugccuugcagaagcuuuggaguuucauuaggucccauuugucaauucucgaucuuacagcacaagccauugcuguucuguucaggaauuuuuccccugugcccauaucuucaaggcuuuuccacacuuucuccucuauaaguuucagugucucugguuuuaugugaaguuccuugauccacuuagauuugaccuuaguacaaggagauagguauggaucgaugcgcauucuucuacaugauaacaaccaguugugccagcaccaauuguugaaaaagcugucuuucuuccacuggaugguuuuagcucccuugucgaagaucaagugaccauagguguguggguucauuucugggucuucaauucuauuccauuggucuacuugucugucacuauaccaguaccaugcaguuuuuaucacaauugcucuguaguaaagcuuuaggucaggcuuggugauuccaccagagguucuuuuauccuugagaagacuuuuugcuauccuagguuuuuuguuauuccagauuaauuugcaaauugcuccuucuaauucguugaagaauugaguuggaauuuugauggggauugcauugauucuguagauugcuuuuggcaagauagccauuuuuacaauguugauccugccaauccaugagcaugggagaucuuuccaucuucugagaucuucuuuaauuucuuucuucagagauuugaaguuuuuaucauacagaucuuucacuuccuuaguuagagucacgccaagauauuuuauauuauuugugacuauugugaaggguguuguuucccuaauuucuuucucagccuguuuauucuuuguauagagaaaggccauuguuugaguuuauuuuauaaccagcuacuucaccgaagcuguuuaucagguuuaggaguucucugguagaauuuuuagggucacuuauauauacuaucauaucaucugcaaauagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuucugguuugcuguagauugcuuuuaucauguuuagguaugggccuagaauuccugaucuuuccaucacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguugggucuuucugugguuuagguaucagaguaauaguggcuucauaaaaugaguuggguagaguacguucuacuucuauuuugugaaauaguuugugcagaacuggaauuagaucuucuuugaaggucugauagaacucugcacuaaacccgucugguccugggcuuuuuuuggcugggagacuauugauaacugcuucuauuucuuuaggggauaugggacuguuuagaucauuaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuaucuaucuuguugauuuuuucaaagaaccaacuccucguuugguuaauucuuugaauaauucuucuuguuuccacuugguugauuucaccccugaguuugauuauuuccugccgucuacuccucuugggugaauuuacuuccuuuuuuucuagagcuuuuagauguguugucaagcugcuaguaugugcucucucccguuucuucuuggaggcacucacagcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagauuguuguucaguuuccaugugaauguuggcuuuccauuauuuauguuguuauugaagaucagucuuaggccaugguggucugauaggauacaugagacgauuucaauauuuuuguaucuguugaggccuguuuugugaccaauuauauggucaauuuuggagaaggucccgugaggugcugagaagaagguauauccuuuuguuuuaggauaaaauguucuguagauaucugucagguccauuuguuucauaacuucuuuuaguuucacugugucccuguuuaguuucuguuuccacgaucuguccauugaugaaagugguguguugaagucucccacuauuauugugugaggugcaacgugugcuuugagcuuuacuaaagugucuuuaaugaauguggcugcccuugcauuuggagcguagauauucagaaucgucuuggaggauuuuaccuuugaugaguaugaagugucccuccuugucuuuuuuaauaacuuuggguuggaagucgauuuuauccgauauuaaaauggcuacuccagcuuguuucuucagaccauuugcuuggaaaauuguuuuccagccuuucacucugagguagugucugucuuuuucccugagauggguuuccuguaagcagcagaauguuggguccuguuuguguagccagucuguuagucuaugucuuuuuauuggggaguugagaccauugauauuaagagauauuaaggaaaaguaauuguugcuuccuguuguuuuuguuguuaaaguuggcauucuguucuuguggcugucuucuuuuaguuuuguugagggauuaucuucuuguuuuuucuagggcgugguucccguccuuguauugguuuuuuucuguuauuauccuuugaagggcuggauucguggagagauaaugggugaauuuaguuuugucguggaauacuuucguuucuccaucuaugguaauugagaguuuggcuggguauaauagccugggcuggaauuuguguucucuuagugucuguauaacaucuguccaggcucuucuggcuuucauaguuucuggugaaaaaucugguguaauucugauaggcuugccuuucuauguuacuugaccuuuuucccuuacugcuuuuaguauucuaucuuuauuuagugcauuuguuguucugauuauuaugugucgggaggaauuuauuuucugguccagucuauuuggaguucuguaggcuucuuguauguucauggguaucucuuucuuuagauuugggaaguuuucuucaauaaucuuguugaagauguuugcugguccuuugaguugaaaaucuucauucucauccacuccuauuauccguagguuuggucuucucauuguguccuggauuuccuggauguuuugaguuaggaucuuuuugcauuuuccauuuucuuugauuguugugccgauguucucuauggaaucuucugcaccugagauucucucuuccauuucuuguauucuguugcugaugcucgcaucuaugguuccagauuucuuuccuaguguuucuaucuccacuguugccucccuuuggguuuucuuuauugugucuacuucccuuuuugugucuuggaugguuuuauucaauuccaucaccuguuugguuguguuuuccugcaauucuuuaagggauuuuuguguuuccucuuuaaugucuucuaccuguuugguuauguuuuccuguaauucuuuaagggauuuuuguguuuccucuuuaaugucuucuacuuguuuagcaguguucuccuguauuucuuuaagucaguuauuuaaguccuucaugauguccucuaccaucaucaugagauaugcuuuuaaauccaggucuagcuuuucagguguguuggggugcccuggacugggcgaagugggagugcuggguucugaugauggugaguaguccugguuucuguuaguaagauucuuacguuuaccuuucgccuucugguaaucucuggaguuaguuguuauaguugucucuguuuagagauuguuccucuggugauuuuguuacacuauaucagcagaccagggagacuagcucucuucccugaguuucaguggucagagcagucucugcaggcaagcucuccucuuucagggaggugcacaguuaucugguguuuggaccuccuccuggccgaagaugaaggcccaaaacaggaucuuucccagaagcuguguugcuuuggccugcagacugcccccugcggagucccagaaucaagguggcccccgcggaacgugaugcagaagccucacggacugugcggacaccugugcucugaccaggaagguggcagguugucuguagccgaaaauggcgccgccucagaggcucuguggcucucgccugguccagaagcugcuggccucuguguuccacacucucaccugcagaccgccggccgcggaguccuggaaccaagguggcccccacggaaagugaggcagaagccucucgggccggguggaccccugugcucucaccaggaagguggccgguugucuggagccggaaauggcaccgccucagagcaaaacacaguucuuaaaaagaacauaagaguuuauucugaagcccaacaugagugacugucucagggauacagauuuguuuugccccagauaccauuuuccaauggggggaaaaagaagagugccauaaagguuuuauagaugcagaauaaaagucagucaugacaguuuaguuuaguuuaguuuaguuuuuaaaauucuguauauacacacagcuuauacaugugcuugaguggauguguaccagaugucaaguuugguuuuugaggcaaaucauuagacucacuagcuaugcuaggguagguggccagagaccucagggauccgccugucuccaucauuccagcacuaguucagacaaucacauucacaucuucacacuugcccagcugccaccuuacugacugagccaucuccaucuuccaucacggaaguucucaaauacguuggaaauuccaccaaaauggaaacaucucugcuguagguuucagggcuauuuggugacauucuuaacaucuggcuugguuggauccaguuaauaucuuauaaaaccuggagucagaaggauauagguuguuuuguuuuguuuugaauauuguuagcgggcuguaguuuguauggcauucggugccuugcuuguuucauguaacuaagcccaugagggagugugcuggcaagaugaaagucacuaucaguauggugacacacgucauguucuguugauuagaaacaagccacauguucacacauggcuggaggaggugguuaccuacaggcauaaauuuaagagggaguaaauuagcuugggagucccuuggaauauaccgucuugguguauuugugauguugaaaguuagcagcaugccuucuacuccauugguagaaaggaguagcucaguucugugucggaagaguccuuaacagggaaggggaaauguucacugaacgcugaagugcagcuucccaguauccacaugcuaaagggaguaggagaggagcacaguaagacaaaugcugcagcagaggcuacacaaagacgugggcagccaggauuagcugagcauuguagcuagggaagaagaggaacagagaccuggaauuuggugaaacacaagguuuugcagggagggagaggauagcaguuuuaggaggcauaacugucaagagaagaggugaagcuggaaugguaagacugugugccugcaaaggaaaaggggagcuuuuggccagaaggacauguuagaauugcuucagauuuuguuuucuaggacugaugaagaaaggcuccauuauuucuuauuuggaccugucuguucuuccucuacagaaggcagauguuugggagugaguguuuccaaaugcuugguguuagugccauacucuauaugcugugcuaugauuuugaaagucuuguuguacaaguggauaaggaacaagcaaaaucucuauaaugugaugcuuauacugagugauucaagccuugcccuaugaacagaggaaugaugauaaugccagucugacuagugggaacuugagguagcaggagaacucacugagacagcauggaugguucugguacacagcagugcauuugaauuuuuagauaaggaugugugauaaggaaagucuucagauaucccugaauugaaagccaccuaaaauaugaaauuauuuuaauuaguucuaaauaaaauauauaguaucugauaaggaauauucaacuugauauguacauuacagaagaucuugcuuaagcugcuucauuuccuguagaagucugcaucacaucucucaucucauuucccuaggagccaaacaguuccugcucugaguauggcaagcagagcauuuagaaagucucgguccuggcugccuuagcacacagcaguuccaggauguagaaacaguaucccgauucacuccauucuuuucucugauucccuuuguuucuugaaacccuggaggcugccaugaaguuuuuguaccucugauuugguguagauagcauuuugguuacuaucagucuuucugaauaucuucacuaugagaacugaaaauagauacuauggcugaggugugauuggaaugcuuugauaagccaguaagauaaaugccagaauguagagcccaggaucaguuucucccucccugaggggcuuucaagaagaucccccacuuuuaccucagccuacuuugaaaaugacaagcucuucuaaaaugucagagaagagaacguuucuaguuuuuuguuuuccuuguguuugaggcuuuugcaauacauacacagaaacuuuuauuugccaguuuuggcugucacagcugagugaaaugugaauggagacccauuuagaguggaauugaguucuaaucucaaaaucuuacuguaacuguuuggcuggcccaggugaaaaaagugccauuuguagcauucuaagccaagucuuaaagagucaugguuggauguaaguuugcguauuacuguuuauuucucucauuuauuauaacaaacccuuugugauuuaaggcagugcuacuuuauuauaaggcuagcuuuuagguccaggaugaggaauagccugaggccugggggcugcaaccacauaggggagaauagcugccauuucauggcuccuguuuuaugaccucuuuuauaccuuuucuucucuaagguuauaccuccauaaugucagcuaggucaaaggcaggauuaugcuuaauaaaucauggguguucuuaccagcucacaaaccccacauuccugugguauacaugauaacuuaacugccccuggccacucaaugcucuuacugcucaaaacucagaagaagcacugcugguaagccaucauuagaucuccauucagagcccugaguucuuuugcauccacauauauuuaggauaagugagugauuucuguuuggguccauuggucuuuuuuuccuaauauuccuugcuugacauucucuuaccuagacuccauaaaucaggauccuucaaaggacuacuuuuucacugaucuccuuugggaugccaaugcuggcaaccuauccgauuuuuuucauucugcccugguauaugcaacugggccuugugagucugaaucacagcacaguguucccuccugauggucuacacagagauaguuacuuccaugggccaaguauuguucucagucuccagugagguggaguuuuuguuuguucacuuccuuuuaaaauaucuaucuaucuaucuaucuaucuaucuaucuaucuaucuaucuauuuauuuugcaagugcugggaaugguccuccaaggucuuccgaaugauagggaaggguuucugcccuagauccagugaguuuuuacuaauacacauagcauuucuaugagauggacaacuaucuucucauuuugcagauggagagccaaaguauagagaaaaguuaacugccucaagucaucaaguugcagaguaaggaaguaguggagaucucucuguagaaacuccaaaaaccugcuuaggcacugagauuguagcucaguaaauaacaugcaggaagcccuggguuccauccccagugacacacaagcuggcaugguggcucaugccuauacuaccagguagaggcauuagggucagaaguuugagaccacuguggacuaugugaaacccugucucaaaaaucaauaaucacuccugccccaaaacuccagagggcaagugccccaauuuuguauuuuuaaugacuuggggcacuugcucucuggaauuguuuccauguagucuagugacauuuagccacuauuuuauuuuacuguuuauuuguauacagagguuugugccacuuugagcauggguguacacuucaagcaugggugugugacuguguguguguguguguguguguguguguguguguguguguguauguauguguguaugcgcuuguuguaggaguuaguucuccccuucaaguggguucucagguguuagucaggcuuggugguuagcucccucaaggacuaaccaggacuccucagccucaguuuuaucuagauauuuguaaguguuugaggcaggcauuaugcaugcaguuagaugucggcaacugguuugguuacauuugacuacaaguucuaugaucucugacuccuggguccuuguuuugugaugcuucuucaguuguagucauugacagaguuaaguggaaguagcacaauucauugacacauaaagcaaauaaaaaugguagaaaucucuuacuaacuuguuaagauauguacuuuuguacgucgucaguuccaguguauaguugauggaaccaaggagagaggauuuucugaagcgucauucuuugagggagaaagccauuauuuguuuaauuuauuuuauuaacuuacuuuuccccuuucagagcuaaguuauaggcgagaacuuugccauucaagagaaaguguuuuggagauacagguuuagguuugggguagauaagugcuucguauacuggaggcuggauuccugcacuccagcauccaaagcaaagcacagaaagucuuuuagauguaucugcuuaagugauggcaucucuuucaacuguacaauuuuuccugcuuauuuuuccuucuaaaauauugguauugcuugccuuuaaucccaguacuuaggaggcagaggcuggagcaucucugugaguucagggucagcuugauauacauuagaaauuccaagucauccagacagagcuacacaguaaaaugcugucuuagcaaacaaacaaacacuguguagaggaagggcccuucuaagacacauuaaaauagaguugcuuucauuuaguauuugaagcuacugaaucaauugaaauuauguaucagccuuaagaguguuuuauaugcuuuccucuacuuauagaauaaccagcucuccuugaaugguucugcuuucuguugguauucauuuucauagugguuuuauucaggaagaagcuuugugugaggguaauguaaacuggaauacuguuacaagcggcagguaaauauaaugcacuguaguuaauacuuuacuagaaaacacacacacaaccuuuuuuuuuuuuuuuuuuuuuuuuuuuuggaaugauaccacaugccaguuuuguuucuaugacugagucuuuugacauacuugagaggaaacuuuuuauuccaacaagaacuuugcucugcuuuaugacugcuuagguaaaugaugaaagacagcagauuucuuccauagacauaguuugaaacuuguguuuucugaacuccaguaagaaugcagugagccaaaguucagauauucuucacuuagaaaccauacagcagaacaugaagugggagucuuucagauagcauccggcuugcauccuuuccuuuuggaugcauuuggauggcauccccucuucuuggaagugaaacaggcuaaguaucuucaacuaaaucccaugccuguaauaagguaguguggcagaaggucagagacugccucugcugucacaaguugcuuuucuugucugccagaaagguucuuuccagcuucaugagagcagguuuaggaaggguugaauuuagagagcauggaagcuguucccagaucaccauauguacgcugauguucuggagcuuuugcacaguaacuuguggcucacagagugcuuucucucuuuccucauuugcugccuacagagucaucuggaugugugugugugugugugugugugagagagagagagagagagagagggagagagagagagggagagagagagagagagagagagagggagagagagagagagagagauuacugaauauuugcucagggucaccuagcugacauaugucauagguaguccucagucauguuacuuuuacaggaggcuaggugagaacuuuauguauaaaaugcguggugggcaggcccuagaaaguauaaagcauucaggcucucagauucaucugugcuuuuagccuuugcugagaguccauuugcuuuuagguaugaguuuaggugacuucuaauucacauuacuuuguaucuguaccaguuaggaaaacaugacuuacaggaacaaaacagaaauggaacagugucuggguucucacucagccuuugauguauucuuuaacagugaagagaaucugcuguggcuguggaacuauugucuuaagcaguggaacuauuguccuuagcagugauacaagaggucaucucagugucacugcagagcugcacuucugacaagauuucucacuugaauaaccccagaccuugcauaagccugauuguauaggaacuguggauaacaaaagugacccacaaaacauugguccgauuugacuggaagaugauguuuaaauucuucauauuugaccaagggauuccauuccaagcaaguaguacugggaauacaucuacauguuuaagauuaggaauuucaucaugccauuuguagcaauuccccacuggagacuggugaauuuauacuauuacuauugcugguaaaauagauauugaaucugguuuuaugaugaauuauaaguacaacucuaugcaagguacuugucuaagucaauguucuauugcugugaagagacaguaugaccagugcaacucuuauaaaagaaagcauuuaguuaggacaugcuuaugggggcaagcaggaagacauagagcuggagaaguagcugagaauucuaccucuggaucuccaggcagcaggaaagagagccccuaggccugguuaggacuuuugaaaaucuuaaauccaauggcauacuuguuccaacaagguccuaauccuuuaaaauagugccacucccuagugaccaagcuuucagaucagugagccuaugugguccuuucucacucaaaccaccauagcaccugaagugaaaauguacuaauaaagagaaugguaaguuuugaaugaccaaugcuuauuuauaucaacguuaagaggaugagagcucaaaagaguaacaagaggugaaucucugcuguaaacuacagagcagaguguuccuggguagaugcauauaacauuaguacggaggaauuuuauacuucaguauaccuucuuuucuuagggaugaugcacaguuccugcuauguagccuucuuaaccuugaacucuuggucuuccucccuaaaccuccaggaugcugggauuagagguaugcaucacuauacugauuacuuuguaacuuauuuuuuauguguagaugcauaaugugcaugcauggauguaugcauguguauaagugcaugggagggggugagagugcauuuuggguguguauggacacucaaaguugaugucaggagucaucuucaaucacuuuccaccuucaucacugaagcuagguuucaguugaucccagagaguuacagauguagagguaccuagcuugcuguagggcucucaugucucccacaccuauguaguauuaaugugaauucuggugaucuaaaccucugugcucauguuugcacaaaugcuuuaccuauugacugucucccuagacugacuuugcaacuuuuauaacaguuacuuuuauagucagcaaaacuauaaacuaaaaguuauccauggcaguggcucagccauugcccucagugaccaugcuugagccuggcuuucucuugggacucucuaucuuugugcugcagaaauguuucagaauaggccuggaauuuccucuuggccuuggggacaccuggcagacuccaaggaaccccuuagucuuagagcugucugucuuuguucacacaaggcccuugcuccucuuugcuagcaccuuuaacacauaacaugucuacuuucauguacuuaggccauacagccuuuucuucuguacacaaaucaggugggugcaggcagcuaggacuuugcucagagacccucugcagacuuguuuuucccaacuggcagcagauuauuaagagcucccacacuuugggaggggggucaucaagaaccagaagaacccuguuuaaaaugcucaguugaggaaaugcuuuaaaaugcagagcuaauuugaggcccagauucuuuugugugaacccugccuuucugguacaguucugaguucaccugugaucaagcaaacacuguuguggagaggggacucaccuuauuacacaugaguuuguucaguauuauaucgcacuguaaugagaagccugaugccucugggguuuccugucuuggucucuacaggugggacuauuuguaaccauuuguaacacacauuaguaugcacuucaaaacuauauuugugucuuggccaaauagaaguaagauuauuuuacuauuuggcuacuuucaguugguaauuaaauucauuaaauccauucagcuguagcacugauugucccaggacucugauugaaaugccugugacauguagagcacaacuagacggaggcagcaaaguguugcaaugaagaacuggguagguaugacuauggaauguugguuuuccacaggaguaugacaagcaagguauuuauuguguucccccagcaccugacugcucugugugaccucuggaugcugucauaaguggguucugugcuuaaaagguucuuaagcuuuuaggguacccaguggcaauauuuuuuaagacccaugugacuuagaaaguuugaguacuaauucugccucuuuggauacagauuugugguagcccucaauagcucagagauggcucugaguggagagagcuuguacaagacuuucagucagauccucagcacucaugucaaaaagcacugaagaguuaggcaggagacuucucaggagaacagucagcuucugagucagugaggauucaagucaguauggugugggaaguaauaaaaauaccaagcauccugcucuaccuccauaccaugcacaggugaucacgucugcacacagagcugcuugugccacacacaaaaagaggugcaugauagcauuucccuaaaacccuacagaaggcaugaagcaaaauaauauaaaauaaauaagaccauuaauuugacaccaggcauaaaguaugcccacaaauguuaauggacauauuauguguguagguggguggggugggugaguggauggauggacgaguggauagauagagagauagaugugauagugcauguuagaaucauuaggaugcauauuuaaaaaugcagguuugugauguauaaacauaaaaaggaaauuuguuacagucuggagauacagguguaauauuaagauuuaccaaaaaguaaagcagaugugagcagauaccucucagagaucuucuuagaacagaccaaaucaagccucagaauaucccacuccugagauuuaacugcugagaacugugggcaugaacacagcacuguaaacucugucuugcauugcaauuccuagaaaggauugaugaugacagcagcuccugaugagagccuuguagccagccuaugguaaugggaauaaagagaagagacugugguugagagagauucagguggcggugcugccuuagagcuguguuguaagcagugagagugucagaggggggaguuuuauguauuccauaaauaguugcggcugucagcugugcagccugacagguuuuucuagagaccucaggugaagccugauguaggcugcagaagacaauugagggaugaguaugaagugaaguuggaguuuuaauauuuaauguuuuauuauuuaaaaucuagauagauugaagugugggcauuaagaggagauguauguacauauaagugugggucucccaauugcauuaagugucuuaacaauacuuauguauaauuuuguugacuuucaaaguuacuuugaauggaucagaagauuauuaaaaaaugauuuggccuauuauaguuguaaaaaguauuuaugagggcugugcacauuuuuacagcaugcacauggaagucagaagacagcugaugucuugugguucucucauuccuccauuugaguuacaaccaucuaacuuaaaugccuuuccuuauguuuuaguuagaguuuuacuacugugaauagacaccaugaccaaggcaacucuuaaaaggacaacauuuaauugaggcuggcuuacagguucagaaguucgguccauaaucaucaaggcaggagcauggcaucauccaggcagucauggugcaggagagcugaaacuucucaggcuacuaugaggagacugacuuccaggcagcuaggaugagggucucauggccacaaugacacaccuacuccaacaagaccacaccugcuccaacagggccacaccuacuccaacaggaucacaccucuuaauagugccacuugcugggccgagcaaauacaaaccaucacacacuguguugugguaacgguaaagcuuggcuuguuuguuuugcaagacucauacuguaaccugcacuggccuucaacucauggugauccucagauuuuagaguuugaguuugcaaguauuauccaugugccugacuuggaauacauacuuauauuuuaagaacuuuccuuuaauaaaugaguuuguaaggugguuuguggggcacuuuauaguuucacagccugguaaaauaaaaacguggauuaaaagugguuaguguucucuauacauauaccaagucaguucuaaagugcugcuuugacaauggaaaacucgaaggugacacaguuuggccuuucaggugugacucauuagcaguuucagcauuaugguuugaaauauuucucucucagaaagaaaagagaacaaaauacucaaaauggaaguggucaguuguuuggaaacagauccugagcuugaugggccucuccuucuuuaugcccucuuauuaaugcucccugccuuuccauuuugucuugaagggagaaggauaagaacagccaggaaauagcccaagggauaaacuauggguaugucuuccaguuacuuacuagcaaaguuuaaagaaaauuuaagagaaaugaaggcacaaaaacaccuggccaguaagguguccgcugguuguagaaaaaguacaaaugagauacaggcugccagcaagucaagagacuucaggagucacaaguauggauuuugcucccucaugacuugguggcuaaugggucugcagcaagaaggcugucaccagggugcagauccuugacuuuguaccuccagaaccaugagcuaaaaaaaaauagacugucuuuauaacagaaaaauucacuaaagcucucucuggcuguagaagacacaggguaccugccaaaaaguauauagaaaaagacagugaaauguacuacaagugaauagaaggaggcaggaaaauggagagaacugugugcagaauugugcagagcuuugggacagaguguaguugggagcuguaguuaggguuugggugggugcuacauaaaagaaaagcuucuccucuucccuucagaaagaaaaaaauugagcauauuugcauauugaagaggguuagcucguuuagguuuccaaagcugcaagaggaauaugcaugugggaaugaguagagcuccaguuggcaggauugugugcuugggacuucauacagcuaaaucuguagccauucccauagagagaacaguuuugcaaggguccuguuguucucuuccucuuguagcccuuggagauaucucuguucuucaaaauucacaccaauugggaacuagucauaugauuggaacauggugccaagaaaauugcacaguauuuuguccuccuuuaaguaagauagaauuuagugacaauugaggugaucucauuaccgaacaaauuaaugguuuuauguucuucaaauuuauauagaaagucuuuguuguuucuaaguggccuauauauuuccaagcaauccuucauccugucuucuagucauacuuagugggagaaguucagcauuaaguauauuuaaaacucuuaaacaaaacaaaaugguuugugaccuucaguucuccucuguuuagcugauaacaaauacuguaccauucagaugguuaucucuggauugaccugagggauugaguugcauggugagccuguggccuacacuuguguugcauuucuugcugugacaaauacaugagaagaagcaacuuacagaggaaagcuuuguugugccucacaguuucaggauauaguccauccuggcaggaaagcauagugggaggagccugaggagcuagucauauggcagucuagugagaaagcagggucagugcugcuggucagcuuacucucuucuuuauuuaguccaagacuccagccuguggccuaguucacccuuauuuuggguggauccucucacuucaguuaauucagucuaaaaacucgcucaaagaaauggcauucucagaggugugucugcugugugauucuaggucauaucaaguuaacaauauuaacugugauaacuacaccuugucaauaugacacucaaguguacugcuuuuaagccauaaccuuccacccuuugacaccgaagucucaugucccuuuaaugugauaauuaaauucagauucaguacaauuucaaaagucccuguaguuuuuaaugguccuagcagcauuuagaaauccaaaauuucuucugagaggccaaaauuuuaauugccagccucuauucuuuuuaagcauacuucuaacuucuaauuaggaaauuauggaguaaacauugcuguugcaaaggagacuaagggaacauaacagagaaugagaaccaaagcaaggcaaacaccaauuauuguuggcucuguuuccaggauauagagcucagaacuuggacagucccaccuuucuagccuuuuggagucuggcagaaauuuuugaacucagcuacauucaaguucucagguuaaggucaaaaugcagccagcucuuuugccagcaugucaaugaauggucucuaccucuguuccugauagcauccuuuuucucuuuuggauccuccugaccuuggccuccacuaucuucauacucccagcuuucugguccuuucacauucccauucaaacccugaacauaaccaaauucagauuagaggcuaggagaggucaccuugagucucuaugucugaguugaaggcuggauucuaguauuuguuauuuuacuucagaauagugucuugugccuugucagcuucaguuuccuaacucauaaaaugagaaaaguauuagcuuccucagaagacuguuggaauaaugaacagagauuuucuagaacaauccaauaguggcugauaacacaguaagccuuaauguguggaaauucccuaaagcuauuuaccuucagacuucaguuuuaccuugaccuuuuccauaauuuucauauuacuaaguuaagauaauugaacagacauaugugcacaagguugugguauuuuuacuucaguacuuguaguauuucugcaugucuuccuuauuugcuucuaauaucuaguagagaauauguauugauaugaucucacugagagaaaugauuggcccccacccagaacugucacccaaaggagccaggagaauucuuuaucagacaccuccauuuaccauuuagaagaaaacaguugcuuggccacacacuaaagacugaaguuaagacaagccagcaugaagcagucuuggcauuuauuuaaaaagagaaggaaagggcugaaaagaugcacagcagucaaaagucagcacuuuuugcucuucuagaggacccaggcuugacuccuaccacugacaugguggcucacaaccaucuggaacucauuccagggggauuaagcacacaugugagacacaugcauacacagaggaaaagcauccacagugagugagugacuuagugacugagugaauagaaggaagggcucucaggaaaugauaagguacaucccagagccucaguguggcuucccaaaggagagucauucuuaagagaucuagugaugaccauagguagcauuugaaaacucuaaaauuuuguuguucagaagauuucugaaagacuccaucugucuguuucccuuuuugauuguggagacuauagggauuguggagguacccucaguacaggugugcucugaugaaaucgggaaccacuauguuuucaggaggcauuuagggcauguccuuaacguuuucuggucagauuauaggaaacugcagauuuguaacuggugaauacaauuuggguugugucuuagucaggguuucuauuccuggaccaaacaucaugaccaagaagcaguuggggaggaaaggguuuauucagcuuacacuuccauauugcaauucaucacuaaaggaaaucaggacuggaacucaagcaggucaggaagcaggagcuaaugcagagaccauggagggauguucuuuacuggcuugcuuccccuggcuugcucagucugcucucuuauagaaccaagacuaccagcccagagaugguccgacccacaaggggccuuucccccuugaucacuaauugagaaaaugccuuagaguuggaucucauggaggcauuuccucaacugaagcuccuuucucugugauaacuccagcugugucaaguugacacaaaacuagccaguacaguuuggaauucuuuuuauucuauucuauuuuauuuuuaauuaauucaucuuauguguaugaaugcuuugcuugcaugcauacaugugugccacacgagugccugguucccauagaaguaaaaagagguuuccaguuccuggggaacuggaguugagaugguuaugagguagcauuugggugcugggugucaaacucugguccucuacaaaagcaguaaaugaucuugaccagaccacugagccauaucuccgccccguguuagaauuuuuaacuuucaucuggcaagaggcuucaacaugaggaaggaaaagaacucuuuucucuuucccaugucuuucccuuccuauccugccuuucuccagugauaccuaaguaucaccaguugaaauugcccucaaugugaaacagaaacaaauucacauuugguuuucauaaauguaacuguugaaauuuaaaaauugaaauguuuucugacaaggaagaaaauucaauaugaaaaugugaaaagaccaguauuuuaacuauaaagguaagaaagggcauaagcugcaauacauuuuuucuuaucucaauaucugccuuagcagcucuaccagguguaauuuuaaaauaggaauaaauauuaucuuagaagaacuuacauuuuuauuuaauuucacagcccagagagucaguguuucaggaggaugacaguugaaaugugaccuggccucugcagauuccugagugcuaauagguguuggaggcugauguauucauuugcuuuccuuugaaaugacaguuugcaguguguggucuugaauuacaggacucacacaauuuuucauccuuggccgaguaacauuucaaguguguguguacuagucacuugcuguuuuugucucuguuuucaucugaucuuuaauuuaucugaaauacaguaaacuauuguuaaaaguuugaaagggacugcugagugcaucccaugcauacauuaccacucaguauuuacaguccugugagucuuaauuguggcagguguauuaacuccuguucaguuucuguuguuguaaaaccucaucacuaaaacaaacuugaggaggaggaggaaaagguuccaggcucccucaaucuaaggucaaaggcaggaacuaaaauaaagcaggagccaugaagcaaugcugcuuauuggcuugcuucucauggcuuguucaguuugcguucuuauaguccucuggacuaucuugcccugggaugaugccaccacugcauugagcuuggcugcccacaucauucauuaauugagaaaaugcccuagagacuugcuuacagucaggcagcuggaugaaggcauuuucucaguugagucuucuucccagauaacucuagcuuguguccaguucuuaaaauccaagcaaggacaguauggaacuugggauucuccugucuuagcugucuuagugcuggaauuauaggcgugcaugguaaaugccuuguuuuucuaugcagucguuccuagaaaaccaguuucuugauaucucagcacuuucuacucaaugacuugguaucuuugagccauuuguucugacuuucauuugcucauaaaaauuguauuugcuucucuuuauagcauugauagguucucaccaagcaaauuuagaaaauggcauauaaucaaaaagaagcagccagguaucuacuuugaaccuuauuccuaagauaauuuuaucccuuuuugucaucuccuuuuagcauauuucuuguucauauauagauguugauauuuuucuauaugggcuuucuuauuuuuucacuugaugccuucuuguagcuaucauacaaucaugcuaaaauguuuucuuuagaccccaacagauguguguucacauuucacuucauacuauccuggcuggugaccuuguaugccuuuucuugucuccacuuucauuugcaauaguuacaaaaauacuuuggguuuucuuguuuguuuguuuguuuguuuguuuuguuuuguuuuuuucuucauuagguuuuuauuaacuucuaagaagcuccaaauagccggauggugguagcacacgccuuuaaucccagcacuugggaggcagaggcaggcggauuucugaguuugagaccagccuggucuacagagugaguuccuggacagccaaggcuauacagagaaacccugucucgaaaaaccaaauaagcaaaggaaaaaaaaaagaaacuccaaauagauccacacauaucuagcuguuuaaauuucugcaauggggaacagagcuaaaaagagauuucucaacugaggaaacucgaauggcugagaaacaccuaaagaaauguucaacauccuuagucaucagggaagugcaaaucaaaacaacccugagauuccaccucacaccagucagaauggcuaagaucaaaaauucagguggcagcagaggcuggugaggauguggagaaagaggaacacuccuucauuuuuggugggauugcaagcugguacaaccacucuggaaaucagucuggcaauucuucagaaaauuugacauaguacuacuugagaacccagcuauaccacuccugggcauagacccagaagaugcucuaacauauaauaaugauauaugcuccaccauguucauagcagccauauuuauaauagccagaagcuggacaaaacucagaugucccucaacagaggaauggguacagaaaauguaauaccuucuuuacacaauggacuacuaaaaacagcuauuaaaaacaaugacuuccugaaauucuuaggcaaauggauggaucuagaaaauauccugagugagguaacuuagucacaaaagaacacacaugguauguacucacugauaaguggauauuaaacuagaguguggaauacccaugacacaacucauggaccacaugaaguucaagaggaaggaagaccaaagaaugggugcuucaguccuacuuagaagugggaacaaaauaauuaagggaaguggagggugggaaggacuugggaggaagagaagagggggaagggaugaagggcagaaucagguaugggaggagacggaggagauguacaaucaggaaauugaacggagauguguagcaaugggggauggggaacugggagcagcaaccagaaagucccagacgcuagaaaagcaagaaccucccaggaccucacaggaaugacauuagcugaaauaccccacaaaggggagggagaacuugucgagaccauaucagagguuaggauggggccacccaccuauuuccaaaauuuuaacccagaauugcuccugucuaaaggaaauacauggacaaauaauggagcagagacugaaggaaaggccaucagagacugccccaaguggggagccaucccacaugcagacaccaaacccagacucuauugcugauacugacaagggcuugcugacaggaggcugauacagcugucugcugagaggcuuugccagauccugaccaauacagauguggaugcuaacaggcaaccaucagacugagcacagggaccccaguggaggaguuaggaagacugaaggagcugaagaggccuuauauggcaucagugggaggggaggcccuugguccugugaaggcuugaugccccaguguagaggaaugcuaggguggugaggcggggaguggguagauggguagagcagcaccuucauagaagcaagguaaggggggaugggauaggggguuugcagaggggaaagugggaaaggggauaacauuugaaauguaaauaaauaaaauauccaauuauaaauaugcaaaagaaaguuuaaauguuaguaagagagaguucucagaagaacaaagugccuacuugccuucuguccguccucccuuccucccucccucccuuccuuccuucagacuauucaguauuugccagucagaggcucuugaaugaauagcaugcuuuucauugaauaaaaagaauggaaauccauuacauucucuuaaaccagguuugaaaacccgaauagaguuuauuacugucucgcaugguauuucuuaacaaccuuccagaaugagcuggaagggagaaugggcgcauucugagaucagcuugggcuggucucaguaacccuuuccuguacacuacuuacauaugaauuuacuauagacauuguuuuuucccuuaggaauggcaucugucauugacuuuguccuuaucuccagacccagccucaggcuuucugcaaagguuuaccuggucuguuucagcucuaugauuguuagaaguaauaauggggacaggaaggggugggccugccugcuucuuuuuuuguuaaaugucaucacaaaacuaauggggucuggguuuaucuccugcuccauauuucuccuuacuuuacauaucaaugacuuccuaggauuuuuagaacaagcuuucagauuucuacacuggucacacuagcuauacagaaccuuuaaaauauagagauguuagaacaguugaggaacagcuauugucagugggggagaaacgagacuucacacaccacagcaaaaauaauggagaauggaguagagaugcagaaguguaauagaggcuguagucccuacaugucucacuccugguugcuauccuuuaugacuaauguuuuuuaauuaugccauguguuccuugucaucucacagaucaugucagcugagacacacguagagucuguguggugguguuauuuuaagauaucucuuuuccaccucucugucuuaacaguguuccuauguagugacauauucccacacgauaguuucuuuuauuuccuguuguguuucaaagguacugaggcuuuuacagcacaucuugguuuuuuuuuuuucuucuucagcagagaguacuguauuugcaaauggagagaucauucuguacaugagcauuucugaucacauagaguccuuuaaggagcuagaaugauucuauggagucucugagguguugacaggugacuggguuccuugcugugaauguagucuuuguuuuuaccauguuguagaaugaagccauuguuagccaggaacaaguuggcuuuuacacuguuguuagccaagcagaagcagccuacuuugaaaauacuuucaauuuggagggaacagugagugacaagucugacagagcuuucccagauguuggauguuuguggccucacagagcaacacaguguuucuucugugucugucugcacugagugcacuucuuguuuucuuaauuucaaugcagcuugaauuuggccuuaguguagugaaaaggccagaguguauuaguuugguaaacuguucccccccccccccacacacacacccaaaagaauaaaaugguguuucucuggaaagaacaccuuuugauuuaagaugauuuuccuuaagaagacaauggugcaauaaaauagcauuuccauuugucaguuaaguaaggugaagaagugcuaaagaguuggaccuacuguuaagugacaguuuagaaguuuggagaaagcaugugaaggacuagggcauaacucaaggaguaugagugucagagggacagcacuaccugggccuuuguggauugcuuggcuuggcgugacuuuaguaaggcaaacucuuccuguggaagguggcaacaagcucagauguagacguugcauguaagcugagcugacgaggcuagaaauacugagagaccagaggcuucagacucugaaguuuaaaggcagcuggagcagcagaaaggaaaugagugagcacaguggggaaaguggaagcccuuucuccauagaccuagcuaaugugggcaaaccccacauuagugcagagcuuaguggagagcauggaaaauaguauaguugcugucugcuuuuaaaaauacaguuuuauuacaacaaauccaaacuuguguauccauuuauuacaaaaaauccauacuuuuguucugaaucacagauugaauaguuggaaugaggguuaugucccuggcccuccaugaagaacaguugcuggccaucaugguguaaguuuugguacaucuauguguuugugcaugucugucugucugucugucugucuguguguuugugagagaaacagagacagagagaaagggguugggggagaaagcuuauguuauaacaaaaaguaguaugggucauaacuauaaaccuuguucaccacugugugugcaucugauggguacugacgucguagcauugauucaucgagcucauagaacaguggaagggaagcuuucugauggaauaaugagggcagugauguucaucucguggacauauuuugcuuauguacgauagcaccagaguguuuagcaguucuaaaaaggcagguauugaggaaaggagaaaagaggaaacuuaaaaacaaaguauaguacccaaggggaggugggaaucuuggaaaaaaauuauggggacaauuuaaggagcaaucaggauuuuucuagaaugauuuguuuuuaaguuugaauuuucuuuuuuuuuuuuuaacugaaaauucauauaguauauucugaguuuugugcuggacaccuacagcugggcacggggccuacccuuaacugugcuuauauacucaccauuggagagaauucauuuuuccuuuggaagcaguugucaauuggagauagcuucuugguugguuaggguaggagauuguguuuaguucucagucucagcauuggcaccucaucugacuuagaccugagaaugcugucacagucucuaaguucauaugucugucuguccuguugugucuggaaggcaaggucacuuggugucaucuuuuccuuucugccucugcuucugcaugauuuccugagcccugaggggaggggauugauaaagacauuccauuuaggacugaguguuccaaguucucucaggcucugcacaaugcccaguuguggcucucuguguuaguuccggucuacagcaacagggagcuucucugauaaugacugagcagacacugaucuguggagucuagcagaaugccauuaggugucauuuuauuccuguguuccuuuagcagaguagucaguguaggacuugugggugaccucaguuguggugcuggagggagaagucaugcucagucucacuauuuauaugacuuugaaucuuugccuaauugacaaaaugaagcccuaccuaccuauuuaucauuuauuaauuuaucugcauaauaaauguguguuuugaaagucuagguauccaaccuggcccuuaaacaugcuaaccaaacacagccugcauucuggucuucauucucaacccaaauggagacuauguguguaaauguauuucuuuggggggauuucuacacccauuuuaguucccaaauaauagacacagagaccugguuauuuuuauuaacaaauuacaaaccuaagcugggcagguucugagcuauucuuuuuuuuuuuaauuagauauuuuuuaaauauacauuucaaaugcuaucccgaaaguucccuauacccucccucugcccugcuccccuaccuacccacuccuccuucuuggcccuggcauuccccuguacuggggcauauaaaguuugcaauaccaaggggcagcuagagauaugagcucugggggauucugagcuauucuaacccucuaauuuauuuaccucccagccacaggcucuguguuacuugcaguuugagugucacccuggaucacugucuacaugugcuccucauagcaucucucucaucuggaccucaugccagaucccuuggcaaccuucuucuccuggacccucugccuuccucauggucuuccucuuuacuuuuccucucccucuugcucucccucucucccaucuucuucucccaucucuggucucugugggacuccuaccaccacaaccacucaaauuggaagucucacccuauuuucuucugcccaacuaauugguugaucagcucuuuacugaucaaucagaaggugguagagaagaauauuuacaaaaaucugagacaggugaugcuucauaaaacuaccaauaccagagucuggccugcacucaucucucugcucguauagagaucaucaccuaaauaauacaaagacaaccuuuacauagugcacaaagagauuaucucugcaaauguuuguaugugaaguucuuagaacgugccuggcacauuaaugcauugggaauuauuauugaauaguguugaugcaacaagcauagucuuaccuuaaagggaauagcuuauccugaccaaauaagaauuaucaugaccuggguacacagaguagaccuccaguuauguaucccaacauaguaauuuucugaugaaauuuuuguaguaacagaaaaaauagucauauauugacacauuucaaauacauuugcggaaucauuaggcugacuaaagugcggaacuauagggcuuaugcuaucuguugaaguucuuaguuuuuccuugguggaagcuaggaggguuuuguuuuguuuuguuuuguuuuguuuucacuuguuguuguuguuguuguaagguuucccuguguaacccuggcuuuccuggaagugcucuguagaccagucuggccucuuaucuuacaaagaucugccucccucugccuccccagugcuuggguuaaaggaguguaccauuacugcuuggcugaaacuaggaguuuuucauuuaauacuuugaaaagguuuuaucuguuaauucacaggguauuuggcuagagguaggcaagaaaugacuauuuggggggcuaaaauagcccaagauaaaauguguuugggcucuggaccuguagcauuuugauuucuccacacuuauucaaauguaaucaguuggucaaucuugaagaaaauucaggagaaggugcagcugcuuuccuggaacuuuguuuauaguucccucugcugccuaaguguaauauuuuguacuugaugaagccacauauuauuuaccaaauaguacuuauuauuguuuccuaggugcuuacugccugugaccuuagagacuggcuuccuccaaaaacuuuuuucagaaagauggugcuggggaguuuuaacucuacaaccuuuugcuguuaaaaacaaaauguuuaguaguuuauaaaaaauguguuaucuggcugcuguagaggugguucagcugcucuuugcaggagacccaaauucaguucucaucaccuacuucagguagcuuacaacacaccugcaacuccagcucugagggaaugccugugguuucugaccugcacuuaucugcgcauagccacacacaaacauccuucauacgugcaauccauuuugaaaucauaaucccuaaauuucuuugcuuuuuaaaaguuuacuaauauacuguauaucuucacacaaugcaaauaaguguguucuaaagaguauuauauaggauaaacauguauuuuuuaguauaaaauaggucauugauaaagacuuggccagugugaauugaauugguguauauaaacauguuuauguaaguugcaaaaugaucuucuccugcccuaucccuuuuuauacaaaagugaagucuaaguggggcaggagagaaacagaauuugauuagauguguucugugcagguguucuguuugguaggagcuuagagcuccaugguuuauucuuagaauggugugugugugugugugugugugugugugugugugugcgcgugcgcauuuacacuuagcaaaacguugcaaaaugaaugauugauuuuucauuuucuuaaaauggccacugauuaauauggucucuuugaaaccauaguauagauagacuacaaccuaaacugaaaacaugagcuaggagauuuuccagggcucccucgguuugguuccuuuaauguucacucuuuuguguguggugcucagcacguauuggauaaauaagaucuccccaugugguugaagguagguaccaucucgccuggagcuucuucuaaggccagcacaagcaaagcuuguuacuggagcaggcaaagggggcgggguaggggacccuugguuuucaccccucagucaguacagcucuaagcagggacuccaugucauggggaguuaacuuuaagcaaaagugggccagaagcuucuucucaguagcuagucuugccugccguaguacuuggcauauauguguaagaccagaauggcagugauauaggggcuacaaguaccuucuacucaucuccuuuguagcuuauuucagcuuuacaggcuaaggagguauuugaagcagucuauuuuuauucuuuaaugguuugaauaauaauacaugauaaccuaggcuuauuucuagugcacuacuuuucucuuguuucuacaugaauaaaggguaguaguguggcucuauguugcagguacagcuguuggcugcaagguuggaaauguccuugacacuggcugccuuccugcucaggcccagaacacuggugcaguuguacagggaguuuucucuacaacugagaucuuguuggucuguuuuuuaaaguuuuagaucauuuaauaugaugcagaaaugagaaauggagaguuuuuccuccuacuuacagucaguucacuuuuucuauuuaugcuagagcagugauaauacgugcuugguguuuaaaaaccaagcauaaucccacuuauaggauggaaguacacuugcuuagagguaaauguaagcugugguauaguuuuaauguucugacuagugcccguuuccuucaucuucuaaaucagugguucucaaccuuccaaacacugcaaccuuuuaauacaguuucucauguugaggugagcgccccaaccucaaacacuaagauuuuguuguuuauuuaugacuaaucuugcuacugcuaugagucguaauauaaauaccugagauuucugauggccguagguaaggcaaccagaucucugaauuuuaggccagccuggucuacauagugaguucuaggacagccagggcuaugcagagaaacccugucucagccccacuucccccaccccaagaaaaggaaagaaccugguaguaugcugccugcuuaaggcugugccgcaggcagccucuccacugaccguggguauuucccuccucugcuuauggcuuuccacaaugcuaagagugcuuagaggaugagugaagccuguaacaagaaaguguauucacacaugauuccagccugccuuucauaaugauaaucacauaugaguaauauuuuugcacuccauauugccuauuagguuuucucaugagucagaaucauguaaaucgauuccauagucugaaaaacacugcaccauacaguguuucguggaacacaggaguuuucucuuucuccugcccuguuagaguuugcuuuuucugugggugguaagacucuccugagcgcugaggaaguggaguccuuugcccuuugauuucuaacaaucaaaucuagccauguaagcaaaugagguagucaccuaucagauuuucauauacuuucagaccugauaaacacuuuaauucucuuucuaaaauuuuaacuucuauuucacucuguaacugcaaacccugccucacacacauuucuaucucagcaaccaaagugcuguuuguuuuacucuuagugcccaagcuccuccuagucuagggucuuucagcauccagagucagcacccuuggcagcagagagaaaaaccauuucccuagagagcagagacauccagggcagagccauuguuuucaagcacugaaccuuuccaagggucgauuugccagaaguuggauggacuucaccuugacuguaaacagcccugaggcauugugacacaagcagcauagaucacauuaaacugaccuuugcgccacagugugacacuugaucuugauaagagaauuagaaaaggaaaucaaguuauuauuaaagggaccagacuagguaugcuauauaaagagauacgacaucucuucuugucucaucucucugugcagccuugaccagaucccaaugugggcacacuuguaugcucggauggaauaaaauuauuuauaguggggcuucuguggugccagauuaauugccuuaucauugguucagcucugcagaugagauggacuguuuaaagacugugaugguuuuagaucacacuuuaaaucuuuuaauaguagaaugcugaugcacauuucuuuggucuucagcaaagcaguucugaaugcaaaccuugcccaucuggcggccuagugccuuucccuagagcauaauagucuugauggaauucugaacagcuaguucugccuuuguagucacaucuuauuucaucaauuguugugcuucucauuuccuucuguuugaggcggcccuccgugcuugcauuuccuccuuacugguucgcuguccugaacuggaaugugugaggguucggauuugcaguuacagaaugaaauaggaaguuaaauuuuuaaaaagagaauuaaauauauuuaucuggucugaaagugaaauucugguagaaaguuaccucacuugcucacaugacuagauuugauugucagaaauucuagaaggaauauaagucacauggacugguuaaaaauaaucuucagguucuuggguuuaaaauagcuguaggaacagucuauguucugucugccuugucaccuauuaauauuaugucugugauucagagagaaaguguauguuuuuuuuucccccaaaaaauccuugaggaagugcaucaguaucaugcuuagaguaccuucuuguuagcuauccugccaaaguugcuugcacuugaguccacuguuugucgugaauuguauguguuuuuccugguguuugaugugauagucguugauaaucuuuccucuuacauucucagagauaauuuccuauucuauagcugugacuucauuucucagcccccauccauuuccaugugcuuugauucuagacaccuuagcaucucuggugaugaugucuccuuucuguccaguguaacucugucccuugacuuuuaugcucuuagucaucugucuacauuccuuggcuagacaccuucccuguguccuguagaauuggaugcugaaacacaaucuagggaggucuuguuuucaguucuuucuaaugugccuaaaaauugcuuauggcugaguugcaagguaucuuuuuuuuuuucuccacaaggcaaagguuuauugggagagggaaggagacaaagggggcugggggaagagagaaagacaagagaaaaaaggcugcaagacaucauauuucuucauuauugauuucugcacauuuauuacacuuucauacaaacucaggcuuucaaauuucauaguuacacuuauugucuaucuccaucucugucucgcucucucuuucugucucucugucucucucucucuaugugucucugugugugugugugugugugugugugugugucuacacauacaugauuaugccacagugcccauguaaagaacuggaaaacuuuaggaauuaguuuucuccuucuaccauguagauuccagggaucaaacucagguugguagguuucaggcacuucauacgucacugaccccaguuuuaaacucccuuauaagaggcucaguuauaugaaccccaugcuauucugguuaggguuucuuuaacugugaugaacaaaagcaacuuggggaggaaaggguuuauuuggcuuacauuccccacaucacuauucacaucaaaggaaauugggacagaaagucaaaacagggugggaaucugaaggcaagagcauggagggugcuuuuuacugguuuccuuccuauggcaugcuaagccugcuuuuuuuauagaaccuagagcuaccagcccagagauggcaccauccguauagggcuguguccuuccccaucauuaauuaaguaaauggccuacaggcuucauacagcagaucuuaugaaggcauuuuuaaauugugguucucucucacgacuuuagccuuugucaaguuaauauaaaacuauccaaacacauaguaaaaucaugaauuaaaaucauggugucaggcugauccuaaaacaaaauuauaagaaaauccuaaauguagaaaugggaauucaauuuuuuuucugaaauguuuaauguguguuaauuaaacuuuuuaauuuuuuuuuaaguuucauuuuucuucugguuauuuuaagaacaguacuaugaguaggagguguuccauaugugugcuuuguuuaacagaaauuugcaaguaauaccacccucuuccccuaagaaggaaaaguagcauugaguguuuuccuaggggauacuuuuuguggauuugucccugaccacuggggaguuaguuaguggucucuggggcagggaugaguguugguugacccagucagugcccauccuuuaccacugcaggguucuuuaaaagaacuagaguaaauaggcaucacuaggaggguggaauaagaaaaucagauguggggcauuucuuaaaagcugacuuccaagcuuuguuaucauuggauuuuuaccaggaagugugcagaugggucugcgguauucagaagcugggaagcucgacugguuguuaguucuguaccuuuuaagagucaucccucucucagugucucaggcauucuuuggggaaaugaccagugacauguuuacuacccucuuucugauguauauuuaugaaaagaauaggcuaagguuuucaaguagaaacacauuugauuaguuaugcagacaucucuacuuaaccaauguaugguauagucaaguauauuguuccuguuguaguuaguugccugaauaugucaggacauaaaaacaccauucuguagacuucccccuccuucugcuacucuucacuccacaacauacccacagugcauaguccucacuuuauuccacaguuucuuacccauuugccuaauggguguccagacucuuaaggaacuugguccagagauuucaucaugcucuagaaaaccauguguuuaucgcagcuguaacucuagugacugaauaggaucauaugcuuagcuuuccuccaguuuaaaaaaaugaugaugcacacagaaacaaugguuuuuuuuguuuuuguuuuuguuuuuccagguaguuuucuuucuggggcugguuuaaauccuucugaugggugcaguuugaacuggcagaggagaagagggccuguucuauuugcuucauuuacuaacaugguuucacugagguuuccucagcuugguguuuucuucuucccacuagaaccucauggagaccaggaaauuggguagcagagcuaugaguccagagccaaaaugagccuuacugugacaggaagcagcuuuuggaaaugcuagcacuugacuuguugaaugaguggcaguuagucucugacagcuucuccagguagagauuaaagagucuuuccagaauagaagggugauggacugaguaaaugccauccacccagguguuucaucagcuuugugcaucuccccucucccucccccuagcaugagagucacaucuaucaguacuaaucuuuuuuaacugcugggcugagguuucagcuaccuguaccuuauaauaaguguuaaaucucaauacgagaaguguguuuguuuguuuguguuuauuuuguuuuggaguuuuucuuguuuuugagggggugguacagaaaccuucugagaacagagcaccuagcauuacauggugagcacuuaguugcuacuuucucacacucauauauaccauaguaacaugcuguuugcacucaguguugaauuuuaguauguugcuuuuuauauuuagggguuacuacuaaggguuaggacucaagaaaauaaagucauguaccaaaauuuagaaaaauguuuccugacaugucuaacuauugaagagugcuagguaccucccuagcaguacagugugcucuguugaaaagcagaguaagauuuccucuagaauuuucacuuuaaaauguaaaguuuggagaguucagugaacaaacuugaccauuaggcacauggggaagacaaaguuuaugauuaugcuuauaaagugugcucauucagaaaagcaaaaauuguucacuugcauuauguagaggaaaccagauaauucuauguacuguguguuuuuuaugcuugugcauuuuuucuaguaugucacacugcuuccugguggaugacauagguaugucugugucaguacaguacucuugguggauuuagugguugguagauaguauguugucccggucaacugaaacuuaacaugcuugugcuccaaaacacugucugggauauaaaaacaaguugucaguccuauaauucuggcucccagcagggaaguauuagcuguugcuucuguuucucuaacaauuccuucuguuguguuuuaaugguaacggagaauuaaaguggucugauagacaaguuuaggauguauguuucaaguuugaguauaugagguuuugacugcaucugugcagccuuugugcuggcaccuauuucaagcaacaaacacaccuucuauucuaguugacagcuuucguagugacuuuguuucacgcuuucugaaaguugguuaggauuauauauuugcugucaucuuuguuauauagaaguccucauaaauacgaaggaacauauuugccaccuacucucuaaaguaacaagauccuaauuugaacagaaagagacuaucucacaucaagacucuuauuaguucaaguugaagcaaguuugaaagauugugucuuccuuucccaucuucucccuguagagccuccuucucaaggcauuuaccugugaaacuccaagguacugaagcaaaaguuaaaguaccagaagaacuaaauuacuuaugagucugucagugauucuuuuuuucuuuuacuuguuuucauuugugugugugguauguguauauuugagcacaguuuugugugcauguaugcauguacaugcaugcguguauuguuugggcagaugcaaauaugugugcauguauguggaggggccuuguucuuugaucugcuacaccuuguucuugcagacaggaucuuuccaucagacauguagcucacuaauaaacccugucuccuaagucugaaauuacagaugaaucaccauuccuacucagcauuuaggugggcucugaugauucagacuguagucuucuugauuaccaagcaugcacuuuaaccacaaagauaucuaucucuucagacuuuguuucuuuaaucaaaucugguaagcaguuaaaaacuguucauguguaagaacuugccucccauuuauguuugcccagaauaugucagcaccuuugugaauaagcauuuaguguugucuucaucaucucugugacuauccuguuuuuucucguuuuaucuuuaggucauugcuucuuaaagcuaaagacaggcacuaucuguuuuauuuaguguugauuggguucuugcagauuuuauuggaaugguuuaaucccaaauaauuucuuucugguacugugaguggagcugaauucaaccuuuccagaauguuuagauacucuuuucucccagaacuuaauucuccugcuuggauuaccuauuuucccagcucuggagucagaccauucuuuccuuauuguauaacguggacugggauagucuuugauagacuacuaaguuacugagcuaaguagagaagccccugauccuuagagauaaagcuagggcugcaagccaaaugcccaugggaaugggaagacaggaagacuagaacaaggacuuguagccccugccauaucugaggggccuagugcuaccaaauggccugauuguccagagauguuaaaaauaaggguguaugcgugcacacacacucaaaaguuucaugcaugugacuuugugcucucaaaaccuugagauugcuauguguuagucugguuucucuuuuaaguuuggacugaauagaauaccugccauggcccacaucagaucccacauaacccauauacuucaaacacuaccuuuuagcaugaacaugccagugacuuuaaaugaccucagaccucauuugcucacuucugaggagugcaugcccugacagagguauagcacuuacacagacuuguguguaaucgucuucccugcuuuuucagggccucucagugcagagacuuuucaaaaggcaguguucuuucaggccacuagcucaccuguggaacauaucagauaugggugguuuuuuguuuuguuuuguuuuuuuauuguuuuuucuagaguuuucaauagcaguauucuuaauggagccaaaagaaucuacuaacauaaaaaccggcuuccacaguuuaaaauggagagguugaaaauuaaucaugacuaccuaauaaucaacuugauauuuauuuaauuucucuuucuuucuuucuuucuuuaaagauuuaaacauggaauucaauccuucagaccauccucgggccagcacaauauuccucagcaaaucucagacagacgguagguuacuaauucauuugcuuuuaaaaauauagcuaaccuaaauguggacacugcuaggacuugauuuuucauuuaugauagaguucccuuuagugaccaugaaguacuguguguaauggugcucuuuguuuauucugugguaaugaauuacauuuuuacaauuucacauuugaagcaacugucuucauuuugccauuagcuagguuaccucugauaguauucuauggugaaaguuaauugagucagaaauuucccuuuaggcacuaaaguuuaggaugugacacuuaugaaguucugaaagaucagauguguucacuugugugauaguaaguaaaaaaaaaaaaaaaucuaaaccuuaaaugaaagccaauuaacucuuucuguccugucacucaucagcucaguugaaccugcauaugagaugcauauccuuucguuucauuucuuuccucucccuccuccuucccuuccccuccuccuccucuuuucuuuugccaaacuuuagguaacuagcucauucuaaagauguuagaauucuuacagucuguccuagguguguguauuucuccuauggugugggcauaucuuuucuugccccauggcuuaccucccuguucucuggccauugguuucaaagacgaggaaagauaauacaaacucaguuuuuauaaaucuucuaggacaccaguagggcauaauggcaaagugaacaggguaugucuggcgaaggggaaaaccugacaguucuacccuugacagauuggugguucuaauucaguuuagguccuacagagaccacagagaagacaaacauaucuaaaacaguaguuauguauaagaauggaggacuccucaguagugggugggugucagcuuugacauaacaugaaugauugucaagcagaguacuucaaaaaagucuccaagaguaagaagagaaaaaucaauaagcaccaaauacuggugaaagaugcuuucaaucuauuagguuaaaaagucaaucccaaauuuuucucuuugacaaauaaaagcugcugagagguauagcauauuacaaacaaaagaagauggguuaggauagggugaugaaaaugaggaucaaaacugauuuuccccaaauacuugagaacagugagguaagaaaccagugucaagccuggcgguagauaggguucuucugaugagcuaagaugucuucccuaugaugucuucuccagugaacgucggagccuuugggugagugauacacugugacuggccugcucaaggaaggaagugaccuaacaagaaggaaggauucuuccagaaauaggcaguggcuguucauucugcuagcuuccaucuuucuuccuuuuuaguagaacuucagaucuuuguguauugcuucaguuucuacuaacuacuagggcuuucuucucuacaugcagacauaacugaguuucauauuacaaacaaaaagaaaaguaaccucuuccaggagguguucuucucugcucuuuccauacagaucgcuucagggggacauuucaguucuguggcccucacugccaugacuucuaucgcucuucaggcagagccauuugcugaaaacaauucucuuuaaugaacagucaauuuaucacugauuuugaaaauuguuuuuuuuuauacacguaacaaucuuggcaacuuuaacgacuuauuuuugagugaaguauuugagagaguugugaaguaguugguuacuuauuuuaugaaacaacuuugaacaacuugauacagaaaacuuaaagcuaccauugcucuucuguucauacauggccaguuaggacaauugccucacuuguuccagguugcugugucuguguuuaccuguucgcuucuuaguuccacaucaucuucucuuagcgccugccucugaugggauuucauagugacucagaguauaugguccugauggaaaccuuuguuggguccaggcucuccucauacaucuagagcagugguucucaaccugagagucacagccccagguagcauauaagaaauuuacacugugauuuauaauaguagcaaaacuaggguucugaaauagcaaugaaauaauuuuacccuuggggucaccacaacaugaagaacuuugcagcauuaggaaggcacugcuuuagaaccugugcguugaacuggcagauuaugcauccuguauucaaaauggcugccucuccuuagccuccugucaugccacugaucucuagacauuuuagcuuuguaaacaccugagcucaagaccuuacccucgucuagcucugaauuacucugugacaaaauacaauuuuuuuucuaguuuauguauuccucagcauuuuuuuauauuaaccuuaugugcugugugcuggugaacuuuggaacuguagauugcuaaacaccaucucacuuaccuguuuguuuuuucuuuguccuaggaacaaugguauuugucucuucuggaucuuuuaauuauggaguacauuauaacuaaccauauucacccguuuguguaaccgaauacaagacuugaauuccuagccagcuauguauuuuuaccuguaaucagccucuaugucccacgcuccuaggccuguaacuauuguccuaugcuguacuucuaugaacagcccugugucaagagaucauacuguuugucuuccucugaugacuuauuuuauuucacauugaauuucauuauucagagugaacuuuuugguuuggauucuugaaacagugucuuguuuuguauuccauacuggaacucagcauuucuccugccucucagucucaguacuaagauugcagguauaugccaccaacccaaaaacuaucuaaacuguuauaaagacuaucuguuuaucuauauugccuucugcuugagaagagagauuguuuucuucauuuugcucuuucuaaguaugcugcuaccagguauagaaaguugauaaaacaggggaacaaaagcuuaaagggaggggucuuacuacuucauucucacuagcuaaaccacuaugagauggcuuuauguagcaauacacuuugucccucaaucucuagcuugauuauaaugggauauagcccuuucguaagcagcgguucucaaccugugaggcguggccccuuugagggucaaccaaucuuuucacaggggucacauaguagucuuauguauuagauuucauacugcauuucauaacaguagcaaaauuacaguuacaaaguagcaaugaaauuaauuuuaugauuuagggggucaccacaaguugaggaacuguauuaaagggucaaagcagaggcaggaggacauagguauuucuugcccagguaguaaauguguaguucuuuuuucccacucugaauuuaguaugacuagccugcccaccucuuucaccacacuuaucccuugagcuguaggagguaagggcuguguaugugauggggaguggggaauaaaggcucuuggccaggccaggucugugagggauacuuucuucaggugcagggguuuggucuucucuugaacauugccuuucuuugagcauugggccuuucaaucugaacacaauuguuugcauaguacagacuccaaugcagucaguuagagcuaaagugaguuuuucuucgcuuuuaccacagucuaauggugcccccaggugcagugguuaggggacuuugucaggaaauacagacacagaacaaaaaaugaugguggugauuuguccaacaggguaggguucucucccuuugccaccauagugucauucuacugaugauagccuugugcuguggucuguugguuugaaguaauaucuaguuauuuuucaucucucaacaccuucagcucccccucuaucaauaccaaacaacccucucaguguguuucauagcauuugauuaccugagccgugacaucuaggaggcuacagaaauaagaauauguuacagacauuuuguaagaacagcuagaagccacacauagugauguauguaggcuuuuauucucaguacuugggagacaaauaaauaagcaaaaccaaacagaacaguuacaaaucuuggguggauauucugaauuccacagugacucaaagcucagaaccauagcuauuuaucugcucuuuguaaguauguuuuuuuuuucuaauuuguuuuugcaugcacacaucuaaaagcaugugggugugucugugucuuagguguacacauggcagauauccuggggcuggggguucagaggcauuaaguccuccuggagauggaguuguaagaaguuguaugcugccccauguaaauguuguaaaucugacagagcucccuuggaagaacaauaauuaacuaaugaacuaucuuuccagucccuggauauguuuuucaucuuucaaguaaaguugguaacuguuucugagacuacaagaaagaugggaaggaugcacagucuaucagaacuccaagcacaguacccagacuaguaccacagucuaaguaacuguagcccagcagccucuuuacauuaaguuucuuccuuuggcuagggcugugccaucuucucucuggucuugguuucagagauuugcuacccauagcaccucacagcagagcacagucuacgaggagagaagacgcacuucagcugagagugcaagggaguucuuugcucaacuaagaacugucuuucuacuucuugguuuucuuacuacagauacauuggucuuggacaaauuuaagaguuacuucugaauaucuuggaagcaaaccaggaauaggucaggucugucagaugauaguaguacuuugcaauaauguacccagucaacaccuugaaucaucaaaauaaugccucaccuccaccaugugcagaaugguguuagcucaguuguucaguguaugcacgaacucaugggcauccuaaugcgagacaaguauacaugugagcuuaugaaagcaguagagaaguugggcauggugauacaugccuguaauuccugaacucaaggggcuguggcaggaggacuaggagucgaggucagccuggucugcaaaguaagacccuuuuugaaaagaaugaaaccguggagaaaauuuccuaaaaauggaaucaaguaggaaaaauacaauacauaugacaaaauacauuuguauuuuaaaaaaugaaaauguagucagugaaaaugcugauagcaguacaacagauaacguuauauugguauguuuauaugucagugcauucaugaagaaaaacaccuauuuucaaaaguauguauuucuauaaaugcacacaggaaagagacuuuaaaauaucgaccaaaauacuguguugggauugcuauaguauguuuucucucuuaauguuauuucccaagcuuuacuuucuauuuauaccauuuuaaccucuuugucauagugcuuuacauuuuccaauuugacauaaauauguuuuuuauaaugagaaaucauuucugguuuuaguugguugacuuuuauuucuggugauaguuggcuguguuucugaagaaauccucuggcccuagguauugucuguggaaacaaguugggugauagauuuuugugguauccugccgcccuuaucuucuccaucucgaaguuuccuccugauuuuacacagcugggaaauuguucuuucugucccuguugucuccuccuugcucauuuguauuuccuccugaauguacagaauaucccaauccucaggaucuagaucuagaaauaaaagaucugcuagcaguucaagcucccuuccugcauccuugugaaaaugaccucaccaggaugcccugcccagggcuaggaagugugagcuaacauccucuuacaguacacuuuguauucuggccauuguguucucgaccucuggccaaguuaugagcucaagaaaguggaaguuugauauguacuccaaacuaggacuuaccaguuguauuuugguguguguguccgugcgcgcauaugugcgugugcuguccuaugucuauguagagcaggcugguuuugaacucacaagauuuaguguuuaggggucuauggaaccucacuggcaaacaacucaaaaagagguaacccauucugauauugggggguuuauuugcuaaugcaagugaggcacuugauugucuauuguugaggugucauucccucucccuuccuuauuggaugacuccauuuaaacuuuuuaauauguacauuuauuuuagaaagcuucuacaguaguagguuuccagguaacuucuuuacgaagccuuuggugucaguuaccccucccucauauucccucuucuacccugcuuuccacuccuacccgauuuaauccuucuugccccauuauuuucuauuuucucuuuucucuucauaccaucuguguucugucucccuucucugaaagcaucuucuacgcccaugacccuuuauuaauuuccagaccucuauggacaguccaauuuauuaaacaugcauauguaaaaauucaaaacaagaaucugcauauuagagagaauaugcaguguuugacuuucuggguuaccucugucagaaugauuccaaaucuaucauuuuaccaggaaauuuugcauuucuauuugcuuauuagcugaauaauguuccauuauaaaaaucuaacacuucauugggugauagauaucuggauuguuuccauuuucuggcuauugugacuagaguuucagugaauauggaugauuuggucucuggauaguaggauauaguccuuuggagagagacaaaguguaugguuaugugguaggucuaucuuuagcuuuuugaggagccuccacacuaauuuccauaguagcugcacuaauuuguguuuccaccaucagugaauaugccuuuucccauauccagaccaacacuugguaucauuuguucuuuuagucuuagccauucagaucaggguaaagagcaacuucaaauacauuuuaauuuacauuuccuugauggcuacagguauuguacauuuuaaaauauuucucagcauuaguauuuuaucuuuggagaauucugauuaauuacaugcccgacuuuuuaauuggauugauuuauugacauuuaguguuucgaguucuuuguguauuguagauuagcccucucucagaagcauagcugguauuuuuucccauucuguagacugccucuucucuccaguuauaguuuacuuuguggaacugaagcuuuucuguuucauggggacccauuuacuuguugcaggucuugaagccaguauuaccagaauacuguuuagaauaacuuuucuuaguuguguaaguuaaagcauauuuucuauuuucuccucucacagauucggaguaucaucaggucuuauguucagguccuugaucuauuugaaguugaguccuaugcaagaucugaaauguugaccuaguuuuauuccacagauagcuaaacaguuuuacuagcacaguauuuguugauguugucuuuucuccaauguauaguuuuggccuguuuaucaaaaauuacuggcuaugucaguaaugggcuucaguucuacugacuguuuuuaugccaguugcugauauuauuacuuuguaauagcuuuguaguauaauuugaaaucugggaugaugauaacucugacaauuucauuguuuaagaaucuuuugaguuucuguauucuuuuguguuuccauauuaacuuuaaggcugcuuuuuaaaauuucugugaaauuggguggguuuguuuguuuguuuauuuguuuugagcuaagguuucaaaauauagcucuggcugaccuauaacucgagagaucuaccugcuuuugaugcuggagugcuguaauuaaaggccugacccugcacuggaauuuugaaggagauuguauuggauauguaaauugcuuuuaguaggaugaccauuuucauaguauugaaccuuacaaaucuaugaacaugggaggucuuucucucuucugguaucuuucuuucaguuuucauuuacaaguguuuaagaacaagguuccuucacuugcugggcccaggacuuugguucagcuacauuggagacaccaagaguguuuccuuaugaaucuagaacaacuguaaguguagaaaacuccaaggccuccaguucuuggcuaaagggcuuuguggauacaaaccacaggauaaugcuugcucagaugaaaagcugaauuugcacuuuguugagauagcaccuucuccuugcagaagccuguccuucauauccucuacaaggaacuacuugguuaguugauggacuagaguaugcccaucaagguuagucuuuagaaaggacaacacaacauucagugacaguaguuuaucacaaguuuccuuguguucucugacaaccuucugguuucugaggcugaaggguugcccguugugacaaaaacugaggcuaaaggcaugcagugcaguucagaauaugcaggagcaaggcuggacaaaacagcauucaguaugggaggcucaucugucucucugaguguagaaacugcaaaugcuuccuggagcuuccugaaacagaaggaagcucaggccuguuugcagcgcuggccagaggacccaagugucuuccacugcacagcaaguuuuuuccacaucacuuggucugcuauuagggauaucaguguucuuacuaauuauucauucauauaauauuggucuacaguuacuauguaagugacuguguauugaccucuguugaugaaguuuagaucugccauuugugcagcuucuuuacacuuuaguuugguaaauaaguaacugggaaccuugguugguaggagaauaugagcauagcaaagaggcucaugucucugccaccugcagggguugcuauguaugcaagcauaacauuuuugacccauguuuuguuuucacagugagagaaaaacgcaagagucucuucauuaaccauguaaguaaaacugccuccccauuuuuuauaaugauuguauaguagagugugugguagggaaagacgcccuguguguugugugguacuaaaaagacugaggggugaugacaugaugauucgcuaggcauuacuugggagucacuuccgcuagcaugucuauuacacagguccaaaaaaaaaacagaggcuuuuaauuuugaaccuuucauuucugcuccuuccgaaauuccuggguuuuuguuguuguuuguuugcuugcuuuggcuugguuuuuguaguacacuucccucugaguaaauguuauuagauuucaagaacagcuuucugcuuccucuuucucuucuacacaauggauguuugugggacaguuccucacaguuuuguuuguauacucaagaacaaucuguauguauggggagacuaaauuuggcccuuuaauuuuaaaagcauuuucaaaauuuuccucuagugccuuggccauucugagcaguauaucuccccgugguggcugcacaggauaggaacagguauaccuaccuucuccagccucuccccaccccuccauggcaaacugucaacagacaagcuguaaccaccccucccguucuaaucauguuuguucuuuaagaaagaaaacugcuccacaagguaaggaaugauauaguauaguuagguaaacugcuaaaguaagugugcuauaaauaucaacucacacugaaaaucgcagugauggaucugacuuuacaaaagcuuggcucaggauuccuagccugcauuuuggaacuuguagauccuaauguguguaaugauaaagcuguauauuaaagacucugaaggccaucagaaggugagugagugcuggggucauaggaaacuggugaucccucugcagcaaugacagcuacuacuuguaguucacuuucuagaggucagaagcucucuaaugccuaugggcuaauguuuuuuguuuuuuuuuuuuuuuuuuuuugcuuguguuauuugagggugcauggugugugugugugugugugugugugugucucugccugccugucugucugucugucugugucugucugaguuagaagguguauuccugaaucuagaaagggcagggauugaagauuaguucucuuucucaguuauuuaccuaugguauguacuuggcuguguacccuacguugacacucucaugagggaugagcuaaaauugccaccagaccccgauccaauuuaagggcaugugaaaagagaagguguuugauuguccaggcuacuccugauaauaguuaauggaacaggugagaucucacaguuccagucucuauauuuguuuucauauguucuccacucuguccuuaccuacauccuaugcaguuuuggcacaugucuccugcuaaaucaguagacauguacuggcauguggauauggauacuaggcugugcauccuaacucaagcuucccugaguguuuaccugcugucauacaguggaaucagacagaugauguuuucuuacauguacuuguuucuggauaaagauagcuguguacuaaguuucuuuguaacaggugacccuggaacuuguaaucuuucacacuguucacagacuugccugcaaaugagcauaugaguucugcuucaacuagaaaaagccaagugcuguucagccacauaagacagagucaaagugagacuaucugcagacuggauuaagucagaacaacaauugugaguuucacagcuucucacauaaaaguuaaaagaaguagaaggggagcuggagcagacuggagagauggcucaguagguaagagcacugacugcucuuccaaagguccugaguucaaaucccagcaaccacaugguggcucacaaccaccccuaaugagaucugacacccucuucugaugugucuaaagacagcuacagugugcuuucauauaauaauaaauaaauauuaaaaaaaaaagaaggggagcuggagaaaugguuccacaguugggagcacuuguuuucagagaaugugaguucaauucccaagcacccauguagggaggcuuacaaccuccuauagcucuaggggaucugacauccucuucuagcuucuucagggauauacauauacauagguacacacauguacaugaaaauaauaagagcaaaaauaaaucaauaaauaaaaaagagcaguaggaggagggugugaaacacugacaguccguuggcccaaacucuuaccaccugacuuggacaguguccacuccagcucagcacucagugaacccucacccuccugcuauugaacaacugaggcauaaagaaacauguagcagaugugcagcuuauucuucgugcaggucccccaacaacuggagacagggcuaucccaauaucuguucccugccuguggauccuguuucccuaacuaggccaccuugucugacuucuguggaagagauguaccuaguccugcagugacuugaugugccuguggagcagggcagggacaagauaaccagaagagggcucucccuucucagagaagaaggcaggagauucugaagaaccuguguaguauguauugcucaggcaaucuacaaagagaauguuguuagucaagaaacaugaaagcgauggcugucuuugaggagaacugucagaguucccucugcugccagcuaaauaauagcagcuauagcugcauuguuugcuguucucauugcccugaucaaauacuugacaaaaaccacuugugggaagaaagauugauuuuguuucaguuugagggguagaguccgucauggugggaaguccaugguagcaggaacauggaacagcugguugcagucugaugaugcaguuagaaaugaaggcuggcacucagcucccucucucucuuuucuguagccuggggcucuagcccaugaaauugugccacccacauuuaaagucucccucaguuaccucagucuugaaaaucucacagccgugcucagaggcuuguuuccuaggugaucuucaaucuuauccaguugaaaaucucuguuaauggccauagccucugggacggugacuuccuccagauggaaauguuccucuggcucccaguagcacacacaccagguggaaagaagccccgaccugucucuuguaagaaaugagucauaggcuagggaaggaacuaaaaggguuuaagggauuaaagugucaacccuucucaagauuucuuacguaggaagaaaaugguuugggagcaccaacagcagcuaaaacaaguacuuagauuaauauuccaaucauugcuucuguuuuagauguaauuagaauggacaaagaaaaugugauguuaugaaaauguuuaaagcuuuguauaauggucuuuauuuaaaauuugacuuuuuaaaaauauauuugcucaaguuuugcuuuuguuuuucuugaaagugagauacuuaaguagaucuuuaacuaaaauuugaaaaucucugauuauaaauuacaauguugcagauaauuguaguuaagagucuucccaaaauauaggcagaacugaauuugcuuuauuuuucuaugaccuccuccugccuucuacugacagcauauguaaugugaaucauuguacagcauuuaaugaaguuuggggaugguggaaacaagacauuccaagacaggaucaggaguggaauggcuagucuuuuucaugcucuuuucacugcauauauguuuugaaaccaggaagcugaccaggaaauauucugcagugucaugcucuucaaaaaguuuagagauagaugauuguucuaaaaacuucauaaggaaauaaugcaaguagaaauccacgugucaauaauuuucacgagucagaccagagccaaaagaguuuuggagcuacuuuuggcagucuugaaaauguuugcaguaguagacucccugucuucucaacugggucaugauggcuguccuaugugacucggggaagcagggaggggaaggcgagcuggagacugaugcacguguaggcagguaguaugcucgugcacacgugugcucuagucuuccagguucuguacgugcacacgugugcucuagucuuccagguucuguauuagcagcugauggcauuguuuuaguauuugaguauaauucaggaaacuuuguuauauaauuauuaagaauaggauucucaaguggccauauauuguauucaucucguuuuaagaacacugguuuaaguaguuuuuuuuuuuuucuguuuguuuuguguuuaauguaguacagcucugaauugauuguuuuuugugagcugugagugauugaaaaagaauuccuuaagaaauggaaucuuugcuaguuucggucuguaucucaaguuauggaaguaaaagaggaagugggaagucugaaaucugauguuuuuaaaauucugaacuuugcuucuaagagaccuauucuuauuggaggagaaauuugucagauagcuaguguacuugguaucaauauaguauuuugggggaaugcuaaaaaagacucgguaaaauuucaguuauauaaagauuuuagaucugcuaggaugaaggaauuggacuucgaagaaguuucaaguugagagaaaaauuacaaaguaaaaaaaaagaugcaaugcuacuaagcuauuuuugcuaauucaguaauaccuuaccacagaugacacagccaaaauggaaaguuauuguacagucuucuugguggauauauacaugcaaaaaagcauucucaguaaaauacuuagaaacugaauucaaaaauacauaaaauacaccaugaucaacugggcuucauugcagagauucagggauggggaaaauucaugguccucucaauagcuguagaaagguuugcuugcugguugguuguuuuacaaaaccuaacauccuucaugauaaaaacccuaagggacaaagacuaucuuaauaugauuuauuuaaacaaaugaacaaacauauacaugaaucuaugccuaaauggggaaaagcaaagcguaucuacucaaaugaggaucaagaugaaagguguccacugucucuaggguuuuguuuguuuuaguauaguccuugagaucuuagcgacaauaaugagacaagagaaagaaauaaaaagaauaaacaaaguaagaguaucccuacuuacaaauagaaauuuauacacaggagaccuuaaagauaaucaucaaauucuuaaggcagaugaacauucucagcaggauaguaguauacaaaauuacuguuuaaaaaaaaaaucagagccuuccuauauucuaauaacaaacauugguuuuuaaaauaguaauucacguuuccaaaaauaucuuagaauaaaugucuaauaugaaagcuuuaaaacacuggaaagagaauuugaagauacuaggaaauagaaagacuagaaaauagaaagacccaugaguguuguuagugagaagugcugugacuuaagucccagccuucuauaugaaguuggaauguaguuccugaauauugagccaucugccuucuuuccauugcucugugccuggguugcuaugguagauucguagugcccuaacuuguguucagucugacuugcugcagggucagaguaugcugagaacacaggauggcuaucagaucuucacacugaccuauguaguauuucaccaacuaaagggugacaacucauguuuuauguuccugccucaugcuugcuuaaggcuugcuuaaggagggauuuccagguggagacuaauagggaagaaagaauauaaggccacauucauaguaaguacccuucauuccaccauucauauugaaugucuuugguccuguuccccccaacccccaccccauguuuugucuacaaaauguuaauuuucauguuucaccuuugggagacugugcuggcuaguuuuauauagauuugacagaggccagagucaucugaagggagaaaacuucaauugagaaaauccauaaaauccaauuguaggguuauuuucuuaauuggugguugaugggggaaggcccagcccauuguuggugaugccauuccugggcuggugguccugguucuauaagaaagcagacugcgcaagcccugaaaagcaagccaguuaacagcauuuuuccauggcaucaucagcucugcaccagcuccugacuacagcuaaauaaacaucuauagugucuuacccuccaguauuuaaaacugaaugugucucugacgcugcccugcucugaaaacuuaaagcauauauaaccauuauauuagaaagcuacagcuauuuuggaaaacaaaacaaaaccuccuuuucuuaauggcugcggagaccucgaguagcagaaucccccaguggguaugugagaauccucaugaacauacugugucccaguaccauccucuccucauaucaggcuaggccuuaucugugucucugaauauuaccucacuuuuaauggucauauuuugacccuagcaagcccugagugaugcaagacccuuccauugucaccaaaagugggaucccaaaauaagaacucuguugaaaaguuacuuaacuuuauuuaucuaguauguccuacacaucaauggccaugcauucucacaguaacaacagcaaggggcaagcuuugccaccugccauggacagauaagagccuagggaaguauuggcuugguugugucuauuugacccaagcuagaguuaucaucgaggaaggauccuuaguggaggaaaugccucuaugagguccaacucuuaaggcauuuucuuagugaucaguggggcaugggccaguucauugugggugguaccaucccugggcuucuauaacaaagcaggcugaucaagccuuguaaagcaggucagccaacagcaccucuccauggccuuuguaucagcuuuaccucaagauuccaacuaugcuugaguuucuguccugauuuccuccagugaaggacuauaaucuggaagugucagcagaauuaacuccuccccaacuugcuuuuucaucaugcugguuuuugucccagcaauagaagccuaagacagaaacugagcccaagguggccauguguggcugaagccaguucauuguugaaugugaaaagaucuaccuuuaccagauacuccaggauaguggggugagcuaagaugucccuugcaaacagauugugaggguuguuuacacagcgcucgcucuauggagaagagauccuugaguacuggccccugagccuagcuguggcuccuaacccuaggacuugugcaucucaguccaauaacuaugacuccuuggaucugcuugcugcuucccugcaccacuuugcugaaccuguccuuuccuucaggauggcauaaguuguccaugagauuugaggcgccgcuucguuaggcucacacaguuggcuuacauaggacccugcacuuaucauggggaagcaggcuuccugugcuuggugguagggcuaccaacaggcuagccuaagagcugcuucucaucuggugacucaaguccagguccuagacacaguccagcugagugaaugcaggugagaacaaagcauagagaggacauagcuacuauggguauaauaacaggaaguucugggggccaaaccaaagggacagaaaauaccuucaagguacaugugugcagucuagacagaugaacuacagaguaagcagguucugucugcugcccucccccugauuugauuaagugugagugguaagauacauagagugaaggcugggcucacuagggaggguauaggcacuuguuucuugcaucugacaggcgucaguguuggguuacuaaccagguaaccucaggaaccaaaaugcaagguaauaacauuuaguuacuuuucaucaugcaggccauuauaucaguggacauugguguaaauaguaaauuauuucguacuaugggcauuguguagaaaccuugacuuguuucaguauuagcuuuacagugaucuuguuuaacauucauaauuuacuuuguaaaauaugcauucuuugaaagaaaaaugcucguacugcauuggaaauaacccauccugagcaaauaauucuuccugauagucuuuugccugguuccucugcuagauaccaguagcuagagauuaucuuguuacugagacagcuguuacugggauucucagcugucuggcccauuaagccucuuuugaaguaaaauacugucuugagcauucucuuuuaugaucuaggaugucuguagacuucccccauugaaggcauuucuaacauuuuaaaaaacaguacuaugcaaaggagcagagccuucuauacacuaucccuccccuaauacuuccagaauaccuccagcauaccucauacugaccuuaggaggccaggucugcuaugcuaacugcuccacaguuaaguaaauucaccuaagagcucccucaaaguaaccgagcaggcagguaguuaaucugacucauguuacacuuacugugucccuuuuauuuuuuaacauuuauauuauuaccauucuugagauuuuuaugcauggucauguauuuacaucauauucuccccccaccaccaccacucuucaacuuugucuuuuugauucugucagucugucugucacacacacauacaugcauagagaagcagagagaggcacagagagaaacacacacuuauauauaaaugcaaccugaugaaucuaguaugcucauauguauguguguuuaggaaugcccacuugggauuggguagccugucauggagcucaccccuggaaaaguucaacucucucacugagcagccauugccugccuguagagcuuuuuauuguggguaggaccuugugagauuucucccuucuaccuugguaugucagcuagguguaaaaagucgucuuuagguggcuauauuguuaaaauuucaugggugcaacucugcaucauauauagaaaacuauuucucaguagauaaccugcuccucugauuuguauauguauagucuuucuucccagaacaucuuccaugauguuuccugaaccuuggguguaggggguguguugcaauguaucaacuggggauggacaccccacauuuaguaguuuguugaauuuugaccaggugugaauuucuaugaugguccccaucugcuacaaaaccaaguuucuuugaugaucaacaagaguuaaacuuaucugugaauauaaggauaaacauuuagacugguuuuagagauuauacuaguuuaggauucagugccucacuguccaaggguaguugacuagguuguaguagcaggcaugaauucucuccuuuugagugggccuucaguccagugagguugcuguuggcuaccuuccagauaaaaguaccacuguugcaaccuuggaugugcuggucauuguugugguuuguaaccagugucugcugugccucucacuaccaucuuuuuaccagcagauugcaauguugcagggagagaagacucugucacacguauauaagcacacuguuuguuuugagaaucauaggacaaugauaaaacauggcugaagcuaagaacgaucuagcauacugaauagcauuucaaauguugaugaagccuaagugaguauccugugacuggugugaacacuaguucuuucguuccaucagaaacagcuguccauguuguggcauugugguuagguguuaguccuugguauuccugcccuccugcugugcucuuaaaggaauagaucaguacagucucucucaaaagcucuaauagguuucugcuuucagcaugcuagugcuauaagguuuuagguuaaacacagcuugacuguuagaauuucagcuaguagcuugaggccauuugcaacuauauugaugagacacugaagcugaauauugguuugggaguggaauuguuaucuuagaaaggauuucagcccuaaguuuggggauauaauaauacagagcugggccaccuacaggccgggacugauuccuuggugaaagacuaagcugagcuuugacccccccugguuugcauacauggcacauauguucuuacccacagacucaaugauaaaugaaggaguggggcaggggggaggguucaagcuauauucauugcugcaguguagcacagugccccacagcuccaguucuuggcacuuuguguaucacaguuuaauauucagggaauuaucuaaggaaagauugaaacccuacaacaucuagaaguaaaauacuauuguuuuuugcuuuguuugaauuacuaauauuauaacauaccucuaaaauacuuaguagcauaguaacugaauuuuagcauagcauaguagcugaauuuuuaugucagaaucuguugauuuaguggaagcacuagguuuuguaccugcaacauacagaugucauaagcaaggcuuuuuuucauuucuuauauuucuuuuuuaaaaauuuuuauuagauauuuuuuauuuacauuucaaauguuauccccuuuccuaguuuccucuacuaaaaucaccuauccccuccccaauacgccuucuccccaacccacccacuccuauuccugguucuggcauuccccuauauugggguguagaaccuucgcaggaccaaggaccaccaaaggacucuccucccauugaugaccaacuaggccauccucugcuacauauacagcuagagccacaaguuccacaauguguuuucuuugauuggugcuauaguuccaaagaacucuggggguacugguuaguucauauugauguucccccuauggggcuucagaguccuuaagcucccuggguacuuucucuggcuccuucauuggggaccugguacucaguacaauggaugacuaugaggauccacuucuguguuugccgggcacuggcagaggcccucaggagauagguauaucaggcuccuguuagcaggcccuguuggcaucugccuaguaucuggguuuggugguuguuuaugggauggauccccaaguggggcagucucuggauggucuuuuuuucagucucuacuccgaacuuugucucuguaacuccuuccauggguaauuuguuaccccuucuaagaaagauucugaguuucugggcuaauauccacuuaucagugagugcaaaucauguguguucuuuugugaauguauuaccucacucaggaugaaauccuccagauccauccauuugguuaagaauuucauaaauucauuguuuuuaauagcugaguaguauuccauuguguaaauguaccacauuuucuguaucuauucaucuguugagggacaucuagguucuuuccagcuucuggcuauuauacaugaagcugcuaugagcauaguggagcaaguguccuuauuacauguuggagcaucuuguggguauaugcccaggagugguauugcugggucuuccaguagaaguauguccaauuuucugaggaaccgccaaacugauuuacagagugguugaacuaguuugcagucccaccaaaaauggaggaguguuccucucucuccacauccucaccagcaucugcuagcaacugaguuuuugaucguagccauucuuacuggcuugagguggaaucucaggguuguuuggauuuacauuuccacgauggcuaaggaugucgaacauuuuuuuaggucauucucagccauuugguauuccucaguugagaauucucuguuuagcucuguaccccauuuuuuaauaugguuauuugcuccucuggugucuaacuucuugaguucuuuguauauauuggauauuaccccuauuggauauaggauugguaaagaucuuuucccacucuguugguuaccuuuuggucuuauugacaguguacuuugccucacagaagcuuugcaauuuuaugagguccuauuugucaauucuugaccuuacaacacaagccauugguguucuguucagaaauuuuuccucugugcccauaucuucgaagcuuuucccuacuuucuacucuuuaaguuucagugucucuuguuuuauguggaguucuuugauccacuuagacuugagcuuuguacaaggagauaauaaugggucaauucgcauucuuuuacaugcuaacuucaaguugagccagcaccauuuguugaagaugcugucuucuuuccacuggaugguuuuagcuccuucaucaaagaucaagugacuauagguguguggguucauuucuuggucuucaauucuguuccauugaucuaccugucugucacuguaccaguaccaugcaguuuuuaucacaaucgcuuuguaguacagcuugaggucagggauggugauucccccagagguucuuuuauuguuuagaauaguuuuugcucuccuaggauuuuuguuauuccacaugaauuugcaaauugcccuuucuaacaaagugaagaauugacuuggaguuuugaugaggauugcauugaaucuauacauugcuuuuggcaagauggucauuuuuauguucauggauccugccaauccaugagcaugguagaucuuuccaucuucugagauuuucuuugauuucuuucuucagagacuugaaguuguuaucauacagaucuuucacuuccuuaguuagagucacgacaagguauuuuauauuauugugaaggguguugucucccuaauuucuuucucagccuguuuauccuuuguguagagaaaggccauugacuuguuugaguuaauuauauauccagcuacuucacugaagcuguuuaucagguuuaagaguucucugauggaauuuuuagggucacuuauauauacuaucauaucaucuccaaauagugauauuuugacuucuuccuuuccaauuuguaucucuuugaucuccuuuuguucucuaauugcucuggcuaggacuucaaauacuauauuaaauagguagggagagagugggcagccuugucuagugccagauuuuaguggguugcuucuaguuucccaccauuuaguuuaauguuggcuacugguuugcuauauauugcuuuauuauguuuagguaugggccuugaauuccugauuuuuccaagacuuuccucaugaaggggaguuggacuuuguggaauacuuucucagcauguaaugagaugaucaugugguuuuuuuucuuugaguuuguuuaugugaugaauuacauugauggauuucuguuuguugaaccauccuugcaucccugggaugaagccuacuugaucaugauggaugaugguuuugauguguucuuggauucgguuugugagaauuuuauugaguauuuuugcaucgauauucauaagggaaauuggucugaaguucucuuuuuuuguugggucuuuaugugguuaauguaccuucuguuucuuuuuuguggaauaguuugaggagaauuggaauuagguauccuuugaaggucugguagaacucugcauggauaugggacucuuuaggucauuaaucugacccugauuuaacuuugguaucuggcaucuguguagaaaauugcccauuucauccagauuuuccacuuguguugaguauagccuuuuauaguaggaucugaugaaguuuuggauuuccucagauucuguuguuaugucucccuuuucauuucugauuuuguuagucccugugcugucccugugcccucuaauuagucaugcuaaugguuuaucuaucuuguuaauuuucucaaagaaccagcaccugguuuuguugauucuuuuuauaguucuuuuuguuuccacuugguugauuucagcccugaguuugauuauuuuuugccaucuacuccucuugggugaauuugcuuccuuuuguucuagagcuuuuacauguccugucaagcugcuaguaugugcucucucuuguuucuuuuuggagaaacucagagcuaugaguaugaggaugauauauucuuguuccacccauuugccuacaaaauucaugauauccuugcucuuuuuuuuuuuuauuaaaaaaaaacagauuguauuuuuuucacuguucacauauuuuuuuaauuaaguauuuucuuuuuucuucauuuacauuucaaaugcuaucccaaaagcccccauacccuucccccaacccccgcacucacacuucucugcccugguguuccucuauacugaggaauauaaaguuugcaacaccaaggggucucucuucccaaugauggccgauuaggccaucuucugcuacauaugcagcuagagacacgagcuccaggaguacugguuaauucauacuguuguuccaccuguagggcugcagaccucuuuagcuccuuggguacuuucucuagcuccuccauuggggacccuguguuccauccaauagcugacugugagcauccauuucuguguuugcuaggccccagcauagccucacaagagacagcuauaucaggauccuuucaacaaaaucuuucugguguaugcaauggugucaucuuuuggaggcugauuauggaauggauacucagguggggcagucuagauuguccauccuuuccucucagcuccaaacuuugucacugaaacuccuuccauggauguuuuguucccaauucuacgaaggggcaagguguccacacuuuggucuucauucuucuugaguuucauguguuuugcaaauuguaucuuguaucuugguuauucuaaguuucugaacuaauauccacuuaucagugaauacguaucaugugaguucuuuugugauuggguuaccucacucaggaugaugcccuccacugccauccauuugccuaggaauuucauaaauucauucuuuuuaauagcugaguaguacuccauuguauaaauguaccacauuuucuguauccauuccucuguugagggacauuuggguucuuuccagcuucuggcuauuguaaguaaggcugcuaugaacauaguggagcauguguccuuaccaauuggaacaucuucuggauauuugaccaggagaaguauugcgggauccuccaguaguacuuuguccuauuuucugaggaacugccagaaucauuuccagagugguuguacaagcuuggaauuccaccaacaaugguggaguguuccucuucuccacauccucgccagcaucugcugucaccugaauuuuugaucuuagccauucugacuggugugagguggaaucucagggauguuuugauuugcauuuccuugaugauuaaggaugcugaacauuuuuucaguuauuucucagccauucgguauuccccaggugagaauucuuuguuuaggucugagacccauuuuuuaaugggguuauuugauuuucuggaguccaccuucuugaguucuuuauauauauuggauauuaauccccuaucugauuuaggauagguaaagauccuuucccaaucuguugguggccuuuuugucuuauugacggugucuuuugccuuacagaagcuuugcaauuuuaugagguuccauuuguugauuuucaaucuuucagcacaagccauucaggaaucaucaggaauuuuucccguguccauaucuucgaggcuuuuacccacuuucuccucuauaugauucacugucucugguuuuauguggaguuccuugauccacuuagauuugacuuuaguacaaggagauagagauugaucaauucacauucuucuacaugauaacugccagcugugccaacauaauuuguugaaaaugcugucuuuuuccaguggauggcuuuagaucccuugucaaagaucaagugacauagguguguggguucauuucuaggucuuccauucuauuccauuggucuacuugucugccgcuauaccaguaccaugcaguuuuuaucgcaauugcucuauaguacagcuuuaggucaggcaugcugauuccaccagagguucuuuuauccuugagaagaguuuuugcuauccuagguuuuuuguuauuccagaugaauuuguuaauugcccuuucuaaugauuugaagaauugaguugaaauuuuaauggggauugcauugaauuuguagauuguuuuuggcaagauagccauuuuuacuauauugauccugccaaucgaugagcgugggagaucuuuccaucuucugcgaucuucuuuaauuucuuucuucagagacuugaaguucuuaucauacaggucuuucacuuccuuaguuaaagucacaacaagguauuuuguauuauugagaaggguguugucucagccuguuuauccuuuguguagagaaaggccauugacuuguuugaguuaauuuuauauccagcuacuucacugaagcuguuuaucaaguuuaggaguucucugaugcaauuuuuagggucacuuauauauacuaucauaucaucuccaaauagugauauuuugacuucuuccuuuccaauuuguauccccuugaucuccuuuuguugucgaauugcucuggcuauaacuucaaguacuauguugaagagguagggagaaagugggcagccuugucuagucccugauuuuagugggauuguuuccagcuucucaccauuuacuuugauguuggguacugguauacuauagauugcuuuuaucauguuuaggucugggccuugaauuccugaucuuuccaaggcuuuuaucaugaauggguguugguuuuggcaaaugcauucucagcaucuaacgagaugaucaugucguuuuugucuuugaguuuguuuauauaguggauuauguugauggauuuccauauauuaaaccaucccugcaucccuggaaugaaaccuacuuggucagggugguuaauuguuuugauguguucuuggauucgguuagcgagaauuuuauugaauauuuuugcaucgauauucauaagggaaauuggucugaaguuuucuaucuuuguugggucuuucugugguuuaggcaucagaguaauuauggcuucauagaaugaauuggguagaguaccuucuacuucuauuuuguggaauaguuugugcagaacuggaauuaaaucuucuuugaaggucugauagaacucugcacuaagcccaucugguccugggcuuuuuuuggcugggagacuauuaaugacugcuucuauuucuuuagggaauauaggacuguuuagaucauuaaucugauccagauuuaacuuugguaccugguaucugucuagaaauuuguccauuucauccagguuuuccaguuuuguugaguauagccuuuuguggaaggaucugaugguguuuuggauuucuucaggaucuguuguuaugucucccuuuucauuucugauuuuguuaauuaggaugcugucccugugcccucuagggagucuggcuaaggguuuaucuaucuuguugguuuuuuucaaagaaccagcuccuccuuugauugauuuuuuuuuuuaauaguucuucuuguuuccacuugguugauuucgcaccugaguuugauuauuucuugccaucuacuccucuugggugaauuugcuuccuuuuguucuagagcuuuuagguguguuuucaagcugcuaauaugugcucucucuaguuucuuuuuggaggcacucagagcuaugaguuuccucuuagaaaugcuuucauugugucccauaaauuucgguguuguggcuucauuuucauuaaacucuaaaaagucuuuaauuucuuucuuuauuccuuccuugaccaaaguaucauugaguggagucuugcucaguuuccacgugaauguuggauuucuauuauuuauguuguuauugaagaucagccuuaguccauggugaucugauaggaugcaugggacgguuucaauauuuuuguaucuguugaggccuguuuugugaccaauuauauguucaguuuuggagaagguaccaugaggugcugagaagaagguauauccuuuuguuuuaggauaaaauguucuguagguaucuguuaaauccauuuguuucauaacuucuguuaguuucacugugucccaguuuaguuuuuguuuccaccaucuguccauugaugaaagugggguguugaaaucucccacuauuauugugugaggugcaaugguugcuuugaguuuuccuaauguuucuuuaaugaaugugguugcccuuucauuuggagcauagauauucagaauugagaguuccucuuggacgauuuuaccuuuggugaguaugaagugucccuccuugucucuuuugauaacucugauaggaagucgauuuuauucgauauuagaauggcuacuccagcuuguuuuuucagaccuuuugcuuggaaaaucguuuuccagccuuuuacuccgggguagugucugucuuuuucccugagauagguuuccuguaagcagcaaaguuuuggguccuguuugugcaaccaguguguuagucuauguccuuuuauuggggaauugagucuauugauauuaagagauauuaaggaaaaguaauuguugcuuccuauuauuuuuguuuuuagaguugguauucuguucuuguggcugucuucuuuuagguuuguugaaggauuacuuucuugcuuuuucuagggcguuuccguacuuguauugguucuuuuuuucuuuuuuucuguuauuauccuuugaagggcuagauucgugcaaagauauugugugaauuugguuuugucauauaauacugugguuucuccaucuaugguaauugaaaguuuggcuggguauaguaucaugggauggcauuuguguucucuuaguuucuguauaucaucuauccaggaucuucuggcuuucauagugucuggugaaaagucugguguaauucuaauagguuccucuuuauauguuacuugaccuuuuucccuuacugcuuuuaauauucuaucuguauuuagugcauuuuuuguucugauuauuauauguccggaugaauuucuuuucugguccagucuauuugaaguucuguaggcuucuugcauguucaugggcaucccuuucuuuagguuugggaaguuuucuucuauaauuuuguugaagauauuuccuggcccuuuaauuuugaaaaucuucauucucaucuacuccuauuauccguagguuuggucuucucauuguguccuggauuuccuggauguuuugacuuaggaucuuuuuguauuuugcauuuucuuugauuguugugccgauguucucuauggaaucuucugcaccugagauucucucuuccaucucuugucuucuguugcugaugcucaaaucuaugguuccagauuucuuuccuaggguuucuaucuccagcguugucucccuuuggguuuucuuuauugugucuacuucccuuuuuaggucuuguaugguuuuguucaauuccaucaccuguuugguuguauuuuccugcuuuuuuuuuuuaaggacuucuaccuuuuuagcaguguucuccuguauuucuuuaagugaguuauuaaagugcuucuugauguccucuaccaucaucaugagauaugcuuuuaaauccgggucuagcuuuccggguguguugggguauccaggacucgcugaggugggaguguugggcucugaugauggugaguggucuuggugucuguuaguaagauucuuauguuugccuuuugccaucugguaaucucuggaauuaguuguuauaguugucucuaguuggagcuuguuccuccugugauucuguuagacucuaucagcagaccugggauguaggcagccaacgccuaagagauggcaccggucuccaaaaauucuaguggcugcuucaaagaggcccguuacaaaauaugaaaaugguucuuuggggcccugcaaaauuuuuguaagauugccugagacugugccuuuguuugccaaugccuuccaggcuuugguagcuaccucauuuauuugggcauagacugcuucaggauaauuuguuugaucuaaagcaaaaacguccuaaacccagaagcguaucugcaucccaaugucucugaggaucuuguccuguggcuaaauuugcugcugccugacuguuugcauauucauaggacaaagacuuccagucuaaauacuguccggacgacaaacaagcccgauuaauauuauuccaguccuccggggugaggcaauaucuagcaagccccucgaccugugcaacuccaaaagcugcacucaccccguagguacggacugacucagccaguugcuuaauaguuuuaaauuuuauuggcucaugauaucgucaucccuggccaucuaagaagacagggaaagucaguccaacuuccuuccaaaccucugggcaaaaugagguaccuuguuuaccaccuuuuguggauuccuuuuuuccuggauacucaggguuaagagguggaguggucggcacuuucgauuuuacucguuugccagccgacuccccccgcccccuuuuuaaaggauugguuuuguaugaccaaucuggaucauaccuaucccucucauaccgagcugccucuucuucuaggucagcuuccucauuuuuaucaagcucugagucacuggagucagaacuugcugaacuuauuguuaagucuuuuaaugagggauauauuuuugcuauuuccuuuucuuucucauuauuuccuuuuccauuuuaauuugccuuuucucccuucuccuuuucucucucuuuucgccccuuuucuuucuuuugcuuauguguuuccuaucuuccucugacauacuuucuucuuguuccaugagauuuuucugaccugccuuaacugcuucuaucaaacaaaagcagagaccagaaauuacaaaaaacaaaacaacaacgacaagagcuacccauacugggucuacgggcgagaaaaacauaucccccuuuuuaaccgaggaucaauuugggagacuuaccgguaucgccguuccucagcugaagaguucugaaucaaugagauccuuuguccccgugcgggccaccaauuuguugcgcucaccucaucugacaaggaaaaugcaacacgguuggauucuucucaacagcuuuauugcaggaacgccuugaugcuacgggaacccugggaacccagggagaacuccuuauauacaccccagcacagggaaaagcuuuguguccuccugggauuggucagucugccggcaccuuaauuugcaugcacccacuccggaaggguuggugccagauucgggcuagcgccugugcggugguguuguuuaaggggaaggagucggcugccuacacugggagacuagcucucuccugaguuucaauggucagaguacuaucugcaggcaagcucuccucuugcagggaaggugcacagauaccugguguuuggaccugccuccuugcagaagaugaaggcccgaaacagggccugucccugaagcugugucaauucuuccugucccagaagcuguguagccucuguagucaccugcgcagacuagucucucagggaucugggaaccaagauggcuccccgaggugcuccccauaucuugcuuuucuggagugaugguguaucaggacuugcuauggugggagagucagcuucugaugaugccaaguaaccuugguuucuguugcuucuguucuuaagcuugccucccgcuaucuaauuaucucaagugcuugcuguccucaauaugucugauuggagccuguccuuccuguaaucucgguugauucagggcuucuccgaguccagcuuucuaugugaucuugugauuccgggauccuaugaaccugaaauucuggcuguguccaaguucuuggcagucaagcuuccucagaaacccugagauccuggugugaccaagcuccugggauccuuguauccuggaauccuggaauccuaagauccugggcguguuuuggcaccuggaagugguaucuccuuuagggacuguguggcuguccacuuuguucaaaacccagguagaccagcaccaaccagaaggaaccugagcuccuguauccuugcucuugcugucucaggauucucaugauguuuuuggaacagauguugcguuccacucaccuaugauccuaagauccugggcaugcuagggggccuguggaauggagagucuucugaggauugugggacucuccaccgaauucauggccaagguggcccggagcuugugccaacuggaagggacccaagccccugggugggcggguuuccuguguccaugcuccugcuggcacaggcccaccacgauuguuuuggaacagauguugcauuccacucauccaugaucccaagauccugggugugguaaggugccugcggcguggagaguucucuggggaccgugggaccgucugcuauauacuuauauuauauaaguauguuucuuaauauuacuugauuuuagugcuauuacuaugaaagaaugacuuuacaugacaucccaagaugcuguaaggagaaugcugauuauucagucauccugaaaugccaucauaaacucaauauugaauccuacagugaacuugacuugcucucuccauacuccuuccacacacaaguaccuaguagugagcuugagcuggaggcuccagagcaucccuuggugggcugaggcuggugcuucugaccugucaacugcuuacagaguauuccacagaacugccacuagugcugccuucuaguccuguuuuaaggagccagauaccuaaaauacugaccaguaaguauuugcaagagaaguuuguggguuuugcaguuuuuucaugccucucuuggguugcugcagauguuuauaguuucacuucagaggaaaccuacagauaggaaguaggugugaacaugcugagcagauaucugggccuuagaucagguacuucguaucccaggaguuuugcugaaaguagacaaauaaggcaggcgauucuaugauguauaaaggauuugguuuuuguuccugaaaaugacaucugccugucaaaaucauaucaggucauaacaagauuuguuugaaugguuugauuauuuuuuucuuuuucauucuaacccagaauuacccagauggaagucuacuaacccugucucccaaacauuugacaaaugucuccucagcauucaguuuuagcugucguggcuguaaaguucauguugccuauccgaagcuguugccuugcucaaguucuccauagaacuggaacuugugcaguuccuaaaaaaugacaaucauaagggcaccugcugccuaaaggccaucccuacagaagcccagucuuccacgucagagugcagugggucuuaacagagaaguacuuccauugaucaauuugugugaauuuaagcauauuagccaggagguuuuuaauuguuccagggcucgagaaauggguacaguggguccucaacuuaauuuuaaugcauaaaaagaagccaccuuagugcacuguaugcugcagucuuccugugauccccaucaagaagaucgguacuaggggagauagcaccuuagcauggaaagaacaagacgcauuccagugugacccaguguucuacucuguuagcacuuguggcagagcucuugcuaagacauguuuccuuugugucugaucucagauaaaggggcaauguugugucuugguuaggguuucuauuaaugugauaaaauaccaugaccaaaagcaauuugggagaaaaguguuuauuucagcuugcuuaaaugucccagucauaaucuaucuguaggaaauucagggaaggaacuugaggcaggaaccagaggccauggagaaacaguacuuacagacuugcuccucauggcuuacuuagugugcuuucuuuuuuuucuuuuuucuuuuuuuuuaaagauuuauuauuauaucuaagugcauuguagcugucuucagacacaucagaagagggugucagaucucacuaagaaugguugugagccaccaugugguugcugggauuugaacucaugaccuuuggaagaacagucagugaucuuacccacugagccaucucuccagccccuuagugugcuuucuuauagcaccgaggaccaacaacucauggguagcacugcgcaguuugcuggcuccucccacauugaucacuaagaaaaugcccauacacauucccauagaccagucugguaggggcacuuccucagcugagauuccuucccuccaaaugacuccagcuuguaucaaauucacaaacacuagcuggcaagggcugcuuggugaaauuuuaagucuuguguaacuacgaucaucuuguuuucuagcauccuccagggcagacaucaaggaaauacagcucuugcuccaccaucuuccuagaugacagcacagucagccagccaaaccucaaguacaccaucaaaugguggguaugcagacuuguuugguuuugacuugggagggggguuauuuguuuuugugugggguuuuuguuguuuuuuuguuguuguuguuugggguuuuuuuuuuguuuuuuuguuuuuguuuuauuuuguuuuuugagagaaggucucuaguuuuggcuauccuggaacuaccuauagaccaggcuagccuugaacucauagaucuucuuccuuccucugucuccuaaguucugggauuaaaagcuugggcuauagugucugacaagauaauuuuuaaagguuauuuuuguuuuauguauuaugguauuuugcccacauguauguuuaugcauuaugugcucuuggaggcuaggagagggccuagggcccgcugggacuggaguuacagaguguugugagcugccaugugauugcuuggaauugaacucugggccaucuguguaggaguagccucugcuuguaaccuuugagccaucucuccagauguguucacuguggccccagaguguccagacuucugaaugucacuggugccaagguguuuauugauuuugagggucacugacacuuggagauuuuuuuauuaagugauggguuauguagaauauuugggcauguuuaucauauauauugagagacuagcauuucaccuuauuuuaaauauugaugaccuaaaauaugcccauugguuuguguguauacaugugcaguuuugcccuuucauuugugacugaagcuauuucugcacagugccuauaguaauuugacuaguacaugaaaugauacuugucccuuccagucccagauagggacuugagcuaauuaaugccuagacugggauggccuggccaggagccucagguccuugucuuaaaauggacuuagagggaagaagagggaggcuuugggucacaucucccucccucccucccucccucccucccucccucccucccucccucccucccucccucccucccucccucccucccucccucucucucucucucucucucucucucucucucucucacuuucauuguuuaaagaagcaaagagcacugguuuuccuguacuguccugcccccaucagcacaguaauagcaacagcaacccuuggaaguggucucagagaacuuuacagcuugacugaaagucucagauacuuuaucuguuuccuuaagaaaguucacaucuaguaacaacucauuuuagcacauaaaguacuaaaauuaccaccuauaaacuuguuuucaugggccaaguuugcugaguuagagauacuguauaggcuuguauguaacagucacugacucagucuaggcauugaggacuauaacuaacuuccauggucaguguuuuaguccuguaagggggaaacaggggccacuucuguauguaugcuuuaucacauaggguuccuuugccucauugccccagcaugagguaauggcccgugagcauaaacccagggaaacugggaagagaugcauuauacauaacacauaguguauuaugcgagugaccucacuaaacccauucacuucuuaagauggagcucacugcuagaaaauggagagcauggaaccuuuuagaaguauguagagcuuguggauaaaauugaaaaggucugaagauguuugugucauguaguucuuggcagcuucucaagcucugaagagccuggaauaaaagcuacuagcuuccauugaauccuagaucuucccaguagcaagccagagaugaaagagaaggauggaguacauccagaguagcagguagaagaaaaggacacaaaccauguacuggugaaaaauccuguucugcuaucugaaccugaaauaucugauuuagaauauugggucucaaggagaugaagggguuuacagccccauaggaggaacaacaauaugaacuaaccaguacccccagagcuccuagggacuaagccaccagccaaagaguacacauggugguauucaugacuccagcuucauauguagcagaggauagccuugucgaucaucaaugugaggagaggcccuuggcccugugaagguucuaugcuccaguguaggggaaugccagagccaggaagugggagggggucgccuggugaggagggggaggggauaggggguuuucggaggggaaaccaggaaaagggauaaacauuugaaauguaaauaaagaaaauaucuaauaaaaaauagaauauugggacuaugauagggcuaugaauauaugggaagauacucugaaaacaguauuaucuuaacucugaagccauuuuaccuuagucauagaccccucaucagcucagauucuuagugauuuaggaggaaagaucuguuacuugcucaugguccugugccagggucuguucuaggucagucucaguagauauaguacacaccucagagcuggcuuaagucucugcugucccuccuccugucaucuuuaccucugguagucuccugaagaguauuuuuauucucugggaaccagagcacauuuuagaggcaaagaaaauagcuuugagguguuuuuuguuguuguuguuuuguuuuguuuuuuuacauuugaaguaagacaaaaggaguagaaagaauuuuagacaauuauuuuaaagaagaaaauaauuuaaaagugaccagucuacaugaucaugaugaaaacuaugccauuuucuauucagaaugaaaagguuuuaucaaaauguucaaggugagugucagugaaucugcagugaaaggacacggccagaaguacaaagacacuuucagucuguugagagccccacuuaccaagucaucccaguguagauaggaugcuccccuacagauauaauauaaccgcaauugcacagagauuuguaagccuguuuacuauggugugaauuaauuaccaagcaguacauauaauuuaaauauucagccacagagaaugauucaguaauuagugagcaaucauuaugaaauauaucuaguagcuuuuaaaaucauguuuauuagcaauacuuccuaaugguaaaaaaaaaagaggaacaaaaugguuaucuaagcauaggaugccagccucuuuguucccacacauagaaguacaaauaguaacugaauaucucaaacugauaguaguuuuggugggcaaaugauugguuuuugguuuucuguauuuuguuuugugaugugugugugugugugugagagagagagagagauuuagugacauacucuuucuauguaccuaugcuagccuccaacuuucaauucuccugcuuccuaaguauuccucaccauucuuagccaaaaaaauaguauuuuaaaguuucuuucccguguacugggaaucagauguagggcugugaaugugcuaggcaggcaugcucccacugagcugccucacaacuuuccaaaguucuauggugagcauauuguauuuuauauuagaaaggaaaauuugaggagaaugaauguuuauuacguucauguauuugaaaauuuuagacaguuuuaaaacagugcuuuggguaagucacagcaccauuuugggaugugaguggcagugcugaauagcuugcuaagaugggugugagagaaaugccagccacugguugugcuguuuguuguuauuucugguaguuaugaaaacaacuaauaauuugcuaacagaguaggccaugaauugcagacuccagaguagguuuaauuuauaguacuuuuauauaguaccugcauuuuaaaagugaggaaagcuuagaaucugauagaaaagcuguaaguccccccuguuucucuguuauuuccaaaaauaauguaaaaauccuggaagugccuuuauuuggaguauaaucuuaucagcacucuggaugaaauggagcuuuucagauggacucugugacuuuuaauuaaauuuauuugcauaguauaugaaaugaugaguguguuuauagaacauugaauuccuguguuuuauuuuacaguguagcucuugcgauauauuaccacaucaaaaacagguauguggccacuugauucuguucuaaaaguaucacacauuguuuuacuauguucuucuguauauucuuugcauuuauauucuuagugcguguuuucauaggacuuguaaagguucaugcaccagagugcuggguaaaagcugagcuaccucuggaccagggaaacaugaugaguggcaggagcagacuucuugaaaaggcucaaauucuuuuuuuguugcuuauuuucugugcaacuuaacuaugcauuccauguuuuauaaaauguuaaauuuaguuugaaaucaguugguggaaauuuugacaugcaaaacaaaacaauguagaaacucucccugauaaaagugcaucuugcaaugguucuguuaguuugaaaagugagguaaaacuagauuuuuuuuuaaaccuaccuuaaacacaguaauaaguauuuaagguggcuuuauaggagugaguuaaauaagagcucugucacaauagagguggcuccuagcaccucuaucaugccccucaaaaacgacuauaauuccagcuccaaagaaugugauacccuccucuucccuccaugggguaccuccacgugugagcauucucucauacagguaggcacauuuagaagaaaaggcggggaggggggcaggggaaugugggccugaaaggaaacugaguaaauaagagaauacauugcucuugcagagaaccugaauuugguucucaaaacaaccuccaaacugcagcucagagugcaucugcugcuucuaacuucugcagggcugugugcacucagaugcacacacacgaugagacaugccggaaacauaaugaaaaauuauaacaacaaauuuuagaaggggagaaaagguuaauaacucuuucauuuauuugcuaauuuaauugaacaucaaaacuguugcuucagaucuggggcauuaagccauaucuguaauuccucuuuucaaacauguuuaacccaauaguaaggacucugaaagguaucugcagagcacugaggauagaaucuuuccauuuugaccacauauguaccaaacuucuuugcaaugauuuccuuuuauuggacuuuuacaaaacacacucuuaauuuuugucacaaaggcuguuucgccacugucacauuuuagugauuaaugugguguguuuauagacauaauguuccaugcaaaacuaguuugggaauaggaagggccuccaaacagcaagacagcuguccacuaguggucuccauaccaaccccuagccugaguuuccaugugaagagauaguuguuaggccauguggugcaguguugauggcagcuucuggggagcaguauucuagggaaacagcucucugaacauagcaagcaccugcaaguuguucacuguaggggucaguuccaugcuguaacugugaucauaugcauuguggcuucugagaguuuuagauguaagaacuacaaacagaacaucuuugguaucugaacuaagauaacaguaguaauggaagcauuguccugucauuucugugguacaagcucaaacuuugaaaacacagauuccaaaguuacauguaagaccuguagugacagucagaugugcuuuuaaaccaacuuuuaauuagcauacuuaaggagauuucucaguucuuguuuugguaccaagaauuugggccaagguucuauggauguugagccugcccucugccagugaaguauauuccaaagucaauuuagcuauaaauguagauagcaaacagcuuuauuaagugcuugcucagacuucucuugucagucuuugcauggauuuuuaguuuuaauaacagauuuugagaagugcuacuuugaugauuuacauuuugcagauaaggaaauugaggcacaaagauucucuuagacaaaacucaaacuauauuaaacaguugaauguaaguagaugugucacagaguaggugacgugcucucuauagagaccaaaacuucaaggcucugaguugaccagaggccagcagcccaaagaaccaaauagacuagaguccaacaucuuaaagcacuuuguagguuagaggcccaaagcccaaacugcuuguguaaagcaucgguuagcauccccuaauucugucuagacuagagcuaacaauucaagguacuguguggaccagaagccaguagccuaagguucugagaggucaguagcuuaaaacacuguauagaugaaaaacgagcagcucaaagugcuauguguacagcagcuagcagcucaaagcacuuugugcaccagaaaccagcagcucagagcacacuguacaucugaagcugucaacucaaagaucuauauaaguuguuugccagcugugauccaaagugcugugugggccacaggccaaaagcccaaagcaauguguaagccaagaguugaaggaacuaugagaccagaaaccaucucaagguacuguauggaccacaccccaguagcccaaagcagugugugaaccugaguccacaaccccauuuccuacauguagagccauggauggcagccauguguaccgaaugguccagggcuucuaaacaaugauccauucaugagcccucuguauugguuuauaaaauacacaugcaaaccaaacaugcugaugugaaguuacuacaguaugaagcauaauuuuacauuuauuaaaaaggaaaacaagugugcauagugaggagauggguguacuuauuuauuuuuacauaaagaaaucuuagcugaauauuugauacugcaggacacagaguuuuggauuuuuugauauuuuuauaauuuuuaauguugaggaugcugauucacauacauguucaauacaaaauggcagaaguaucuuuuaggaccauuucagaaguugcuggaaauucuguucuuucccauaccacauuuacugaguaauaguuuaugaaacucaaguccgcaacccaaacugcauuuuuaaacaucagauacuauggcacaguauacauaauucagagguguuaauuuugaugcuuuuauacucagaaaugacaauaggaaaauaacaaaauuauuuauuuuucauaacuaguccauuaugauucuauaaaguccagauaccauuguauaguaagaaacacugugguucauaauauccaggagucucaaguuccagcugggggguuucaggcaguuuccuuggcauuguuuggccugcaagcuacagugugcaugcuguauauucagaacaaaaccugaagugaggugaacaugauucaccacaaaugagugcuguuagaacuaucucagaaucgcuucguggcuagaguuagcaguguauguugugacaauuuaagacugauuuuuguugccugcugcaugcccccuuccccccccccacaucauucgucauacuuacuaaccaucagaagaagaaaaaacacugauagaauuagaucauuuuagguuuaguucauuuaaggagccauaggggaucuugagagggaagguagaaaaauugugaauguuguggaauacguaagauaaggcagucagccuuacugggaagcaggcagaguuggagagaagacauggagaaaggaguaugggagaggaaugaacaagaugaaaaucauugacaccuguaugaagaugucaagaugaaaaccauuacuuuguauuuaguuaagaaaugaagaggagaguguuggaaaauuaaaaucuaugcuuuuacuuaauucacauagagguuuuaaucuuuguggcuucuucaacaaaaauggauuaaaugcuguacuuaagaauaccagaaaugccucuuaaauuuagcacuuucugucuccuagacuacaguugaacugaaauguguuuuauuucauuuugaguggcacuuauuaaagaaaguaaacucuaauuucuauugcuuuccuuaccagggacccagauggaaggaugcucuuagauauuuuugaugaaaaccuccacccucuuucgguaauugccuucuuaucuucuuauguuucacgagaugguuuaguuagcagucucuugcuucuguuaggugguagucaucugaaaacuucuuuuucuccagaaauccgaagugccaccugauuaugacaaacacaacccagaacagaagcaaauuuaccgguucguucggacacucuucagugcugcucagcugacagcugaaugugccauugucacccuggugagugugagcagcagagacucuuagcagaugacccuggggaaacuuguagaaguuucaaugucuucugugagaauagaagguggaugucucaagagaguguggaauuuauuucauaguccccuucuaaaaucaucugugaagucccacucaaagccagucaguacuuucagcgcugaugguuucaaugaagaugcauucaguaggguugaugcaagguaguauggaccaagaacauccucuaccagugucugguugccuucugcucacuuaccacugcagucuuaauggcaacauucuaagauguggcaucaaugaagaauaugcauccauggccuagauauaagaagugugacugacuagcuucugacuuguuuuauauaacaguguaggauauccaguugaaaaccucauggacugucuagaucaguuauuuggaaguagguuuaagaguauagccucauuaucccuaaucuuuccauagcacagcacucagaugagacacgagcuuugccugggacugggcauggcugcagagcagacucugcuuagauucuggggaagauuguugucuaacagaaagcucacagaaggcuuggugcuauaucuccccacacuacacuuuaauggccugggguuacucaacaguaagccauuuguucauuuuugaguugguuugugguucaucacuugcuggcuggcugcagacugagauguguuuagauaauccuuacugauccagaaugaccguagguuccaagaugaagcgcaugcacgcuguuuccuaacaggaauuuguccuacaaaacaaaaaaugagcagcaggguugauaguuucuggaaaagaagagcugaaaaguuggaagacaauugagauaaaugguaaaauuuaugcuguaagaaaacuuugauuuauuaaugcaaauaauauauauuuuaauauagauugguggguuuaacugacauuucuguucuugacauaaaaguaucaacauugugaauuaaugacaucaauguucuucuuucuccuucugcccucacccuguucccauuucccucaugucagcugaggguuaggccccuucuaagaacaaaccuguguucacucuuuacugucuacacuacagauugggauauucuccagggcugcaaagacuuuuuauuuuccuuuuuuuuuuauuagauauuuucucuauuuacauuuuauuuuauuuuauuuauugucauuuuauuuuacauuucaaaugggaucuccuuuccuauuuuccccuccaaaaauacccuauccucuucucccucucccugcuccccaaaccaccuacucccgcuuccuggcccagauguuccccuauacuggggcaagggcuucucccauugaugaccaacuaggccauccucugcuacauaugcagcuagagccacaagucccucccucuguuuuauggauuggugguuuagcccaagggagcucugggguuacuggugaguucauauuuuuguuccucguugcaaaccccuucagcuccuuggguacauucucuagcuccuucauuggggacccugugcucuuguccaauggaugacugugagcauccacuucuguauuagucaggcacuggcagaaccucucaggagacagcuauauaaggcuccugucagcuaccucuuguuggcaucugcaauaguaucuggguuuggugguuguuuaugggauggauuccccagguagagcaguuucuggauugucauuccuuuagucucugcucugaacuuugucucaacuccuuccauggguauuuuguuuccccuucuaagaaggaucaaaguguccacacuuuggucuuccuucuucuugagguucauguauuuugcaaauuguaucuuggguuuucugaguuucugggcuaauacccacuuaucagugagugcauaucauguauguucuuuugugauuagguuaccucacuuuggaugauauccuccagauccaaccacuugucuaagaauuucauaaguccauucuuuuuaauagcugaguaguacuccauuguguaaauguaccacauuuucuguauccauuccucuguugaggggcaucuggguucugucuagcuucuggcuauuauaaauaaggcugcugugaacauaguggagcaugcuuccuuauuacaaguuggagcaucuucuggguauaugcccaggagugguauugcugcaucugccauuagaacuauguccaguuuccugaggaacugccaaacugauuuccagagugguuguacaagcuugcaaucccaccagcagucggggagugcucuuucuccaucuccuccccagcaucugcugucaccugaauuuuugaucuuagccauucugacuggugugagguggaaucucaggguuguuuugauuugcauuugauuaaggauguugaauauuuuuuaggugcuucacagccauucgguauuccucaggugagaauucuuuauuuagcucuguaccccauuuuuaauaggguuauuugguuuucuggaguacaacuucuugaguuccuuuauauauauuugauauuaguccccuaucugauuuaggauagguaaagauccuuucccaaucuguugguggucuuuuugucuuauugacaguguccuugccuuacagaagcuuugcaauuuuaugaggucccauuugucaauucuugaucuuacaacacaagccauugcuguucuguucaggaaucuuuccccugugaccacaucuucgaggcucuccccacuuucuccucuguagguuucagucucacugguuuuauauggaguucuuugauccacuuugacuugagcuuuguacaaggagauaggaaugggucaauucacacucuacuacaugcuaacuucaaguugagccagcaccauuuguugaagaugcugucuuuuuuccacugggugguuuuagcuccuuugucaaagaacaagugaucauagauguguggguucacuucugggucuucaguucuguuccauugaucuaccugccugucauuuaccaguaccaugcaguuuuuauuacaauugcuuuguaguauagcuugaggucagggauggugauucccccagagguucuuuuauuguugaaaacaguuuuugcuguccuagguuuuuuguuauuccagaugaauuuacaaauugcccuuucuaacucugugaagaauuagcaaaggcucuuaagaacaaaaaaauaguguuguuccgauuacaaaacuaagaaguuuguaugugugugcuuguacccucauuugcuugagguuuuccuaguagccacucuuugcuacuuuaaaaugcagcgaggggcuuucugguguugaaagagcagagagaaccaaacuuccugauaggaaucuuaguuaaugguugcuuacucaauuuucuguagaaaugccaagccaaauaaagccaguguuuccauuuucacuuuaggguaccaucaaaacuuucagaauuguucuauaauaaaguaccaugagcuaagugacuuaaacaaaaacaaacgaaaaaugaaaaacaaauuuaucuggauauggugucauacacccaaaguucuaaauacuugggaggcuaaugcaguaggcucacuugugcuguggaguucaaggccagccuaugcaacacaaaaauccuaggaaagaauguuggguggggagggggggguagcggagaguaaggggagaggaagagggaaggggugaugcuacugugcuuagaaucaaaucuaagaugugcucaugccagcacaagagcuucuuuuuuuuuuuucuuuccauuuuuuauuagguauuuagcucauuuacauuuccaaugcuauaccaaaagucccccauacccacccacccccacuccccuacccgcccacucccccuuuuuggcccuggcguuccccuguucuggggcauauaaaguuuguguguccaaugggccucucuuuccagugauggccgacuaggccaucuuuugauacauaugcagcuagagucaagagcuccgggguacugguuaguucauaauguugauccaccuauaggguugcagaucccuuuagcuccuuggguacuuucucuagcuccuccauugggagcccugugauccauccauuagcugacugugggcauccacuucuguguuugcuaggccccggcauagucucacaagagacagcuacaucuggguccuuucgauaaaaucuugcuaguguaugcaauggugucagcguuuggaugcugauuaugggguggaucccuggauaaggcagucucuacaugguccauccuuucaucucagcuccaaacuuugucucuguaacuccuuccaaggguguuuuguucccacuucuaaggaggggcauaguguccacacuucagucuucauuuuucuugaguuucauguguuuaggaaauuguaucuuauaucuuggguauccuagguuuugggcuaauauccacuuaucagugaguacauauugugugaguuccuuugugaauguguuaccucacucaggaugagcuucuauacugaccugcaauccugauuguugaaaaauucuauacaucaaauacuaaaaauccaaauggaaaaguuauagaacauuuaaaagcaugaagcuauaguuauucccuuaaaauaguuuguuucuuggcuccacguuugaaucuguagagcaucguugagggcugagaguuuggauaauaauucucaugugcuaaaauaaacgugaaaacaucugaaauaggauacaauuggggauggaaugaagaugucgacucuuauuacugucuuguucuuaacauucuuguccuaugccuuauuagggucaucucugauuagcuaaaucaaauagcuguaagacuacaggauaauaugcaaaagaaauuguauauuguuugaauucaggccauuuaccugaccuacauaauuuuuuaaauucagauugaauaauugcaucacuguugaaguuuucuuuauguauguucguugcugagcuugaauuuaaucuuuuucugcaaaaugccuucccaaccuuuucuuugucuguagucaauggaguacucugugauuccgcaguugacacuaaccuguacugucucgaaaguuccuaggcuagucuuuuguaugacuacaaugugaaauuuuaauugaacagucagcacuaucuagaaauaauaucaugaaaaucaguauuacgugacuuagcauagaaucagaguacaauauuagaacauuucccccaaauaugguauuacugacaaguucugcugaaucacaugcuaggaagauuuguucacucuaauuaucucccacaauguaucagcugcuuuccucacauguaacaucuuaugaugucuccauucuucaguaagcccucagaugauuucacucacauaucagaaaucaaguugguucuuucaacaggcacaacaggcagaguauuauugguauccaucaacuaagauaauuuuaacucaaaauaaaauuucauagccaccuuuguaccuaagccaguagaaauuauuucauugcugagauuuccccaacuuguguacagaagcuguuaccaagcugugggaagauguugcgucuccagugucuaugaacugagaggccgagguaaucccaguuucuguuuucugccuucagaauaguuuuaccugccuuacccuguagagaaugggaagaguauuauugucaagacuugagaaaguacaauuugggguucucuagaaugcccagcugaaagucagccuggccccaaccaguuauuuguuuuauacaaauaaaaaucauucucuaaagcccacccucacugcucaugcuccuguaugauaaauuccauuuaaaauccagauauccagagguuguuacugaaacgauuaacuuucauuucugucaucaacagccggcucucauccuugugacaaauccucagagccagccacagauauucucauagagcagucugcauuccgacuccugguuuucugggcuucccuccauggccgcugauucuuauggguaaugcagaagaaugccuucuugaucacuuugagcugucucucuaaaccucacugcuucagcucccuccaucugugccaauucuuuccugaaugccaguggcauuuggucacuuuccccauuagcuuccuucugcauuuccuugcuacuauuuuuguuggaauauaacuguggcggaggcugcucacaguuuuaagcagauuucauuaauggauaccucaugugagacuggggguguauuaaaaaacaaacauuuuggcagcauuaaucugucccagccuugugcgggguggcacacaguagggcuguuaucaggaacuuaggauuuauuguagaaagagauaaugaaaagacuuaacuauauugagcuauuuccaaauacuuuacugccucaggaagucuugggucucuuaacacacuugacuuagcuuuucuuuggaaucuggaauguuaguucuugcugaaugugaugacacacaacuguaaguuuuuucuuuguauucagagugugaccugguccauccugcauaccacaugguauuagaaaguagccauaagagucuaaaucuucaagaucuuaaaaauugguauuucuuagugaaucacugaaaacagaacagugaucuuugggaaccaagcaacuguuacugucuuauuuugugcauaccuggcaaaguuugcuucaguuggaaggagcaguauugaauacuuuguuucucaauaucauuagguagaacaaucuuccuauaugugguucaggggcaggaaauguuggaggaggagcugacccagguacccugcugcacugacucgugauuucccccagcagccggaguucgcuucuggaaggaagcgucuccauucccuuuccuacccucaucucuccucagccugcccucuuaacugcuucucuggccuucaugcugugcugaguuuaaucuuuguugguuacuaugagagacagaaauuccauuuccuuccucgguacuuggaagugugugaaaaaccucugaguucuccacacaaguaugagcccaacaaauagaaugggccagauccacuuuccguuccaacuuccugccccaucauccugucuccagcuccaaacaagggaagggacuccccucucucugcuacucuucauuucaagccuuggaucugccugcacagacucagucaugucuccaugcucacaaccuaugggauauuuaucucagacauagagcacacagucauaucugcaguuaccuuccauaccuuuuccccucuggaaccuccaguuucuaauaaauguauuuagccaacugcacauuccagaagucuuggguacuuccaagauggccaucuuuggcaccuucgagaucauuuccugcaagugucugaacuauauuuagauggucuccaccgaaaacacuacuucuuucuauuuagccugauucauaauuuuccuuccaagugcuaccucaagucaugggugcuucucaggccccucucugacccugacuggaggcucagggucagcauggugcauccacugggaucugcaccuagacacuguuuggcagguaagugaacucauugaccugucuccuuucucuugucugcugucauuaagucuauggugcugccuggugucuuacuuuucacuucaccuaguucaucuuugccagcccaugcuauuguccugauucucuaggacuuggccaaaacugagccucuccugggagccccaguaccauaucugguauggguuuucuuucuuuaggaaaucucuguccauuguugggcuuccuguggaguucuuauccccuucaggaccuucaaucuuaaucuccaacuucucccuaagaguuccaacuggaugugaauaaaaaauuuaguaaguaaguuuaaaaaagaaaaaaaaaaaagacauagaaggcaggaauuauauaaaaaaaauaaauaaauuggacuuuauaaaaguuauacauuuucuuuuccacauguggcuuuuuauacauuuuauaacuauuuaggacuauacauacacguguguguguguguguguauguguguguguguguguguguguguguguaagaguaauauauacauaaagcuauacauauucuaucuuuuuauaaagcaaguucuuaagaguauuacaaaucugaguuucauuuuucucauacagaguuucauuuuguaaaugaaaagcaauaaaaacugcaaaauugauuaaaagaagcuuuaaauagucuaaauuaguuaugggaaacuaauaggcaacuuacuuaggacacaguuuuuuaaaaaguguguguguguguauuuguguguuuguguguggauguguguguguguguauuuguguguguguguaguuguaagccaccugauauggguauuggaacauaacuuggguccucugagccaucucaacacccugugacaucuuaagugaaggacuuccuguuuguuuuguuuauguguuuguuuaucuguuuguuuucuaauuuuaauuuuuuuacuuauucaauuuacauagcauucacugcccuccuccuggucacccccucacacaagucuuccuccccuccccuucuagguauccccccccccccucaugcuggcauaucaaaucucuucaaggcaacccggcaagaagaacauaucccacauacaguuaacagauuuuaggguagccccccuuuaguuguucaggacccacaugaagaccaagcugcacaucugcuacauaugugcagggaggcguaggcccagcccauguauguuuuuugguuggugguucagucucugagagcuccaaggguacagguuaguugacucucuguuagucuuucuguggaguuccugcccccuuguggguggcaauccuuuuuccuguucuuucauaagaauccccaggcucuguccacugcuuggcuguggaugugggugucugcaagcauaacagaguauuaauuaauaguuucaggaauuaguguuugcccauaggaugagucucaaguugggcugcuuauugguuggccauucccucagucuaugcuugaucccugaaguauagaaaagaaaaauuuggggucaaaauuuuuguggguagguugguguccuuauucuguugggggcuccugccuggguacaggagguggccucuucaaguuccauauccccugugcugugagucacaccuaaggauacccccauugauucuugggugccuccuuauuccaggucucuguuuuguccugaagaugccuuauacugacugaaauaaaccagggccuagaagauaaauauuguaugaugcacugguauaaaauacucauaagauacuuguuccuagagguacaaagguacaguagugcuuguaggagaguuggcagaaggaggaauuguaggggcuagaaaaaaaauuguucaguguagauauauguuaauguuaauauauguagaauuucauuuagagacaauaaaaaagcugcauauugauggguaaagauaguuacugaacauugagcauaccuagugcuucagauacaauuagaaaugauugagcauaguguugugacauguguucuacuauaguaauaaccauaucagcagccacaugugaauugaaauuacaaugaagcucaguuuuuuaaaaacuauagggggcaggaggaucccugugagguacauaguaagauccugucuuucaaaacaaacaaacggugccauuaugcuuccggaaaagucgcaaggaaaaguauuucaagcaaugguuguggcuguggggucgggcgggaaaggaaaggguggagagauucagccuguaagcgugaaaguuagagagaaacuucucccagaauauagaggcaccaaaguaguucuagacgacaaggauuaugccuuauuuagagauagugacauucuuggaaaauauguugacugaaaucacuguugaaauggugucacgugaagcugcccauuucacugacuuucugaacuauuucaucauguaaauaauuuuccaugcucaauaauaaauggaugaugccuaaacuggcagccauugucccugacguuuagauucauugcacuauuaaaacauuuccaaauaaaaugauguaaaagaguggaaaaaaacaaaagcucuguaacaggcaacaagauggaugacucaggagauagaggcacuugcagcauaaccuggagacauguuccauccucagagcucacaggaaaggaaaggagauagcuggcuccauaaagcuguccucuggcuuccaccuaugcagcauggcacauguccucacacagcauacaaugauuuuucaaaauaaaugcugaauaggucaguggcuaagaucaagaauaaaauacuucauagaugaagaaaaaaaugcuauguggccuuuacaugcuuuguuugagaaaguauuuugaccaguggcuuugagauuuauaccagucucaauauugacaaggcaagcuacauuuucacuguuaaagugugugaccuccagccugugucuaagcauacucacuggucuugagugcuuuaagaauuaguguguucuggugcacuuauggccuccagaucauuguucucagggacucuugauucuucuuuucuugucuugucuucucuugucucuucucuucucuucucuucucuuuucuuuucuuuucuuuucuuuucuuuucuuuuccucuccucuuucuuucuuccuuucuuccuuucuuucuuucuuucuuucuuucuuucuuucuuucuuucuuucuuucuuucuccaaagaagguuuuauuuuucaccaaauguauuaucuauuaaccauuguguagaauuucucaaagaacacauaaaaacaguaguuucugaagauugcuaaaaccaucaaggaaacagaacuacaacaaagaucagcugacauagacacauugagaagaauguggacacccgccugccaugcucguucacugccaagugcuucuuaucucguaucuaccucuagauacacagaaucuuaaugccuucuguuucuuuacagcaaagauuuuuuucuuuuccauauuuuuaauuggauauuuucuuuauuuacauuucaaauguuuuccccuuuccagaucucuccauuggaaacccucuauccccccccccccgacucuaugagggugcucccccacccacccacucccaucuucacacccuggcauuccccuacacugggacaucgaacacccacaggcccaaggguguuccccucacugauguccaacgaggcuauccucugccacauagguggccagagccaugggucccuccauguguacuuucugguuggugguccaggccccaggagcucugggaggucuggcugcuugacacuguugcuacccccauggagcugcaaacccccucagcuccuucagucccuucuccaauuccuccaucggggaccccaugcucugcaucuaccucuguauuugucaggcucuggcagagccucucaggagacagccuuaucaggcucccuucagcaagcacuuccaggcaucuauaauacuguccaaguuugguggcuguacaugggauggauccccagguguauugugcaaaugagugguucuguuucuugugccuucucuugggcgucuuuccuucuguuugauuugucuaauuuugcugccuauguuagccuuuguuuuagcuuacuguauuuuauuuuauuuuauuuuauuuuauuuuauuuuauuaucccuucguagccuguuuguuuccuaaugagggacagaaagggaauggaucugaguggaaugggagguagacagaaucugagagaaguagagggagggaaaacuguauucacaauauaauaugugagaaaaaaaucuauuuucaauaagaggagaaaaacagguuuaaaaaaucuuagguuauauauuuuaaguguacucaacacauuucuuuauauauguuuagugugcuugguuuugucaguaccuuugccauugcucuuauaaaugacaucauuucaagacacguuuuuuuacuaauuacagcagauuauucauauaaagaaguaaguguguccagguaacuccuaguuaaaagacuuuugaguuacuuggguggaggagacaacugaaagcuuauuagcauugguuuccucaugucucuugucuccucagguauaccuugaaaggcucuugacauacgcagagauugauaucuguccagccaauuggaagcgcauuguucuaggggcaauccugcuggccucuaaggugugggaugaccaagcuguguggaauguggauuacugccagauccugaaagacaucacaguggaggacauguaaguuccggggauaccaugccuauuuggggugguaaaaagugagugaauuuagcugaugguuuuaagucaguccagcaggaaaccuggcuauggaaauguagugaauuguauuucucaucacuuugaccaggaacaggugcuggcaauacuuucuaguuucacaaaguauuugcugaaacucuguuccagauaaauauuucuuuggagauuuauaguuagguuuccgugucacaucggaauaguaguaaaagucuauguuccucugugggcagcaagccuaaccggagaaguucagaaacuaaauuagaauauuuucauuuggcuucagaggacacauuccauguuuuggcauauuuggcaaguucagauacugauaaucgguucuguacucuggggcuugauuugcacaagcaucauuccaucauucucucugcaaaaccaguggaggagccuccacaugaggacagccguccaccuagcucccaggguuaugugaugaugucccacuggaccagaccucagauucugugagaauuacuggcugagggccuauccacggguaucagaaaacugagaagggaacgcugagucauagaagcacucaagccucucaaccaucaggagucuuuagucaguucuuguguucuuugcuuggcuuaacacuuaagcuaaccaccuugaggaaggagguuacuagcuauauaccagucacaccacauacuuggaccaauagcccuagagcgagaaucuuauugcaaccugugugggagagucaccaggcuagaggcacauuggcuacuaaaugauauagccagaauuuacauuucuuuucuugggaacgguugaagcaaaaaucuucuaaacuauauaugauauuguauuuuuaaaugaucaucugucugucugucuaucuuucuaucuuaucuauuuaucugucccucuucuauauaaaaaccuacaaaaucugaccaaaauuccuucagcugaaauugaguguaaagaaugguuuggaggcuggagcuggagcucaggaucugagcaucuugguuuggccccaguaccugcaagagagagggaggauuauuuugaugagcauacacuaaauauauguucuuuugugagaucuucaguaccauaaauaauuaucuguuacaaugagguuggaauuucuuuucaaauaaggauuuuuuuuuuaagaaaacuaguuuuuuugaaagcauuauguuacauguaauacuaguaugcaaaauauagaacucauacaaaaguucuauguuuuccauauuuugucaaaagaaaaauaaugguuuuuuuagacuaguuucuguccuuucuuugaacccuauugguaaccaggcucauugauugccagcaaaccacaugcuaauucucaucagaucauaauagccugugauggaugauagcuuuauaccaguuuugagcaaagggaaaaaaacacacagugaccacucgguuccagaguguagacuguaaccagaugucucgugcaauugccaguguuuggagguagagacaggggauccagacaaaauucaagcccagaguauauauaaaaauccuuuugaggaaaauagaauguacaucuugugcccuucaccuaccucuggagacuauggaccucuauuaggccugcuccucucucuccugacuaauuagcaagcagccuauugagacucuuguaugaugaccauuuguucugagugacaaaguucuugguuugaauagcuauuuauaugccgagaagacuauguuuucucagagggaaacuggugacacagguggggagaucugugguguacaaguuugacugcccugucccaaccccaagcaaaauacccaaggccauggaauucuuccuaguauggcaucagugaaaagaauguucuguauagugauccaccaugaccacagaagucgucacacauuuagcuugguuuauccaucuuuaaaauauuuuggaaaccuuuaucugucuacuaugagaugaugcuaaaacuuuuucuuuaagugugauagcauacgccuucauucccagcaugcagaggcugauacaggaugaugcaugaggaccaggccagccagauaccaagacuuaacucagagagaggacguggacaaguuucucucaucauaauuugugauuaaccccauuuuaaaauggcaagugugagccaaacccugagugccaccauuauucauguucucagagucugagguuuuagauuguccccuuucucauugagcuaaauuuucuuuugaguuucuuugcuccuuaaucuguucuuaaauuaucuguagcagaaaacauccauacaaagugacacuguggugcugcuucccggacuguaauagaaucacuuauaaacuucuuuaccucaguagcacccaguugaucagcacagugugaagaaucauuugugguggcacaugccuguaaccucagcacucagaaguguaggaggaggguaaguaacagagcagccuggacccugucucaagaaaaaccaacaaaaaauaggaaucuuuaaagguuauagaauaaacuaaaucuauuaaugagauugguauagcugauuuacuccaccaauucauaauuuuauuauuaccucguggcacaaguuauucucauuguuaucuucaauaauauaguagcuucgaaacgugacauuacaagggauuuuguuauauuaaugccacugaacuauuuuuagguuuuucugaauuacauauuaaaaucauagucauguguuaauacaaguuaccuaauuccaacuuuuuuuuuuuuuuuuuuuuuuuuuuuuugguauuagcuagcugcccacugaaauuguuuucucaguagcaacacuuuagaaacuccacuuugggaugaggaaccuauguaaggcugggugcacagccugccccaccuccuaaaacagaagaaaagugguggaaagaggccaacccauugauuugcucccucucagaggccagugagcuuuagcaaacaaaagugauaggagauauagugauaggagugauaggagugauagugaaaggagucuucccccaugcugugcuucucagcaugcauuugucucagauaaauguguaucccagcacuaagacuagaacccacauagaggccuguaacagguucuggcuguuagcagccaaauuagaucuccucagaguucaaacauucaaaaucugacccauaaaacucaggauguaacuauaauuggcaguaauguuuuugaagaagacaucaacuaaaaauggggucaucaggaugggcccuaaucaaaugucuauguuguccucacaaauggacaagauugagccauagacacacagagagauggcagugugaaggugcagagaaggcagcaauuucuaaccaaggagaaaggccacagcagauugcuugauacugaccucucauccuucagaaccaaggggaaacauuuguugcuuaggauacccagucaguaacccugguauuugguccuaguuuuuuugaggagacuuuugcagauuucagucuugggaaaucuugcucuaacaaauucuugaaaagguagggggaauggggguaaagguagcuuugaagcucaguuccaaaggauagaagagauuggaggcauguuuucaaaaggaaaguuaacccuggauucuuagagaugguugauagaaauagagacauugauagcaguucuauugagggcuuagaaagaauacagcuguggggaagguuguuucaucucagguaugagcacagauccuguaucaugaccagaccugaggguaauagguauagaagagaguaaagauucccaaaucaaagggccagcaaacaucuucaacaaaauuauagaagaaaauuuucuuaaucuaaagaaagaaaugcccauaaacauacaagaagccuacagaacaccagagaccagaaaagaaagucuucucgucacauaauaguuaaaacaucaaaugcacagaacaaagaaugaauauugaaagcaguaagguaaaaaggucuaguaacauauacaggcagaccuauuagaauuacacaacuuuucucaacagagacucuaaaagccagacuaaaagauccuggccagaugucauacaagacccuaagaaaacaaaaaugccagcccaggcuacuauacccagcaaaacucgcaauuaccauagauggagaaaccaagacacucuaagacaaaaccaaauuuaaacaucuuucuggggcuguagggauggcucagcaguuagagcacugacugcucuuccagagguccugaguucaauuuccagcaaccacauggugacucgaaaccaucuguaauggccugaugcccucuucuggugugucuggaaauagcuauaguguacucauauacucucucucucucucucucucucucucuauauauauauauauauauauauauauauauauauauauauauauauguguguguguguguguguguguguguguguguguguguguguguguguguauguauauguauauguguauauauguauacacacacacacacacacaccaaugucuuuccacaaauccagcccuaaagaggauaauagaaggaaaaguccaacacacggagggaaacuacacccaagaaaaagcaagaaauuaaucuuuccacaacaaauccaaacaaaaaaaagagacacaaacauaauuccacuucuaaaaacauacccagggcuggagagauagcucagggguuaagagcacagacugcucuuccauagguccugaguucagugcccaccaaccauaugguggcucacaaccaucuguaauggaauuggaugcccucuucuggugugucugaagacaacaacaguauagucacaugcaagcaauaaauaaauaaauaagaaaaaaaaaacauacccaaacuuauggacacaaugaaagcagugcuaaaaggaaaacucagcucugagugucuccaaagagaaacuggagagagcauacacuagcagcuugacugaaagcucuagaacaaaaagaaacaaauacacccaagaggaguaggucaggaaauaaucaaacucagagcuauaaucaaccaaguaguaacaaaaagaacuauacaaaaaucaacaaaaccaggaacugguucuuugagaaaaucaacaagauagauaaucccuuagucagacugacuagcgggccuagaaacaauauccaaauuaacaaaaucaggaaugaaaggggagacauuacaccagaaacugaggaaauucaaaaaaaucaucagauccuacaaaaguguaugcugaacaaaacuggaaaacauggauuaaaaaggaugauuuucuaaacauacaccaguuaccaaaguuaaaucaggaucagauaaaccauuuaaacaaccccauaaaccccaaagaaauagaagcagugaaaucucccaaccaaaaacucccagggccagaugguuuuagugcagaauucuaucagaacuucaaagaagaucuaauaccaauauuccucaaacuauucuauuaaguagaaauagaaggaacacuacccaguucuuucuaugaaaccacagucacacugauaccuaagccacaaaaaaaaaagaaaagaaaagaaaaagaagaaaggaaaagaaaagaaaagaaagaguacuacagaccaguuucccuuaugaauaucgaugcaaaaaaccucaauaaaauucucucaaaccaaauccaagaacacaucaaaaugaucauccaccaugaagcaggcuucaucccaggaaugcagggaugguucaauauauggaaauccaucaauguaauacacgauauaaacaaacucaaaagaacaaaaccacguggucaucucauuagaggcugacaaaaaccuuugacaaaaugcaacacccauucaugauaaaagucuuggaaagaucaguaauucaaggcccauaccuaaaagcaauauacaacaaaccaauagccagcaucaaacuaaauggagagaaacucaaagcaaucccacuaaaaucagggacaagacaaggcuacccacuuucuccuuaccuauuuaguauaguacucaaaguucuacccagagcaauuagacaacaaaaagagaacaaauggauacaaauuggcagggaagaagucaagauaucacuauuugcaaagaaccugaggacauaacaaugugguugagaccaugggagacccaggagaacaacuaccuguaggacaaggaggaaaacuucagcugccucccuccaacagaaaaaagaugguuuuagcuguggcuuuugucucagcagucuugacagacuaauaugcuguaaaugguuaaaagguauaguuaccaaggaaucuguagccuugaaccacauuuguaaagaggcuucacacuguuauugggugauaaaguggagcucuuaaacccuacuuucuauaagaaguccuugaucuauaccuuugcaccaaagcuugguaaguccucuagagugaaagggggcauaucauucaagugacuaaggaaagaaaauaccucuuauagaggauagcaggauugaggccuccuuggaagcaaggagcccgggccaagacaaagaugaacacagccuacucagcagugggcuguuuccaguauccucaagucggacauuucucuggagucugccuccugacgaacugugugcagaaggucguaguguaagguuugcauagccacuggaccuacacuccuaucugcaacugucugagagggcaguugguuccaucuacaaacuuguauuggucucaguuggacagacaaucaugcucccccaaccaggccaaucuugugcagguagacauaaaccacagacuaguuguuauguucucacgccaucacaaagcagauuuugaacaccaaaguaucaaaugauaguugcugaacaugggaaagcagaugcugaggccugguugugcugaguucuacgggcauguguagcuuguaugcgugugugguugugggcaugggugugugcauguguagagaucugacagcauuggaugucaguccucccccucuaccuugagauaggcucuuugucccuggccagucgauacaacgagcuggcuguccagugaacugaggauccucuacuuugcaacuguauuuggagcaugggaauuauagauauacaguguuguuuccagcuuuuacuugaguuugaagaguucugagucaggucauuguacuuucaagguaagcauuuuaccuacugagcuaucuuucuagucucuacucagacauuucuaaaaauuucacuuggcauuuguaugauucacuuguguuuguaguagucccuuuaagggucauuuucauauguauucugggggaaucuucagugaccagaagccaggcuacuuaucuauuuaucacagacagaucaggacauaaagaaccucagucccucuguuggugccuggugucugugguggugguuguuguuuguuguucaguuugugguuaaaauaugcauagcaugaaacuuuuauuuuuagcauucaauaaacugcacuauugugcagcuagcucucuuucuuuccucccuccagccuagccaccauucuuucuucagagaauugaaguuuuuauacaggucuuucacuuauuugguuagauuugcaccaagauauuuuauauuauuuguggcuauuguaauggauguuguuuugcugauuuuuuuuaguugauuuuuuuuaucgagccaccguucugaagguguuuacaacuuuagaaagaaguucccugguagacuuuagaaguuccugguaucauacuccaauagcaauacuuugacuucuuccuuuccuguuaguaucccuuugaucugcuuacugcucucccuaaaacuucaaguacuauuauuggauagauagggugagagugggcagcuuugucuugugccugauuuuaguguaauugcuuccaguuuuuuucauuuaauuugauauuccuacugguuugcuauguauugcuuuuaucguguuuauguauccuuguauccaugaucucuccaagacuuuuuaacaugguggguuguuagauuuugucagacuuuuucagcaucuaaugagaucauaauguuuuuuugucuuuguauuuuguuuuguuuuauuuguaguuuguuuauuugguguauuacauugauugauuuuccuguuuuauacaauucccgcaucucucggaugaaacauccuugaucauggaugguggaugauguuauuuauguguuuuuggauuuaguuuacaaguauuuuauugacuacuuugcauuucauaagggaaauuggucugaauucucuuuguugagucugugugugguuagguaucagggcgaauguggacuuauacuaggaauuugacaguguuccuucuguuucuauuuuguggaaaaauuugaggagaauuggaauuagcuuuuauuugaaagccuugguaugauuucuuaacuaaaauugucuagccaggggugaugguggugguggcugcugcuauugucauuguuguuguuggaagacuuuuaauguuugcuucuauauccuuagggguuagaggacuauuuauauaguuuaccuaauaucuugauuuaacuuugguaagugguauauaucaguaaaaucaugcauuucauuuagauuuuccaauuguguggaguacagauuuuugaagaaaaaccaaaauuuauuuuuugaucuucuuugguaucugccccuuuucaguucugauuuuguuaauuuggauauuacccaucugccuuaucuuuaauuuggcuauggguuugucuaucuuguugauuuuucucaaccaauucuuuguuucauugauucuuuguauuuuuuguuuuuauuuaucucagcccugacuuuauuuccugccaucuacucuucuuuuugcucuaaaaaugucagguaugcuauuaaaucacaaauaugagcucuaauugauuucuucauaagggcauuguaaugcuaugaacuuuccuuuuaucacaaauuucguugugucccauaaguuugggcaugguguacauucauuuuuauugaauucuaaaaagucuuuaauuucuuuauuucuaccuugccccagaugucauucaguagaaaauuguucaguuucuaugaguauguagguguuguuguugaaguccagcuuuaauccaugguggucugagaagauacaggguguuauuucaguucuuguguguguuaagacuugcuuuguaacugaguauauggucaguuuuggugaaguuuccaugaggugcugaggauauucuuuuguguuugggugaaauguucuauagaucucuguuagauccauuugagucauaacaucuguuaguuccauuauuucucuguuugauuucugucuggaugaccuguccauuggugagaaugucauguugaagucucccacuauuuacguuugggguucaaugugugauuuaagcaucaacaauguuucuuuuacaacuaugagugcccuugcauuugggacauaugaguucaaaauugagauaucaucuugguagauuuuuuuuccuuugauaaguaugaaaucuuuccucgaauauuuugauugauuuugguuggaaaucuauuuuauaagauguagaaugguuacucuucauuugcuuggauuuuuuuuucuagcccuuuacucugaggaaaugucuauguuuguuauugagauuuguuucuuaauauguagcaggaugauagguucuguuuuagcauccauucucuagucuaugucuuuuuauuggguaguugaguccauugauguugagagauauaaugaucaaugauuguuaauuucuguuauuuuaauggucguggugguacuaaauguauccuuucaccugucugugcaucuguguguccgcacuucuuuuuguuuucucucuuaccuugguuguaguuaacuuccuugaguugcaguuuuacuucuacuauauucuguaggacucgauuugggaauuaauauuguuuaaauuugguuuugucauagaauaucugucuucuccaucuauggugauugaaaguuuuguuggguauaguagucuaggcuacugucauuuguuaucuauuggguaucugucauuucuuagaccgcccaggcccuucugacuuucacagucacuauugaaaaguaggcuguaauucuaauaggucugccuuuaaaugguacuaagccuuuuucccuugcaguuuuuucuuuguucuguacauuuaguguuuugauuauuguguggugggaagauucucuuuuauggucuagucuugguguucuguaagcuucuuguacauuuaugggcaucuuuucuuuaugguagagaaauuuucuucuaugauuuuguugaaaauacuguuuggaccuuugagcuugaugaugcugcugcugcugcugcugcuucucccuccuccuccuccucucccuccuccuccuucuucuuucuccuccucauccucaucuucuauuccugcaauucuucauuuugaucuuuuuacaguuucccagauuucuugguuguuuucugucgggaacuucuuaaauuuaauauuucuuuggcugauguaucacuaucuuuuauuguaucuucugcaccuaagauucucucuuucaucucuuguagucuguuggugaugcucgaaucuguacuuucuguuucaucuccaggauuccucaguuugugggguuuuuuuguuuguuuguuuguuuguuuguuuguuuguuucuguuacuguuuucaguucuuggauacuuuaguucauuuccuucaccuguuuguuuguauuuuucuguauuucuuuaaaggauguauuaauuuccucuuuaccaaccucuauaaacuucauaagacugaauauaagguaauuuuuaugugugugugcuuucacugugguucuuaggcacaaguugaauaggacugagagcaagauaguggugcacuggcuuagguuugaagagugaugcauaggaucuucaggacccacccaaguucagcuucacaaaugaggaauagagacuaggccccuaccaaguggauuccucugcucaaauuccuccaucucuggcugccccuuucuaccagagcuucauccuccuuacucagaacucuucucacuuaccuagaaaaacagcuggcaugacaaacagguauccuagcuaagaaauguagaagcuagaccaaacaauugcaacguacugugucaaagggcagaagcagauaccccagaguguuggcccagcauacuaggugcuugcuuucuggggagauaaucaggaccagcucccacaauauuaaccaaguguaucuacuuugaaagaugaaugcgauauucuugguguugaaauaugaaaauucacucuggcuguugccauuucuacuuauaaaaauaaaagcugucuauguaccuaaacaccucucuucucacuguggagaacugucccagcagccaaccccacaugggaccuauuagaaggggccaucuccagaccaacuaagcuaaagcuagaguagaaguguucugccagcuucuuuuuuuuuuuucauuuuuuuaauuugauauugucuucauuuacauuucaaaugcuaccccaaagcccccuauauccucccccacccugcuccccaacccacccacuccugcuuccuggcccuggcauuccucuguacuggggcacaugaucuacuucuuuagcauguuccaaagcacccagcucaaagcccaggguccuggaauuccuuuaaggguugggucuagaauuaucuuuucacauaaauuggacauaguacuaccagagguuccagcaauaccucuccugggcauauuuccaaaagaugugccaacugguaauaagaacacaugcuccacuauguacauagcagccuuauuuauaauagccagaagcuggaaagaacccagaugucccucaacagaggaauggauacagaaaaugugguacauuuacacaauggaguacuacucagcuauuaaaaagaaugaauuuaugaaauuccuaggcaaauggauggaccugggggccaucauccugagugagguaacccaaucacaaaagaacucacacaauauguacucacugaaaaguggauauuagcccagaaacucagaauacccaagauacaagauacaaucugcaaaacacaugaaacucaagaagaacgaagaccaaaguguggacacuuugucccuucuuagaauugggagcaaaacacccauggaaggaguuacagagacaaaguuuggagcugagaugaaaggauggaccaucuagagacuuccauacccggggauccaucccauaaucagccuccaaacgcagacacuauuccauacacuagcaagauuuugcugaaaggacccugauauagcuguuucuugugaggcuaugccggggccuagcaaacacagaaguggauggaucacagggcccccaauggaggagcuagagaaaguacccaaggagcuaaaggggucugcaacccuauugguggaacaacaauaugaacuaaccaguaccccccagagcuaguguuucuagcuaguaucagaagauggccuagucggccgucuuuggaaagcgaggcccauaggucuugcaaacuuuauaugccucaguacaggggaaugccagggccaagaagugggaguggguggguagggaaguggggggaggguaugggggacuuuugggauagcauuggaaauguaaaugaagaaaauaccuaauaaauaaaaagaauccucuaaaacacuucccuauuccucccaaugaggaaguauagaccuaagcuacagaggccagcugcucuguauagauauuuucugagacucccuggccuguuccuugauggauuccuugagggacaggcauugccugugucaggccuuagugauaugaaucucucuaaagcauuuucuauugaucaucgcagucugacuucaccuuucugggcuccagcuuauauguuggugauauugcauagcuaguguucaaccaggcaguuaauuagaucaauuuuguucuggaaggaugcaauuuucuagaguucucaguggguggcagccaugccuauuuguaggcagcuaagugugacuguuguugcuuuuguuuuguaggaaugaacuggagaggcaguuucuugaauugcuacaguuuaacaucaauguuccuuccaguguguaugccaaguauuauuuugaucuucguucucuggcagaagcaaacaaccugagcuuuccucuggagccccuaagcagagagcgugcccacaagcuugagguaagggggauucacacaccacugcagugcauugccccauuaccaucucugugccccagacuuucaguauucuccacuauguguugggaaauuaaggacaggacucuagauggauugcaggccaguucauuaacugaguauauauguauucuucauuucuuaacaaccauaaggcagcuuuuccuuauuauauaccaauucuauuccuaagucauucuuuuuaacauucuuaaguuuaugguuuuacucuuuuuguuuuuauaagucuacaaaaauaaguauuuuccaucaugcauuaacauuaaaaaaaaaaaaaagggaagaagcuuccaaguggccuuaguaauugagaaccaagaaaagguauuauuauugucuuacuuuuuuuuuuccuaaaggauucuuuuguaguuggaauuaaggccugccugaauggauauggucuggguugaaggcuguuguuacuaaccaaugacuguucaucacagcgaauguauguuucugucaacucuucauaucugguuuaauggguagcaugaaaggcaaagaguuaagaaggaacucuagugaccccugcuccaaugugugcugacccuguucucugucccucuagacuucagccccuuggcaaugugguuucagugauagagccuguucuagauuaguuucuaugcuuugauaaaacauugcuaauaccacuugaggaaaaaagaaucauaguauuucuacauuauagaucauuguugaaaaggaagacaaggcagggcaggaccccagaagcuagaacugaaacagaagcuaaagaggaaugccacuuaaugguuugcucucauggcuugcccagugugcuuuguuacuacccaggaccaccuacccagagguggcacuccccacaagcgagucugauagagauauuuucucaguugagguuuuugucuuccccaaugacucuagcuuaugugaaguugacaaaaacaaaaacaagcaaaaaacugacacaguauaaagccuuagaccacaguggaagaugagaguccuucuccaaacuugccagggucuuaugugccuacuccacuguuaggccuggugcucugacaaggucaguacuuguauaaaaucaagccagagguagacagagguuuuuuuguuugguugguuuaguuuuaguuuguuaggaaguaucuucagugugaauuuccuucacauucauucuguugaaaacuguuguaguuuucauacuguugcuguuauaaaauacucugacaacaauaugaaggagaagucgguuaguguuaagauuucaaguuacaguucauuauuucaaagaaagucaaguagcuagagacauaacaucugagaucagaguaagaauaaaggcauacaugcuuagugcucagccagcuuacucuacugucaaggacccaaacuagggaauggggcuacccacaguggacagaucuuccuacaucaauuaugguaaucagaacaguucccuauagacaugcccacaggucacucugcucuagagaauuccucauugagauucaaguaauacaauaucaugguuugggcacauagguucuagguuuuuuuguuuuuuccuuaaaaauuacaguuaagagagcaauuaggagucuuuuuuauuuuuuauuuuuuuauuaaauuuuggagacagggucuguuuacguagcccugacuggacucacuauguacaccucaaauacacagaaaucuggcuucaaacucacagaaaucuuccugcaccuacuuccuaagugcuucguuuuaagcuguguuccacaacacccccggcagucaguuaauuuuaagauggaaucucaguagagcaaggagacaaggagacaggcugggugcuaagcacugggacuaaagaacuccagggaggugccacuacccccuuuugugcagaucugcaccacaugcaaaguaccuuacggauuuagcuuuuaaacaauuacucugaaccaggcucaagguguuuggcucuaucuacaugucagagaaagcuguuguuaccacauauaaucugguuaagagggaacacuacuaucuguuacuacuaugaauucagacacacacuauucuugagaaauagcaauugguaaucucagaaauuuuaaauaaaagacccaagaacucugcacacagugcuuggggugacacagcucagccugguaauuugucuguucucccagcugaccacuuggcuucaacauggaugccugucugguuucucuuccccaguccgucuucucagcugaugcuggaauuauuuuccuaaaaugcagccuuugauuuugucauguucucuuaagauuaguggcaaguuuucacuggcuacaaacuagaaaguguuuccauccuggccugugugugcucuccaucccugaaaccccaucuggucucacuaacacccaccguguggguccacccuggcuccuaggucacucuggacaccuuauuuguugccauccuuacuaugguugucucucauugugguuugccucacaguagccuuagcuguuucuucucuuuugcuuucaagaucaggaggacacagauacacaccaucuccaccccauuucaaaacaggguuggaaguugugcuaggcaggaagaccaguugagccagcagaugugacagccuugcagagccccuggcugaggugggaccuugguguguacccugaccugcacugucuuucucccucucaggccaucucucgucucugugaggacaaguacaaggaccugaggaaacccaugaggaagcguucagcaagugcugacaaccugauucugccaagguggucuccagccaucaucuccuaacuggggcacucuccugaggcugugcugucccucaguuucuccuuuuguuuaaagaaaagaugaacuugggugguuuuguuugguuugguuuucuuuuuuccuucuguuuuuaacaauagccucaucgaggcugccuucagcccgccuccacacuuggugggugcacgcagagcggcuuuaagggacgugaaaucaguauucaggaaacuuggugucaagccuucccggccaucaugaaaagcacuucuuucauggaggaaacagacucuaauccuggagaaggaaaugaaggaaaaggaaguuguguuaagggauagauuacuugguagcuuugcuguuucuggguccuugucuggucauagauaccagauggagccagaugauagguagcagaguugaaugcaucuccaaaucgggaaugccaugcuaugcccuuggaaucugugugcucuguaagaaagacuuccugcauuccuucaugcugcucucgggauuggggauggggauguuuguucauuuuuauucugguuggguuuugauuccucagagcagagaguauaguuuguaaccaccauggcacagacauccaaauaaauaguacugauuguuuaucucugcuccauuuucucuagccuucuucugagcuuucuuccucacaaguaagaugugcuuguuguguuucuacacaccuguuauauaugauucucuuucaacaauagcaggauuaacuugacuguaguacugaaccaaaacuaucccucuccugccuaguuccaagaacauucuaucuagauuaauaugggugcuugugccuuccaguuuucuugcaauugguuguucuugguuuugguuuugucaccuccucuccaucccagguucucuuuuucugcuaacaugaagguguaauuacaaaacgcacucagacuuuguggcugaaggcaaagguccucagcacaagcaucuuggauagagaagcauccggggagccagguuucccugaccucaugaggagccauguccaugugcucccugccuggucauucuucuacuuccauguccauuguuguaagcaauauucuccuugaauuuuauaugcuuccuuuaaaucaaauuuagucuauuuguauacaauuuuuuuaaaaaucuaaaauuuagaaaauggggaguggguggguggguauccagugggaagaucacuaaaaggaaaaauguuacuauuuccugagguauuuuucacagaaugauugaauaaaaaaaaaaauucaacuugcauucucauugugggugcuuggagaagcuacacaaacugugaagguucauacuuccuuacuuauaaccagcuuuuguguuuucugacugguuuuggcuuguuuggggaauagauuaaacucuucuauugagugcaguaaaaggguuagagguagcuaucaaagagagagucugacaugaagucuaagagucugagucacacacaagugcuuugcuucugcccaucuuagguugcggugaccgagguuugugagguuuuccuuguuugagauaaauucuagcauuugcuuuaucauauacuccuccugugugagcguggaaaaguuuagaauuguaugcuaguuuugaaugcccuaaaaucauaugccugaccccucucaauagagcacacuuugaagauggaaggaacaaaauaucaaaaucccaaaaguaugaagccacaaauguuaguaaagagucagugcaguucuugugcaguuuuggaugcaauaugagcaaauucuagccuaaacuugcaaagcaggaaguaaaaaauuaacuacccuccuguugccucuuugaugauuugcucugagugggaaaggggaucggcuucucuccuuacaaaccuuaaacagaggucgaaacauguagaaagugucauuuuguauucccucaucucuauaacucuagaagggaccuauuuucuuagccaaauaugaaugccucuuagaugaauccuuccucucauguaaaguaccuuaucuuaccagcccauuucaggaaagaacugcuggcuugauagcagaaaucuuauuuuuauuccuuuuauuugaaugggagauuuggaaauugacuuauguaaauaguucaaugcaccugauacuauuuuguggaguuuauuaaacuacuuuaaaagauuguacaguguauucguuguauguguguacacacagucugguaccugacauucaacagugacucuuuauagccuggcuugguuuuauucagacuguugacuauuguuuucaagccuuguacacuggacucuaccucugaauaggaagguuuucucuuugcaucagugaguguuaacuguauuaauugguuguauuucuugcacuaaggauuucaguuguacuguuuagucugaauuacuaggcauguaaguauaggcucauuuaauuuuucuauacaauaaugaaaacuuauuuuuguuuucuggguuguucucagguugccaaaauaaaaaggagauaaaaccaaucuaauaguaguguugauaaaucauagugacuguaacuuguuugcaaaguaguucgguguccaacagguaacgcuggaugcuguuugggaaugcuaucucagugcagccucugguaaagagcucguugucauuguugaaggaugaagaaagccacaguuuuuugacuauagacuugauuuaaacagcaaauauaauuuguugaagaauaaacacacauuccgguaaauuuuguuuuacuuuuucacugggaaaagaaaggaguuaagcuaaaauauaaugagauccuaagcaccuaagaggugcuuucaugccuuaauguucaggugagaucagcugugacuucaugccuccagcuguuuaagauagcucuucuguucuguguuccuucuccauggucuuuaccugggauaucuccaacuugguguuucccuugcuucagggaauuuugcugcuuaccugagugucaaagcagaauuuggugaguuaugauuuugcauauucuugcugcuuuagggacagcaaccuggggccauauuauaagcuuugaguuuauauauguauauauucuuaguucacuauagguauuuaauaaguuaaaaauauauauguacauagaacaaauacugucugccuuccugcuauauuuuuuuaauuauggugguauaagauuggacaguguuuucagaguggcaauacugaaucaugauugugaggcuggccuccuagucuauguaaucauauucugccucaaaacaguaaaauugagcagguuuuaggggugaugaguaaaugaauucuaagaauagugagagaaaguguguaugucuucagugauugagaaacugaagcccaccugggacuucagccaggugaggagcuaaguuagccaguaggaaucagagcacauucuuuccuuaaauacuguuucuguguuauaaaccacuauguccugguccucaguggaguggauaucucaagacugagccuuggcaguucuuacaaacaugaauggucuucugaaaagcaagcuacagaugaugccuauccuuguuaauaggaggaaauaggaagcauagccuggagcagaacuggggaaagaacuuagcuuagggcuaagaaccccucagcucuaugcguagaaagaaaacuccagccuauaauaggaauaacaguucagccuuacugaaugcagagcacagagcagcaccagaaugcccucccagaagcaagcuaccugacagcuccauuagagacaaggaagucagugaggcgugugcucacacugcugaugacuucaacaagccauaccccaugcuacuuguuagagcuucuuacugaguuuguauaugucaaggccacagauccucuggugccacuuuuacuagaaacuucuucgguaagcaauacaaaaaugacuacuuuuacugauggugugucauuagaagcugcuuuguguguacacugcugcaggguuagcaaugcccaagccaggacuuguuccaaaaaaacauguagaguucuccaagaaccuguuuauacuaagaaaugcccuccaacaugucugacugaauggcauuugagauuuauagguccuaguaaaccaucuuguauccuuuugugauuuguuugugggcagggaacuuuauuccuuuugagaacuuuuguuuauaaauagauuuaaaugugcaaucaaaaacugucaucucaaaauaaauacaguuuugacaaaaauguuaaccaugacuucaucucauauguaauacuuuauugauguugguauugaucuguguuguaaugaaaccuggaauucuauuccaagucuuaaacuaugacaccaccuucaccuucauccucucauuggagguugcuguuagacucuugcuaguccagggacacauguacuaagugguucgugugggaugcuaggaaauaugaaugcauuucuuaaaagcauaagcccaccugaguucccugggauguuaguccauuuuuguaaggcccacuccaugaaagaguugcucuuacauuuguagaugcaauucucauauaaaggccaugguuguuccaacaucagcuaaauucuguccuuuuccagcucucuuguagucauuauugaccucaaguagcauuccacugaaucuagccauuguguuuuugucuggguugcuagauucugggaaaaugagguggaugucugacuucacccccaacugaagcuguuuuagaaagagugcuacuucacgcugaacucacccuggaagcguaaccuaaccaaaaaaaaggauugccuccucccuuguggcaugucccaccuguccagaagacuaauaauaagcaaccaccuccaagcuucccauaucugcaccugagcaccagcuacugcagucuauggaaaaguucuugccuuuaaggggguaccggaaaguuggggaaaccuggggaaagacugauauuugugaguaaaacaugaaguaacuguagugugggauaccaugugggaggccuuagugaccucauauaucagcagauaagugaaagauauaguccuggccaugacaagaauucuaagugugucuuauuuugguuaauacuaaauuuggagucucuggauauuaauaacaaaaguuuucauccaauugguguuugagaaagagaaaaagagauugaagguggugcagugggaaagcagcaguaggucacauacuuauccguccuguccagacaccuguagugcugagccugaaacauuucuauucuagaauauuacccagaaaauguauaucuguuucauaaguuaauuuuaauguagacuuuaaaugaucccuauauugcauucagcagcuguguauugaccauguauggugguagacggugcugguguuaggcucagugcaguaaaaacaagacaaggucuuugcaggagggcucauuaauaaccuuacaacuaugagguaugauauuuugaaauuggauggugugguaauaagaggaauagaguggaaguagccuuuugaauugagguaucuguggaagaggcaaagaggguuacuauggugggcuacugaaguguuaaacuguuugaaccagacccuauggccaagugugguuagcccuuuguauacaaaggccaacagugggaggaucucugcccucuucacacaugaaauauuggcaacaagcgaguagccaauucaugaugguacaacuucugggaaaaaguggcacuuugucuaucauguugcuguagauugugacugaaccgucagucaagaggcuggaccuugucuucagaacggcaacauguaggugcuaaucaaugcuuuguaugugacaguaaugacauugaauccacuuucuugauguaggcaugaaaagaauaucugaacuugucuugguaacauguaaauaagccacuuccuggacauuguuucuuccuacagauaaucauuguuugaugauuuuuguuguuguuguugaaugucaccaugacuugagaaccuuagaacucaugugguugccacuaaaaaagcccaagagaaacagccagaaguacauaauacacuuucaguaaggugacaguugaaagauuucaauaaaaaaacuuauaauucacuaacaaua

SEQ ID NO: 8805 - RNA, 2312 nt, Mus musculus
ggcaccuuggagaccggagccuggugauagauuuuuaagcucucccuaccuuuagccauguugcaguuucaacuggggcgagucaaagggaaucccaugucgaucucauuuuguagcuguguagaccgcccguuggcucccaggcuauuuuucuagccucuaacagaauuuucucuugcucuucgguuguuaaaagcaucuguaaccgcuguugacaguaaucccaagaaggcugaugagagaacauaaggaacuccgccaacccugugaggcauuggggauccugagaaagggggugguuaguuuuuuaguuauaaauaccagcagaggaaaaugaccaguacugaaggguuuaaaguuuggguggguccaccagaguccgcccggacucugcucugcaggucccuguggcuccauguacucacagccguccgccucucaacgccccgagggguuugggguucccucggcggcuggggucgaggcuguggauaaggggaagguuauggacuagaccacucaggaggcuuuauagauuuuagaggagccgauuuagcugguggcuccaauucaggagaagccuucaauuucucuuguaacaugagagcacaaccacaauuuugagaagcaaaacccaauuuuaacaguguaaacaaucuauuuucuuuaaaaaugaacucuaaaaacauuacuugcuacaaaguuuggcugucuguuccugcacacaaacacaagaagguguagccgccaauauaucucaaagacacuacccuaaaucuuaucuuuuauaaaucagauuucuaggauaagaauuacacagaauauuacccaauuuaggcguaucuuuagagaccuguucccauggguugucucaugcuguauguuguaguucuaaauuacucuaacccagaguuaccaguuuuaagucaacuuuuuguuaccaauguuacaaauuuuuaaucauaaccaauaacuuaugagccacuaaucuauaaccaagacauauaaaacauauuuauacuuuugaaacuauuuagaaacaaaaaugaaauggccauauacauuugcccauuuaaaccaaacaaaauucuuaauuuuucuagcuguaauuucaagagaggagcaccuugucaccugaugaauccaauaaucacaagcacugagauuuuuguaggaaaagcagccaucuguucccuuaccauagaacuugagaagcugcucgucccuauaagagcagcguuuauaaucagcgccuagcagggcuucuccagccacacuagauuccuaacuacagaugcagggcucuaaagaccaaucaauacuguuuauuuuauuuuauuaccaaauuacccccagauagucggagaguacuacuuuucuuaaaacccauucucucacaucucagguguaaacuaucucuagucaggauauaaagcaccuaugagaauuaccuuugcuuuuguuuuuuuuuagauuuucacauagcucuaaacacauacacaaaaacacacaaaacagaaaccaacagauccagacacacucgacccuuucuuguccuccacaagcaggcaaaagaauuagacgauguuggagggggaagcuuccgcuucaacagaacucggucccucugaccgaucuccggagacagccaggcgucccugacucucccuaccucccagggcgucccccagggccacagccugugguccucuuagcacgucugccgaccacaauccuccgguccuuacggcccaagaggacagcugcaaauacagacgcgcgcauuucagaaaaccccaucaccccaucgucuacaaacaccaucguccacuucuaccuagacgaccaaaaccagagaagcacacuuguuccucacucugccagguguaaaaccaaggcacaaggugggacucgaacccacgaucucguaacccugaaaccaagacacaaauucaauaaacucagauggaucuaaacucagacuuugccguguuucacaaacaggacaagauacaaacaacccaacacaacaagcacauguuccaauguucguuucagaaaacagacacucagaacagagacaccggcuggcacgcacacaagaggggauccccauaccuccaagucgguucucgggugugagggguggucgcguuucccggccaacgcaccaaaugaaagacccacaacgugaggacucccccacguucugacucaggagaggcgacaccccaaaaucaccaacgagaaaacggucuuguugcaaauugcaagaggauuuuuauucaagagcgcucucgggcccacgguca

SEQ ID NO: 8806 - RNA, 170715 nt, Mus musculus
cggggugagaggcgcgcggcggccccgcggcagcagagugcagaacgggacgcuaggacuggaacgcugaaggcugccaugggcgugcagugagagacacugguacgacuucuccgggcggagcguguccucagucaccaugaaagguagggcggcagccgucuuuggggcucacggaaggucggcggagguguagcccgggcgcccgggucgcccucggacucgaggaacgcugcgccgcacagcgggagcccucgaggcuggguuugggaagugcucaggcgcucuccuuuucgucggucuccucaguccuuuagaaaucccaaaucguuguuuacggauuucaguuuccaacuuuguaauugaaaaaacaugcggaggagauuuaggcaucaucauucuuccgagugaguuugucgagcuugccacucucccggguccucugcccucgcccgaugacccuuccgcggucccagacgucacacugccacaggccggcuguuuucccgggacucgggauguccucggugcgcgcgcggcacaucuggcaacgauuaggugcccgcggaguucagcuggcuaggaaagugcguuuggcaucucucuccaucggauccacugacuggaaaauaacugcuccuuucccuacgcccgcccagggaauaguuguccccacgugugcccagagaaugccacaaaucuuacugauauugguccccuaggugauguccucugcaggcggguuuauuggagugucagauuuuaucuugcuuuuuaaaagaaucuggagaccacggccuggggguggggagcaaucuucagucuaguggaaacaugcggauuugucagcagaaccuugauuuaugugggagauaaauaauuacagucggaccaucggagauggggugcgucguuaaaaaauagacgggaguaguguuuacuuaaggcugaaguugcugguuugggacugggguaaaacguuucauucccugcgcgguccugggcugaaugcgaaaugacuucugaguuuccagccacaccagacuacgugaugugaucuguuaggcugaggggggcgcccuaggagcuccaggaauuuggaaaguaucuuugcuccgugagguucgugcugaacuacguggagaucccgguccuguggaagcaaucgccuuccaaaggcgcugccgugucuucacuggagggaacugcaaggaacgugacuguaagccaggugcuaagaggcuugucccaaggaaaggauacucagaacaggccacaacuuuaugaguugagacuuuuuguuuguuuguuuguuuuuuguuuuuucgagacaggguuucucuguguagccuggcuguccuggaacccacucuguagaccaggcgccugccuuugccucacaagugcugggauuaaugcaugagccaccacugccccgcugacuugagacuuuuaaaacgcugugauaugcuuucuugcucugccucuguuucuauugccuugccccuuauuaacuacuuagaaaacauguguguuucuuagcuagaguuccccuaacuccuaaagugggaauugaaauuaggcccuaucccacugaacuacauccauuacuucucuccgauuuguaauuuacgauagaaagauagggucucacuaaauuauucagucugaucuagggccugcaaguguaggcagugaacuugagaacuaccugacucagccucccaaguagcuggagcuacagguaccauaugacuuauugccaaugguuaagucuaucaguuucucaguuuuuggcaagacaacccugcccccagcaccaccucaggcaugccugcgcuuccaucaauuccagcucuggaaugcaaaacacagguuuuaaacgcauuuuggaugagacuuaauaacucacuggggaccagauuggaaguucauaauuuaccucuuguggucugagcccauuagcucucaucacuuucuuccacagucagggagacuggauccagggacuggugaaucuguauguaguuuuaucuuauuuaauuaguuaauuaauuagagagguuuacucuauaaccuaagcuggcuccugauccuuuuauuucaaccucccuaguguuaagauaacaggugugucaccauacccuacuugaagaacucauuuaauuaauagcaacagaguuuauguagcccaggcugcuguaccuuucagucggccuggcuucaucuccugaauucugggauuacagacgcugugccugaaauacuagguccagcuaaaauuuugacauuuuacuuacuguauuuuuuuuuuuuuagcagugcugagaauugaacucagccccucccugcccaguguaauuauucugauaccuagccaucaguaguaauuaaccaacccaacaacaggauccuugggguccugauuaugucauaugguucuuaauucauuuaacuucauuggaauuugacuuuucuacuccggagguugaggcaggaggauugguaggaguacuuugcuggucaggacuacacuuauuuuuauuuuuccuuuuaaaauuuccuaagugaugaaaguaguaagauuauuaaaugcuuaagcacuguaguuagucuucuguagucaccagcucuacaucugaagacucaacugaggauugaaaguaauuguaaaaaaaaauguguugaauaggugcagacuuuuauccuuuuuauucccuaaguggcaguguagcaacuauguaugaaauauuuauuuuuuauuagacauuguuaagucauuuaaagaugguuuaaaguaagugcaggaaguuauagaaaguacugugccuaauuaguuuguuuguuugucugacucagacucuagcccucagcacugaggaugcucuacuauuauuuauucauugugauguuaggauugaaccuaguaccucccacauuuuaaacaugguuucugucauugagccacagucauggucuagaaccauuuuguaugaggaacaugaacacucuguaauuuguugcuguuugggguuugauucuuuggaaacaaugucuggcugcugaagaaaucaucuuuagccuucuuuaauuaaacaaacucuggggacuguaaaauuagagcuucucucgaugaagcaagcauuuuuaggguauucaguuuucuaauucugaugcuuaaaccuuggucauagccucuucaguaacccauuccuguacuauccagucugcuaugacucagagcaacaccuaucuguugcauuuagcaaacaucugucucugcucucauguuuucaucccaggagucucaaguaucaaaauaaugaaaucauucuauauuuccagaagaaaaucucuuauuccauguucagccaaucuccaaacugaauaaaauacaguucuuuguuuuuuuguuuuguuuuguuuuuuaguuuguuuccaauuuaauuuucaaauauuucauggcgccauaaaucucgugguuuuggauagucacauucuuuaaggaaggaaucugacuccuuuugaguuaggugugucauuauuaaauugcauuccugguucugaaugcugaaaauauugaugaguuuccaagccagcaccacaugagauuacagaaguccaaacagugauucuuaauugucccaaagaaguuguacagucagaugaguacucgggggcugggauguagccugggcagcagaauccuuacuuagaaugccuuuuaaaucuccugcaagacaaacuuaguaugugaugguucucaagguagaaguagaagcauuggaaguucuguucacccugugcugugcaggccagcuugaguuacugaaaccuaucaccaaaggaagaaagaaagaaagaaagaaagaaagaaagaaagaaagaaagaaagaaagaaagaagagaagagaagagaagagaagagaagagaagagaagagaagagaagagaagagaagagaagagaaagaaaaaauauagcagguaacacaguuuagcugcugacuucugcacauacacauuugugaaacacugcuuaguaauauuacuuuaccugcgcacugcucaguggucuauuucugccuccaucaguuuucucccacacucagucagcuugcuuucucgaaaauuuuugugcugagugggaacccccuaggaaccccuuguaugcaggaaaggagaaaugcagugaggccucuuuucuuuugcuaguugggcaucgaagcugcccuuuugcagagcuaauuuacaacuuaauuaugcuuuuaacuuuucauuaacuuagggauacuuggcauucuuaagccguggcuugauuauuguuaaguauagauguucccuguggucuaccauacaauuucccccaugauuuccauguuuucccuugccccaggcccccagcuuuuugccaugguggcuuaucaucaaugaugguguggcaggaaugguaacuuucaagcugggcuacaaccaagugucuaauuuucuaauaaaugccuauuuucauuaaaauauuauuucuaaacuucugaugccaggguacuuacacagccuuuaaaguauuagcuuuuagguaaaacagaucuucaaguuuaguaacagaaaaaguauauuuggccuuggguaaaccuggcauugugaaucaucccucuugauggcaaagacuuggaggaaggagugagguuccuagagaggaagcucagaguggugacaaaccagcuuuccugacagacaauguguuucaucacgaggcauaggcugucuuagcuuucagagacuuggcuguggcuacaauguaggaggacaggaaauaggguccuaggaaaauaaauaccaaagaugaugcccuuuccuauacaugucugguggacuaauaauaucccccaguugucugugugccugucugccugucugccugccugccuccuuccuuccuuccuuccuuccuuccuuccuuccuuccuuccuuccuuccuuccuuucuuccuuccucccuucgguuguuuuuuugagacaggauuucucuguguagcauuaacuguccuggaacuugcucuguagaccaggcugggacagaagauugggacaauucaagugguugggacaaaaggcaugcuccaccaccaccuggcuuuuauuuuuccuguuacuaauaucuauuguuucuugggcuccaaccaugguagucauuguuauuuguugcaggcaaauaacuauucuuauuuauuauuugcagacaggcuuggagaguuugcccuuucaguucaagggccccauguggucagugggaagcaguauucaaacuuacagucugaaugcaaucaacagaguugucaagauauuauguuagucaguucuuugcuuccacuuuaugaaucucaagcuuugaacucagguugacagacuugguggcuuuuucccacugagcuaucucaguggccccuaaaaggacauauuguaaaagauacucaggaguaguugacauucuguuuagaaaugguuucauuuguuacugcugacaaaacaguuucuaaucacaccaucaacccaacacuuucaaucaagcaaugauuugauuucuacuuaaacaggugucauuugaagagccaaaaccaauauaguauguugaaaagucucugcugguugcuuaagggacguuuuuuaauuacauagcagugaaagccaaaguaagcagaaauuaguaauuccacguuuaagaucucaaggguacuggggacucuuaaccucagaauuuaucauaaaaauauuuaaccacugcucuuaaaaauagaauugugguacucaacauggagggagguuuuaauuaagcacacuuauuggacuugguauuuuaaacauggcuccuauguuuccuaaaugcauuuauaucauaacuaacucagugucuuaggaagcaauguucaucaccucagaggcuggucauucagcaugcuguguaaaaaguaguuagcauuuggcucuacugcaaaugagcauuucucugaccuucuuuucuuaaggcggugcuguuaggaaacuugcuggguuuuguuuuuguuuauuuauuuuauguauauuagaauacacuguagcuaucuucagacacaccagaagagagauuggaucccauuacagaugguugugagccaccauagguugcugggaauugaacucaggaccucuggaagagcagucagugcucuuaacugcugagccaucucuccagcucaaaacuggcuguuguuaauaagcgauuuauuauuugaagguuaagacaacuagcuuaaaaguagaugauccaugcuuuaaaugauuaccaacucaugaaguauaauuauguugagcaagccaaaaaauuggaccuggcaguuucuggauggccacaagaguguggacuaagaaaccagagugccuggugaacacaaaaaaguacugaaccaucuagggccucggauuuuuugugaaauuagagcaguaauugcuaucuacccaagagagcuguuuugagggugaagcaugucaguguaaaucaguuauucagaauagugucuaguguucaaaacucacuauuguagucacuguaauagaagacuguauuauuauaaucuucagacaguaauuccugguuaugaaaacuuuauauuaauuuaauugagugauagaguuaggaccuugaaggcaaguccucaaaguaguuuucaaacuacagauguauugauacugcccuaggguaggaaugagcugucuaugggaagauguguugguacugugcccucuucagaugcuguaguucuucccacugucauucuugugaugguaucagaaucaggccuacccagaaaacagucacacagggaauaauggaguaaugguacaacuucccucuugauaaaauagugguugaguauuuaauuuacccaagaacaaaaauuucccaugggucugaugaugaugacagaauauauuuuuaaaaaguuaaaagcucucucucucucucucucucucucucucucucucucucucucucucucucaaucucucuccccuuagaccaugcauguguacauacaugcauauaauacacaggccacacaugucaaaaucagagugcaauuucuaggauucaauucucucuuucuacauaaugggcagagcuuagugaaccaaacgguugaaccugauaauuuuaggacucagguugucaggcucagagacaggugucuccaucuacuuaggaguuccauugaccugaugucagaauguuuuuaaugaaaugugucucaaauucaguguccaaguuuuuuugcuuuuguuuuugguuugguuuaguuugguuugguuugguuuugguuuuuugagacagaguuucucuguguagcucuggcucuccugaaauuagcucuguaaaccaggcuaucuuugaacucacagagauuugccugccacugccuccugaaugcaccacuacccggcuccaguguccaauauuauuccaucugucuugguuacuuuucuacugcuguaacaaagcaucuugaccaaggcaaaugaugaaagaaagcuuuuaccugagaggcaaagucaaaugaaucaucucuggguucaaggccagccuggucuacagaccaaguuccaagacagccagggcuaaacagagaaaacacccugacugagaggguauggggugaaaggagaaaaagcaagcaagcaagcaagcaagcaagcaagcaaacaaguauuauauuagguuuauauuuucacaguucaugaccaucaugaccaagcaaaaaugugguaaaaaaaaugugguaaaaaagagcugagaacucacaucuugauucacaagcaggaaguagagagaacaccaggaaaugguacuaagcuuuugaaaccuccccaagaaauacaucuccuugaauaaagucaaacuuccuaaaccuuucaaaacaguucuaacaacuggagaccaacuauuuaaauauaugagccuacggggaccauucaaacuaccacaccuuccccaaauugcuucuguccgguguuuuguuacagcaauaaagauaugaccuccaagaaaucacaaucacaacauguaucaagacagauauaacuaauaaguuuuuaaccauaugacaucgugucuguuucauuagcaaugucaauuauccauuaagguaucuuguauuccuauuuauuauuuauauugggcuaccacgucuuaacugguuuccaguuuuuguuguuuuuacuggugguacuugggaucacacuaaggagccugaacaugcuaggcagaugcucuaccauugaguuacacuccuagcuccaguugggauuuuuuuguuguuuuuggguuguuguuguuguuguuguuguugucugaagaaauauuugguauauacuuucaaugcaagucgauguagaaauaucguauaacaugaaugaagcucauccccaaggaacuuacaggcuggugggcaagauuaagacagugcauaagcaacuguaauuauggguagcagguagggcaugcccuagguggguauuagguagacagguuagggacagagauauuuucuuuuggaggacagauaugaacugauugauaaauuagugauagaaaauacauuuaauuuacucaagaacaaaaguuucccguagaccaguaaugacaaaauauauuuuuuaaaaguuuuaagcaagcuuucuuuguuuucauucuuuccuuuuuugccaugugagugugcaugcauacauguguauaauacacagaccauggcacacauguuaaaaucaaaucaaagggcaacucuccccauggcaggggggcaugguagaacacuuuuaaugccaccacuugggagguagaggcaggucucuguuaguucaaggccauccuggucuacucgugaguuccaggauaaccagggugacuuagagagacucugucucaaaaaacaaaaacaaagaccaaaaaaucagaagaagaagaaggaggaggaggagggggagggggaggaggaggaggaggaggaggaggaagcauacugcuaagugucagcuuucacuucuuggugucuuuuggcugguaacugcugagugaccaugccuucccaccaugguggaugguauccuaaaaccauggcucaaauagacccuuacuuaaacuuuugacaaaaauguggcaaauacaaagucguugaagaaaaugucuucaaagaaaagcagaggaugaaauugggcuacugugauaucaagugugauugauauucuaggcauaagaagaucaaauucaaaguacucccagguccugguaguaugaccaucuauccuaucuacuagacuaaaggagaaggaucacaaguucaaggcuauucuaggcaauuuagucaaaggggguaugccaucccacuuguagaguguuugccaagaauauaugugcucauaagaggaauuacaagcaccaccccccaaaaguuucaccaaccuugguaauuguuuagaauauugcuuuaauauaacuuaaaauaaucuaaacuuuaauuucaaaacaguaauaaauacuuggggcaagcaauacucuuuacaaauaauuuuuggaggauuucauacaugagcauuuauaucauuuccaucugcccucuccccccucuaacuuuucucacauccuccuacucucucucaaauucauaacaucuuuuaaaauuauuguuacacacacacacacacacacacacacacacacaccaugcacaauacccuauuuaguguugcucauauuuccauauguguuuauggcuagccacuuggauaacucagcccuggagaauggaugggugucuguaaauacuuguauacauacauauguacauauauacauaugaccacauacagguaaaugcauauauggauuucuaaacauauucauguauuucuaagcaaaggauauaguucagagguagaaugcuuguccuaggcugaauccucaguccuggggaaagacauaagagaaaucuccugaaauaauaauauagcuuuuuggcuuguuuugggggcugagaaucaaauccaaggccuuauacaugcuaagcauauauucuaucacugagccacacccucaucccauauaccuuugauuauugccaacuaucucuuuuguuguuggguuuuuuaguuguagaugguugguugguuuuuggaggaagggucuccugucacuucggauggccucauaguuacuauguacccaaggauagccuugaauaucuguuccucuugccucuaccuuccaagauccuuaacuauugccuucccucagagacuauugauaaaauuucccaaaugcucagcaaauagagucaagccuaugacuuguuugggcaucuaggaaugucaggaaaaagaaaaauucaaaggcugaugggacuugcaaauauuggggcaaaagccauaggaaaaaggaugaauaguuuauauuuuuguauguucuagaggacaaaaggcuauggugugguccuaaacuacuaauauuucaauuaagauaaauagcccuacuuaaccuaguagugcagaccuguaauuccaucuucucaggcaggaggaucacaaacucaaggcuacagagugagucaaaugaaaguaacuuaaaaaaaaaaaaguaaaaaucaggcaggggauauagcucagugcaagagggcuuacuuagcacacacugggcuuugguuggaucuccaggaccacaaacagccaauaauuaugugcaguauuauguucaguucucaaaagauuuuuuucucacacuuuauagagcaagcuauuuguccuagguugucuucacaguccagugcccacaaaggagauacaacaaagccagucuuugcagccuaaucucuuuacagcuugccacucucugaaauguguuuuuguuuuuauuuucucacuuuuuugucccugaaaggagcaguguugcucucccacaguucauaccauauaacuaugaugcgugccuugccacccagggccaguuguggacagccuagaaccucugaaaaccugagaccucugcagcuuggaacucuuuacacaaaccaggcuggccuugaauucacaguggcuuuuccuccuuuacuuucugaauguuggguaugaguauacauuaccauacauggcucaccuucuccucuccuccuccucuucuuccuccuccuuccucuuccuccuccuacuccuuuucuuuauguguuuuaaauuauguguuuguauguccauguguggguuugugcucaugaaugcaguuccuagagaggccagaagaaggcauaagaucuccugcccuggaguuacaggcaguugugacucauccacucugagugcuggaaaacaaauucuggucuucugcaaaagcagaugcuuaacugacuuugaaagguagaaaaggaggauucuacagucaacuuuuuaaagcacagagggagacaaagguaaacugucuccuguguuccaccucuaggccuugggaucuaccagguaucauuuuccaaaccccuuuccccucacaaagaaaacaugaaaaauuauugauuuaagacauuucuguaccaagacuuuucuugauaauccccaucagacguuauuacagaacuuuaugggaaucuuuacaucucauagaauucuuuugauguucagaguuggaugcaauaaacaaauguuggaagaauggugaaucuuuuggugaugagaguuaagaucaaaaguaggauauuuucuuugaucugaaaugugggugggucuuuuacccucuagucccucacugcauccuucagcuccucacuguauccucuaguuccucacugcauccuucaaccccucacugcacauccaucagccccuugcugcauccuucuuguccuuaccauauccuucagucccucacuauguccuuuagucuucaaugauuccuucagcucuucacuauucccuucacaguucuggguauuaaacucagaucuucaugcuuguagggcaagcauaugaccaacugagcuauaucuuuagccuuagaaacuguacuuuaauuuuaccguugggguuuccccuaagcuaauaauaugcaauacaguccuuuuggcaauucugggcagcagcagcagcccaaucaucacaaugaaaacaaucaauauagaguacugaguuauaggcauuuguaagcuacuuuuaggugcugggaauuaaacuuggucuucuguaagaauacuaaguguucuuaacugcugaaccauuuuuagcugcuuacuauauuuuuaagcuaugauauuggguugcuuccuucugacuacaucuaaaauaggauauauuaagccuauaauacuuuuaacacaugauaaguuuauuaggauauagcccuauuuguuguaauuagaggaauguguauuugaucagggcuucugguaauggcauggccugaccuuaucuuuacaguaccugcucucucuagacccuucucuuguagaaauccaaugagcagcucuuggucccugggugaggaaucuugucaugucugaguucagaugacuugaugacuccuaguaggaacuaauuuaucgugacuuauaagucucuugucacuacugugauucuauaucuagaaacucuacagaagcacugccuguugucaggcugggaaucaucuguuaaccucacuuaucuuacagaauggggaagaaucucauuguaauuucaagagcaguuuugggguucugagaugcugcaguaguuguugagaguaucuaaaggggacagcuugagcugucccuuaacuuagcuuagacaauugguuaauucugccauucauucaacaacauuguauuaagccccugcuuuucaacaagccucauuauaagcaauggggguuuauuuauguccgucugucuauauaggaaguacaaugauagcagugaacauauaugaccacauguguguacacauguaaauaagugaagaugguaucaggaaauaauaccgaaaugaauggauaugauagaaucuggguaguccagucuaguuagcuagagucuggauuggaagccauuauuaagacggaaaagcauucuagccaaugcagagggccagugauccuccucagaaagcccggggagguccaggagcagaaggaaagccauuauaauaggcuuuuuuuaagggaagagaagggugugucugguuggggccaggacaauugcauccugcccccauucugugcuacugugucccugccagggcuaacacuguauguuuuuuuuucuacagacgacuuugcagaggaagaggaggugcaguccuucgguuacaagagguuuggugaguccuggcaaagcuugguuccuuccccucacuuagucuaggaugcaguaacagacuuuuacugugcuaacguaaugagacuuugacacaagugaacaguugggacuuugaaguccaauuguaguuccaaauugagcuucaaugugacagguggaugauuguacaacuuugaggguuuuuguaacaagagcugcauccaagcaaauagaagugaugugauguuuaugugucugccgaauacagacuacagacagcucgacugccaaauacuuugagaaugggaaaucugugaccagaaaggagcagaauacuaagaaagucccucugcugguauucacaaaacagcauuuccugugucuugccuaauccuagaccuuauacucauaaauuaguauuagaugagugggagggaaacuucuuccaggaacccaacugaguaagaacacugugggaguguagguaaugccccccaaaagguauuagcaucuguaucccuggaaacugagguuacauggcaaaaaagacaagccauaacuaaacugaagaguuuaggaugcaaagguuauucuggguuacccaccagcccccuaauugccacaagaaggagucacagggaaaccagacugguguuucugacugacugaagcagaauuggaaggguccugaagucagggaauucugguagcuucuagaugcuuaugaaggcaagggaguggauucuuccucuagagcuuccagagggagggcagucuauauuaccucuuuauuugcgccaacugaagcugacuucagucuguaagaggagaaaagugucauguuugagccucccuguuuguaggagccugauauagcaccacagagaauuagcacuuacccucugucuccccaguacugugcuuaugaucucugcucuuguauaauaaauagaaugcaaggucagaacacauuuaguuagugccagauauccaugcauuagaaccaauuuucaugcacucuuggcuuuuaguuacuuuugguggggcuaacacaggcaaguucaucuuguugguaugauacaugauuuugccaugaagguuaaacuguccucaaacuuagaguucucaugcuucuguaugccaagugcugaguuuuuacacaagugcuacuauggacagcuugacuucauuuagauuugccagaaccucaagggaagaaaucuaugguguguaugguaaccuguuuuagcagccacagggaacucucaccccugcugcagaacuugaucucugcucugacccagcuuuucaggaucucuaguggggcugagaaacaucaguaaagcauugcugcuccauccacacaguucaaggggaugaaggaaacagcuuguuuuugugccuuggucauaagaaaaagaaagaugaguggggugggcgugggggggaauauaaagagauucuaaaucuacuuccuauuacuugaaacauccugccugaacuuugauuaaaguuaacagcccccagcugcucuggcuccauaauuguuguagcuuuuuuuuuuuuucuuuucuuuucuuuuuuccaaucuggagcuaacauacuuguguuucuuucugaaaaaaaaaaaaaaaaaaaaaaaagaaauggggcuuuaauaugagaacauagccacacaagggccauaauucccaauucaugcccaagcagagcagccuggacccugacccucccaccuccuccacacagcagcagacuucucguccauaccauguguuguucugauuuccuuuagggugagccacugaguaggguuauaguagaauugaagaggaaaccaagaauuacaaaggaacacaaaacacauggacuagaaaauauuggaaaauaaauauugggauuacuauauguuuuggaaucaguagacaugugaagaacugaaagagguuuugaggucucuuguaguccaggcuggccucagaauugcuguauagcagaaugcagacuugauccccaaccucccaagugcuggaguuacagguaugugccagccugccuggcugagaaaacaugauguagucaugcaugccuguaauucuaacaguuccuaaaguugaggcaggaagaucacaaguucaccuuagugagaccuugacucugaguguaaaaucuuaaaaagguauagacuuuuuaagguguuagagcccuagcagcuagcagcaugaagaucuggguucauucccuaguacuacagaauaaaaacauuaaacaaacaaaaauuaagguuacagaauuaaaaaggugacacagaaaacauuccguuaauuuuaugaccacauuacuaguuaggaggguggggagcuggugcaaaaauaaaaauuagcacauuuugaaaagaauuuuaguuuaugggguuaaauuacacacugaaauugccaacuggugacucagagucuccucauguaaugaacugagaaauguccaaagagcauaaacagaaaggaggaagagaguaaguaaaugguaccagacagaacagacagaaaauuugggcaggccgggcaaaucccagcacuugggaggcagaggcaggcagauuucugaguuugaggccagccuggucuacagagugaguuccaggacagccagggcuacacagagaaacccugucuggcuccugagccugaaaagguggcacacacccuuuauccuagcccuuggaagguggaggcaggagggucaaggguucaaggucauccucagcuacauacugaguuucaggccagcuccauaagacccuaucucaaaacaaacaagcaaaccaacuaacaaaggaaaagaaagaugguccugcugcggaguuuugggguuguguuucuaaaacauagugaagucuucuuccacaaggcuggaguagaaaacugccuuuaauuccacagauguagaaggugagauguggggacacugaguccuucgucaagugaaugagcuggaucugagauuagaaaagucuguuuucuaucaggcucgugucugggaugggaucuuacauuggguugaggagacaccuccgccucugugccugagaagagcauccugcagccuaggaacccuaacgugggucuaccgucucuauccaggccucccacuggggaagccugggcauuguuaacagguucuagaacucugaccaaguucuuaaaaagguaaauagguuuucaguguaguucuuaagugcaacagaaccguagagcuuauuuccuuaggcauuuguaggguugaacauacucuuugcagucaguugguggagccuaaaagguggaaaguguuugucuacaugugggguaaccugaugggcccuuccccuggugacacucguuacuggaaaacacuuguugacacucgugagucuuagcauccuacccuuguuccauaagcuguugauaccaucaagguagaguaagucugccaugcagggcuuuggugcagagggguccugguacacaaguucuggguaggcagugugcuguauuucacacuugugaaguuuggggcuauuagcacucuuggcauuuuuguacacaacuucagaacauccaagugugaaaccucauuccuaaggaguugggaguaguaugacuuugccucuaaauauggcuguuauguugaccuccauuuuugcaaaaagaaacuggauaccauagagagaguuguauuauugucuuauuuuagagaugucuuauuuauacaaauaaaaacaacuugaauggcauacagaugagcuagggguuaauuaccucagauaauuaccaaguagguauuuuaaaagcuauucauccauaguuacucagaaacauuuacugugcaagguccagguuauuuauaucauaauauugauuauuuuccagauucagcacagauuacagugagggagaaaauuuuugaucuuuggugauauagaauauacuguaucaauuuuuuucuuguacgguuaucccuuguuuauuuagagacucguuauuacauuugucucaacuagguuuguuuucuuuuugucuguaugucaaaguuguucuguucggaaaguucugaaacaugucuaaaaacgaugacagaaugaagccugacaguuuugccacugauuuguuacguaacagaagccucaacaagaggaaacuuugaagagauaaauaagugagcauucucagaguuuuuuuuuuaauuuaauuuuauuuguaauucauuuuuuauacuccauauuccauuccccaccucuuccuguccauccuccgacugacugcuccacaucucacaccuuccccccccccccaccccgucuccuuguggaugcccccacuccccaccucgccugaccucuaaacucccuggggcuuccagucucuugaggguuaggugcgucaucuccgaaugaacacagaccuggaaguccucuacuguauguguuuuggggaccucauaucagcugguguguacuguaugugaucucagggguccagguuaauuaagacuguucuccuacagaauugcccuucuccucucuccgaaugaacacagaccuggaaguccucuacuguauguguuuuggggaccucauaucagcugguguguacuguaugugaucucagggguccagguuaauuaagacuguucuccuacagaauugcccuucuccucucuccgaaugaacacagaccuggaaguccucuacuguauguguuuuggggaccucauaucagcugguguguacuguaugugaucucagggguccagguuaauuaagacuguucuccuacagaauugcccuucuccucugcuucuuucagccuucccuaauucagugacaggggucagcugcaucuguccauuguuugggugcaaaugacugcaucugacucuuucagcugcuuguugggucuuuccgagggcagucaugauaggucccuuuuugugagcguuccauagccucagugucaggccuugggaccuccccuugagcuggaucccacuuugggccugucgcuggaccuucauuuccucaggcuccucuccauuucuaucccuguuaauucuuucagacagaaacuauuaugggucagaagugugauggcaacccccuccgucacuuguauuaucaggauuuucuguuuucugugauuuuugguuuuuuuguuuuuguuuuuguuuuccuuaaagauagaucuuuauuucaaacucuaaucuaccaaauuagcauuucccaccaacucugggggcggagaccuucacaggcuucacaaucuuuugucugggugcugccuuugugguggccuuggcagcagccauugcugucuucuuugaugccugcuuagccuuuuuuacuuccuuggcagccccgauagccugcucccguugggcuuuccuaaccucuggcuucugauuccacuuggccauuauaucagcaggagacgcaccagugauggcucgauggacuuugacugcacggcggguucuuuucuuuugaauuucuuccgacugcccuuucuuguguuuucuucuguagaggacaauccaguuuaucugcagaguauuccuuuuggaaaagaaugcagacucacauuuugcauuuagaaacuggaaaaccuucccguugguccuggaguagugccgcccgugucccggguagaucuuguacaugcuggaacugcacagcucgacccuggugccugcguacuucauagagaugcauucuuagguuuuagucaggcuugggagucagcaucucuuggccucacucugcagagcuaauuuguguaaauuugguuacagcuugacaaaggaccuuuucugagccaugagacaggcauucgcgugugccugugugugcagagguucacuguguagcccaagcugaccucaaguuuauggagcuuucugccuuagucucuuauuugcugggauuacugaaauaccuuauuggagaaguccucgcuauuuucuguauuuaaucuaaugauaccuuuuacuuauuuaccagucucuacuuucuuucuuuuguuuuguuuuguuuguuuuguuuuuacaguaaggguauuuuguauaaccuuggcuauccuagaacuagcucuguagaccagauuggcccugaacucacagugauuggucugccucagaaucccaagugccaccaccugacuaguuccuuuaaaaaaaaaaaaaaaaagucaugcuuucccuaagaaagagcuagagauauaacucagugguagagagcuugccuaaucauuguuugcuaugcccuaggguucaguuucuagcaccaccaaacaguaauuacagaaacaaaauaaaccucuccauggcucuggaaucccucauuaucccacuuaguaucacccuggauaucauagaugcucucugccccccacaaccuauuuggcaccuaucuguguugggggaucuguagaccagcuugguuucauuaaucgcuugcaguguuguuuuuggaugauagcuugguuuaguauacauguccacauuggaaugaugaagggacaaaagcuacaugguucagcuuaugaagagcaauguugcaugcagcuuuugcuaccuugcuaagcucuggccccagagaauauuagaucugaggaugaaaaacacagacccacacauugcuuaaauucaaccuucuuggcucagcugcugggcaccuccaaucuaccccagcuagugcacccuucccaguagucuuagcucucaaccugcccuagcuucaguugcucagccaccuucagucccagcucaacaccccaagaucucacaugacugguuggcuuuucccccuccaaagcaugucuaaaacuccuuuccucucucuccugcaucugcuagcuugccuaugaggaccuggaaguccuaccuauuccaccuaugccucuggcaucuuuauugauggaucgagaaacaauuggggaacaggaccuuagcaucagaaccaaccccuacagagcaagggcaaauuuaaagguuauagugaguaacugugggcagcugaaaacauuugcuguuuguguuuaacaaaccaaacuuggacaaaauugcuugggacaggggagcaggguuuuugggggaauguuguuaauaacuaugaaaaauauaugaaaaaucacaaacugaaguaauagcaaaauuuaaaggaaauguagcuuacuuuacuaugaagaacaagagggcugguaaaaagugagugaaaauaguccaaaggaacugauguguuacagugccaggucgagucucaacagcacacuaggcugagacaguucgacguggaagaggguuuauuggaagggagagacaaggugguggaagaaagaagaaggugagaagagagagaaagagaggaguguuccccuuauuuauaugaaaaaugacauaacacagguaaaggugggaggugagccaaguguauucugggaacaugguagcugucaucuugacaacaugucuguaggucacacugucgccuaugugauaucauagguuugggagguccugaugccaacgggaaccacugaaaaaugcucagaaguuacaggguuauagucuagaagagggguacaauugaaggcagcaugaagauuguccuugaaucauuuuguuuauccacaacuucaugggugucuuacaguuaugguuucaaaugggccuggcuuuuccuuccccuugaaaaauaauuaugagccaggcggugaugguggaggcacggggaggcgcggggaggggcggagggaggcggagaggcagaggcagagaggcagaggcaagcagaucucugugaguucaaggccacacugguggucuacagagcuaguuccaggacagccagggcuacauagagaaacccauccuauaaaacaaacaaaacaaaguugaaaaaaaagaauuauggguugaacuauuauuauuacuguuacuuguauuuuaagagcuaaggcuuugcuauauugcccagacuaacuuuugaacuccuagguuuugaacuuccagacucggccuguaaguguagcuaggacuauaggugugcgucauccacaccucucagcaagauccuuuaacaggcuaccucacacaguacacagcaguccaagccgccugagaaguaggugcucccuccuuugaggccauccucuaaagggauaaacuucaacuugaagcugcuuuuagaugagaggcuuacaaaggcuuauagaagcaaaaugucuaguuuguuccagcucuuuauuugaggauggagucuugcuaugggucucaaacuccugucccaaacuccacagugcuggaauuagaagugugugucuucuaccacaucuggcuucagauacuaagaaagcaaggguuggaaacauaucucaacagucccucuugcagcagaccaggguuuggauccuaacacucaaauaguugcucucaaccaggggucuaccaucuucuucuggccuuucugggcacugcaugcauauggugcacagacaugcauucaggaaaauccuguuacauaaaauaaauaacucuuuaaaaauaaguaaauaaaagcauagaggaccacuuagacuucuggaagaucaccacaaauauaugcuggaaagaaauauuaguugugagcccugguaaauuuccacuuucacugcaaaaaacaaaaaacaaaaaaaccaaaaaaaaaaaaacaaaacaaaacaaaaaaacauggucucucucuuccucuuuguguguaugcauguguuugggugucuuuguguguguccugguguguguguguaugugcauguugaggugucuaugucuaugugugucugggagagauguaugugugucuggguaucugugugugugugugugucuggguaucugugugugugugugucugggaguuuauguaugucuguguguguuuauguaugucugugcauaugucugaguaugugucuggggauugacucuaagcucucuccuguacuuagccccgucugccaucagccacacucccaauccaaugcagacagcucuuccagauuuugccaagaagacacugagcugucuuuguaaaguugcucaaaaugaacacuugggucucuccucuggcuguuugagcuguuuuuccucaucugggauucuuccuagaagcuuggauucaguuuugaauuuguaaagaguguugugugucaugugccccccuugcccuaccccacuccuugggaagacugacaccuggaguguuuagcuggggcaguaaugggaaugucaggaauccaggaauguccucauuuccuguggggagcaucuaauugagcccagcaugaggcuguccuuuaagcuguaccuuucuguacccaaacaucucugaguagagacagcacaagaaaaaaggcuaagcccgugggaggcaagagcaggggaacuggguucaggguuugacuuggugcccuuugaagggcugcuuugaaauguucaaagccuuuugcaacacuuagugggagggguuauugauucauauuccugauuuuuauaagaauuuaguguuagauggcauguggagagauggacaccaaaugguucucaggcaaaauucuccuggaaggggguggcucaucucacccauuuugcugccaaggaggcaagugggguuccuaaaacuaaagggaaguuuccugacuguucccuguuuucaaauaauuuaggggcgauuucaucuguuuuguaccauuaaugguauucacagccucauguaccaacccccacaccccauucccccacccccuucacccuugcggaggauucagugguaggguuagcucccugccuagccuuuucuuuuacaaguaaaugcuagucaaugcauuuccaugugaaagacauauuaggacauagauuuucuuuuucuuuucucugucuuucuuuuuuaaccauuuucauauuaaagaaagggcuacauagcuuuucuagaauaucauuugugugcucgccaauuucagcuuuuucauucauuuaauuuucuccaguauuauccaagagagagacccagggauuuauaaaugaggaacugaagcucauggguuacgugauuccaaggggcccagcuuguagcuagcacuagagugugggaacucagcaccgccccccagguccaauuucuaguacaaagaaucccaggagagggagcaucugacuucaaagacccuuguuccuuccuggagaccccgagauucuggggaugaguaauacugauaugugcaggugggcuccgccacccuuuacaccuggcuuuacugugggagucucugacauugucuguggaguaaugggcccuaaaauuuccaaccauuuucaggccucacaccccaaccccaguuuuuguucacugaugaaucccagggaagaguggaagaaaaggaggaauaauuguuuuuuccaacaauuaaguugaagucaaacauaguuuguuuuuauuuugggaaguauuacagggaaaacaucuucucaguuguuuuucuaccaagagagcaugaagauauuagguuguuuccagcaauuaguuguggaguguagggugggaaagaguuauuugguagguagugacucuaagcaaauggaaacacaugagcccugggacuucccuuaaaggauuugagcugaucguccugaggaaagaacugccuuaggcuguaaaccauauagccuucagugaaguuaugaacuagagugacuuucucuaucacuuugccucugguguccuuggggucaggaggccaggcuuuagagcagaucgcccuucuuaugccagcuuugccucuuaccugcaagucaucaucugcucucagccuuacuuuguucaucugugaaauggaaaugacaugaguaccuuaugcggccugcaugauaaugagaaaccuacccgcgauacaugugguagaucugcaguaaacuguggcuguacagaaagcugucacucuucugaacacucuugccugcugcuuugauccuugcuucacauauauuccuguuucuuccuuccaucaaagccccacuguccuagcccagcacucucuacccugcauuauggcaugguuuguucauagaguauuaaagauguuugcuucacagcgggguuucuuuuaauuuaauuuuuuuuuuuaauuuaaaggcuugguggagacaaaauauugugaaacugaucucucuuccugagucauugugcaaugcuuuugaaggaagggagugugcuaacagaucugagcagcuuccguggagccuuggaauagcaucuuggcuaagaguuaacauagaagaugggagccagacugccugcaguuucuagauuaccagaaagcagcagacuagccuuggaugagauagccccucugcugacuguggcaucuguggugauguuuagagcaguguuuuauguuagaaagagcuaugacaguggucacaaggccacuguagcauuucuagugggcaagaagucacuguuucugugccaccuuguggagaacaggaguucuccuggaaagggcuaaggaugcuuagcuguuucacugcucuggagagcggugaucuaaguaugagcaguggcuuagcugugcuuagcuugacucuuagugacuaaucuuugguggagggauuaaaauccucuggccacuauuaguuauaacuguaauacauaauaugaccaccgaauuuagaacguaauggcacaccaugcaaugaucauuauagaacaguuucauuauaaacagguacuuuauaauuuuuuauacuuguaaaauuaucuuuguuuuugagacuagguuucaugugguauaggauaaccuaggcuagcuuuuagcucaagguagcugaaaauggccuggaauucuugauucuccugccucuauuuccuuaguauugagguuacagagguguaccaugcccaucaaaagaucguguuuuauauaaugcacuuaaaaauucacuuuauucacaaaaucauuauaaauugucucagaaauuguaauuguucuagaaauggugcuagaaaguguuaaacucucagagcacaaguguucuauuaguauguaaacccucagagcacaacuguucuauuaguauguaaacccucagagcacacauguucuauuaguauguaaacccucagagcacacguguuauauuaguauguaaacccucagagcacaacuguucuauuaguauguaaacccucagagcacaacuguucuauuaguauguaaacccucagagcacacguguucuauuaguauguaaacccucaaagcacaaguguucuauuaguauguaaacccucaaagcacaaguguucuauuaguauguaaacccucagagcacacguguucuauuaguauguaaacccucagagcacaaguguucuauuaguauguaaacccucagagcacaaguguucuauuaguauguaaacccucagagcacacguguuauauuaguauguaaacccucagagcacacguguucuauuaguauguaaacccucagagcacacguguuuuauuaguauguaaacccucagagcacacguguucuauuaguauguaaacccucagagcacacguguucuauuaguauguaaacccucagagcacacguguucuauuaguauguaaacccucagagcacaacuguucuauuaguauguaaacccucagagcacacguguucuauuaguauguaaacccucagagcacaaguguucuauuaguauguaaacccucagagcacacguguucuauuaguauguaaacccucaaagcacaaguguucuauuaguauguaaacccucaaagcacaaguguucuauuaguauguaaacccucagagcacacguguucuauuaguauguaaacccucagagcacacguguucuauuaguauguaaacccucagagcacaaguguucuauuaguauguaaacccucagagcacacguguuauauuaguauguaaacccucagagcacacguguucuauuaguauguaaacccucagagcacacguguuuuauuaguauguaaacccucagagcacacguguucuauuaguauguaaacccucagagcacacguguucuauuaguauguaaacccucagagcacacguguucuauuaguauguaaacccucagagcacaacuguucuauuaguauguaaacccucagagcacacguguucuauuaguauguaaacccucagagcacaaguguucuauuaguauguaaacccucagagcacaaguguucuauuaguauguaaacccucagagcacacguguucuauuaguauguaaacccucagagcacaaguguucuauuaguauguaaacccucagagcacacguguucuauuaguauguaaacccucagagcacaaguguucuauuaguauguaaacccucagagcacacguguucuauuaguauguaaacccucagagcacacguguucuauuaguauguaaacccucagagcacacguguuuuauuaguauguaaacccucagagcacacguguucuauuaguauguaaacccucagagcacacguguucuauuaguauguaaacccucagagcacacguguucuauuaguauguaaacccucagagcacacguguucuauuaguaugugaacccucagagcacacguguuauauuaguauguaagaagagaaagcuuaaaacaaggaccaggugauggaggagcaaaucauugaaucagcauuauuuuguuuucaggagcuuaauauugucugcucuuuuaagcagauuuuuaaaggagugugugugugugugugugugugugugugugugugugagagagagagagacagagagagagagagagagagagagagagagagagagagagagagagagaagaggaacuaaaagauaaaguccuaagcauuaguggcuccaguucuugccacaugaacuauugugaaacuguucucuucugagucauuacuuucugcuccuaccaacgcuacauuuuuauccuuuuauaguuuugcauguuggcauuuggcccugguugauacaagcuucucguuuuuacuugaauaguuauuuuucaugagucacuuuuggugggaagaucaagucuuucauguguuguauagggugaaagaugguggacuugucaggaaagugagagagauuuagaggucuguaaaaguucuaauagaaacccuggcuacuuuggugccugcagagacugggguuguuuuauagucucuaauguuugacauaaucguucuaagguguccucauucuucaaacauguuuuauuuguguugacuuuauuucugguaaaguggcucagugguuaaaggcacuuacucgacagcuagcccggugaccugaguuugaucccuaggaucuaacaugguggaaauacagagaacccacaaagucuccacauggaugccauaucauguacuccccacaaacacaaagaaaggcuuaauuuuuuaaauuaaaaauuaaugucuuuugagggggacugaagugagggcuuugggcacaccaagcacacucuacugcugggcuacacuggcagccuccauagcagcagggucaacauaacuacugugguuugaagacuaguggaaacauuauugaugaauaagaaucugaaauaaagagguggagagaaagcaagagagagggaggggacauuaacucuaguaaauuccuaaacaggacaaaaggagaaauauugaaacuuugggaagagcaucaguaaccaguaaguacccugagccucauaugucucauagcugugaguucuggaccccaguucaaccagaauggauagaaaaauguggggaaaaaaauaacaucuguucugaucucauauagaugggcuguucucuaaacuguacgcgcacguaucucauauuagguaucacaaaugaucacauaguagggaugguucauacugugaggaaggguuguaauucaaacacuuucugguuuuguaugagugacuugagcaucuguagacuuuguauugucaggguaccauggaaccuaugccccucugugaucauggaggagcaacuaaccugucuucaagggaaaauaaauggggguauguacaugaaaggcaaacacacucacaccguucuccuggccaacaucauaugauaacauggaauucugcacuuuuuagggaccaaucguguaugaggugcuguguggaguucagaauaguaaauaguaaauucugaaaaauaguccaaacaaguucaaagaaccuggguuauucacaugaaacaaguuaguuuguuaguggaguucuggagugaaaaugaaugcagacaagaggaaauaagaaaagggaaaggagaggcuacaguagcccagcuguugggcucccugccuguuaacagaggcaggagcuagcaugggagacaugcagggguggagccaaagacuccaaauagaggccagugugggaacccagaaaauggaugaaaagauuuugauuccauuacauccaauaagaugacugaucucugaaagaauuuuuaggaaauagucuguggcagcagauguggggugacucuacuauccagaaaugggaguaccaauggguagaaaugggagcugaugagcagagaacacuguaugaaugagugaaugagcugaugauggacaugugaagacaggaaggaaaggagagagaugaaagacguuacuugcagggucuguuacuaugugacugugauguccaugucaucaacucccugguaacugauaacaucuguccucuaagacccuaggccaguaguagagcgcucaugaaacagaaugcccugcccugcaaaaugagcuaugcucagucccuguuggcagcacucagugguguauagcauccacccuuccuucguugaggugguuauucucccacaucuaguuuauuucuugauuuuaauguacaucuuuuggucuggucaaucauugcuacauauaucuuuaaugcaguaauuuauagccagguacaugugagaaauauuuuucauuuacuauuugaugaugcuggagaccuuacacauacuaaaccacguauuguaccucugagcaacaccccaagcacccacuuccaacuaagcugcugaaauaaauugcucuguggaacagccuacccugaaggcugcuuugaagugaaggagccuugcuggcccauuaagauggcaggaacaaaggaguccuuuagguuugagccuggcccuucaggccuuggaccuuuuccucauuucccccacccaccccuuccuccugaaagacagcuaccagaagauuugucucuuugauuguugcucaugaggaggcuucaucugaagaagucagcauagguagggagaaauuaggagggaguugcguccccuugcuuugcuuugccuucuacuaucaaugaagcaugcaggucacaagaucuaaauagucaucugucacauggccaacuucauauaccauaagccugaacauauaaaguauguaggggcucagauggcacuguaaaucuuugucauuuuauaacuuugccauucaguuccuuccuuccagucuauucagauuuauucagccacugauauaagcaauucagaauacuuuuaugacucuagcaacacccacccccuucccaguuucccuucaguuccuuuaauccucacucuucggaaccacugaacugauuucugacuaaauuugccugccugggcauuuuucauagacgugcaagcauagaauguguugucuuuguguccaguuaaccucaccuaguuuguuaucuuuaagguuuauucauauuguaguauguaugacaacuucauucuuuuuuauuacuaaauaauauucuacuguguaguuauaccauguuucacuaauuaucauuugagaaccauguggauuuuguuccucuugacuguuacuguuauuugcauauauguuuuucugugaacacguuuucauaucucuugaguaaguaccuuagaguggagcuucugugcuguauuuacacuugaggaaauuccaaaauauuucugagagggcacaaugcuuuguuuuuaaauugugugacccauucucuuuacaccaaaagggauggggauuggucuaacuuguuuucuuacaguacagaaauuauguaaguuaacuaaaacagagcuacaauggaagcuuuuauuugguguguguguguguguguguguguguguguguguguguguguaaauauccacaaaagucaaaagagggcauuggagcccuuggaguuaagaguuauaaacaguugugagccauccaacaugggaacugaacucugguccucuagacaagcaguaagcauuuguaacuacuugagccauguuucuaaucccaacaccucuauuuugagcuucuagaagaggaaaaaaaaaguuaguuaauguaauuaucuuugggcaaccucaagauaauugucaggguuuuuuguuaguuuuguuuuguugguuguuugcuaucgcugaagaaaggccaggaaucuuuguucccugagugagaaucaaaguaaugcuaguacuuggggcgcuagagagauggcugagcaguugguuaguuaagaucaucggcuguucuucuagaggucauggguucaacuccuugcaccuaauaugguggcuaaccacugccuauuauaggaucuguuguccucuucuggugugcagauacauauguagacaaagcaccaugcucauaaaaaaauaaaaaguuauccuuggaggggugaacuaaccuuaaaggggaaaaaggacugcuaauuggcuguacaguggugucuugguagacuccgaacccuuuacaacauccacucaccaccugauacccuagccaggguuuuguucgcugugaaaaacaccaugacuguaaacaacuuagggaggaaaaggucuauucugccauaacucucuaucacagucuucauaaagggaggcuagggcaggaacucaaggcaggaaucaggaggcaggaacugaugcugaggucaugggaggaugcugcuuacuaacuuaguccucgcgccuugcacaguaugcuuucuuauagcaaccagcaccaggguggcacugccacaaugagcugacucuuaaccacaucaauuaggaaaaugcaccacagcuugccuacaagccagucuuacaaugucauuuuuuuucaauuggggcucccucuuccaaaauuacucuagcuuuugucaagaagacauaaaacuacccaguagaccugccaaacaguguaagacguuucaccaaauagaaauaugccuaucaagaugccaaguuaagguccugugcugguugaauacaguguucauggguucuuuuccccuaguauccuauauuucuauuacugugaagcugucugagguaccaucucuucucuguggcauaacucaggaagugacaauggacccaaaagaaagugagagggagcauguaugagcaaguacugaggagacugcaggggccuuguucugcacgccauucuucagccaguguguaaagacugcuugauuccaggcagguuugacccuggguagauuaccacacuuaccauggagggucuguauuuggguugugaaaaaaauagggcaacaguaucuuuuacuuggcagugguccauuguacgauucauguuaugagcugguguauuuaauccuaaguagccugacacaaggcuuucucuagugguugcuugauucaaaacagagcagacccauucuuuggcaauauccccaaguaacauaauuuagcuugacucacgaucuuaugauggauacauuccugaauucuguuuaguugggaagacaaccucuuccucuuggcugggacuucaucacugauacauaaauuuaaaccugggguuggacaugagggggacucucaagaugaaacggagcccaugaaacccuaggcauauaguaaaugaagaaucugggucucucuuguggcuuauccaaguuaccacaacagaagaaaacaaaaguagaaaugaggcagccaagauuuuuacucagaggugacagcaaagggacuucgugugcauguaaaggacauccuguaaaaagugucuuccccagcucauuggugcugcagcacugugcuuacaguucaguccugauugcagucuuuuucuucuuucucuaguuggguucauaagaauuugucaagcuagccgggcgugguggcgcaugccuuuaguccugcacucgggaggcagaggcaggcagauuucugaguuugaggccagcuuggucuacaaagugaguuccaggacagccagggcuacacagagaaacccugucucaaaaaaccaaaagaaaaaaaaaaaagagagagagagagagaaauuuggcaagcuaaccgguauuuuaugucauuugcucauuuuaaaggagaagcagggaugucucccuggcgagucccuagaggucauuguguacuagaaauggcuuagcugagauacaaggcaaucuuaauaaacuaaugcaugugaaaauguguuacugaguucuccaggcugagcccaggccaccauuaggagcaaugguacaccuuuaagaagauggccuuucucuuucuuucucgauuccacucagaccuuaggguuuagacacaugggaaaggcaggcaauucuaccuacccuugacucuguguuccuuuuagaagcuucugcaagaagguuagauaauaacauucuagcaugcagaggacuuauuugcuaucuuagaugugcugagaucugacauaaacuaguggagcuuugagaaaaauggcccuguuguagucuucuucuccuuuuuucuuucuuccuuuucuuuuuuguacuauagugaaagacuugaggaugggugucuuauacagaaagagauuaauguuguguauaguucucuaagucugaaguugauugcuuucuugcuuguagaguuuagagguggcauaggguuucuauuauaugagcagaacaugcaugcauaugccugccccuucuggucuuuuuaaaacuuucaggagucaguacuguccugcccugcucuugcccccugccauuagauuaacuaccucuaaucagcuccuaggacaccuaaccaccagucaaaugauuuuuuuuuuuuuuugguuuugcaagacagaguuucucuguauagcucuggcuguccuggaacucacucuguagaccaggcuggccucaaacucagaaaucugccugccucugccucugccucccaagugcugggauuaaaggcgugcaccaccaccgcccggcagaugauuucuuacaucaucauaccucaucauggguaugagguauguuucuauacaggaauuuuaggagagauacuuugaccauauauaaacauuuugcaaauugcaucccaccugcgcuuucccuuucccuccuucaagcucucuuaguaaggaaagcugucugguuuuacaucuaaaucuauccaugagagaaugccagguucuguguguccugacucuuacacaugggcauguuugcacauggaggacuugcgauggggcauauucaacuucauagcauacaggacaaaugccuugucagcuuuauagcaggcugacugacagagaaagccuguuggcaccuuucagauacuuuuuguuuguuugguuuugauauauaaggucuuacauaguacaagcaggcuucagccuuacuauggagcucagucugggauugcaggcuuaugccaccacucacagcuugggauccuucaaagucuaagacaaggagagguuuuucuacccacacagaagagcuacucuguccugagucaggcagaauaccuccuuagaguguagaaaaucaccaaguauggugaugaacagagugggaacugagauuacuucaucuuggggugagcagauggacacaauugugaaacagaggggguccaagaugaaaggcuuccaguggauggaccuguccagcaaaggcaaauguuguuuguuugucaucauugguucuuagggccugggcuagugcuaauucaccccagugaaggccagucucaggaaagcuguguagacggcuggaauaguaggucccaugccuguggcaggagaagagaaggcuugcccaucauuccuggcagccaucuauuuccucugccuccucagcccacccaagcucauuagagaaaaaaaauucuucacaauuaccagaagcccaggccuauuccaacaggaggcuuauucaguaccagcagacaagaucauagcuugacuaacaggaggcaugggacauccuaaauuagcugaucgagguaaacugagaacauucuuaaauuaaaauuacucaguugauagagaaaauaguaaaaugacugcagaugggaacacaaacagaucauccaucaucuagccuaaugggcuuuucuuucaaagguuugggcuugggguuauucuaaacuuagggccuuccauggaccugaaguuuucuauggcugggccuaccgaucccucuaccacaaagaaaacaugaugccucuagcaaacuacaguuuuauguagaacuacacauauuuauguaacucagucaaaagaauuuaaaagucuccaauuuugugaacuugcuguaacagaacaaaagauccauaccgaugagauaugccauccccuacaucuggaacagucgaggaugcaaucuuuauuggcagugauguucagcaaugcucacugaagaaggcuugguccuguucaacgacagagagauacuguggcuaucaugaaguaggagccagcugaacaucuccuuaauggagagucuaagaugugccauucauaccuccuuuuaaguuagcaagaaugggguccugguagacauguuucuaguccuuuccuuauaagauagggaacucuuuaaaaaaauuuuuuuuaauuucucucaaauccuuuguguguguguguguguguguguguguguguguguauguguauacauacacaaauacaugugcacagggaacccuggaggccagaagggagcaacagauuacuuaauucuuuggagcuggagugagagguaguugagccaucuaguguagugugggugcugggaacuaaacccaguucucuucaaguacagcacgugcucucaaccaccaagccaucucuucuggccuuucuaucccuuuucuuauaaaggacucuaauuaacacaguugugguccauuuucuacauaaguuugccuugcuuagauaacuguacucuucuucaucugcuccaacaugugacaggacauucuucaaggcaggguuacaaacaucugcagccuaggaaucagugaguuccccagggaggguguuaaauccagagucugcugaucuguuuccugucuuuguuaugguuucuucaccguaacuggauauccuuccgagcuccagcaagcugguacuaugugcagcugugucagcaggccaaggacugcuggcuuuggaggccacauucccauuuacauagccagcuuccagaacuccauuauaccuauuuguuuacaggguaagcugcucccugucugcagaucuguaggccucuccaugucauucacaagguucuguguaaucuaauuaagaugaaauaagagggagagugguuaccuagcugcacaggacucugccaagacaaaaccucacaggaaugcaaacaaaucaccauccuaacaaauagcuaugaaaacacuucaggaaaguagcaaaaucucuaagacuaugaagcugggaagcccuagcugaagcuguggagcuagggaauguggguauguggcugugccugucuagcuuugugcuaccacuuauauggugcuuuugcuuugaggacagauagcccuccaaacagcuuuugauccacaugugcugucuccccagaugcagagcagcaaggagucccuguugccugagguccacaacuuagcacacugcucuuuauuggaggagaaaaugcacuuuuuggaaaccuugcaaaugacauugacuauucacagaaacacagcauccacugccaguggguuucuaguaagcuuuuagaguguuuuacccaaaguggguuugugaacaucuugcacagagguguugaagaggcuccauagaggguaaagagcaagcuuuguauaacucugaagucacucuuguugaccuggcacagaagagauagccuaccaaaugugugcuucucuugaguacaagaugguacagggauuuucuuuccccgcaucaagugguuuaucuguauagcccugauuuaugaccucaagucccucuuaugauuggucccaccuccuuggugcuuucuggcacccaucuagcaagagguuuggauuuuauaugaaguuggaagaacugauaagugugcagaacaaaaauuaacagcauguuguauuguuuagacucuuaagaagagcauaaugccaaaaaccguuuccagucuucauugagaacuccagcuugguggagaagugcaugccuaugagccuagcacuuggaaaguggaagaaagaggaacaggaguucaaggcuaguuuggacucuaaaaccuuaucuuaaaaaaaaaaaauaaccagagaagggaggaucucaaaguaggcacugcuacaauaccgucagacuuuaaugcugucauuuauaccucccgagaaaucagaugguuuuucugaauuuaguuccuauguucgguguagaaauguaguaaaaugguccauauaaugaacugcaaauagguucuaagccagccaggcuccagccacgugcuguguguaguaccaacauauggucugauuucacacucugucugaacugugccugauauguuuaagugacacaucauuuaaaauauacugugcugucucauggaacuuucuccaaaauugaccguauacacaaguuucaacagauacaagaaaauucaaaucagaucaccucagauuaaagauggauuuuaacaacagaaacaacaaaaagccaaacucauggaaacuaaacaacagaaugaaaacuguaucaaagcagaaauaagagagaaauuaaagacuuccuauuucuagaauucagugaaugcacagcacacccaaacugaugugacacaaugaaggugcuguugagaggaaguucauagcacuagaugcauuuauacagacacuggagagaucuaauacuagcaaccuaacagcacaccugaaagcucuagaacaaaaagaagcaaaaggaauagacauaaggaaaugaucaaacucagggcuaaaaucaauuaggaacaaaaagaauaauacaaaggaaaaaaaaaagcuguuucuuugagaaaaucaguaacacagacaaacuuuuauacaaacuaaaagacacagaauauccaaauuaacaaaaucagaaaugaaaaggggaauauaacaaugcauaccuaggaacuccaaagagucauuaggucacacuucaaaaaccuguacuccacaaaauugaaaaaucuacacuaaaugggcaauguucuugguagauaccacuugccaaaguuaaaucaagaucagauuaacaauuuaaacagauaauccccaaggaaauagaagcaguuacuaaaagucucccagccaauaaacaaacaaacaauaaaaaaaaauuaaaagcccagggacaaacagucuuagcacaauucuaccagacuuucuuucacagaagagcuaauagcaaaaauuaucauacaauacaaaaacagaaggaaucuugccgaauuuauuuuaugaggccagucacccugauacccaaaccauacaaagauucaacaaagaaagagacuuauagacuguuucccucaugaauauugauacaaaacuucucaauaaaauacucacaaccuaaauuaaaaaaaaaaaaaaacaguucaaaaaggugauucaccaucaaguaggcuccaucccagagaugcuggaaugguucaacauaagaaaaucucucaauguaauccacuauauaaacaaacaaaaauuacaugaacaucuuauuagauacugaaaaaaccuuugacaaaauccaacaccccuucaugauaaaugucuuagagagaucagggauacaagggacauccauaaauauaaggcaauguauagcaagccuauacuggucaucgaauuaaauggagagaaacucaaagcaauuccaguaaaaucaggaacaagacaaggcuucccucucuuucuguauccauucaauauaguacuugaaguucuaccuagagcaauaaaacaacuaaaggagaucaauggacuacauauuggaaaggaagaagucaaaguaucauuauuuguagaugauauacuauucauaaguaauccuccaaauucuaucaggaaauuccuacagcugauaaacaccuucagugaaguguggcuggauacaagauuaacuaaaaaaaagaaaaaucagagaaacaauacaccuuauaauagccacaaauaucuucauaucugaaauaucuugagguaacuaaccaagcaaguaaaagaccuguaugucaauaacuucaaguuuuugaauauagaaauugaggaagauaucaaaagauagaaagaucuuucacagucauggauugguaggauuagcauaguaaaaaugcccauucuaccaaaggcaaucuacagauugaacacaauacccaccaagaguuccacacaauuuuuuacacaccuuaaaagagcaauacccaacuuuacaggggggggggggagagaaacagagagaaacagagagagaaacagagaaaaugagagagagaaacagagaaacagagagagaaacagaaagagaaacagagagagaaacagagagaaagaaacacagagaaacagagagagagagaaauagaaagggagggaggggaggagggagagagggaggggcaggcuaaaaacaaucuuguaaaauaaagaacuuccagagguaucaucaucccugauuucaaguaauacuauacuacagagcuguaguaauuaaagccauaugacauuggcauaaaaauagacagguugaucagugaaguugaaucaaagacccagcuguaaaucuacauaucuguguacaccugauuuuugacaaagaaauauacaauggcaaaaagaaagcaucuucaacaaguggugcuuuuuuaacuagaugucugcauggagaagaaugcaaauggauccagcuguaucacccugcacaaaacucaaguccaaauggaucaaagaccucaacauaaaaccagauacacugaaccugauagaagagaaaguggggaauagucuuagacacauuggcagaggagacaucuuccugaacagaaacaauaguagugcagguacuaagauguacaauuaaauaauggacccucaugaagccaaaaagcuucuguaagguaaaagacaccgucagucgaacauaacagcagccuacagaaugggaaucugacagaggucuaauaugcaaaacauauaaagaauucaagaaacuagaugucauacacacaaaccaaauaauccaauuuuaaaaaacauaggauacagaccuaaacagaaucuucaacagaggaaucucaaauggcugagaaacauuaaaagaaaauguucaauauccuuacccaucaggguagugcaaaucaaaaugacucugagauccgucuuauaccugucaguauguggaagaccaaaaccauaagugacagcgcaugcuggcaagcaagggggacacuccuccauugcugcugggagugcagcccaguaaguccuauagaaucagaaauaggaaaaacccucccuggaaccugcuguccagcuaguuuauauaaaccaaaggacuccagaaucuguguaaaacuaugcccgagaaaacuaaggcagagagcaguacagacagauagcugauguugacuccaucuuuuacauauguaucuuugauugcacacacacacacacacacacacacacacguacacacacauguacacacaugacagugaugacaauagccauugguuaguguaaguuuaagcauuuugugguaugugaccugauaucucaguuaauucuuacuauaaucuuauaaaagaugcucuaauaggggaaguguuccauuugauuggugaagaaacugagguguaaagaccucuauaaauugucuacaggccaauagggagcagaaaauagaaaccaagucugucugauuuuacaaccuaaacguuuauuuacuucaaaucaaaauauucaucagaacaguaauuauucaaaguuucuucuaacaguucauaaguaaucauugaugcuaacaguuuacuuaacaccuauucugcuuaaugcaugaucaugcaaacucaggacauuuaaagggacuuugacuuuuuucucaagcaacuuauaaucuauguuggagauaauaucauuuuuaaagaagguaagaauaaguuaguauauagcaaauaauuggguguaguacaaaauuauaaauucuuaggugagaaaaacucaacaugggucacaggauuaaggugaccuucccucuaugauguaauuguucuuuaacuaaaagccuauaggcucucuguuccucccuguuccagagacagccacaucuuccugugcagugccagccucaucccguagacaaaauggugaagguaggugugaacagauuuguccguauugggugccugguuaccagggcugccaucugcucuccacucagcaaaguggagauuguugccaucaacgaccccuucauugaccuaaacuacauggucugcauguuccaguaugacuccacccacggcaaauucaacagcacagucaaggcugagaauggaaagcuugucaucaaugggaagcccaucaccaucuuccaggagcaagaugccgcuaacaucaaauggggugaugcuggugcugaauauguuguggagucaacuggcaucuucaccaucauagagaaggccaggacccacuugaagggugggaccaaaagggucaucaucuccaccccuucugccgaugcuuccauguuugugaugggugugaaccacgagaaauaugacaacccacucaagauugucagcaaugcauucugcaccaacagcuuagucucccugaccaagguuaucuaugacaacuuuggcauuguggaagggcucaugaccacaguccaugcuauuacugccgcucagaagacuggauggccccucuagaaagcuguggcaugauggccauggggcugcccagaacaucaucucugcauccacugguacuucgaaggcucuaggcaaggucaucugagagcugaaacggaagcucacuggcauggccuuccguguucuuacccccaauguauccacuguggaucugacaugccaccuggagaaaccugccaaguaugaugacaucaagaaggugauaaagcaggcaucuaagggcccaaugaagggcauccugggcuauacugaggaccagguugucuccugugacuucaauagcagcucccacucuuccaccuuugaugcuggggcuggcauugcucucaaugagaaauuuguaaagcucauuuccuggugugacaauuaauacgacuacagcaacagggugguggaccucauggcuuacauggccuccaaggaguaagaaacccuggaccacccaccccagcaaggacacugagaacaagagagaggcccucgguugcugaggaguuccuaucccaacucaguccccaacacugagcaucucccucacaguuuccaucccagaaccccuuaauaacaggaggggccuagagagcccucccuauucucuugaauaccaucaauaaaguuugcugcaccccccaaaaaauaaaaaauaaaaauagaagcauauaaaacaguguaacacuuggguuguaccuuguacccaaaaggcacaugguguugcuaaaaucuaguuauaagaaauacuauaacauuuguuuuuagaaguugccuccaaaaaaaucuacuccauguggcauaguuuugcucuuuguuauguguuaauuuugauucugaaguugaguagaucuagaaucaccuaagaggcacagcucugaacaugacagugauggauagaugaaguacacuaacugcuaugcuuucaucaccacuguggacuggguccccucaaauugugagcaaaauauauuaaguugcuucuugguggguaucuuguuacagcaggaaaagugugugcauguguauaaaauauugcaauuuguauacaaaucugugaacaccauuuacuaucuuccaugugauuguuuaagauuccaagaugagugagacauaggcugugcucucagagcuuaggugaagguaagaagacaugagaaggaugaggugggcaggugugugaaacaccaguuaacagucaauggcaauaggccagaauauagguaucuguaugcuuuggagagauggggaaaagcuguuauagcuagggggaagagggaaaauaagcagaaugggaacacaguucagaaaaagagcuggguacuagacauacuaccaaggcuuugccuggaccaguaggaacagugcuuucuccucacuuguagaagagaagaaaaaaaagaugcuuuuaaaagaagguaaguaucuugugcuuuaaaauugaaaauuuagaguuacaguugaauuauuucucccaagaguuguuagaguuccaaccaccacuaccaguggcuaggugauaucauuuggagggggagagagaguagguguguagguuuaugcauguggaggucagggaauaaacuuaucugucauucccuaggugucauccaucuuuuucuccuacuggcuuggaaaucaacuaguagauuaugccaccuugccauugcuggguucugccuccccacaauggguuguaagccuggcuuuuuguuuugggucagacuuagguccucauauucacaagggaaguacuuuauugacugaacugucagguaaugagauuggaaugaagucauggguaugaucguggauuuauauuuguggccauacacaugugggaagauaaagcaaagaacugggugaacugugccaaagauugccacaaaccaccaagguucacaggcucagaaguucucaauccugccaauaccuuuugaguuauagcugccaugaccacugaggggugguugacuuauggugcuuuuucacugccaaggaugugagugguacauuauaucauuuuauuauggcuuuuguuacaaauucaccauaagaccagaaguauguacccaguucuggaagccagaaguacaaccuccguuucacucguccacauucaagagucagcagggcugaucuuucuggaagccucaggaagaauccauguuuugccucugagcaccuggugucugcuagcauccucagcuucuagcuucucacuacacuagcugcugcugaggaccuacuguccuucccucuguguuugcuagaugcccccucuuucucuucucucauaaggacacuaguuugucugcuuagggcccaccagguaacccaggaugaugcuccaucucacuauccuuuguuuuaugauauuugcagagacacguucuccaaauacauuuccaguuucagggauuagagcuaaugucucuucuagccuaucucagauauucugacacguaaacugaacuggccaauggucaucaagaugauccugauauuaguaggagcagaaaacagaguguguacaagagugaaaacuuaggagagaguaugacuagugaaaacuuaggggagaauaugauaucuuuugggaauaggugaggaagaagauggagucaacagccaccugaaagaagcagaugcuggaagacaguugaaaugacugaaaagaaauccuuauauuaguuuccugauaccauaacaaaaucccuaugaaggaagcuuuauaagaaaaguucguuuugauucaguuuucaggcacagggacaaaaagggcuguaucugaugaucaccuucuucuugccggggccuaaaguagcucacaguaucgcuuggcuacaaacagagcaccuguaccugugugugcccucugguccuuucccuaggaagcugccaguauuuaauuuuggcagcgcuaccaagauagccaagaauaaggacaggguguugucaaaaagccaagagaagaguuuuaaaaaagauagucauucuuuuaaaggaucauguucuguuuauucuucugauaguuucauacauguaugcaauauguauagaguauuucuuuuuuguuuucuucuuuaaucuauuuaccuuuauguuaugugcauuuguguuuuaccuacauguaugucuguaugagaauaucagaucuuggaguuacagacaguuaugagucaccauguggguacuaggauuugaacuuggguccuguuaaagaguagucgugcccuuaacuacugagccaucucuccagcgccauauacaauguuucuugauccuauacaucccagauuccuagggucaccaacauuuacccuuucaccaucacauucuuucuuucuuuguuauuauuauuauuuauuauuauuauuauuuguaaccugcugaguccaauugccuacuggaauguugauugauuuuguugacuuuaagaaagcaguaugcucuuacuaccuuuugucuuuugcacacaguuacacaaguaagucauguuacaguugugcuccacuagcacagcaauuaggguacuagacuauggaucucuguguucccaccucccuggcuuucaguuuggaaauuccaaauuacauuuauuccaugauguuggcaaaguggcuagagaagauugcuacacacacacauacauacauacacacuauacauacauguacacacacacacacacacacacacacacacgcaugaaugggaguuuuuacauauauauguaaagaaauaaaauacaggaaaauaguaaucuuuuugacacaaaagcucugacccugacugacucaagagaaagacaaacuuuguggcugccacuuggguacugaaaagcaucagaauugcagucucaggaccucugcaccucugcacuucuccacagguacuuuggaugcauauuuucaugccacuguucccagaaucagaugcccucagcaaucaaauuaaaucauauuacuauguacuuugaugguuggcugcuuuugaaaaaggcuuuaaaacaaaacaaaacaaaaauggucugaccuguaaaaaacucaccacuguaucuuuucuuuccaugcaauuacauucuuugugcauuuugcuguaguagaaaaaaaucccauagcuuuauauuuaguagaauacgagaguuuaacuuaguuuugcuuuugcauaugcuguguauuacuaaagaguuccaaaaaccaaagcagguucucuuugugauaacaucaaguguauauaaaggagaagagggcauuuuacaucccacuuuuuacaguggcucacuaagagcagucuaggugcucagcacacagggccaugaacugcuguuuuucuugcaguaucucugguggaucuguuuucuuggucuggcaaagaagucagauucuauucaagacacccauguggguggccucagcuuagcauuuccagaagggcggaucauacugcuuucucuccagccccugagaaccagaggagggccacgauguuggggguaguggugguaaaagagaugccuaauuggcucugaugagcucauacccacagcagagucacuuuaacauaagcaauucuuugaugguacaaccauuugacguucaguuacauauagaaaagguaaauuguugguaacaaaguccagggagagcauggaugcuugugccaucugcacagcauagucuuucauuggaggagauucaauuaaugaaauagcuacagaauaaaucacaauagauuuaaaaaggaauucaaugugugacugucucauuuaauggacauauggggugaaaucuccaauugcucaaaccaaaaggaaccuaucagcagagaagaaaagcaguauaaauugccaggaacaaucauuaagauguuacuaaacacccaaagucauauaagucagcuuuccaggaguauaacaaaauaaacuacaacagccagcuuacaaagaagaaagguucauuguggcuuacaguuccaaagguuuugauucaugcucaguugacccuguugucuagggccuguggugagacuaugguggagcccuuuucuuaccucaugauagucuagaggcagagagauguagcgagagggaagagaggagaaaguggaguagaggggggagugggagagaggaaguaaguaauagaggagauggggagaggaacaguuuaaugguugcuucaaagaacaaauuggguaguauuccuucuguuucuauuuuguggaauacugucaagaguauugguauuagaucuucuuugaaggucugacagaauucugcacuaaacccaucugguugugggcuuuuuuggguugggagauaauuaaugacugcuucuauuucuuuagggguuuuuggauuguuuagaugguuuaucugauccuguuuuaacuuuagaacgugguauguuucuagaaaaugguccauuucauccagauuuuccagcuaguuggguugaguauaggcuuuuguaguaggaugugaugauuuuuuggauuucuucaguuucuguuguuauaucucccuuuucauuucugauuuuguuaauuuguauacucucucugugugcucuuguuagucuggcuaaggguuuaucuaucuuguuauuuucucaaagaaccagcuucuggcuucuuugauucuuuguauaguucuuuuuguuucuacuugguugauauaagcccugaguuugauuauuuccugccuucuaguccucuaaggucuauuugcuucuuuuuguucuagagcuuugagguaugcugucaagcugcuaguguaugcucucuccaguuucuuuuuggaggcauucagagcugugaguuuuccucuuagcacuguuuucauugugucccauaacuggguauauuguaccuugauguucauuaaauuuuaaaaagucuuuaauuucuuucuuuauuucuccuugaccaaguuauaauugaauagagcauuguucagcauucaaguguaugugggcuuucuguuguuguuuuguuuuguuuuuuguucuuuguucuuuguuuuguuuuuuguuuuuuguuuguuuguuuguuuuuuuggguuuuuguuuuuuguuuuuuuguuuuuuguuuguuuguuuguuuuugcuauugaagaccagccuuaauuuguagagaucugauagaaggcaugggauuauuucaaucuucauauaucuguugaggucugguuugugaccaauuauauggucaauuuuggagaagguaccaugaggugcugagaagaagguauauucuuuugauuuaggaugaaauguucuauagauaucuguuaaauccauuugguccauaacuucuguugcuuucacugugucucuguuuaauuugugguuccaugaucuguccauugaugagaguauaguguugaagucucacacuauuauugcuugagaugcaauguaugcuuugagcuuuaguaaaguuucuuuuaugaguguggguguccuugcauuuggaacauagauguuuagaagugagaguucuucuugguagauuuuuccuuugaugaguaugaaguguccuuccuuaucuuuuuugaugacuuuugguugaaaguugauuuuauuccauauuagaauggcuacuccagauuguuucuugggaccauuugcuuggagaauuguuuuccagcacuucacucugagguaguguuugucuuugucaccgagaugcuuuuccuguaugcagcaaaauguuggguccuguuuaccuauccagucugauagucuauguguuuuuauuggggaauagaauccauugauguuaagagauauuaaggaauagugauuguugcuuccuguuauuuuuuauguuauuuuuauguuuguguggcuaucuucauuuggguuguugaaaaaagauuacuuucuugcuuuucuaggguguaguuuccccccuuguauuggcauuuucuaccuguuauccuuuguagggcugucuuuguagaaaaacuguggaaauuugucauggagugucuuuguuucuccaucuaugauaauuuagaguuuugcuggguaccugggcuggcauuuguguucuguuaggaucuguaugagaucugcccaggaucuucuagauuucagagucucuggugggaagucugguguaauucugauaggucugccuuuauauguuacuugacguuuuuccuuucuacuuuuaauauucuuucuuuguuuguggcauuuaguguuuggcucauucugugaugggaagaauuucuuuucuggucaagucuauuuggaguucuguaggcuucuuguauguucaugggcaucucuuucuuuagguuagggaaguuuucuucuauaauuuuguugaagauauuuacuggcccuuuaaauugggaauagucacucucuucuauuccuauuguccuuagguuaguucucauuugugucccagauuuccuggauguuuuagguuaggagcuuuuugcauuuuguauuuucuuuguugugucaauguuuucuauaacaucuucugcaucugagauucucucuucuaucucuuguauucuauuggugaugcucauaucugugacuccugacaucuuucauagguuuucuaucuccaggguugucucucuuugugauauuuuuuuuuuauuguuucuacuuucauuuuuaaaucuugaaugguuuuguucaguucuucuacccuucaccuguuugguuguguuuuccuguaauucuuuagggguguuuuguuuuguuuuguuuuguuuguuuuugugcuuacucuuuuagaguuucuaccuguuuaccuguguucuucugcauuucuuuaagggaguauuuauguacuucuuaaaguccucuaucaucaacaugagaugagauuuuaaaucagagucuugcuuuucugguguguugggguauccagggcuugcugugcugggagaacuggauucuccuaaugccacguagcuuugguuucuuuuguuuauguucuugcccuugccucuugacauugaguuaucuuugguguuagcuguucuugcugucucugacuguggcuugucccuccugcaacccuguguguuagugcucuuggaagaccaguucucuuggggaggaauuuggguauggagagcuguggcacagggucagcuccaggguguagacagaaaccaaaagauuccugucucuggcuguuccuugguucuuguguccagauggcucugggcaggucccucuugggccaggaauuugagcagaaguugugguuuuaccuaugcucagaggcacuccugggagaccagcucucuccuggcaguauuugguuauggaguauuguggcacaggaucagcucccaggcacagacagaaaucuuuuuuaauuuuuuaaaaugugaguuuuuacaugacaaccuagcacaugugucaucuuaccccuuucauaauucuuuaaaacucagaaugugacauguaauuuagaggugaauuguaauugaugauguacauguaacauacguguauauucagaaauauguguacuguguguugaccgguuagagcuuuaagcucuguuuccugggucuauuuuauuaguugagagaacauauccauccuugaacuugcagcucacggaaucuacuaagugaacuaauagaugcacuuugaacuuugaacuuuugaaaaaguaccuggccauagugcaugcugcugcugcuacuauuauuucuccaaugucuauucuuuuaauucaaaugcugcuucauggaguugacucauggcacacaagaauauagcuuuguaccacuggguuccuuuccucuccuuuuuaaucuacuugcaauaguagauacacuaaagggaguuaccucaaccagcuuuccacagaacagaugacuauacucaaauaauuuuuaacacccccacagugaaaaucagccuucaagugaagagagaagagacuaaaggaacagacuuaaaaaaacaaaaacaaaguagauuaagucaggggacaggucaagcugggcagaagacuuucagagaacuggagauugugugcagguggucacccugaagcuauuuuaucuugagucaucugugaucucuuccagcugugaacaugucugcuauggcucagauggaagaccuuuaucuuuguauuucacagccuguacagugaaugcaggaacuuaaaucugguccuuugcuguccuaucauuaacauuuaauggagcuguugccuaaaauagagaguucuagaagagaggcccuaaugugggccaauacacacuucucugucccaugguuuccucucaguaucuguugacucucucccuccauuucagcuuucacuuccuccugaguuuuucuuuuugucaguugcuucuccccuuaaacuccagcauuuuguuuugugauuugucccaaauaaugaacuaggaaugugugaaaaacauagaucuggugcuguuuaucuuuuuucauggcaaagucaacuaauugauggguaccuauuacauuuguguuacauaugucaguuggugacucugccaugugagauacucaaaagaaguaaaaagaacgaaccuucauauugauacacuucaccugguuauggaugaguagacaacacauguccuauuaucacagagcaacacaguuccuuucauggcugucuaaaggaagacacuauguauucuuggauauccuuaagagugacuuuugguucaaaugacuccugggaaggcuggacauaccugcaaauaccaauuugacauagauguaauaccuagaccaaaucuguauuuauggauuuaguuuucagaacucuacuuuuuuuccccuuuauuaccuauuaaauuaucagauaacugccuaagaagacccccuaucuaguacccaggaagaggagugucuauuugagcauauguuuucaauauuuuaaaguguuucuguugauuagcaguauacauauauguauauguguauauauauauauauauauauauacacauauauauauauguucuuccauuauauauauaguaaacaguaacauucaaaccaaagcaauuugcugacaauucuaauauuaaauauauaauaauucuaauaauaauaaacauccaggcugccauuuaccugggaugacuuaaauuuaggcaauuucccaauuugcagauaugaauaauccaacuuuaagauaccucucucauuguagaaguuugcucugucacugguuuggcacuuccuguugccucugaugcuccuuagagauggaaauuuaaacugucuacauacuacacucugaucaauguucuggagucagccuacaauagcaccuuugugccuucagccuaagugugcuuaccaaaguacacuucuugcaguuucccccaaguuucauuaucucccacaucaguguaaccuguccugcuagucucaaaucugcuuuauuuccccuacaggucacuagauaccaugggugacacagaacagaauuauaaccacuaagcagggcuauuuaauggagccaaaauaacuuagccaagaaguaguguuaugaccaagaguugaugaccaagauguuauuuguuucuagcugucauaccauauacauuagucauggauuuugacuuaaauuuuguccagagacagccuagaaggacgaggugaauaguuauuaagaauaucuggcugccagaaacauaaucagacuauuagugacauuugguucauacaaaugaagagucuagaugucacucuaaauuucugucauguguuuucaggacauucuuuaggcucacccaccaaaaagaguauucauuaucuuucaacacuuuuuaugucuugacaagauguaaugucgauauaauguuaggauccagauguugaagguacugagauuuuuauuuagaagugggcaaaauucugaaugcuuccuuuacuuaccucuugauacucagagaaagccaauguauaaaaagucugugaaugugugugugugugucucgguggguacacacacacacauacacacacacacacacagagaauuuuguuucucaucuuuuucuaaguucaacagaauuuuauuuuaguggccuuaauagaacaugcauuauaggcaagaaaguaggcuuuuauaaaauuuauauuuguuuuugcauguguauguguguaaccacugaggcuagaagaacacacugaaucucuuauagcuacaaucacaauguuugugaacugcccaguaugaguugcugucagcugaauccuccucugacagagcaaugaaaacuccuagaccucuccagcuucaagucggcuuggugcuaaaaucuuuaagaaacuuggaauccagagcugagugguuaccucagucaguaaauugcuugucucaaaacuacaauaaccugaguuuaaucccuagaagccauauagaaacauucacacacacacacacacacacacacacacacacacacacacacacacacugcuugauagcccucuuuuauaaucacagaucuguggagauggaaacaggagacacccuaggguuugcuggcuaaacaaucuagccuaauuuggaaguuauaggccaaugagagaucuugucucaaaugaguaaaugcuuaaggcuggauagauggcucaguguuuaaaaacauuggcuacucuuucagacguccugaguucaauucccagcaaccacaugccaguuuacagccaucuguauugagauuugcuguccuauucugcuaugcuccucugcugcuauacagaggugcaugcagacaaagcacccauaugcaugaaauacacaagcaaauaaaucaguuuuuaaggaguaggugaucucaucuugaggaugacuaaguugaguucuagccucacacauacaugcacacaugugcaccugcauacauauuaaauuaacacacauguacacaugaaauccuacaagagaaguguaagugaagagaauuguaauaucaaaaguaaauacaaaauaaacaucccagugcuacuagucaaauuggagaaguugaaacaaaagaugagagagggaggcuugacauccaagaggaauaaugguaagaauauuaguuggccuggagucagguccgguaggugugacucauggagccggcaagugaauauguggauagugacagggaaauaacagggagaaaaaaaaaucccuuacaaagucauuggguugaaguggguauauuauaagaucaagguaauugguguguguuuaguuggugagaaugggcuucaaauauguacuuuuaaugucuggugugaugguaguaugguaaugaaaauaaauggagauggguauugucuuaggguuucuauugcuauaaagagucaccaugaccacagcaacuuucauaaaggaaagcauuugauugugcuggcuuacaguucagagguuuagucuguuguuaucauggcaaaaagcaugauggcacauaggcaggcauggugcuugauaauuagcugaauguucuguauccagagcugaaggcagcagggagagcaagugggccuggcuugaacaucuaaaaucucaaagcccacagagacacacuuccuccaacaaggccacagcuacuucagcaagaccauaccuccuaauaguaccacucucuaugggucuaugggggccauuuucauucaaaccaccacaaauaucuagaaggaaucugacaucaacuauuaugucagacaggcagggauugcaacaggcagagcugauagggauauuaaugaaggacucucuugaggaagugaccuaaagaaaaagaauggucuagauguggcugcuaagaagguaugcaggugugguaaacaugaacucuaggcugggucguaagucauagcuaauuauaaaaacaaaucauuagccccaguugcggagaguugccauaaaaaaggaaaaggguguaagcugcauucaucuuugggauaauuaucagucaguauuaaaaagccuuguaauuuuggacaauauguagcugaguuugcuuuuugugucuucgaaugauacuuugaaucacuuuugaacaucaccuuaccaucucuuauuaucaguagaaagucuacauuuuaacaaugccuuuuuccuuuucaaggugaaaguggcuuagugauuuugagauaacauuuuaguggugcuauucagaauaggaagacuggccuuacauauuucauuuuguuguuguuguugcugauuuguuuaaaggauucucucuggccuuugacaugugaugcuguguuuacaucauugaugucaucccuuuccccuugcaguuccuccugcguccacccaaguccuucaaauucaucaccucuuacuuuuacauuuauguuacauaugucugucucucuacuuaucuguaucaauguaucugucuauagcauuaguuaucaucuaucaucuaucuacucacacagauauauguaaauucaaccuaauaaguccauuuaucauugcuuguauauauuuguuuagagcugaucccuggguggggucauagcuugucccugaaaauugacucugucucucagcagcuguuuugccugaaguucuucauuuggggaagaacccuguaagauuuacuccccccaccccgguccccauccacacuggcaugucaaauggugguauuguugugcagguauuguauaugccaccguacuuuugcguuuucauggcuauagcuuuccugucauauaugaaagacacuaucucacagcaugcauugugacccucuggcucuuacagucuuccaccuccuuccaugaccuucccugaaccuuagguguaggaguugugcuacauuguuuaucacuggaguugagcauuccaugaucaguuaaaaaaauagagaaugcuuaaugaauuuucuuaucauaccacacaggggccaugcuaaucuuuucuauaucauuccaauauuaguauauaugcugcugaaaugauucgcuuaauuaugcaggucucauguugaccuucauguagauuuuucaggauaucugacccuccuuauccuuucuuuuuuucauuguacuuagaaaaauuaccaccuuugaaaucaaaauuguuaguaaguacacacucaauuugaugguguaauuugcuucauuuuuuuuccuuauaagaaaaauugacaaacaaaaaaccaaauaaaccacccacguugacuuauuuucagcauccuguugguaugguucaguguguuaaauuucauuuaaaagacuauugaagggaaauauugaaucucgaaacagcagggugagaugagacagaggugaauguuaauuugaaaaugaucuccagacaguugcuccugguguaacagaccucuugucuuucugaaaaucaccacacuguugcauauucacacaguggaaaccauaggcugauggagggaauuagaguaagaggaaacagcaccccaaaaccucaccuuugccagguacuaaaaaagaaauaacuuaaaaaguuaucacaggccagugagauagcuuagcagguaaagguguuugucauggaaucugguggcuuaggcuuuaucuccugcagacuguccucugaccuccuuaugugguacaugugccacccccaacacaaauacaugaaugcacauuuuuaaaauagcaugguuuuaugcaacucacugcuuuuuuuuaaaagcauaaacauugcaguaaauagaguacuuaaaaaacauugcuuccagggguaggcacuaggaguggugcagcuuuugagaaugucuagggugguaggaggccugccugaagucagggggcuaguuuaaauagcaggugucuguggguguagcucugacacugccgacccuggacagcugguggauguuaagaugccugagugcacaucuuguguuuucuagccuuccccaguucagugagcuuccuguggaagaaaggcaaacuucauacacacuuaaacugucuuuaauauuucaguuguguuggaacaaauuuguauuuucaaaguaggaguuauagcuauaucaaaaugguuuauaaucuuaucuucaauuauuguguaaggaagcuaagacugagugagccacaguacauguggugugguagccauguuaguggcggagaagaucaugauuuacaggccucagccuccuuccccaucagcugugugcuguacugucucaccuuucauuguguuauaaaauuccuaucauuaaaaaacaaaauccuauuugguggugguggcacacagacagaccucugaguucaaggccaaccuggucuacagaguuaaaggacagccaggacuucaugaagaaacccugccucaaaaauaacuaacuaaguaaguaaccacugaccugagguuucaaggauggacagauggcucagugguuaagagcacuggguguucuucccgaagacccagguucaguucccaucacugacauagcagcuuacaaccauuuguaacuaucuuucucauacagacacacauacaggcaaaacacaugaaauaaaaauaaagccaguuuuuaaaaugcuguauaaaaaagaaaaaucccuccauucuuacaguucuuacugucguuaauuuuauuuuagccccuuuuuuaauacuuagaauucaucaaccuguccaccuucauuugcuugauuuccuauuccugccacauuauuagucucacuauaauugaguguuuuccauccucaaggcccagguuuaauaauggaggaugcggggacucuccauauagccuaugaugcccguccagcuugguggaaaucaucuuuguuagcagugcugacuuuguucuucucuguguccucuugaguauccuagucuucccugcauguuugucacuuuauagcuaagacccgggaaaguaaaugacuugcucaggauccaccuucacugcuggucucccaguuuggaggacagagauuuuucugugaccucuugccugcuccuuaccuuagcucacucuggguaagagacagaugacuuuggaugcaccccaaguugucuaucagugaaaugucagccaauauuagaaaugcagaugguuaaaacuucaacaguauaugaccaggaagcugcuacccacaauuguuugggugggaccauaacugucuuaaggcgcauauugauaccuaauaugauaaacuccuuggugguuugaauaagaaugcccccgcacccccaccguaggcucauacguuuuacugcuuaguucucaaggaauggcacuauuugaaaaguauuaggaggaaguauaucacuuggggugggcuuucaguguucaaaagcccaugccaaguccuuucucugucuguggaucaggauguagcccugagcuacugcuccagcaccaugcuugccuccauguuccccaccaugauggugauggacuaaccccuugaaacuguaagcaagccuccaguuaaauacuuucuuuuauaaguauuaccuugguuguagucucuucacagcaauagaauagugacuaagacaaacuccaaggaaacauaguacuggccuccaggagagaggagagagagguaauccuuucccuuacuuauuguggaccuugggugagacauaagcuauucccaaauccuguuuucucaucuacagaauguugacuacaagaauaaauuaaacacagaugaaacucuuauaaggcuuuuauacuaaguauucaauuaaaaacuaguauaauuuugauaauaacuagcuguugcuuuuaaaagguaaaaucauggucguagcaguaucacacaagcuuguaucaaggaauccuaugcauuaguuagucaggaaaucaguaagauguuauaaacaaucaaaggaacaccccaaagcagauucauacaggcagucaggaaugcugacccgaauuugcuuaauagacagcaaagagaauagagcaaucaguaccacugacacugaccaaaguucauuuacagaucaguaguggagaaucauuguccucaguaagcuaagacuuaacuaaacuguaagcucaaacgccuucaaagugcacagacccauagaauaaggacaggaaggguacaaggggagugaguagcugcuucccugucaguaacaugccauaaccacccuggccauuagaaauguuucacagcuccccuuaagcaaucuguauuauugcuaguucuuuaucuccuaggaauauuuugaggacuaauaaaacaauggguagaugugccucuguuuacaaugcuguucuaucauaaacuaaaaaugcauauaauucaccugauaaaccccacccaccuuaagugugcacagaacucuuaccugagucuguaguugaaugaaaucaucuaucacaaagcccagucuauaacaaaauguugauguucacgcaaucuauuggguacugaaccaaauacaaaauaauacaaugggaugggugccaucaugaaacugaaaaauccuggcugagccacuggagagccagggacuaucuguguaugagucaugauauagaagcacccaagguguauuuuacaaagagcagugacaguauacaaggaagagaugaggcaggccauauugggucuucuuuucugugugaccuuggacagugagcugacagauuugugccuuucuuugcuuagcuaucugccuggauguuagaagucauaacaucuagauaaaagaaucuauggggaauugcccuggaaaaugaaaaaaaaaaauacuacuccuagaagugacuguacggugacucuguuuuagguuugugcucauuuuuucuuuaagaacaaaaaccuauagaauaaaaagaugauguggugagcuccuggaugugugcacaaggccauaguuacuggaaguuguaaaucauauggaaaagucuuuaacucagugauuuauggccccacugcuaguccugaaguucauguucacugcuaacccacauguccugauggccccagagaagcaugggaaugucacugacuacaggggccauaugucccuacuuaaaccuguauagacuguauuucacucuccauaaccuuucuuagcaaagcugucucucugguguugccuaccugucuugaagaaggagguuugagaauuccuaagaacugggaaggaaaaucuuugggucacauacuccuuuuguagcucaauuauggauuuugucacugagacaggauaaggagaguuuagacugauuccagcauauaacccugaguauacaaaaggggggagagggagaauaugaauaagagagaaagugaggguauaaacuagguggaaagagccuguacugugguuggaaagaaggcagccaugcaucagacacagggcuucuccaguucucaccaaggccugcaccagggaacagaaugucugccacagcagaaggguuugagcuauggaaacaguaggacuuucuggguugcauuguacucuacacacuuaaagugcugcaaaaggcuuuggagauguugaaaaacaacggcaggucucccuucaccugaguaaacaaggguaggucucuuuucaccugagagauaccgaccaugccucuccugaggcaaaggcuuacuucagacucacaaaagaaauccauacuuuguuugaccuaugcuauuuauuaugcauagaggugucaggugguggagaggagugagguugcuggagcuucacugccucccccucuucucaccccaugaggugauuccagcuugccuugcucauaugcgauauaacauuuccuacacugucuucugguuuuggugaacccauugccacugagucucgguuuuuuugucccugcccccagccccuggcacagaccugacauauacaguucagcaguaauuuucugacggagcguauugaggaguuauuccuugacuggucaacagaaaucucaaugcccacaacauuaggagaaaccccagucacaacaguuuagcaggccagcccuggggccucuucauaaaaugggaaagcuugagcccaaaauucaguguucauaaugagacuauuuucggcuuucucagaaacagcaucuguaaauaaucaggcagaagccuuuuauaaaacaauguaggaaaaaccucaaauccauucuaaggcugaaacauugaaacaagauuuugaacccacgggcacgccaagaucaacauggggcuuccugcauaaaaacuggaauuucauagcagugugggggcaagaacuaugacugaauuuuccccuuccuaaauuauauacugcuuaguguuaaagugaacagagggcugcauggagaugggccugugguugauguaaguuccacuacaaacccauggcgucugugguggugggacuugggagagccgucaggcuggcugggcuguauguugcaaaaaggucacucguaggucaugccacaguuuaagucuucaaugaaauuuagcaugggacuuuuccucuuucauacaaaaauaaucagggacauuauguaauaaguuuucaagagacaguguucugaauguugguuuagugacagcuauuaauaccuaccauuccaaagucccuuacuuuuucaucccuguuggauagaggaagagguagucuucuauaagaggugguguuaaacuugacucugaauacucucuucauguguggguagguagcucggugcggcuacccacaaguuucuggauucugcccaugcacauauacacaccacugacagaaaccgacagcaaaaacagugaagcccuuucaucucucuuagcugaauaauuucucccaagggagagagacuauguaugucuggaagauucuguaauguucuguccacccugaaccaguaaugucaguuguaaauaaguggcaaagcaacgacccaaagccagcauucccauuaggcccacccuggccagggugaaacagccaugacuucaguccucuaagagcucaccugcaggcuucucaaaguacuugggauuuguacuagaagagucccuuguaaaaagagguuguuuauuguaaauaugggggagagaacagccagagccaucuggaaggguucagaugaacauggcuggcagaacagaccaggccacuagaagagagggggcagggguagggggagugagggaagaagagaagagggagaggcaggagaggcagaguagcaagagcagaaccaagagaggaccaagagaccaagagaaaaucaggacagaaagugauccaacagagcacagaucccaaaugacuggguuaucauaggggaaaagaagcuggggaagggagggaggggaagcucauggguuguagagguuuggcauggcagcagagugagaagagaaguguugagaggaaccaggacucugcaacacagguacuugugaugcgggagagccagguagcagaaaccucuuugauaggcuaauaggcacuucaaucagcuguuugucucagguuuccuugggaccuaacaauggguaccuagaaauguguacaccucacccaacauuuccaugugugaauauauagaauguaauaaagagagucuuugugugcacacauauauuuugaauagcuguagaaaguagacuuuuuuuuaaaauagacuuuuauuuuugagacagggucuuacuaaguagcuacagcuggcuaggaacucaagagagaucagccugccucuaccucccaagugcuaggguuaaagucauauucugugacacucaguaagaauauagauuuuuuuuaauauuuuuuauuucuaaguagauacaaagauuauuuuugaaguauagaaguagagauuuacuuuuuuuuagaaauuugaagaaauucuauguaacaguacaaucuaaacuuuuucucuuuuuuuuaauuagauauuuccuuuaaauuucaaauguuaucuccuucccugguuuccccuccaaaaacccacucccccugcucaucaacccacccacuccugcuuccugguccuggcauuccccuacacuggggcauagaaccuucacaggaccaagggccucuccuccccuuaaugaccaucugcuacauaugcaacuggagccaugagucccaccaugugcacucuuugguuggugguuuagucucugggagcucuugaggauacugguugguuccuauuguuauuccuccuauggagcugcaaaugccuucagcuucuuggguccuuucucuagcuccuccauuggaggaaccugugcucaguccauuaguuggcugugagcauccaccucuguauuugucaggcacuggugggcccucuccaaagacagcuauaauaggcuucugucagcaagcauuuguuggcauucacaaaagugucugaguuugcugauuguauaaaggauggaucccccacguggggaagucucuggauggucauuccuucagucucugcuccacacuuugucucuguaaauccuuccauggguacuuuguucccccugcuaagaagaaucaaaguauccacacuuuggacuucuuucuucuugaguuucaugugguuugugaauuguaucuuggguauucugaacuucugggcuaauagccacuuaucagugagugcauagcauuguguguucuuuaugauuggguuaccucacucaggauaauauuuucuauuuccauccauuugccuaagaauuucaugaauucauuguuuuuaauagcugaguaguacuccauuguguaaauguaccacauuuucuguaugcauuccucuguuggaggacaucuggguucuuuccagcuccugacuauuauacauaaggcugcuaugaacauaguggagcauguguccuuauuacauauuggagcaucuucuaguauaaacuaggagugguauagcuggguccucagguaguacuauguccaauuucugaggauccaccagacugauuuccagagugguuguagcagcuuguaauccuacaagcaauggaggaguguuccccuuucuccacaaucuugccagcaucugcugucaccuagguuuuugaucuuagccauucuggcuggugugagguagaaucucaggguuguuuugauuugcauuucccuaaugacuaaggauguugaacauuucuuuaggugcuucucagccauucgguauuccucaguugagaauucuuuguuuagcucuguuccccauuuuuuaaaaggauuauuugguucucuggagucuaacuuuuugaguucuuuguauauauuggauauuagcccucuauugguuguaggauugguaaagaucuuuccccaaucuguugguucccuuuuuguccuauugacagugcccuuugcuuuacaaaggcuuuucaauuuuaugaggucccauuugugauucuuacucucaaaucauaagccauugguguucuguucaggaaguuaucuccugugcucuuccccacuuaagcuucuauuagauucaauguaucuaguuuuauguccuugauccacuucaacuugagcuuuguacaaagaguuaagaaugaaucaauuuguauucuucuaagugcugaccaccaguugaggcagcaccaucuguugaaaauacugucuuuuuucccacuggaugguuuuagcuacuuugucaaagaucaagugaccauagguguguggauucauugcugggucuucaguucuauuccauugaccuaccuguuugucauuguaccaguaccaugcaguuuuuaucacaauugcucuguaguacagcuugaggucaggcauggugauuccccaagagguucuuuuauuguugagaauaguuuucacuauccuagguuuuuuguuauuccaugugaauuuccaauugaucuuuuuaaucucugaagaauugauuuggaauuuugauagggauugcuuugaaucuguagagugcuuuucgcaagauggccauuuuuacuauauuaauucuauauuaaucaaauccaugagcaugggagaucuuuccaucuucugagaucuuuuucuauuucuuucuucagagacuuguaauucgaaaguucuugucauacaggucuuucaauugcuuaguuagagucacaccaagguauuuuauauaauuugugacuauugugaaggaugugguuucccuaauuucuuucucauccuguuuauccuuuguguagaggaagaccacugauuuguuugaguuaauuuuauaucuagcuacaucacugaaguuguuuauuagcuguaggauuucuuugguggaauuuuuggggucauuuaaguaaacuagcauaucaucugcaaauacugauauuuucacuucugccuuuccaauuuguaucccuuugaucucauuuuguugucuaauugcucuggcuaggacuucaaguuccauauugaguagguagggagaaagagggcagccuugccuagucccugauuuuaaugggauugcuucaaguuucucuccauuuaguuugauguuggcugcugguuugcuguauauugcuuuuaccauguuuagguaugggccuugacuuccugaucuauccaagacuuuuaucaugaagcgguguuggauuuuguuaaaugcuuucucagcauccagugagaugaucauauguuuuuuuuuucccuuugaguuuguuuauauaguggauuaaguugauguauuuccauauauugaaccaucccugggaugaagccuccuugaucaugaugacugauuguuuugauguguuccuggauuugguuucugagaauuuuauuuaguauuuuugcuucaauauucauaagggaaauuggucugaaguucucuuucuucgugcagucuuuuugugguuuagguaucagaguaauucagauaccugguaucugucuagaaaauuguccauuccauccagauuuuccaguuggguugaauauuuuuguaguaaaaucugaugauuuuuuggauuuccucgguuucuguuguuaugucucccguuucaauucuaauuuuguuaauuaggauacuuuucucugugcccucuagucuggcuaaggguuuaucuauuuuguugguuuucucaaagaaccagcuccugguuugguugacucuuuguauaguucuuuuuguuuccacgugguugauuucagcccugaauuugauuauuuccugacaucuacuccuucugggugaauuugcuuccuuuuguucuagagcuuucagaugugcugucaagcugcuaguauaugcucucuccaguuuguuuuuggaggcauuuaaagcuaugaauuuuccucuuaggacugcuuucauugugcccuauaaguuuggguaugcugugucuucauuuucauuaaauucuaaaaagucuuuaauuucuuucuuuauuucuuccuugaccaaguuauccuugaguagaguguuguucagcuuccauguuuaugugggcuuucuauugcuuauguuuuuauugaagaccagccuuacaccaugaugaucugauaggaugcaugggauuauuucaaacuucuucuaucuguugaggccuguuuuaugaccaauuauaugaucaguuuuggaaaagguaccaugaggugcugagaagaagauauauucuuuggauguaggauaaaauguucuauaggaaucuauuaaauccauuuguuucauaacuucuguuaguuuuacugugucucuguuuagauuuuauuuccaagaucuguccauugaugagagugugguauugaagucucccacuauuauuuuguguggugccaugugugcuuugaacuuuaguaaaguuucuuuuaugaauguggaugcccuugcaucaggacuauagauauuccagauaaagaauucuucuugguagauuuuuccuuuaaugaacaugaaguguccuuccuuaucuuuuugauaacuuuagguugaaagucgauuuuauuugauauuagaauggccacuucagauuguuucuugggaccauuucuuuggauaauuguuuuccagccucuuacuccaagauagugucugucuuugucacugagguggguuuccuguaugcagcaaaauguuggguccuauuuauguauccaaucuguuagucuaugucuuuuuuauuggguaauugagucuauugauauuaacagauauuaaggaaaagugauuguuacuuccuguuauuuuuguuguuagaggugaaauuaucuuuuuugagguuaucuucuuuuugguuuguuaaaagaagauuaaucccagcacuugggaggcagaggcaggcagauuucugaguuugaggccagccuggucuacaaagugaguuccaggucagccagggauauucagagaaacccugucucgaaagagaagaagaagaagaagaagaagaagaagaagaggaagaggaagaggaagaggaagaggaagaggaagaggaagaagaagaggaagaagaagaggaagaagaagaggaagaagaagaggaagaggaagaaagauuacuuucuuacuuuucugguguguaguaucccuccuuguauuagcauuuccauuuuccaucuuuuauccuuugaugggcugggauuauggaaagauauuguauaaauuuguuuuuugucauggaauaccuugguuucuccaucuaugguaauugagaguuuugcuggguauaguagccuggguuggcauuuguguucucuucgggucugcaugaccucuucccaggaucuucuggcuuucauagucucugacaaguagucugauauaauucuaauagugugccuuuauauguuacuugacuuuuuucccuuucuacuuuuaauauuuuuucuuuguuuuguacauuugguguuuuguuuauuaugugacagaagaaauuucuuuucugauccaaucuauuuggaguucuguaugcuucuuguaucuucuugggcaucucuuucuguagguuagggaaguuuucuucuacuauuuuguugaagauauuuacuggcccuuuaaguugagaauuuucacucucuucuaucccuauuaucuuuagguuuguucuucucauuguauucuguauuuccuggauguuuuggauuaggagcuuucugcauuuucuuugacuguugugucaauguuuucuggacuugagauucucuguucuaucucuuauauucuguuggugaugcucgcaccuauaucucuugucuuuuuuccuagguuuucuauuuccagaguugucucccuuugugauuucuuuauuguuucuacuuccauuuuuagauccuggaugguuuuguucaauuccuucaccuguuugcuuguguuuuccuauaauucuuuaagggauuuuuguguuagcucuuuaagggcuucuaccugucuaccuguguucuccuguuuuucuuuaagggaguuauuuauguccuucuuaaaauccucuaucaucaucaugagaugugauuuuauauccacaucuugauuuuccgguguguuggggaauccaagacuugcuguauugggagaacuggguucugauggugccaaguagucuugguuucuguuuguaagauucuugcauuugccuuuugccaucugguuaucucugguguuauuuggucuugcugucucuggcuagaauuucuuccuccugugagucuauaagccugugucaacauuuggggagacaagauccuggcagaacuuguguacaaagggcucaggaacagcccaagcucuggguccaaauggugacuggaaggauccugucccauauguuccacuguucuugcucccugugugcuccucacugcccagcuccagauaguuauuggagagaaaguggcuaucucacccacgagcccagaaguaaaaucacuccuagaagaacaagucucuccugguggugggacccgugcacaguggccuguggaucauccucagcucaagggugcagagggugcacaggaaggauccugucccagcugcucuacugaucuuacaccccaugugcuccuggccagcaccguucuacacaguugguuuuuuuuuguuuuuuuguuuuguuuuguuuuuauagaauuuggcuuaucucaccuccgugcccaggaguaaaaacacuccugagaggucaggucucuuuuuggcaggaccugugcacagagggcuguggaacagccucagcucgcaggugcagauggcgaauccaagaauauagauuuuuaacagcaguuauuuucugagaggagaauaaaauggaaaaaguaaggagaauuuuuuuguacuuucaucacuuauuucucacuguuugaauuccucauaaagaauacgcaguuagcuggccaugguggugcacaccuuuaaucucagcacuaagaagcugagacaaccagaucucugugaguuccaggccagccugcuguucauauugaguuccaguacggccagggcuguuaaacagagaaacucugucuuaaaaaaccaaaaaagauuuaagaaaaaacaaaaagguacaauuguuuaucucuucuuggcauguggccuggcaacuaauaaagcauucaguguuacaguguuaaauuaaguggcugugccuacagagaauguagaaaauuaacucacacaucugauuucgggaggcuuaagagauggaugaggaggaggaagcugaacugagggcuuaccuaggaaugagaguaggaacugagucuggcgcuggaagaggcccucagaagucaagaagaguucuggguugcagcuguuaaguugacugauuggaguuaaaaaacaauccuggugucagagaaaugacucuaugguaauugcugacaaaccugauugcucaguuaauguaggugaguguuuccaagccuacccauuugaaaggucagucccuaggauccccacagugaaaggagacauacagugccacacguauuccccaaugaauuagcaaauacauacauaaaaaaauguuugaugacaauaagaaccuguccuaagggacuaggaauauggcugaaucaguaaagugcuuuucacccccauccccaccacuuuaaccaugaggacuuuaguuugaaucccuagcacccauguaaaagccaguugcagagacagggcaugcaucuauaaucucaucacuggaaguaaagacagacagauagaucccugagcucagugccagccaacuuagucaaauugaugagccccagguucagagaggccuugucuugauaucuuguucaaucagauaucaagauaucuaauccuuagauagugguugagggaaauagcagcaccagucuuugcccucuacacacucccaccaugcucauauacccacaugcacaugugcacacacucacggcaaugcauacaucuacuguucuaugcacacaacaaaacaacaccugcccuaaauuagcuuccaaguuguuucugauaaagaacauaauccuaguccucucuaucccuauggauuuaucuguagacagaacaaaggccaacgaccugacacaaaagccacugccauguugaccugcuccccugguagggcuagacuaagccaugauugucagaaaagacuugugggggcugaaaagauagcuucaugguuaagagcauuaacuguucuuccaaaggacccagguuucagugucagcaccuacaagggucuguauguccuucuagccccaagagaaacugacacucucucuucuggccucugaggauacugacugcauacucuauauguaugcauagacauacauauaggcaaaacacccacacacauaaaaauaaguaauuaaaauaauaauaacaauuaaaaacaagaaagaaacaaaagccuugaguucacaagucaagugcagggagcugaaguguuguccagaccggguuggaaagugguuaaccguguagaaacuguaucccuuguaguuuaccuaggacagccagcucagucugucccauaggccgccugcuggagugcugaaacucuuaaccuccacccagcuggcaaaauccaaacauggaacucuuuccuggcuccucaucuuagcaacgaguuagagacauuugcagaugcuucaauggcaguccggaguugauuuguagaguggcagacaugucuaguugagacuuaagucagcagucauuggagucacuuaagccucugaccaaaugaaaaacuugcuacucagccucaaucuggguggcagaguucuuugaaauguguccaugaggugcagaugcagugugucacaaugggaagaagcugauugaagucacugccuuccuaaauuaaaggcacagagaggcagcucuguaauucugcuaauuacacaucccucuuucuccugggcuccuuuaauuccuucacauucacaucugucucaucaacuacaagagcauguucugaaagcaagcugucgaggaagaucuacaaggcccacuggccucagaggaagacagaagcaccuuguuugaagguuccaaagcuucguuaucuaauuucugacaguaaauaguaaaccauuuugugagaguagugaauacccuugguuauguuuccaucugcccucuacuaagaugggcuauuaauaaaauauccuugguucuuauuacuagacaaaaagauucugguucacuuuguuuugcauuaaagucuaugcuugugaccuuauuguucaguuuucacaauucagcuauagaaaauacucuaucucuacaauacacagagucuuacacaacucaguugugguuuuaacagaaaggcagagauacaaggcagggcaagcagagaugaauuagcccgucuaagugauugcuacaaaugccaaagugugggucugguauguaguugccugguaccugacagugguaugagaaaaggcagagauuguugcuuccugggucacaggggccagauggagaaggucuggcucuuuggugauuaguuugcauaucaaaggcauccugccaagggugaccuuugcuaucuuuaagaauugguuaucccucaguugaugaaugacuucauggauagaccaucuuaauacacacacuguuucuuaaaugaauguaaccuguuccgugcgggcugagaaugacgacaaucacucaagucaaauagcuuugaccauagcaggaaaucuguauucaaaaaucgugcguacaauuuauuccuuuucgggacaaagcugucaacucuuagcucaucuacuauggagguaaaauccuuuggugaugugagggacauucaaguacaaccuuauuacaaugaacuccaauguccaaaaucuguucuuauuuuguguuuguaccacacaguaagagccaagauuuuaagcucuacuaaaaacaaaacaaacaaacaaaaagacuuacuauuuauguucauuuaaaaaacuaauagugauauauuauuuuaaaauaucauacaguuaauauauuuggaguuauuuagaguuuauauugagaaaaauguauguauuuucaguauuguuguagacaaacaucuacguaagacucuucaauugauuguuguuuuauuucaaacaacuguaauacucauuuuuauugguacaauaguuuaugaauuuuaaagaauaugauaaaaaaugaaagguauugcagguuuugaaggggggcucuccgggaggaguugggguacaaaagagaaagaaaaaugugauauaagucuauuuacucaaaauauguuuuuaaauguuaacaaauucagauaaauugaaauuauauuucuuuucucaucauaaugcaauaaaacuuaaaucaaaaaaaaaaaaaagaagaauugcuuaucccuagcuaaaaggguuaaaaaugucaaaacaugcagaggauaacauuguaugcuaugcaaaugaguggggucugcuccucuuuucucugucaccucugagggaguagccauuugcuaaauuauacaaucuacaaagaauuauuuaaugcauuucaccuuuggagacagagccaaagaacuacuacuacuucucucuccagcucucaugcuucaaaguuuugugugguuuuaacccacccacccaugcccacuccacccccaaccuccacccaccccccccauccccccaucccccccaucccccccacccccaccccguccccagggacaguuucuuacucucugucuuaggugacuuggaacucacaacaggcacucugcucugcaccaugcccugcccccuuuccuuaaagacuuuaauggacuuuggggggugagcuuuuuauauuggaccuuuggauuuuuccucucuguuguaguucugugguugauguuuacccuucauguauucuguugauuuauauaacauagugucuggggaaugcuguagucuggucuccuuggcuuauauacuuacaaggucuucucaugccuuccaucuccuuuguucugcacgcugugugagauagauaguuuuaacacuguuuuuccagugagaaaacagguacagagaaguuagguaaaccugagucccgcgucuggcagagaccugaggccacaucagaacuuuaacucugaauucugccauuucuuacucuggucuccacugcucacuacccuggugccaucauggcuuucaaaggcuuugaguagaacaaacauggugcacugggacaaaaauggcagaacucacucagcuguuagagaaaaaagaaaggauacaucauuggaggaaguuuuaacuuucuuucuccagagagcuauaacacugcuagguuuucuccugauuccugaagaaucgguugcuacagcgaugaucaguguuucuuggaacuggcugacagcagcagauguuguguuuuauaaaaauaaagagccaggauauguuugauagagacauuugagguaugcugagguacaaggggaugccucugcugacccauuccccccugagguaccagcggauauaacucauggggggagaggggaauggagagaaaaggggcagagaguaagagaguaagagagugaggaggggggcaagcagccccuuuuauagugacucaugcauaccuggcugcugccagguaacugugggucagaaaaaggaauaauagcagacccugugcugcccccccccccaugucagcaucucugcuauaucuacuucccacucaagucacuaaguaaccuagugaugugcugggauaggaguggccacuggcauacugcacagcuguggucuaugagggcagaaaccuuuccguuaaauaccaguuuaacuuuuaauaacaccuggcucaagcuagcaagugugaaguacuuuccuaagccuuccuaguuuagucucuaguguuuucauuuugcuuuuguauuugaugaaauaauccauauaggggaggaaaggcuaguuuugcauuugaacuguaggaguuuuucauuucucugagaaaagaaaauagaaacaagagaccccagagagagagagagagagagagagagagagagaccuuugcaugaguucuuuaguucucacaugcuucucugcagucuguuuguaaacuggauucucugccuagaaugccuuccuuuccuucucuuuuuuuuuuaccuuccuuugcuaaacuugucauaugcuguuuagaguguaagcccuuggauuaucgauugacuuuuaaacccuuuuaaaguacaaaauccuauuaggccucaguuuucucuagaguugggucaaugccuuauguccauugcuggaaccaggaauccacagaaccaccagaagacugucagacccucaauguggacagagacuccaagguuuguccuugcaccuaacaagagauuucucacugaguaaagggcugcuaaaggcauuucuagagagcuguggauuucuuuuuuuaagauacaggaacaagacauuuaacuaaaauguaaagaaggcagauagagacuccucccugcucccauauauaugugauuugauguguguauuucagugugggggggauugugccucagcucaaguggugguuagagaacaagucucuggaaccaguucucaccugccaccuuguugagucagggucuuucuuguuucugcuucucucuguguuccuuaggcuagcuggccugagaguuuccaggggagucgucugccucucccacuguacagauacacaccagugcaucuggcuuuuuaauguggauucugagggucagauugucaggcucucaugacauuugaccagcuggacccaucuagccaggcugagaaccccuaacuuacagacagcauuaaagugauccauuaggcuucuggucuucucugucuugguuuauguguuuucuuucuguccuuuacaucccauaaccucauaaaaccccuuucuguuuaauguuugaacccagcauccacuucagguggcucauaaacaccugcaacucuacaacucaaucaccaaggaaacucaacaccugaccucugcaggcaccugcacauagacagucacacacauauauacauaaucaaaauuacuguaaauaaauuuuuuuaaaaagccuaauguugcaaagaggguacuuugauuuucagaugcuuacuuguaaacuaaucuaacuugaaggaaacuugguugaucaaguccccaggcuagagacacagugaugagaaaccugugauaaacucuuuacuuaggaacaauucuaugugaugcaagaauaacaccaccccauuuuauagaucuagcuacuauggcacagugaaucucagcgacaacgggaagcuggaaaccagcagacauaagcuccucccuagauuuccucccucagucacugcugcuguuucuucagguuguuggggagucuguucucccaggacuagggcugagauagcauccgaugcuugcaaagcugugccagaugcacauuccuaucucuagacaccacaucaggacugauuucuuaccauccugaugcaggucucugaaucaccaaaaucauuuuugcacaaugaggugaauuauuuuuaaacuuuuacuuguuuuuaucuuuuguauguuuugccugaauguaugccugugugccauguauguaccugauguccuugagaguuagaacacaucaaauucccaggaacuagaagaacagaugguugugaguugccuugagcacgcuagggaugcagcucggguccucugcaagaacaacaaauguuuugacccauugagcccccucuucauccccagaggcaagcuuauuuuuuguuuguuuguuuguucguuugauuuacugauugauuugucacuuauuaaucugucuaucuuuuauaauaaauggcuauugaauugcaagaguugucucaguggucuucuaaacacaucauaguggcugguuguggugacauaccucuagcacucuaaagguuacaacaggaggaucacaaacuggaggccagcuugggcuacaccauaagucugaggccagccuugacuguucauuucucuugauguuucaaagacuuugcauuuauaccucuagauguccuuaugguauucuuuggggggggggguggaggugggggaauaggguggcuccuuaggauuuaaaagucauggaauauauagcuuuccugcuuuucuggccuucaaaaacacagaggguacuuacugucaggccucaccccuaaagauuugauuauagucuuuagguagggcuuggguagcuauuuuuaaaguucucaugugauucugaaauguagccaggguugacaaacugaaauuacugaucccuuuaaucucuuacauugcuucccugauauuuaauuuuguguuaacuuaccuggauuauaggauauuagucaaacauuauucugguaagguauuucuuaccagaauauugguaagguauuucuaugugagaucugaguuugaguuaguagagauagcaaagcagacugccuucccuacuuauggaugagccucuugcaacucacugaagacauucucuccuugcugaguaagaaugacucuacguggaccuucccccacucccaauccccaucuucagacucaaacugaacacuggcucuucuuaguucuugaguccauggccuucagguaggaacucaaaccagcaacuaucccagucuucagcuuaucaaguggauaucucaggacucaguaauuacaacagccaauccuaauagugauucauucucuguagauguauauucuguugauucuguuucaucacagaacccugaccaauauaccucuuuaccauaagucuucaggacaucuuugcuguccuugagaguuuucauacauuauaucuucuaggacaccaucaaauaaagcuccuuuaaaacagaguuuggaugggcaucucacuugugcucccuaagacaggguaaguauagcucagucugaagaaguucaaguccucacccaugcuucucuuguugucugacugagacaacaucugugaaaucaaagaacuuauuaucuuacuaccaaguuauaaccuuacugcaauggucccaucccaugaauaucagcacaauuuggugcucacuuaccuuguccagucaucccucacagugccuggaauuuauucauuaugcaagccagaagcauugaggucuggugcccaguagugaauaaggagauaauuauguaagacacaggagaaagaugaaccagauugggagggcaggguaugugugcaagugcauuccuggucacaguccaggagcaaacaugcaaugagaaaaguggcaaaguccaugguuagaauccucauggauguucuagaagagaacaggacuaacugaggugaggagcugggaggccaaucagagcuuucuacacugcauuuuuaugacccauucuauggaugccagccugugaucauaauuauggagcaucuuaguugaaagccaugcacugaaaugacuaauuuuucauucaguguaggucugauuuuagucccauuuaaaauguauuguggcuccauuuuuuccuuuugaauauuuacaugguaauacaggaaaaagauacuuugugaaaauagccuuguuuuugaccuccugaacuaauuugcccuaaauagcuaccacauugauaauaucuuaaucaaaugcaacagcccuuuggaauucuguacugcuaauuuccauugcucuacuaucuuguauguagacacaggaacgauguccuugcaucacuauuuuguuugugcuccauuuuuauaaaagugguuucuccuaaacaaacaaagccacaggaacugguucaguugaagagaauaaacagauuucaagggaucaaaggccauuguggaaguucauggagcaaucuuuuccucacuagaucacacucacauguugauggugucauaguugaagaugaaagcaucagggauucuauuuuaugcuucauuuucugaugauuuuagugaucuuaauuuugccuucaaaauuaaauuaaacaaaucaggaauacaaaaggaagaugucuuggcuuggauguuggaggucauccaguucccaagcagccaaagaaaaccucucccaacuucuuuucuaaugacuccgguacaugagaacaaacaggcagcccccauccauauucacuuggccacaggagcuacagaggcugccuaaugaccugacaaacuuggcuguggacacaguuuugacuuuuuacagcuaauacuauaaagaauaauuuuggggaaggauaauuuuucuuuuacuuuugcccaaauuaaaucauuuccccacuuuggcuagguaauggagacauaacuuuaauacuauuuaauacuauuuauuuaauuaauuaauuaauuuauuuauuuucauguggaaauccacacaaguaugguuuuagauuuucuguuccuacauucugcagaaaaauguauggaaguaugcugcaagccaugcuugauauggguucaucagugccaccccucaagaugagcuuuucaacauauauucccuuuaugguauuuuuuucuuuuucuuucuuaagauuuauuuauuuauauuauguauaucaguauaacauugcucucuucagacacaaggcaucagaccccauugcagaugguuaugagcagcuaugugguugcugggaauugaacucaggaccucuaggagagcagucagugcucuuaaccacugagucaucucuccaaucccuacaguauuuuuuauagugucucuuaagggguaguagcccaacucuggaaacacucagaacacugagaaggcaggaagaugaaugguaaaucuaaagugcuucuggcaaacuuuccaauaauauugagcacuggauaauaggaagcaaauaaaaguccuuaauuacacucaugauuaauuaauuuuagauucuaaauucaaagaaaguuguaguaugccucugaagacagauagaaugaaaaagagucuaugauguucugagguaaaaauuaguuaucuuagcuggccaguagugauacacgccuuuaauacuagcacucaggauacagaggcaggcaguuaucugugcguuugacaccagccuggucacagagcagauugcaggauauccagggcuacacagagaaaccaugucuuuaaaaaaaaaaaaauuaguggauccugaucaacuauccugaucagagggcagagucuaucuguggcucucaacuuugaugauaugaugagauuccaccaaugacaugcauaggugagagugguauuuuguggagcuaugucucaacuuuugaggaaaauagacugaccauuaauuagccugggcuuguuuucacuagggauaaugaaugcauucuaacaaaauaaggacagacaguucacuguucaggaaguugaaccauauguuuccagaugcugcuuuccccaaaccaagagaaaaagagguuaggcuacuucccuuuuuuuuuuaaaccaaaauauacauucaaauuguuauuucuuaaaacagaaaaaucaaaccucaaaaauaguaaauguuaccagaacaguaauaaauaacgacaucuuuaaaagcaggcauguuucaacauugcauaaucuacagccaugugcucaggcacuucugugaugacugaagacacauuccaacugucaugagcauacaucacagauucaagccuacacugcaggguuccagcaccacaaccaacacguuggcaacacaccagguuuuccugagaacucucuaugucucccaaguucaaaugauacagcugaaauggugcaacuggcuuagaaacuaccuggggugaaacaacccuucaggaaaccuaauuuuuuaaaagugaaaugugccauuuaaugcugaaauggcuuuccugaagcagagugaaaucauagaugaacuacaacagccuuuccauugccagaggaguaauaauucauuuccccuguauagccugggcccucuugcccuuacguuuuauuacauguguaaguauauguguuggcuauucauagugcaugagcuucuggccgccuagaagggccuguucauccugggcacugcuagccaugccacucgcagcaguugggcugccuugcuucauuuuuuagagcccacuagugcuuuguuacauagucccagagguuauccaugucagaauuaccuagccucucacucuucuaaauaccuauaaaucccuggcaucuugcuuccuaugucccuugcugacugccacaccgaguggcacugaggauagauggagaacaaacaaucgaucacuuauauacuauauauucuggaugccuccaguuagcacucacauccuagcucuguucucuggcucaggauaaccugaacacugagccaaauacuaggacugcuguagguugggcuuuugccaagcacuguacagcagaugaaauagauuucccaaguguuccaucauagucuucacccgacaucuaucucaagacccccuuaugugcugaugaucaagaggggagcaugaaccuauuuaccccuaagcauucaaccuugauucaaaguuaacaacccugcuauguuaacaggugguaacacuacaaaauacaguucuuccaaauaccuauauuuuaccccaaauuaaaaaucuuagaagcaaccuccuaagaaagguagagaaagcuucaagaaauggcagaaagcauauguguaccauuucccagugucugaaacuucaaaggaggucaauaaauguuugcuaaauggguaaguuagugaaugccaugauguggcgaaguagaguguagccucauuagauugguuugacaagcaaagaugcccguuagcugggacagcauguguaguggggcugcuuagcagggaugaaaacacagugccuuaucccuagauuaucuguguucauguagcagaccugcccuaccauuuggcaucugugccauuuggacugacaauucauuauguccaacagagcagucaagaccaacaugguagaaagcuuucccagcuucagaagugacucugcuuuuucuggauagugcuuuaagcuugggcuuuuuuauguucucuucugguugguuuucaucuuuaaacagugcuguuaguugcugacaaaguacccugguguacuuggguggcccaagaaugcuuugggccuaugcugcugugucagauggguaacaagaucagaggaauuuguauguauuuacauuaggauuugugucuggauuaugacauauagaccagcuuuuaauuacuucuuuccuuuuacugcuguucaaguccaugcauguuuagaauccggauauaaacaucuccaauaagcuaagucaccacacaggcuuuucucuugcuuuugaaaaccauucuaaguucagaauagugguaacacucaccuuuaauuccagcacucgggaggcagagagaagugaaucucugugaguucaaagccauccuguucuacacaaaaaauagagaccagccagggcuacuuaaugagaccccaugacucuaccaccaucaaaauaauuccaaagcagaaaagauaugaauauauacuugacugugacacuauuguuucuuguaaaccccaaacacacugugcuuucuccuggcuaggcggcaugguaguacuguuuguuugaauggacaaaucuucacuguuucauuuccaacuucuaaaguugcagggcaugaaguauacugucuggguaaaugaauugaucaggugcauuuggucauaaccuaagcaaaaaaagggaauguggcuuuaaaagaccucuaugaagucaguguaguggcauauuccuguauaugggagguggacacaggaggaucauaguuugaagacaguuuauucuacuucgugaguaccagaccagccugggccauaugguaagauccuguuucaccucacccuaacccucaggaaaaaaguaaaaacaaaaucaaaagcaaacaaagaagaugaugaaggaggaggaggagaagaugaaggaggagaaggaggaagaggaggaggaggaggagaggaggaggggggaggaggaggaggaggaagaggaggagggggaggaagaggaggaggaggaggaaaaggaggaggaagaggaagaagaggaggaggaggaggaagaaguaguaguuauaguaguaguaguaguaguaguaguaguaguaguaguaguaguaguaguaguagcagcagcagcagcagcaacacuaaguagugcacccuagaaagucaaacagacaaaacugcagaggugguaauccauuaucccuucccaaacucugugccagcuacuaugacaagcaauuuaauuugaugaacaguuggcaaaacaaauuauuuauuagauauuuucuucauuuacguuucaaaugcuauccccaaagcccccuauacccuccccuuccugcuccccaacccacucacuccugcuuccugucccuggcauuccccuguacugggacauaugaucuuugcaauaccaagggccucuccucccauugauggccuacuaggccauccucugcuacauaugcaacuagagacacaguucugggggauacugguuaguucauauuguuguuccuccuauaggguugcagaccccuuuagcuccuuggguacuuucucuagcuccuucauuaggggcccuguguuccauucaaaagaugacugugagcauccacuucuguauuugccaggcauuggcauagccucacaagagagagcuaugucaggguccugucagcaaaaucuugcugacauaugcaauagugucuggguuugaugauuguauaugggauggauccccagguggggcagucucuggauggucuuuccuuccgucucagcacagaacuuugucucuguaacuccuuccaugggcaguuuguuccccauucuaagaaggagcaaaguauccacacuuuggucuuccuucuucuugaguuucauguguguugcaaauagugagguaacccaaucacaaaagaacacacaugauaugcacucacugauaggcggauauuagcccagaaacuuagaauauacaucuaauuuauaagauaauaaagauuuuagugauaugcagucagcccuccauaaaccuuucauauuuucacuuaagagaggcacauuguugcucgcugcucagguuuaucugaauugccacuugcuuguuuacuuucuauugcccggucaugugagaaugucuuacagcuuacaguccaucaagaagggaagucaggacaggacugagaucaggaacuuaaacagaaacauggaggagccugcuuguucacucacucaccacagugcuucguucucauugcuuuuuuucuuuuuuaaauauuuauuuaauuuacucacuuauuuauuuauuuaauauauaugaguacacugcagcugucuucagacacaccagaagagggcaucauaucccauuacagaugguugugagccaccaugugguugcugggaauugaacucaguaccucuggaagaggagacagugccaucucuccagucccucacauugcuuucuuauacaacucaggaccaccucucuggggcaccacccaccccacaccaacuaugaaucaagaaaaugcucccuagacuuauauacaagccaaucuuguggauauacuuuguuaacugagauucccucuucccagaugauuugaacuuuuuucaaguugacaaagaaauaacuaaaaaccaccagccucuauucuuguacuuugaggccauucuaaauaacgaggacagcaguacccugauacaacagaugaccuaguaacagaggugacuucuaaaugagggggcagcauagacaguguggacacagagaacaaagggauaaccaggucuuaggcacaacugaguagaugaugcaauguuuuaucacucuguguaaaauagaauguaauuuuaaacauauauuucugcaauuuuccaugucaucauuuuagacuguaggaaacugaaauugaagaacagucaaucuugaccaaggggccaccuguguuacaagcauggcaguagaguucauaugguauaaaucacuaaucuauucucucugugacccaaacacaaagauauaaauugggauuugauccaaaccuuuggcuuuaaucaccuaaguguggucuuguccagugaaggcaaaccucaguacuucuaucccucugaaagguuacaggaaagaaagagccuguggaucuugccagaaugggugccuucauuugugcauuugauuugcccuauguaaaggcucugugauggacugauaugucagaaggguacaacuuucccuaauccacacacagacguggccuugacccuauaaacuugucacgagucaaggcaauguagacucaaaacaaacaaauuagaauguuauaauuaaugaguuuucuccucccaaccuggaacauagcucuuuaggccuuaauaaacccaauuugcauccuuaaagcagccaucuggauccauaggucauguaggcuguuauugcuaaaccugguucuugcucccagaaauaagacucagacucaaaauauauuuacaaauacuuuggcuuggcucuauucugacuagaucauaacuaaaauaacucaauuauuuuaaccuacauuuugucacaugacugguuaccugugcucaaguaccauacauucgucccaucagcucuuuccagcaacccucuuucucucucagaauuccuucucuuccuggaugucccaccuauuucuacaacauaagcccauguuggcagaagucauauuggguuguggagaaaaacccaguaagagaaaagaaagugucaaaucagacccauaccugaaacagcagggauuuggagagaggugcauguuggcuuuguauuguaaccaggauuuguugaguuguuacccaggugccauuuguuuccaaagggcaguaaauugaguuucuuaccccauaccuguugucuuccaccucccaaacacauuggcuuuggggcuucucacucucccagaccuaggugagaagaguugugauuugggugggaagugacaagagacaucauuggaagcuaaaggaaaugcuuucuccuuuuacaaagcugauauaaaaguaaucuauuccaguugaacugccacaaacccuccucagcaacuuucugcagucacaccaugagcucuugggcacagggggccuguaaauugcauaguaauggcugauuccuccgugggaauaaacaugugcuuugaguuuuccaagugagucauucaugcugcaagauaaaugcugauagcaagcagaugugacaugugcuguucaagagugacagaaggggcacgaggcagggacaacuggaggauuggcaucuuucacaugcuuugagggggugggcuaacacuuaauggggaguucuccuuuaacaagaaacacuggguggcugaugagucccuccccccucuucuuuccuucccuaaguggaaucuacacuuuaagccuuaaauguaaacguguucuggcuccaauuugucguccagcucuaauugccucgaaacuuuauauaaacucuaggugaguaauuuccccaaguacaguacccuuuuggaaugcaugugccaugaacucagauuaaacuuuuaaccucacauuuuucugggaaggauuauuaucuauguuuuuuauuguuuaaaaaggcaaucauaaacccaagaacauugagugcucuccaguggcugagccuaauauacuguuuccuuuuguugugcauguuuggggaucauguauauauuugacuucuaacaacaacaacaacaguaauaauaauaauaauaauaauaauaauaauaauaauaaauaaugcucaggcccaguguuucagaauuaaaacuguggggcauugacacucuugucugccuuaugacguucccaacuagugaacuguugggagggccuuguaccuucuccagucaacuacaaaauuaugaaugucccccauccaaguacuaaccagccauagacaaaaaaaaaaaaaucugaaugucuauuugcugauccacaccauguacccuuugcuaagugauguguguguaugcguguuuguguauguacauacaugcacaugcaacuuccucaguagagccugagcucuggccccaagauugcuccugccucauucuaggcuuucacucacuucaucuucuuccucuaggcacaggagaaacuagaguugggcucuccuaucguguugggcagagcagagcaaauaucagcuguuaagcuuuaagaugaagguccucuuugcaagucugaggcuucucucucccugugacauuacucaccugcuuugaccuuugugaaaucaauuaggaugaggcauguuuauuucauuggcuguuuguuuguuuguuuaagucugaauuuguagcaccaaguuggaagcaaguagacuggcuuauucuuccagaaguuuuccauuauuuguaguauauuuuguuugauuauuaccaagaugcauucagcauggcacugagggaagaaagauggcugaggaccaaacauuaguccugcugccaacucacuguguggccuuugguaagucaaggugucugaccaugccacagcccauccauuuggaaaugggaagagcuggauuuuaaccuccuacugaaacagugacagucccauuaauuuugcugugacauuucaagggggaaaaauaacacuaaaacaagaaacaaugaucaaaauccaguacagagagcucugcuggcugcguaagcaaccccugcaaaaacccagggcagagagcuguguuaacugugaccauucucugcaguuguacuggucuguuuuuaugcaaugcucuguaaauacugaaaugcuguuuucauguucuguuauaucauccagcagaagauucauauucauucucuauuucucucuaugugucucucuccgugugugugugugugugugugugugugugugugugugugugugaguguguguguguguacauauguacaugcauguauagaagucaggaaucaacuucagguccucauuccucagaaacugucuaccuugguuauuguuguuguugccauuauuuucuuuucuaguuuugaaguucuugaagaauucugacaaugcuuuuucuaaguagcugggacaaaagcaccugauuuuauuuauugacucaauuuuuaguauuauuuguuaaaagguacacauuugugauacugcugcaauuugaacaacaaaaaggcaucugugcaaauggaugcauacaagaaaagaaggaccaaccuuagcaugaggcacaucaggcuucugcagcaguccaguaggacaggagaacccuggaauuauggaaagaaccagccagaaaguaagacuggccccuuuggguguuauuguguuguccuaaucacagucugagggugcagccaacacaggcaucguugacuuggucucaucagucuguguggugagcgguggagaauacaugguggagauacauggguuucugggaagaugaggaugaagguugaguaaagguggcagcagagguccgggggucuaaccauuucugacaguuuauauuaguaagagaggaauguugggauugaccacaucugcacaauuguagagaacauauacuugagagcaagauccagacccuugcaauagcuaaauggagcacuggaccaaagacaagaacuauagggaaguaaggagagaacagguggccaggaaguacaguacaguauaguauaguaguacaguacagagacaguacaguaguaccaguaauagaaauggaugggaaguacagcuguucgggaaccucccucuagaaggaagcugcuccaggccuaguaguuauccuuuuaucaucaucuuugucuucaucccagaccaagcauuguuucaucucaucaagaaaagcccuguaauuaaguugggaugggacuagccaucucuacaugcauagcaucaucccuucucagaaucccaguaaagagguuguuaggaauuccacuuucaugacauucuugcacaaucauuucucauucgcagaauaugagaauccucuguacaauaaacuugaaaagcuugaagcucucacuguucacaguuuuggggaaaggugcugggcagcucugugaaugauccugaggcugcaaacuuaccaucucacacaccagcagccacagauguucuaugagcuggcuauuccugaugcuuggggacuagugucuugcuagggccauguaaagcagcaggaauaucugaucuaccauggaaaacugcuuggaaggucucugguuccauucaucucugccuagguaugcacagagguuuggaggaagugcauguccuuggcagccugugcugaccuggggucugcauuuugcuuuuaaggacagacucucacugggaccuuagaacauaacauuuaggcuaaucuggcuagcuagugagccccagggagcugccuuucucugucuccucuccaggaggauugcaagcaugugcuaucuacaugcaguuuuuagaugaguacugagaauuaaacuuggguccucagcagcgcuguuuucccacuccugauuuuagacucuuccuagcacuggaagaacaagagaggcagugguagcaucauuucaauccucaaagucuggaaaaucaauaaacuaauuggcagcuacuguucauuucccuuugaauacccuccaugucuucaggaccggauuacaccauuccguucugagcucaucuccccuuugcccugugaaaucaccaacauguguuuauauuucuggcuuccuuggauugucauucuggucuuagucucuguggugagcaaacagcugaaauuuggccaaguugcaaaaccauaaggaaaaugguugguugguugguugguugguugguugguugguugguuuguuuauucauuuauguacccugagauaccugucucucaaagacagaggauuggaaucauuucuaaggaaggagugauauggcccugguucagccagccucuccacccucauccuguaccuccaggagcccuuguuacgaagcuugugugauacuggugugcauuuugcuaucaaggucagcuagaggugacauucuagggucccucauguugguacugguacaggauuguuuacuuguuaauuuaaagacaguuguugaguacuuaccaugaacuuagaacuaaggauauaaaaaguaaauauaauugguauuuccuaaaagaaguucauuaucuagcaaaggacauaggcauucauauagucuauaaaauguaggaaugcauguagucuacagaacaguacacaggugugcauauagucuauaaacuagaacacaggcauaaauauagucuauauauagcacaugggugugcauauaauauauaaaagaggacagguguacauauagucuauagacuaggacacaggugugcauauaaucuauagaagaggauacagguauacagguaguauauauagcaggacacaggugugcauauaaucuauagaagaggacauggguguacaugcaguuuauagaauaggacauggguguguauauaaucuauagaagaggacauaggcagguauguagucuauaacuaagacacaaguguacuuguggcauauagaccaacacauagacaugcauauaaucuauagacuaggacauaugaguccauauagucuacaaaugauaaugcagguaugcauaaggucccuauaacaggacaugucgcuucugucuccaaccagcagaaaagagugacgacacagcguucuucucaaagcaguuuauucaggaaccuuucaacaugcaagcaggaaucucuccuagcccccaaucgcaaucccuuauauaaccccucaaccacgccccaucagcccagucccuguaaucucaguucuuuggccuucaucaaauggccugaucuugcgucauggugcgccugcgcagcucucacaauggacguggcuuauuuucagguguaugaggaagucaggugcaagucauaagaguuggcugcaguccugggcgccaucuugggacuaccgccacaccugcuccccacaaggacacagauaugcaugucgucuauaaacuaggacacaggugugcauacaguguggagacuugaacauggguaugcauguagucuagauauuuggacugggaaacagguguguauauagucuauacacuagcacacaggcaugcauguagucuauauaauagaacacagucacacauguaguuuuuagcauacaguaaguuauguacacuaguaguacagaugcaaagugagaccuagacucaggcacugaguuauacagaauuuuccuuggcuaaaaggcaggugaccaauauuccaggcaaagaacauuucauggacagacaaagaacaauguaaaaguauuugauagacccuuugauguaguuuaggaauugugggggucacuaugauguagucacagauccaugaagacaguggcaaaucagggcuggaaaagcagagugaugaaucugugagagcccuuugcaagaucaacaguuaaguaaaacuguuugcaaacaucccaggcaacuuacagaaauacacacaacauaaagaaaccuguguguuguguaccuuaaauauacacaauaacauauuuuaaaagacaucugaaguguaagaaacagaaaaugaaaaauaauauaaauucaugaauguauuuggugcauauacaguuguuagaggugaaaggaaaauuagauccugagccgccuggucaccaaaaccaaaaacuauuaaguucacuaugccuauaugauaagaucuaguugcuccagggaagcaggcuucuucuggaaggaagaguaaagggagauuucuccugguuuucaucaaagucuccaugugagauccaguggaaauuucuucaacaguauccccacacuagcacauuuaugggacuguuccuuguaauguccccucagugcaagccaauggcgcucugccagaguguaaugcaguaaaaacguccgagcaaguccguucucaaguccgagcagcucagcccaugccugcugcuuggagcucauguggcuugauguggggacacaguugaggacauggagaggaauagauguccuucccaucuuuuaggcaaucauccaugaguacugcuccucacaacaggacucuuaaaauguguuagcaagaacugaauuggaacacucauuucauuggcagagaucucaggaacaaaggaguuugaaccuuggguuaugaaacagaguauguuuuccaaauauauuuacucuuggaagggaaguaauugaucaaguuggacuaagugcagcgucugggcuaagugcagacuggccuggcaucagggcccagcugucacugaaaacuaaccugacagacugcaucuugcugugaacuguaggcugaaggugggcacacaaaagcccucuaauuguuuuuugaucaauucaacauuuauuuaauuuuuugguuuguauuaauuuaucuauuuuuuaucucuauacaccugauuguagccaaacaccccccaagccuucuaauguuuaaaaggaaagcaguggacugauuauacuuucaaauuugguccuuuuuuucugcaauucaaagaaaguuuauguaauugaaaaccaauuuuuugagacagggucuugcuguauagcuuaaaacaacuuggaauucauaaucuucuuguuucagucuucuaaaugcuauaauagcagguacauuccacaaagcccaggcugaaaauaacuucuuuuuucauuuuauuauuagauauuuucuuucuuuacauuucaaauuuuccccuuuccucauuuguccucuggaaacaccccuaugccaucuacccucccccugcacucuaacccacccacucccacuucccuguccuggcauucccaaacacuggggcaucaagcaaucacaacaccaagggccucuccucucaaugcugucccacaaagccauccucugcuacauauguggcuaaagccaugaaucccuccuuguguauucuuugguugauaguuuagacccugggagcucuugaggguacggguugguuccuauuguuguuccuccuauggggcugcaaaacccuucagcuccuuggguacuuucucuagcuccuccauuagggacccugugcucaguccaaugaauggcugugagccuccacuucuguauuugucaggcacuagcacagccucucaggagacagcuguaucagacuccugucagcaagcacuuguuggcacccacaauagugccuggguuugguaacuguauaugggauggauccccagguggaacagucucuggauggucauucuuucagucucuacucuacacuuugucucuguaucuccucccaugaguauuuugaucccccuucauguguuuugcaaauuguaucuuggguauuucuaacuucugagcuaauauccacuuaucaguaagugcauaucauauguucuuuugucauuggauuaccucaccuaggaugauauccucuggauccauccauuugucuaagaauuuuauaaguucauugauuuuaauagcugaguaguacuccauuguguaaauguaccacauuuucuguauccacuccucuguugaggggcaucuggguucuuuccagcuccuggcuauuauacauaaggcugcuaugaacauaguggagcuaguguccuuauuaaaaguuggagcaucuucuaguauaugcuaggagugguauggcuggauccucagguaguacuauguccaauuuucugaggaaccaccagacugauuuccagagugguuguaccagcuuguaauccuacaagcaauggaggaguguuccucuuuuuccacaaucuugccagcaucugcugucaccugaguuuuugaccugagccauucugacuggugugagguggaaacugaguuuuugaccuuagccauucugacuggugugagguggaaucucaggguuguuuugauuugcauuucucuaaagaauaaggauguugaauauuucuuuaggugcuucucagccauucgguauuccucaguugauaauucuuuguuuagcucuguuccccauuuuuaauaggguuauuugguucucuggagucuaacuucuugaguucuuuguauauauuggauauuagcccucuaucggauuuaggauugguagagaucuuuucccaaucuguugguugccuuuuugucuuauugacaguguccuuugccuuacagaagcuuuguaauuuuaugaggucccauuuugucaauucuugaucuuacagcauaagcuauugguucaggaaauuuccccuuguacccaugugcucgaggcucuuccccacuuucuuuucuauuaguuucagaguaucuuguuauauguggagguucuugauccacuuggacuugagcuuuguacaaggagauaagaauggaucgauucgaauucuucuacaugcugaccaucaguugaggcagcaccauuuguugaacaugcugucucuuuuuccacuggaugguuuuagcuccuuugucaaagauuaaguggccauagguguguggguucauuacugugucuucaauucuauuccauucaucuaccuaccugucacuguaccaauaccauguacuuuuugaucacuauugcucuguacuacagcuugaggucagguuugcugauuccaccagaaguucuucuauuguugagaauaguuuucacuauccuggguuuucuguuauuccaaaugaauuugagaauugcucuuccuaaaguuaugaaggauugaguuggaauuuugauggugauuucauuguaucuguagacugcuuucaacaauaugacuguuuuuacuauauuaauccugccaauccaugagcaugggagaucuuuucaucuucugagaucuuuaauuucuuucuuuagagacuugaaguucuugucauacagaucuuucacuugcuuaguuagagucacaccaagauauuuuauauuauuugugacuauugugacggguguuguuucccuaauuucuuucucagcauguuuauccuuuguguagaagaauaccacugauuuguuugaguucauuuuauauccagccacuuugcugaaguuguuuaucagcuguaggaguucucugauggaauuuuuugggucacuuacguauacuaucauaucaccugcaaauauugauauuuugacuucuacauuucccauuuguauuccuuugaucucguuuuguugucuaauugcucuggcuaggacuucaaguaaucuauugaauagguagggcgagaguggacagccuugucuacucccugauuuuaaugaaauugcuucaaguuucucuucauuuaguuuaauguuggcuacugauuugcuguauauuguuuuuacuauguuuagaaauggucgggucuauuugcuucuuuuuuuucuagagcuuuaguugugcugucaagcugcuaguguaugcucucuccaguuucuuucuagaggcacucagaacuaugaguuuuccucuuaugacuguuuucacugugucccauaacuguggguauguuguggcuucauuuucauucuaaagucuuuaauuucuuuauuucuuccuugaccaaguuauccuugaguaguguguuguucagcuuccauguguaugugggcuuccuggauuuuuuuguuguuguuugguuuuuuuuuuuuucuauugaagaccacccuuaauuuguagugaucugauuggaaacaugggauuauuucagucuucuuauaucuauugaggucugguuugugaccauuauauggucaguuuuggagaagguaccaugaggugcugagaagaagguauauucuuuugauuuaggaugaaauguucuauagauaccaugaggugcuaagcaaaggguauauccuuuuucuuuaggauaaaauguucuauagauaucaguuaaauccauuugguccauaacuucuguugcuuucacugugucucuguuuaguuuguguuucuaugaucuguccauugaugagaguauaguguugaagucucacacuauuauuguuugaggugcaaugugugcuuugggcuuuaguaaaguucuuuuaugaauguggguguccuugcauuuggagcauagauguucauaauugagaauucuucuugguagauuuuuccuuugaugaguaugaaauguccuuccuuaucuuuuuugaugaccuuuaguugaaaguugauuuuauuccauauuagaauggcuacuccagauuguuucuugggaccauuugcuuggagaauuguuuuccagccuuuuacuuugagguaguguuugucuuugucaccgagaugcuuuuccuguaugcagcaaaauucuggguccuguuuacuuauccagucugauagucuauauguuuuuauuggggaauagaauccauugauguuaagagauauuaaggaauagugauuguugcuuccuguuaauuuuuauguuauuuuuauguuuguguggcuauuuucauuuggauuuguagaaagauuacuuucuugcguuucuaggguauaguuucccuccuuguguucguauuuuccaucuauuauccuuuguagggcuagguuuguggaaaaauauuguguaaauuuguuuuuugucauggaaugucuuaguuucuccaucuaugguaauugagaguuuugcuggguauaguagccugggcuggcaucugccaggaucuucuggcuuccauagucucuggcaagaagucugguauaauucuaauauugugccuuuauauguuacuugaccuuuuucccuuacugcuuuuaauauucuuucuguguuuugggcauuugguauuugguuuauuuuuuuuaauuagguauuuucuucauuuacauuuccaaugcuaucccaaaagucucccauacccuccccacuaccccccccccacuccuacuucuuggcccuggcuuucuccuguacugaggcauauaaaguuugcaagaccaaggggccucucuuuccaaugauggcaaacuaggccaucuucugauacauaugcagcuagagacacgagcuccgggguacugguuaguucauauuguuguuccaccuauaggguugcagaccccuuuagcuccuuggguacauucgcuagcuccuccauugggggcccugugauccauccaauagcugacugugagcauccacuucuguguuugcuaggcccuggcauagccucacaagagacagcuauaucuggguccuuugagcagaaucuugcuaguguaugcaauggugucaguauuuggaggcugauuaugggauggauccccugguuuauucuuuaacaggaggaauuucuuuucugguccaaucuauuuggaguucuguaggcuucuuguauguucaugggcaucucuuucuuuagguuagggaaguuuucuuuuauaauuuuguugaagauauuuacuggcccuuuaaauugggaaucuucacucucuucuauaucuauuguccuuagguuuguucuucucauuguguccuggauuuccuggauguuuuggguuaggagcuuucuguauuuugcauuuucuuugacuguugugucaauguuuucuaugguaccuucugcaccugagauucucuguuauaucucuuguauucuguuggugaugcucaaaucuauaacuucugaccucuuuccuagguuuucuaucuccagaguugucucacuuugugauuucuuuauuguuucuacuuccauuuuuagauccugaaugguuuuguucaauuccuucaccuguugguuguguuuucuuguaauucuuuaagggauuuuuauguuuccucuuuaaggucuucuaccugucuccuguguucuccuguauuucuuuaaggaucuuauuuaugcccuucuuaaggucaucuauuaacaucaugaaaugugauuuuaaauccaaauccugcuuuuccaguguguugguguauccaggacuuucuguuguaggagaacuugguucugaugaugccacguagccuugguuucuguugguaagguucuuguggcugccuuucaccaucugguuauuucugguaguauuuggacuugcugucucugguuugagcuugucccuccugugggccuguagccuguaagccuuugucagcacuccugggaggagaacucuccccuggcaggacccgugcacagagcacugcaggacaucccuggauccugagugcagauggaggcaggaaggacccugugucagcugcugcgcugcuucugucaccugugcaccccuggcuggucccgccuuagacuuuuuuuuuuuaaugaggcaaaacauuguaugaguaggaaacuaggagugugagagagagagaaagagagagacagagaaaggauaggggugagggagacaggagacagaaauguacgaaagcauggguauauaguuguguauugagguuagaugacaacuuuugaguguugguuccuucuacucuggauucugggaauugaacucugguagccagucuucagcaagcauucuuauccucugagcaaucucacuggcacaccaguaugucaugcaaugaaaaacuauagcuugaucgaguugucauggauguugaaaaaaacaggauugucacauuuugauugcaauacaacccaauacagaaacaguguuuuaaaaaaaucuuuacaagaugcuuagcagcugccaagcuguuaaaaaaaauucugagcacuguagguaaggaaagcuuccugugguugacuuaggaggaaaacucugcaccaaaggcaggaaugcuccaguggugcacugcgggaggagcugaguacugucugguuccuagaccccaugaaaggccccauauguguucuggccagagagggcccuuggcuuuguucuuuccaccuucuauuugccaaauguagugcauugauuuuccuauauguguauguauguggucucugaaugauacaagguaacucacucacacuguaaaaaccucaaauaauccuauguguugauacagaguugcagaauccccccccccccacacacacacccaaaggacaguuguuacaaacaggaguaugagacugaacucucuauguugagauagagaauagcccuagucgucuccuaccuacauuuucauuaaccuuggaaagaucuaaaacccgcuucuccuuacuugggccugguggggaauuggugagacagugcaaacauagggguuagacacagacauuguugccucugauuuacaaugugcugaauuauaaaugucccaaaagacaggaugcuucuuccauucaacaagugcauucauuagggagcccccccaguacucaguguaguacaacccacccauaauuuauaucugggaaacggauccaaagucccuauccauacaguaggcauauaaagcgagaaaacauauugugggcugaagguagcucagcuguuaagagaacuucuugcucucccagagggccuacauucauuucccaguacccucauggcagcuaacaaucaucugcaacuccaguuuuagggaauccgguggccucuucugagcuccacaagcaccagacacacaugugguacauguaaauacaugcaagcaagaacucuuacacauaacuaaaucuaauaaaaacaaagcacauguuauaucuucacugaagaacccagcuacuugggaaguugaggcaggaagaugguaguguguagugagugagaaccuuuuacaggcauugcccaagaccauuggaaaacauauauauuuacacuaugauucauaacaguugcaaaauugcaguuaugaaguagcaaugaagacaauuuuaugguuccucaccacaacaugaggaacuauauuaaaggguugcagcauuaaaaagguugaaaaaccacuucucuagaguaaaugccuagaagagacagccucaggauagcuuguacugcccacugcuuagugaucauacacuuuuguaugagcucuguuccuccaaggcuaaauccugacuccccuaccaccacuaccacccaucugguuucuuguuaaguaagccucucuuucuuaaaucccugucuccagcucgcucagacugacuuagcccaaaauaagaccaacuuugaaggacaucuggaaaaugcuauaaggaaggaccuuacugucugaaagaaucuuuuuucaaaucaaaugcuauccacacuucgagacacuguugcauguagcuuuucuccuucugcccggauggauagugcuuucuguugcgguagguguuuccugcuguuuuccagugguggcccuuacucuuuucaugaagccccaccuccuucucugaggaaaauuccauauucaagauagauacaucaugaagcaagaaauaggcaugaagcaagaaauagauugaccucuccccucccccucucugucuuauaaaaaugccauguuaaaccauguguuuagagucaggucuaauuaaaguauguuagaaauuaaggcuuauuacuacauuaugccuauaaagaagaugauacuauuuuuuaacgugaucaagauuuauuauagaucuguuuuccugagucaaacauucucccuucauucuguagguucgauaacuagccccagaggauaacacuguauauuuucauaugacugucaagggacagagucagcuccaaguaucugacuuaaauacacaaacaaccacucccuuuaucugagaaggugugggauaauuaacucagacaaccauagaaauggcaggagucuccuucagagugucugucucuuaaaucagcaaauauucuccuuggagccaccauagcccagaucuuuacugggagcccuauaccccuuuaccaguccauucugaauuauaaugaacuagguuguucugcagagggagcgggcguuucuguuuccuugggguuuuuccuuagccuagccauuugguaagauuuauuauagacuuuguuuuccugagucaaacccucucucuucauucuacaaauuugauaauuagccuauuaguagccauugaacccuuagcaucgaagacaccuggaaucauaguuaccaggaaccuagaggucucuaauccugaugaccuguccugaucucuuaaagaaucucugcccagugacgcuucucucuaauaauauucauaagauucagugaugaguugcugguucucucaaccccaacucaugucccugagugaugaucuuguaagaaaggucuccaguggggcugaucaucucccauaguugcuccucauuguccuggcucaggacucuccauugugccucauagacaccauuaauaggugcuaccugaggaauucugucuuuuuccuugggaagaugagggaguauuacaaauuuuagauuucuguguuugggauuuaaugagaucaaagucaacuaaaugcugaagaaguucccagaggucaaaaagaguauuaaaauauugaaacagccagacuuacucaagauauguggaaaggaguuggaguugcugaaauaaacauuccaugauuccuacucaccaacuacacauauauauacacacacacacacgcacacguacacauacacacacacacacacacuuuuucaccagguguacuggugccugcauguacccccgacacugcagagacugggucaggaagaucaaguuugaagucagccuaggcaacagcaagacccuguggccaaaagaaaacaccuuucuaaggcacagauaguccuuuaaguacuuggagggaggcaguuguauuucucuaagaccuaugucaguuacccuuguggcaucagaccccuugcucuccuagacauccaucuuuaaagaaccuucuuucucuuuaucuccaaucuuucucaaguuuggguuuuagaaacaagccuagccacccaaucuuagcuuugccaggagcguaccuaagccucacaaugcucauuaaagagcaucucauguauaucacauguaucuggggcuaagaaaaacugucuggaucccucaccagccacagaugcugguggcugcacacauggaaugugggcaugggguuuggagaugcugugagugucaaagaagccacaagcuaguacuuggaggguacaucuccccaacagcacaaacuuuuauuugucucuugguuuuuagcuuuuguccugacuuucuuuaacauggaauauaauauaacuuuaguuucacagcuaggauaguugagcucggguuuuuagauuugcauuuaucaagguucuuguuuuucugagaucuuucauuuagcacaggcuggagugggaacuauuuagccaagauugaccuugaacucauagucuucucaaguuuguuuguuuguuuguuuucuguuuguucggggguuuuuugguuuugguuuuuuugguuuuuuguacuggcugguuuugugugucaacuugacacaggcuggaguuaccacagagaaaggagcuucaguuggggaagugccuccaugagauccagcuguggggcauuuucucaguuggugaugggggagggggggucuauuguagguggugccaucucugggcugauagucuuagguucuauaagaaagcaagcugagcaaaccaggggaagcaagccaguaaagaacaucccuccaugaccucugcaucagcuccugcuuccugaccugcuugaguuccaguccugacuuccuuuagugaugaacagcaauguggaaauguaagcugaauaaacccuuuccuccccaacuugcuucuuggucaugauguuugugcaggaauagaaacuguaagacaguuuuugacaagaccucauuuuguagccuaugcuggccucaaauucugggcagucgucgcccaucaaaugcugcaauaacaguuaugaggcacugcaccuaguucaacuacauaucaagcacaccacuucucuaacucauacugacugaaguguuguuguaaauauuuaaucuuaguccagggcuucuaacccaccuuggaucauucaguucccagauaaaagacacacaacuuuuauucuuuacuacaagccuuuaucugcacuaaaagcugggcagauaucuacccucuaugcuauuaaaaucuguuuucuauuuauagcccugaguuauuacuuaguauguuucaucugggcugcuccaauugaucagcccucauggccaugcuuucuugacuccuaacccauggcgucuuucuucucuccugccuuccuucuccuaauaaucuccuucggcuccuaagccaaagccugggaacccugccuaucucaauucugcccagcuggaggcuacaagcaucuuuauucaccaaucagaaauaacuugaggccaagguuacauguaucacuugggucuacauuuggacugacuaaaagucaggcuaacaguuuaugugugcugcaacaaugaacuucccaauucugauuuuagaacuagacagacauacccacguggccagguuauaaccacagcaucuaugugugagaacuguuucaugaaacagaauugagagucaaaucagaauauaugcucuuguuguaaccccccgaaauugcugauacuagagagacaucaguguuguguacagacaguuugccucugcauuccccgcccccaccucugccagaagcucccauuuucccuccagccuguggcaagcaugaucugcagacagcuaguuucuuugcuuuguccuccuggagcagccugaggcucccuccccuuccccuggagcuagaauggccuuugugucucuaaaaccuaacacuccugcugagaagcagcagaaaaaacuccaggugccuguccuugagaacuuagagaaauaacaagcucaagggagaccauggggaaaaaaguaaacagaguucuggucacaaacaggacuagccauaaaauuagucccgaacagacacccauuaaaccccccccccuucacuacuauuccaccaaaugauuacaucccucuacucaccuuucacacuauuccuaacuauacuguauauaaaccaaaugauuucuggacucaggguugggucgcuugccagcauucacacagugaagugggugaacagaauucgaacuugaaacaauaaaagacucuuuuaugaguugcaguaaacuucgaaauuuuugagcuccucuggguuucccguggacucaggguacaacaucugggggcuuguccaaacggaauuccccagcaggccucuggaaucggcaguccagagagucuaugccagcgagcaagugugggugagugucaguguuucuauauugucuguuguucacuguacauguucuuucuggcugcauuucggcauugggaaaaaccucgagguaacggcuuaugugaccaaaaguagucaaaggagaagcagacgugggucaugaaaacuagggagacuucucuagauccuggacaggugagguuccuguccuucaguuugagguguuugaggagagaccucaauacaguuugcuucccccaccucaguucuauuucccgagaugggagucuuugaguccuaguguuuggauuuauuucuguuuccagccaugaaguagccguuuuuacgugacguuuugucuuuagugcuugacuuuugucuugggcuccugugggguucccguggacucagggcacaacacucucuguuugcagucacccuccccacuaaaaaggaaagugcagcaaacuauucuucacugggccaacacauggccccuuggguaaaucugucuaacuuaauuaauggauaacauuaucacaggacuguaauggcacuugcaucacaagcaaagagauuagggcucaaaggauacaaaauguuggguuggaaacugaagccacauucuuucuaacaugccauacugcuuauauaaggagggguuucaucucuguuggaucucauuauguagaguuacuucagaguuccagccauugcuucuuuucaaaucuuucaucuacauguuuuugugccuuauauuuacuaaguuagggaaacuuucucacugugaugaaaugcagaacgcuaaaaauacagucgcccugccuuggaagaauuuacuauauaaaguagcaggucagaccacacacaugaggccaguugauccuguguucauggcuuugugcaggaggcacggggaaagggggcuuuaaaacaacuagugugucugacaaguauucacuaauguagggcagauaaguccaacauuggucauuuaaagacacauuuuauaguauaaacaauauuuuuaccugaugaccagaucuucugguuauuuguaaugccagcugcacccacaggauccauggucugugauaaucauaacaguacacuaacuugauccuaggcauuucacaggugacccuaggucccuacaugccuguuccacaugguggaaggagugggguuuuuuaguuuccaggcagucauaguccuguaugcuggucuaacucuccugaauaugaguucuuggcauuuguauaucgagcaauuauuuucuuaagugaaggugaaacaauucaguucaacacagacuguacaaacuguugagagucacagaacacuggacaauuugcuaucccucuucuuuuggccaguuuacucuagacuuacuggaaacugggauuugggaauuacaucuugguaaaacggaaaugaauacuuccucucccuuuuuuuuauuauuauuuuuuaauuagguauuuucuucauuuauauuucaaaugcuaucccaaaagucccccauacccccccacuccccuacccacccacucccacuucuuggcccugguguuccccuguacugaggcauauaaaguuugcaagaccaaggggccucucuucccaaugauggccgacuaggccaucuucugcuacauaugcagcuagagacacgagcuccggggguacugguuaguucauauuguugcuccaccuauaggguugcagaccccuuuagcuccuuggguacuuucucuagcugcaagagaguccuucaugcacucgccuaggccuuauuuugcuugcuuugacuuauaaaaggcuccacuucuuaugccaguaccugcagcauucuauaagauacacagagccagcuggcagaacauggaacuaagaaggccauggcgggugccuaugcaggaggcccucugccccucuuucuacagccacucacagcuaucuccugcauucucuugugccaacaggaucacugccagaggugaaagcugauguaaauacacaugagaucugaaaguacuuucugacuuucaaaacuuaauugcaagcuaaaguucucuccauuuuaucauugcauuuacuuugaucuuguucagaagcuuugugacaaaggaccuaacuagaacuugcagcaagaugcaaguguuggucaugaugguagugguggugcugcugcugguggugguggugcugguggugguggugguggugguguguguguguguguguguguguguguguguguguguuguuaugcacauaaaauuuaaaugacauuacacagauugcacaauacacaaauuuuaugugcauugauguuuuaccugcauguaccucuauaugacgguguuggauccccuauaacuggaguuauagauaguugugagcugcuauguguguguggaaauuguuccuuuggaagaaaagccaguguucuuaaccacagagcuaucccuccagcccaaguuuuaaugagaacagccaguauacauuugggucaguuccucuguuagauccagugacaaaugaaaauauaccuugcaagucuuuguuaccaugagaaauaaguggcuggaugaggagucuguuuggguucauggaguguaagacagggagaucuuuagaaggcacauaucacagaagagucaggauuuuaagaugagcucuagagggcugaugagauggcucagcagguaagagcacugaacugcccuuccaaagguccugaguucaagucccagcaaccacaugguggcuuacaaccacccauaaugagaucuaacguccucuucugguguaucugaagacagcuacuauguauuuaaaaaaauaauccuggggcuggugagaguggguaagagcacccgacugcucuuccaaaggucuggaguucaaaucccagcaaccacauggcucacaaccaucuguaacaagaucugacucccucuucuggagugccugaagacagcuacaguguacuuacauuaaaaaaaaaaagaaaagaaaagaaaaaaaaagaugagcucuagaggauggcuaagcaaccaggcauuagggaaucucuuggcagccaggaguguuguaaaguugaucugaggcacacaagagggugaagguacauagguaggaagguucucuuuuccuauaauaaacaaccagaaaugaucagaauuauucgggcuguggaaggacauggugagauauauaaagcaucaaugcugagcaugugugcuaaaaaaaaaaaacccagaaaguaugauuguuuuuucuuuaucguugcuuuuuaaaaugaggcuaaaacucuugccucaguauuagggaggaaucucuacguuugccuauggaaaugcagcucugucuucaccuuagugguuucaugcaagugccaucuuaaacuggcauugagagaggagugaccagcuggcucuuguccugugcacuguccaggcaugcucacaugucaggcugacuaaugacauccucacugcccgccuaaccucugcaucaccaccuuccugacugagugacuaacccucagcucucuggauugaaccaccaugcauagggcuccaugggccccccucaggaucagagcacuuugcucuaaaucacuugucagaagcaccaaggggcuaccacuuagugaagcauuagaaacaguuuuaguauuuugagcuuugaccugaauccauugagaucucucagaaguugggucuuuuugcccuugguuucucuuuauucccuuuuccuccuuugauggguuccaucuaguuuguuuguuuuuguuuuguuuuguuuuggaaaacuuggguugcauggauccuauuucuaaaaagugacuauuucugccuauuuggacuuuuuguccuaauauaucucaaguguuuaggagaguugagugguccagggaauuucuuggcagccaggaguguuguaaaguugaucugagacacacaagagggugaaggugcccagguaggaagguucucuuuuccuacaauaaacaaccagaaaugaucagaauuauucaggcuggggaaggacauggcgagauauauaaagcaucaaugcugagcaugugugcuaaaaaaauaacccagaucaaaggaaaguaggauuuuuuucuuuauuguugcuuuuuuaaaugaggcuaaaacacagcccuagacuaaaauccugugacccugugucaagacaggcauccuuggaauucuccauacauccaugaagccugcuccauucucuacuaaaggcuaucagaaugauuucugucaauuugguguaagguucucaggggaugaguggaaagaaugaaucagaaggaagaaauacagauucagagaguagggagacugggggugcauagggaguaaugaaaggugacaggagucaggguaaaaagguuggaacuaaguagaugacaucauacuaaaagugcugaaagcauaaagcaguggagauuucuuuuuccuuuuauugaaaauagauuuuuuucauacacuauauccugauauaguuuuccuucccucuucuccccccaguuccucuccauggccucaccucuccagauccagucccuuucugucucucauuagaaaagagccuguuucuaagagauaacaaccaaagaugacaaaauaaaauacaauaagauacaacaaaaaacauuacauuaaaguuggguuugaaacucaauaugaggaaaagagucucaauagcagacacaagaaucagagaccuucuuguucuuauacucaggaaucccuuaaaauuacuaagcuaaaaacuauaauauguucauagaggaccuggugcagaccucgguaggcccuugcuugcugcuucagucuaugagcuugugugugcuuucuuuagauaauucagaggccauguucuccugcuguucuucugcugucuccaucuccucuucaccuccucuuuuguagaguucccugagcucuuaggggacaaauuugauggagacaucccauuuaaauucuguuuccacauagugucuggauaugggugucugcaccuguucccaacuucugaugacugaauaaggcacugaucuaugaguguaccagaauaucauuaaggggucuuuuuuuuuuuuuuugauaguuuuauuuugguuuuacucuaggucucuggacuaucuagucucucauucuugcauacccaagcagaguuggagauggauuauguccagugcaguggucuuuaagucagaucagacauuuguugacuacucccacaaguucugugacaccaucaucccagaauaucuugcaagugggacagauuguagaucaaagguuuuaugucuggguuguugcuuuugguagucuacagaauacuuuucugcaacaaagacacuagaauauaaggggugauggcuccauguagguaucagcucaacuucuuauucaaugaguuauguggguguugucuucagaaauggaacucugcuauaaguguucagaaaguaacccauugucuuagacacagccuggguuguuuggggauuuccaugggaccccauuggccaacaacucgguugaauacaacccagucccacuacuggaagcuuuguugggugacaagagaugguuaguugagauuucauauuccccauuagacaucauuagauucacauuuauguauuuuaggaaauuuccagguuuucauaucauaauuggagcuuugagaaagggucuucuuuuauauccagguggagcuggaacuuaccaucuuccugccuuagccccuuaguugauaaaguaauugguauauacccauuccaggcagaaguagauuuucuuagcuacuuuuuuccaugcuguggcucaaauucagggccuugagcauguuaggcaaaguguuccaccacugagcaaagccucuaacccuuuaguaaaccugguggauaggaacugguaugacuuugcuuccuucauuuccucaugcucuauguccuguacaacuuugaucaguugucuauaagaugaguggcaacuauguaugacucugguuugccaaguaauaugcuugggcauuuucuacugccucuagguguugcgcagugagcgugggggaauaaagggagugggagaaaacucgcauuccaacagaguuccagugcucugggcgggccgaugcaguaggacugccacacgcuuuccacaccccgggugggugucugacugugggaagccacuggaccccagcucagcagagaguggacaaggggcaguccuagguaacaggcucucagucucaggcaucacagauacuacuggacauuguggaagaccugagaacaaaugggggcccuggagacagcucagucauccccaggcagaagggaggagagggcaagaagagagggggugcugggugguucccacguaggcaagaguccuuggucugguccauggcuggagcacaggaaagccuucugucagguuagacaaggcucuuuaggggaaagucuaucccaucauucaagcacagugggccuugaugagcagagacacucuaugguuuuacagcuuuauuguagaaaggcagggagaaagagagaaauuagaaagagagaggcuggucauggccauguggagagaugggggaagggagagagaaaaggagggauagaggugagaguaagaaaggugagagcuuaaagagagugaggaggggccaagcagccccuuuuauagugcccuggacuaucuugcuguugccagguaacuauggggaggagcauaucuggcuauagucagguaacuguggggguggagucuagccagaaugccaggaguuugggacauugucugugugacugauagugacacaccucuccugugggggcugugggggcgguaacuuagacaggagccagggauccaggagacaagauugaacaccuuccgucccauguagguggaaaucaccacccaucggguccccaggguuucagaccuuugcuugacuagagaccaggcugucugugugcagcccacugccccacaucuacagagcgggaagaguguucucuaagccuuggcaucuguccuugcagacaauacuuucccuaacaguggaacaacuuaaaauagccaugcaucugucuaccuucauuauaacuuuguuuuuguuuucauugcauaauuuggcuuaaaggcuguauucugguuggugcagccugguccaucugaagccuccuggggaaaucaccauacaguaaaaucucugaaucaucaguggacaguugguugguccaggauaucucacuaacuggcaguugugcuguguguuuacugucuauuaggacacaugugacaaauauucagcuagggaguggugugggguauuccuuuagauuggucaguguuauuuauacaaagucauuuuagauuuuauagauaguacuccuagacccagagcugaauaugugcacaauucuuuagucuuccuuuagcuaaguuggccuuuagaaucuggguuguguuggcaucugaauuaaaccacagcccuucccacagggacguaguacaggccugacuccuacucacccaucuuucccccuccacaggcuuagaccagaaguguugcuguuuaccagcuggcuggugacugccuuugaaucguguccuggcuuucuuaggcuacucaccagcuuccuugucucugguuguuaaggcaagugcuccauacucuggcucugaagaaacagaauugaaagcguuucagauuuuuuuuuuaagucuucaaagcugccagcagcagccugggauuuucuccacuuggguccaaaaccucagcagugcccuaggagguuucucucuuuggggcccgaggcuagcucagaccugauauugagaagcaagaguagcuagagaggcagggcagcuuuugggacucauauuccugccauaacccaguucuugcuguuaguuucaggcaaggucauggaaauuugcaaguguuccagucuccauucacagggacucucagauggcauagcagcccagcugaugagcaccagccucuugggcucacacaagucaguugaauccuauacauccuucacggguugcucuucuaccaucuggaagcuauuagcagugaagugguuucaagcucuugcugaguccugguuuuccgggaggcuuaauccaggauugccaggucuaagcaaccaagggccuucaucuuggaggauuuccauuugagaccuagcauaguucuguccucccagaccaccaccuaggccucuucucuuguugaaccccaggagcaaugacacugacacuuuucccugauccgugacuuaucuccuuuauggguuugaugggaaaugaccacuuuaaagcuccucggggaaggggguacauuuauaucugugcuguagguauuagaaggccaggaauuagcucaggagaguuguguaaaggggacaggacugcugcuuuuagaucucuaaauucauuucagugaccauauuaccacauugcucugccuuugcugaguuucuuccccugguccuuaugauaaauaauccugcagauguaggcacugugguuuagaggcccaagcaacuacuaaaggagauucuggguucuaacugaggucuuuguaauuccaaaguucuuucuguuucuccuaugucccugcugaaaccugggaagaguagacaaccagaacagaggagcagccaaggaaccagcauuugcaugcuagauuuuuuuuuucaaaugaagcaaaaugaucguuugaaaggaaacucauacagucugucagcuucuugccaacuuuuacuacagugcaacuggccaaaaccagccaagccuuguuuggcguaugaaagcagcuguuaaaauaaaccucgcucugcuucuuuccuguuaugauggaaugacuguuucaaguaaacgucuccaauccacagauuuucuggggucaagaaaacauuuuuuuuaauuggcagucuugauuacauuuuuuggacaaguuaggaaguaaacagaauggcaccuaucauuucagauucaagcaggucuguaagucagugccggauccguucuggccacuucaauccccaccucccacuuuguuguuauaccccaggacuuccaaaauagaguuuagagaaugagcacacaaaucaugggaucagaucauggguuggaaucuagaaaccuuaaauguggcucucaaauaauuuacucugggccucagucuccuaaucuaucagaugguuguaauaauaacuacccauuggacuuaucacaaaguuuaaaacaaaaucaaaaugaaaaaauauuauaagcuggaaagauggaucaguaguugagagagcguguugcucuucuagaggacaacauuguuucccagaaccauuucaggcugaucacaacugccugugucuucagcuccacagaaucugacgcccucuucugguuuacacacacacaaauauauaaauaaauaaaugaaaaggacacaucccauggcacuuaguguguacucugugggucuuugagggggaaguauauaaacucauuuaaucuccucaauagcccugugagaugggaacuuccuaaccacaaacuaaccucucucuagguguacaugagugagcacaaaccaggaaucucugcugcacagaccuucugcugucacagagaguaacagaaaaaauagccaguguauuagguggaggaaagagcuauggagaaaacuaacaugggagaggaagauggaaaacaggcaauagggugacugccuucaaaagaguaaccaaggaaugccuaucugagaagauguuaucagaauaaaaaccugaauaaaaaaaaaagcuguggugggaacuguguauaguuccuauauagaaaauguauaggaacuaaaggagccuauaguugcaacugucccacgguuaguggccugguguauucaagaugcagcaaggaagcuacaugguuggaauggaagggucgagcaguuugaagccuucuggaccucaaccuuuucucucuaagaugagaaaguccugaaaagagggauacaauccagaugaugccaggugugagaaggaacacuauacauuuggucacuacaguggcugguccugcuguugguucccacaggauggcugccaacuuuuugagaccauuuaaguaggacauuucuuaagggaccaucucggcauccacuagcgaauuguacuuucugauuuucacaacaaauggacuucccccaauuuccccuaugucugcaucuaggcuucuccuuuucuuuggccugcucuguccuuggcugcagccccaggauggaugguuucucuagugcuucuuaacuggcauuguggguaaugugguguacacuugccaugcuaagguacuacuguuuugaacuaguuauuaguacugaggagucacagauauauauauuauuugggccuagcaacuaaaagaaagaaagggggagaaggagaugcuuguaaaugggauuacccuugacuguccgugucaagagugucugugcgccagcaaaccuccuaggacccauaaauacugaugaaaaguaauuuggauaucccggcaacucccgugagaaauagguucugacccuugagucuugggugucuuuugguaccuaguaucuccugaaguagaguguaaauguauaucuguggggauuuuucugggaugagggucuaacucccacaugauuaguguucuggauaacuagucacagucaggccauacuugcaaggucagauaugcuagcaaguuagccucuguucaaagcuagggaaaucugccaguuugaaaaugggaacuuaggggcuggugagauggcucaacaguuaagagcacuagcuauucuucuagagaaccugaguucaagucccaccacucccauggcagcucaugacugguuuguagcuccgaucuaggggaucuggcaccuugacagacauacaugcagacaaaacagcaauacacauaaaauaaaaaguaaauaauguuuaaaaagaaauaaaauggaguucaaagagauccuuggguugccuaacauagauaacguuaucuccuaaaaguuaugugauguauguuuuaagauaccaauguguauaguguugugcaaggucugguuagccucuuugaucaauggcuauaaaucacuaaaaguccacccucucuaugaggcucuucauugccuuuaaaacacacacacacacacauacacacacacaccaguuccugugguucacacaacacacaugagccaagugguuucagacagcaacguaggccuuaaguauuugguuauccccaauccuucagguccucaucuaaccucauguauugggcccaaaugcagacaugcuaaaaauauuguaugagauaaguauauaaaugaauuuuguuuuagacuuggguccuggcccuaagauaucucauuauuugcugauauuucaaaaucugaaaagaaaauuugaaguacuacuaguuucaagcauuucagauaagggguaaccaaccuuuaucugauuguuggcauuuccugguacuggacacagaauuaacccagugugccugccagucaccuacagauaugcuauggagcacaagaggcaggauucuauggggcugcuacacaccuugugcucuggauaggggucacaauaacucauucuacugagauucagauaagccuccaagggacuucuuagcuggaacuuacagacaccaacagaaggauuugcuaagaaugacugaugccgugcccuggaaugcaaaccacccacaguuacagugcauaaugauaugccauaaaggacacacagugggccuuaauaugagguuccccauuaaagaacugguagaaacccaucaucaguguggccaggagcuaacucuguucccauccagucagguuccuaguuagugcccacacuauucuguagaugucuucucuucgcaucagggacagaaacaaagauugggaagacacagcaugucccugacacugagaauuugucacugagcauggaugaagaguaugcaaaucagaaauauuaaauacaaccugcauuugauaaguaaugugggcuugaauaacuaggaugacauagcaaugcaaaugcacagaaauuucuuauuuuucaucaaaauggaaauuuaaaaugagagaaaauauaaguguucucccaacagacaaucugcacuccuauguggcuuuggucucuggagaguugcugugaagguuccucucaaauuuauggggcagcaugacauugcagugucccaauacuaauuaucuccauggcagaaaauucuaggcaugucaccaaaugcucuguuuuggaugaauuguauuauccaaugucauuaaauaccauccuuucaagagcacucuccaacauguugccugcgcuugaccaauuuagaagguuuagaugauucacucucagcuuuggcuaagugaauucuggacugugaugauugacuuaauagaagcaaaugcaguuaaaguuguuauacauuacaguauacugcaauaguaauuaagggcaucagggcuugggguauggcuuaugguugaauguuugccuaacguaucuaaagcccugguggggguugggaggugagccccuucacugccaauaaguaaaugagugaaugaauuaauucauagcaucuauuugguuucuucauucauuauauuuucuggguguuuguuuguuuguuuguuuguuaaaggcagguggagggagggcaguugagauuguauacaacuugagacccuagcugaauauuguguccaaacccagcuccuguaaauagaaagacaaacagaagugcacuguguaagguuucuaauggguaguaccugggugagagacuaguaagaggagagcuauccuguucaccaaccagguguaauagauaacaaaaccuuaauguugagcuggggcuucaucucauuggugcagcacuuguccaacaugcacaaugcaaucguguucaauuuccagcagauguaugcacauccauguacacacacacacacacacacacacacacacacacacaccaaauaaauacaggaacaaccuuaguauagggauucuccaugggauacuaagucaauacucauuucuacaccugcccucuuugauuaacucugccuugcauguccaaggauuuuuacaugaugcugggcucauuucuuuccucuuuccucuaaaacaggcucagaaauaguaggcaucauuucuaggugacacugagcaaaacauaguucucugacuucuuaggauaaaaguuauuguuggaggcugggcagaugauuccguugguaaagcgcucacaacacaacaaugagggucugaguuccaauccuuagaacccaagugaaagguaugggacaugucuauacuaaaggggcaguagugagggagacagggugauuccugggccaugcuagccaagcaguguaaccaaagugauaagugccaacugagaaaucugucucaaaaacuaaaagagagguuccaggcaaugguggcacacucaggagacagaggcagccagaucucugugacuuugagggcagccugguauacagagugaguuuuaggaaagacagggcuacaccccuguugaaaaaaacaaaaauaaauaaauaaauaaauaaaauuugaaaaaauaauacaacaggcaguuaagaauacuugcugauccuuauagcuauacuacagagcaauugugauaaaaacugcaugguacugguacaguaacagacagguagaucaguggaauagaauugaagacccagaaaugaacccacacaccuauggucacuugaucuuugacaaaagagcuaaaaccauccaguggaaaaaagacagcauuuucaacaaaugaugcugguucaacuggcaguuagcauguagaagaaugugaauugauccauucuuaacuccuuguacaaagcucaagucuaaguggaucaaggaacuccacauaaaaccagagacauugaaacuuauagaggagaaaguggagaacaggcuugaagauagggcccagggggaaaauuccugaacagaacaguaaugacgugugcuguaagaucaagaauugacaaacggaacgucauaaaauugcaaagcuucuauaaggcaaaggacacuguuaauaggacaaaaaggccaccaucagauugggaaaagaucuuuaccaguccuaaauccgauaggggacuaauauccaauauauauaaagaacucaagaaguuggacuccagaaaaccaaauaacccuauuugaaaaaugggcuacaaagcuaaacaaagaauucucaccugaggaauaccgaauggcugagaagcacaugaaaaaauguucaacauccuuagucaucagggaaaugcaaaucagaacaacucugacauucuaccucacaccagucagaauggcuaagaucaaaaauucaggugacaggcgugguggcacaugccuuuaaucccagcacucaggaggcggagacagguggauuucugaguucgaggccagccuggucuagaaagugaguuccaggacagccagggcuauacagagaaacccugucucaacccuccccuccccccaaaaaaauucaggugacaacagaugcuagcgaggauguggagaaagaggaacacuccuccauugcuggugggauugcaagcuuguacaaccacucuggaaaucagucuggugguuccucagaaaauuggacauagaacuaccagaagaagauccagcaauaccacuccugggaauauacccagaagauguuccaauuuguaauaaggacacaugcuccacuguguucauaguagccuuauuuauaauagccagaagcuggaaagaauccagaugucccucaacagaggaauggauacagaaaaugugguacauuuacacaauggaguacuauucagcaauuaaaaacaaugaauuuaugaaauucuugggcaaauggaugggucuguaggauagcauccugagugagguaacccaaucacaaaagaucacacaucauaugcacuaacugauaaguggauauuagcccagaagcucagaauaccuaaaauacaauuugcaaaacacaugaaacucaagaagaaggaagaccaagguguggauacuucgauccuucuuagaagggggaacaaaauacccauguaaggagaguuacagagacaaaguuuggagcugagauggaaggaaggaccaugcagagacuggggaucaucccauaaacaacccccaccuggggauccaucccauaaacaaccaccaaauacagacacuugcagaugccaacaagauuuugcuaaaaggacccugauauaacugucuccugugaggcuaugccagugccuggcaaauacaaaaguggaugcucacagucaucuauugguuggagcacaggguccccaaugaaggaacuagaaaaaguacccagggagcugaaggggucugcagcccuauagcuaugaggaacaucaauaugaacuaaccaguauccccagagcucccugggacuaaacuaccaaucaaagaaagcacaugcugggacuugugucucuagcugcauauguaacagaggauggccuagucggucaucaaugggaggagaggcccuuaguccugugaagguucuaugcuccaguauagggcaaugccagggccaggaagcgggagaggguggguuggaaagcaggaggagcggggagggaauagaggauuuuuggaaaggaaacuaggaaaggggauagcauuugaaauguaaaugaagaaaauaucuaauauguauguauguauguauguauguauguguguguguguguauauauacacacacacacacauacacacacacauauauauuaaaaaaaaaaaaaagaauacuuguuaaaccuggaacugaguucccauguuaguuggcuuaugccuguaacugucucaaucaaacauauccagcacucucuucuggacucuguggcacaaauaggcacauacauaaauaaacauuuuaaagucuuaaaagugaagaauggcagggaaauacacaacaaugaccucuggccucugcaugucuacacacaggcauaugcaccuacacccucaugcaaaaaguggaagggagggagggagggagggagggaggguggugaaaaggaaaaggaaaaggaaaaggaaaaggaaaaggaaggaagguugccagcagcugguggaaaucuuccaguguuucugugauccuguuucccuuucuugcugucaaagcucuccuuuccuccaacugggucuagauaaucacaacacugcucuuuuccaaaagaaaaaccauuucagucucugcucuguaaccccuuucauccugcucuggaccccuauagcaaaagaagcccugcccacacaaaggggccccuagagcccuggcuuucccagcagugccuggauaaacacuucucuuacacacuuugugcccagcuaugcuguguuccugggaaguaagcaaaaguggaaggaaguuuuccaccaagcucaacagccacaaaguucaaauuguguacauuacuccugcagauaaaacacaggaaauguguguucacacagucacucagguccaguggaucauagaaaauuagugcuuggauuuuauaagcccugucauaacaacaguggugcgugggguuuucccuucaacuuuaauguauaaucuuuauuaggugucauuuauuggcugcuguuuucucccccggugcuguuggaggugauagacugcagcaguaggacagccagcaguugcauuucuaugcugcuugucuugaccagccuugccacuugaacacaccugccuucugacaggaaagaacauugcauaguagcaagagcugcaaagucugggcuuccuuuuagcccucacuuaggaauggaaguguugggagucacugaucccuucucuuucaguuccucuucaggacugggcacaguguguuggagcaagagguugaaaugugcugucuuuauguuuguaaagaggacaccacuggcccaacuuaaaucaguaggacuuaaguuugagucacuuuuccaacuguagaguugggcagcugggcauccccagacaggagacacuccagcuaagucacauuucaguccuauccauggucugucaacccaugccuagccagggaaucccucagagcaaguacuucuuuagagagacagagacagaaaaacagagacggacacagagagaguguuugugccccccccccucugcgugugugcgugugugcaugugugcgugugugugugugugugugugugugugugugugugugugugugugagagagagagagagagagagagagagugucugugugugugugucugucugucugucugucuaucuguguacauacauacauacaugugguucucuauguugguucucgggaucaagcccaggaccacuuugccagcugagcugccucaccagccccauugcagggauucucuaccccagcucggcugcaccagucugaguagugugcuggcaaaugcuuagccagcucucuaaaaaguaaaauuccgcugcaacuuguauguucauuuacaagguucaguguggccaaugucaagauauguauguaaaguuugggaccauggaucuguacaaauagacaaacaguagguuuucaccagucaaguggcacguagcuccagccauacugcugaaaaaucuaugggaaacuauacauuugauuugugcaucuaucuaaaggaagucacauauguauauacaaaaguguguuuuuaguuauuucacuuuucaacacauuucuaaauguuaacuguauuaagaaggaacucuuuuuuaauuuuuuauuagauauuuucuucauuuacauuucaaauguuaucccaaaaguccccuauacccuccccccacccugcuccccuaccuacucacucccacuucuuggcccuggcguuccccuguacugaggcauauaaaguuugcuagaccaaggggccucucuucacaaugcuggcugacuaagccaucuucugcuacauaugcagcuagagacacgagcucuggggguacugauuaguucauaauguuguuccaccuauaggguugcagaccccuucagcucuuggguacuuucucuagcuccuccauugggggcccuguguuccauucuauagaugacugugagcauccacuucuguaauugccaggcacuggcaaagccucacaggagacagcuauaacgggguccuuucagcaaaaucuugcuggcauauacaauagugucugcauuugguggcugauuaugggauggacccccggguagggcagucucuggaugguccuuccuuuugucguagcuccaaacuuugucucugcaacucaggaaggaacucuuugguguggaaaauuuaauaagucaagauguuccacuuuacuugucauuugguuauaauuggcuaugugccuucuaauguuucuguugaguggcuuuuuguuuaauuuccaguuucauucuuuugucuugaaaaucauaguuguuggggcugguagaauggcucagcagauaagagcacugacugcucuucuaaagguucugaguucaaaucccagcaaccacaugguggcucacaaccaccuguaaugagaucugacacccucuucugauacgucugaagacagcuacaguguacuaauuuauaauaauaaauaaaucguugggccagagcgagcaggguugccuggagcgagcagagguccuaaguucaauucccaacaaccacaugaagacucacaaccaucuguauagcuacacuguguacucauauacauaaaauaaauaaauuaacuaaaaaaaaaagacaagaaaagaaaaucauaauugucuuucccaaaaugcuucuuccccccucugcccuuuguucagcuuuaauaacaaauaugugccugaugaacuggauggccauccucagggaagccaagcuguacuuucccuguuguuaguuagccaaccuucccucacuuggaucauuuuaaguuggcugacuuguuucccauuaagguucugaacuaaaguauauccagugcaagcuagaauggacaccagcuguagagucugucacugucugggcuucuuucgucccaauucuaaguguccuuccucuuguaaaaagaaaagaaaauguucauagaggaaugaaaaaugucugccaggcuuguuauuuucauucauauugaagccuccuccccuuucaucaaaauacgaguuuuccugaucugugaagaaacaaauguggggcuggagaaauggcucaguggggaagagcacuugcugugcaaguagacaggcaugaaugugagccugcacccauaaccccagcacuauggggugaagacagguggguuacagcagcucacuggacagcugaaacugugaccucaagggucaguguggcacccugucuuaaaggaguagggggaguugaaauaagaaagauauugaaugucuuccugugacuuccaagugcacacaccugagagagagagagagagagagagagagagagagagagagagagagagagagagagcaguuuccaccaucaacggcagagaaccugucauuaacuaagguuaauccuguucaguugugcccugucaucauucucugaguccuucagcugccucaaagugacacuugguaaggcagcaacacuagaggcaagcagggaaccgugggcuuucaugucacccucugacuuguuccuuugagcuugaugaaugcugaauguggagaacuaaguugcgguggaaaguugccauugacacugucugggaaaggcguguuucccauuccuuccccagccccaccaccacuccuaccuguaccugagagccagcuucugguggagcagcccagcugagccagggacuagugcacacucuggagcugacuguugacauccaugcaccugucccaggaugccuacacccuggccuccgggaccaggggauccuucugucacuccuuaccugcuaggacaggcacaaagguagauaggagacuuugaaaucucugcaccugagaacuguuuccagucaaugugaaggagaugggcaggaaaccaucuuucuuuccuuaguacccugacuguuguaagggggagaauuuauuugacaguguacuccagcuagguuuuugguuuuugguuuuuugguuuucaggagauuaagaagcuagacacaauuaaucuucuaaucaccauuaguaacccccagcccuuuaccuuuuugcugugugugcuuaguuccugcaagcuugaaccacuagcauuuguucaggacuuuggaggcugguguuuucgagucuuaucuccguguacucaguuuuagaaagaaaaccuucuagaggugacugacuugaucugguuuccaggcuaagcuucuggaggccucuacaugccucauaguuugccuugaaauuacagaguuaccuuuucaccccacuguacccuuuucacaaaauacugccuuccuugagggagggcaacaugcuuauccuacaggaggggucaacaagccuucuugaccauagaccuucauagcugauccugaaauuucauggaacaaugaauauuuauuuaugauagaauugucuugcuuacugcucagguaugucaacauagcaagagagaauuacagccugcagaagccccugggaucugugguaguuaauuagggauaaguuuuauuuuucauaucugaaaaagcuucucucucaacacacgaaauguucugugcugcuuuauccugacaggaugcauguuguccacauuuaacccaccagcuccugugauuuagcuaguuaggccugugauuuagcuaguuaguccugugauuuagcuaguuaguccugugauuuagcuaguuaguccugugauuuagcuaguuaggcuuuuuuaaaauuauuuuucuagaaguaagcaaguuugaagaaugugugacagagcuauucccaagucccagcucugugacaugguuuggaaaacucuacuuguuugaccguccacuuuucuaaaaucuguaaacugagggugggauuaacccugcucucugggguuauuagaggaauugcaagcagcaaggagggagaguuuggcccauauuggguccccagaaauagcaaucauucuuagcaauuccuguuuguguuugcaagaaaaugucugucagccucucuccaaguacaugcaugguguguaucugucuuaauuguguggcaggcucuuguggcucaagcuggagccugaucaucagagcucuuuccaugcaaagauucagagcuuaaucacagaaggacacugcauaguagugccaaauaaugaagcugucaggacugcuggaauccaucguccauucacucugugcugaagaaugaaacagccaggaaugcagccaggagugaggggaccagcuaggagaggguauggaagagaugaccucugcagccagaaaaaucuucugcucagaauugaaagcauuuguggacagcccaucugauaaagaauucuuauuauauaaaaaccacaaagagaaaauaaugguguuguuuugagacacuguacauucuggcagauacucuauauucugagugggacuauuacaucugauuuugccuauagcaguucuuuguaaaaaaaaaaagaaagaaagaaagaaagaaagaaagaaagaaagaaagaaagaaagaaagaaagaaagaaagaaaaagaaaauaaaggcaggauauaaauuauaaaucuuaaacaaauaauacuuacucuuuaaaaaaauuaaagccaaaccagagccacugcucuucuuuuuauguauaugaaaaauaaagaaauaaacuauacuauugguaaacacguagacgacuaccaaaaacugauaauaaauauggaaagauuuacucauaaagcugucuuauagcuaaucauuuucucugguuuggguauacuuucaugaauagcauugcugagagaagugcugcuuguuuguacagaaagugacuucauugucacuucuugucgugagucuauuuuugugauuccucaugucacagagaaacuuggcauaguaagguguccagcacuaagauuuacauuuaggaaacaaaaucacuuacuaauaaaaaauccacuaacaaaguucauauugugucacauacuaaaugaccuguguaaugaggacaagcuaacuguuugugggaugaaaggcucaggcauguaaucuuuugugauuucauaacaguugaguagcuagccaggauguuaacucuuguuuuguugcuguagaggacaauuauaauuaugcauagauauuuauugacuuaucaguuuucacuauuagaaccaagucauucuccuaggcuuaugggaauauaugccaccaggcaauagauuaguaacuauggaaaagacacaugaaaaguucaauucaaagggauuuuuuagaggggaaauuaggaauggggauagcauuugaaauguacauaaagaagauaucuaauaaaaaaaauaagaagaaauaaaaaaagaaaaaagugaaaaaaaaaagaaucuguauuccaacacacacacacacacacacacaaaauaaauaaauaaauaaauaaauaaauaaauaaauaaauaaauacaaaaaccuguggucuuugggauuuugcaaucuaccaacuuugugaugcuucuuuuuggccacauggucuugacaaugauaccacccaacaaaagacacuugagguaauuaaaaugaccuagauugcuccacggugcucacagugcaaccucuaccucugaagaagagccucaaucagaguggauccugcuuaaugaacaaguucaucuuuggugauacacguagaaggcaaacacaauagauaagagaauacuuuuucuuuucuuuuuucuuucuuuuuuuuuuuuuuuuuuuuggacuucucaaaaaauuuggaaaaacacacugggcuggagccugaaccacaacacuugggagggcucuuuauggagaaccacagccaaaaggaauucucuuuacuggugaauuccucuggcccucuguacuggcauucuugagguaugucaguuauuccugcaaccagcuaaccacccccugguugguugccccaccccaucccauucuuccuugaaacuuguuauuggaaacaggacaacagagagaacuuuuaaguauagacacuggagaccaaauugucagguuuuccuucagugagcuguucaagcucacuaggcugacagacugauucaggcuucauggggcccccaaagguuuuugaauaauaaagauuugagcacuguaaaaugcauuggaaccaugagccaaaauaaaauggacugaaguggagguagcuccagaggauagccagugggaaaacauggacccuaaaggcccuuucugccuguagccagcugcauugcaaauguguuguuuggggcaggcuuuucaagaagcuagaccccuuggugguaagggguaauguugcuccacuuugaacugaaaucuaugaugcacagcauucugcagauugguccugcugcucuuccuccaccuccccggcccccaugggaacaaagucccuagucucuggaaaguaaugcuaaguaaacaaacacuacaaaggcugguaacagggggauaucucucucaaauguuuggcuuuuugugacuaucuagguucaaggaagaagaggucccccagcaccaggaaccugcggggccuuuguaguaggcauccauauguuuagccagaugucguccugggagagggcagagaaggaaagauaaaacaaaguucuuauuaaaaaauaagucuccugagggagaaaaaaacaagccagagaaagugugucaaauggaaagggaggccaggcaguuccaucugauauugguuaaugcugauagucagcagugagaaaugcacacugccaggaaguaccccuguucuuuggaauguaggccuguggcaugcugucugggagcagaucuuugugcaucccacauguaaagacgccuaauggcaacccagugcuaucacacagaggacaagaaggacagauguuugugauacagucaggacacuuguguuuuaaucucgauucaccuuccugggccucauuuucccaucaguagcacagugacacuugacuagaccucuguacuacacuguuguuuaucauaaucucuccaaccaaaucuuccaagagccuucuuguaaaagguaagaagucacccugaagccucaaaacccuagaaaaugacacccuccaaagccucagcaucaucuaaucuuucugcagaaaauugguccaacaucugcgugucuauuuuccuaucuugcauuugccaccaaaaccaauguguucuuucucaacauggaaugugucauguuugcagguauacuuaaaauucuuucucucuaagcuuuauagugcuuucacauccucugaaucuaagaggcuuuauuuuaauuaauuuuuauguuuuauuuaugaguaugugcaugcucgugcuugugcacaugugcaaaaugguagucagaggacaaccugugggagucacaauuggaucucuccuaccaugugacaacugggaagcaaagucaggaaccaugugcaguuggcuuuaccuacuaagccaucgcaauaacccaaauuuaucuuaagccacuggauuacagacacuuugagcuggaaguuuauagguguuuguguucauuugcuuguucaucuuuuaauuaagcgugaagcauuaaaaguuguuuuugucuuuuccuucuuggcaaaggucaugaggacagugauauuuuuagcagagggugaggcuagguuauagugggaauggaaaagaaagucuccauugcggguaaagaucucacacuaagacaguggcagugggaagagaaaggaugagcagagggugcagagauggaggcuugucgaagcugacucacgucagaacccuggcugugcuauguguaagauggcaucuaagcucucucugcuagaccucuuugcaccuuguuccuuggauuccaaauguuccccauaaaggacucacuucagaacuugguacugaguuauuggaauccaccgaacaccaggaaagcaguugguaaugauggugaugaaaauccucuauuggaagaucaguggguacuugucaacugaagaauaaguugaagacacacauucaagauauuuuuuaguuuaacuaccugugcagguuggauaauaguacauauuuggguggaaguuggagauguguuuugcagauguagucaccagggcagcaaaggacaagagacagcacugagacucagaaauggguauuaaagaaguaagguagcaaaggacaagagacagcacugagacucagaaauggguauuaaagaaguaagguagcaaaggacaagagacagcacugagacucagaaauggguauuaaagaaguaaggcagcaaaggacaagagacagcacugagacucagaaauggguauuaaagaaguaagguagcaaaggacaagagacagcacugagacucagaaauggguauuaaagaaguaaggcagcaaaggacaagagacagcacugagacucagaaauggguauuaaagaaguaagguagaaacuggggagguggcucugugaaugagaguggcuguucugcagggaugaggacucaaguuugaagcccuagcacccauguaaaaagcuagacaugguuguauguaccugaaagcccagcauggggauagagccaggcagagccuuaaugcuuacuagccagccagcuugacuaaauggugaguuuugguuuaccgaaagacccugucucuaggcaauaccauuucccacccaaggguaaauuaugaaaaaaaaaaacugauuuauuguacauguguuugaugaaggaauugauuuuuuuccuuuucuuuuaaauuggguauuuucuuuauuuacauuucaaauguuauccccuuuccuuguaggaauugauuuuacagcuucaucuaaaagccaccaacaaauugguagcuuauggucauguucagcuucugacugaaacuccccaucccuuagauugugguccucaggugauaucaccuguaccuugcuaaauguggcuccucucucagcuuuauuggauuggaaucugcauuuuaaaaguauaauaugggaaggccuuucaauuuugagaaacugaucuccugggguguuagacauucacacucucaaaugccuuucucagacccccuuagccagagagucugugauaaugaacccuucaagugauucuggugcccaccaaagcuugagaaugcugcauaagacaugaaaacgacagauugggcucccucccgccuguggcacagaacacuagagggguggcugaacccugagagccaagcuucagcuguuguuaccacauugugcuuauccucauuuugcaguaaacacagcugaagagcucuucacuggagaaagacauaaaacaacaaacgaaaagagaagcuuucacgacagcuucauggcugccaucagaaguugugaauguagucuuauaucaguacuguauguucuguccccccugugagaugcuaggaguacaacaggcaaagaggcagcuuaggcaaaugaggacugucccaccaugauaacacgaccuccaugcaauaugagcuucacauuaaaacucccgaagucuuugucuucuacuuuucuaaucagucagauggaaaguuagcucuuccuggguuaguuucuagagucucuugcagccugagugcugcuuuuuccauguaaacugggcucuuuuuuuuuucagaguuaaacuauacacaauuaaaauguaccucauuucauuaaaauuauuuaugaaauuuuguuuucauaaaaauuuuuccauuuuuuuuccuguaguggcuacucagaauccugugauaacucaacuaauauuuacugccuguuuuguauaccugugauacagaaaauacuuuuauauugaacauuugaugauaaaaccaugggguuuuuuucuauauauucuaguauauuacaaucaauagcaugugaauaaaacaaagguuuuuguagggagugguaaaagggacuacuuuguagaaugcucauuucuaggguguaaauacuccuuuuuggucugauauuauauuauguuacuaucagcuuuaacagccaagaguuagauuuaaccuuuaaaaauaaagagaacaauuuaacacacuuccacaauaagcauuaaguccagagucuaguuuuuaacuguuguuugaaauaauguagaaacaagaaaaucugguuguuuuaaguauuuuuguacaauagaaguguuuauuaacaaauuaucacuguaagaccagcuaaguggcucagcagguaaaggcacucacugccuagccugguuaccugagugugguccccaggacccacaaugcaaauaggcagaaccaucuucuacaagcuauuggcuacagaccuccauacacacaaaguagcagaagagggagaggaaggacuguaggauccagaaaggucaaggauaccaguacaggggaacgccagggccaagaagcgggaguggguggguaggggagcagggcggagggaggguauaggggacuuucgggauagcauuugaaauguauauaaagaaaauaucuaguaauaaaaggaaggaaggaaggaaggaaggaaggaaggaaggaaggaaggaaggaagcaagaaagcaagaaagcaagaaagcaagaaagcaagaaagcaagaaagaaagaaagaaagaaagaaagaaagaaagaaagaaagaaagaaagaaagaaagaaagaaaaccacaaaaaaauaaaaauaaaaagaauacaacccacagaaucaacucagcagggcuccuaggagcucacagagacuggaggaacaaucacggagccugugugggucugcauuaggucuucugcauacaugcugucacuguuuaguguagggugucugugggacugcuaacaguaggagugggagcgucucugacucuugccugcucuugggacccuuuuccuccuacuagguggccucauccagccuugauaugaggauuuguaccuaguuuuauaucuuguuauaccauguuugguugauaucccuaggaaggcugcucuuuucugaagggaaauuaaggagcagagaagaggggagguggguagcgugaacugggagaguagagagaggggaaccuguguucaggauguucuguaugaaagaagaauaaguaaaaagaaaaaaaaaugcuugauuaucauaguagacuguuauuuggaguuguaacuaugacaacaugauauaauauugauagacugaauugcugcaauggugauuuuaauuucagaauauuuucaugguauaggaaggcauaugguaaaacucuuguuacuaaugguaucuaaauccaaaucauugucaugguuaguauuaauuuucaaccuggggucauccaggagacaagcuuucaggaacaccuuguaugcaaucacuuaaccccuaggccugccggugagagacugggcugaugggguucauuggaaugggaagacccauccccaaggcaaaugaugguugccuaggcagggauccuggaauguguaaaugggagagaaugagcugaguaugagcuuucguugcuaucugcaucugaccuggaugcagugggaccagcugccucugggauuccaguaccaugauggaggugccuugaucugcaagccaaacuuuucuuccuuaucucucuuuuuugucaggguauguucuaacacuaucaagaaaaauaguugagauaugcguuagcaaagauacuguuugauaugguguuuuuacuuaauaguauuaaauucuaccucuucuugcagguauucaggaggggacacaguguaccaaauguaaaaauaacugggcacugaaguuuucgauuguauuauuauacauucugugugccuuacugaccaucacaguagccauuuugggauauaaagguaagcaaucuuucuuuuuucacuccaaauagcaagaggcugugaaauuuaaacacagaaacguuaucuuuggaaguaugcuguacaguugacccugguaucuauagagaauuaguguugagucucuuggucgucccuccaaggaucucggaauguuuggaugcuaucauuucuuagugcagggcuugcacauguaaccuguauacauccucccacauguuucaugucacuucuagauuauuuaaaauacccaauauaagaaaaugcuauguagacaguuguuauacuacauuauuuagaaaauaaugccaaaaauaaugguguauguucaauauauauacauuuaugauauuguuuuuuguuguuuuguuuuuaauguacuguuauauuuuugugucucuuuucugucuguuucuuuguuuuauuauuaguauucacuuuacauuccaaucacugucccccucccaguuccccucccccauccccucuuuccuucuucucugagagaguggagguccccuuggguauccccccaccauggcacaucaggugucugcagggcuaggcacuucuucuguuuaugauauucugguggaaaauucacgaaccucaugaacuccauuuuuguguucugagaucuuagccauggaugggacaguuuugauucacuucauaaucaugacagcccuuuauguguucaaaagauuuuccccucuuuguugcuuuaucucacuuuuucccagccauucccucaugcucuauuugguuuucaucuuaucugucucuaauagguucugaggaaacccucaguugucacugacggaagcgcuccugacagaggagaguacucaggcucuccagggacauggcucacccacccagggauuaacacuucugcuuuuuucuacagcauguucuguugccauaguuuguaaacaucuauaaaaacacugcccuauagagauugaacuuaacaggcagcagcaccacuuccaucugcuuaacaaaaggucaggccucccaugucugauuaaaguagaggugauuuuccucccaaguuuccagacuugcugccuucucagucuaccuccccaccauauuggaauagcucuaccauauccaugugcuggaucacuggccuguggacccuaaauggcuucuccuuacuucucaugucucacuagaaaccccugagaaaaaccuccuauuuguuccccuggugagcuucuucacuuuagguccuguuaagccauaucaucauggcuagugugucugucuuguuuggcuuaacacccaaacuacaggcuuuuacaaaaacugccuuuuauuuaugaaaucuccaacucguaccuacaagucagaguuuacuuauuagguauccgggaucagccacacgaguagauuaguagaugaagaccgaagcugguuucuaugaagacaaagaacuuaggcaccucugagacaaucuguauaggagauugcuguccuucaaagcacuacccagacaccuaacauucuggaggucagcuuggccugcugugugagugaaaccuuaccaggguaaagggagaaaagauuuggggagcagauggcaucuugauacccuuucucuccauuccucuggcuucugcugauuaaaaaaaaaggaggaagaggaagaggaagaggaggaggaggaagaggaagaggaggaugaagaagaagaagaaggagaaggagaaggagaaggagaaggagaagaagaaaaagaagcagcagcagcgauauauacuuguggucaccaacaccagcuuagugaacucaaaguugacauucuccagaugcgcuuucccuuuaugugcagagacuccuuuucuuacugauaaaacucuggugaccccaguguuguaggaggcagaaagauaagccccaagccucccuucacagacccucgcuuugaugacuggaaaaguucuucuccauuaaaugaaagaaaaauaugcaguaaaaguuauccaagaaggcaccucucugaagaggaugaaaggaaaccaagcucucuuaaccaggguuggcaaaggcuguuucugcaguuuuccucaaaaucguuuuugcuucuucuuucaugguaccuucauagcuauguguuaggaucuaaugaaguuucaucuugagaauuugccaagcaagcuggagggucacuuagucauucagauguggucuauacaaugagugugaccaugagccucggaaguuucaaaauauaguuuuggacaguugcaauuugauacauccuccacucuagacucauuagucagugagccuacaugaagagcaucgugucuuaaguucuucgguaagucacacuccucccagaauggucccuaaccaugaaaauucuauuccauuacccugcccagcaggcucuucuuaagaugcuuagaaugaagaaagacacaaaucucaaucagcauguuuccauugccuccuguuccugaccauugucugucugacaccucacugcuuuacuggcauagugaggacaagagggaggcacagacacaucaaagcauggcaugagaacuugggauaauguucugucucaguaaugaauccugagauaguguuaaugguagaaaugucuuggaugaguuccaagguuguauaacugcugauaguagaauuccuaggaacuguugaaagagagcaugucucucccugcaccuugauuugucaguacggcacaagcauuuugaagcaguacaugagagcucugugcucugaucuuguuccuggacucaaggaggagccauggucugucucucuuucuuuaauacuuagcaccaugccagaugcauaauaaacaucuguugaugauaacuuuaaagaaaauagaccaaagccaugauugcuuacccuuuagggauucuccuuuauuaagggaaaucagauugaaaaaauaaauauucaagaaaaaucuguguagagucgaagaagauguggauuuuagagguucaucuccuacucugacgucucuuuuaugucugugugauucugaaauauucuuaacuaugucuaaaacucaguuuccucuucuuuaaaacaguaguaauaggagcuaacugcagugacgguccagcacagagccaaacuaggaauuucgcuuauuauuucauaucauaaaaccaaagaggcuguuguuauugucauuccaagauucaguugauguguuccagauucaagagagagacaaaauuuaauaccaugggguagaccauaagaaaugaguguaaacaaaacaggaggggguuaguguccaggccaaaggauaguagcaaaguguaaagguauucccaggcagcuguuagggaaguaugcagugagcaugugaagagagcgagucuucaggcacaccaacugaaaugccacugauguuuuccacaccagaaaacaguuuucaauugaggggccucaucgacagccagaauguugguaccccuucugugcugccucuuuguuuuuguuaucagaauaugaucuagaaacaggucuuuauagauuuaggauuucuaggaugagacaggagcugcagccauuaugcuccuaguugaaauuuugagcuggaaauugggggagaacugaggagaaugcuguguacuggcgcaguauuaguucuggauuccagucagccuggguuuuuaugcacuugcacauugccagcaucacagcccugcaguuuauggccagggugcuauuuuuaaacacagacauacacauguggggcugcuuuauuaacacuugugggcaggacacaucauuugcuuuccucauggaaagcaaaauuagcaguugcuuuguuguuguucuuguucuuguuguuccuccuccuccuccucuucuucuucuucuccuucuccuucuucuucuucuuuuucuucuuuuuaagugagaguauuauucccuuuauccuaaguacacuugaauuaucuguccacaccaguuauguguuuuuauaaacuaaaauggaagaaaaauuagagaggguggaaagcaacuaacugucagcauauuucagauuucuuuggcuuccaggaaagaggugggacuugaaauucugugugugguuugaggacagaaugaaacauauguuuuuaucugaaagucaaaacugaguuuaagcuuguaaacauuuuauuuuauuuagcuuuaguaaauguauaaaauguauuuugaucuacaaaauuuucaaggauucaggagcauguaugccuaucauacagccugaagguccaaguugaaaauggaccucuguguccauguaguauuuuuuuuuaagucaugaguauauauauggauguagguggauauguauacauguguguaguaucaauggagaccggaagagagcgucagaugccauggaucuggaguuagaaguaguugugagccacuuaauaugggugcugagaucugaauucuaguccucuacagcagaauucaguccaaaccacuguccugucucuccagcuccuguguggcaauuuuagaaacaauaguaauaauucaacaaaguguugucccaaguuaaugcugaagcucccugguuaguugacuuauauguugcccucuuuaaccucuagcucagcuagguuuccuaggccucagcaaauucucgcuuuuuaaaauaaacgguauaauaacuauauauuuaauaccauacaaugagcuaagagcuagagauacgucugcagauggucuucagcuuucccuauuugucaagucauaauaguaugaggcaggacacacucaauaaaaaccaugguuucaauuuuguuuuuguccccccugcuagugauguauauuaugcuccuccaugacuuaaaucaguuuucaaagagaaaaggacaaaccaaggaugaggacuguaggcugcgaagagcacauggaaaagcucauaaggaagagcagucaggguacuucguggaguucacugcagccagacugagcacuggauggaaaacagcaagagcuucuccagggucagcuccaggaucccaggagcaaguucauuuuugggucacauacaggcugcuuccugagaggagccaggagcaucuccccagauagccaugcauagauaaaacacaugauagguaguaaaaccugugucauugagcuugaaaguacuacacaaagcauucaugcuucuacaaauucuuuuuauaaaaucauuauucaaaagaaccuuuuugauaacaaagacacucauagccuggguguguugaccugugcacaugguucugcuaauacagccgagucaggaaguaacugcauuguuuacuugggauacuuucaauugaaaguagguuuaucaggcauaauuccaucauaaguuaaggaccucuaaauaaucuuaguaacaagccauaacagcgugguguguagguucuggaauaaggaacaggcuacuacuaucuuagggaauucugcaaggucacuuuuagcuggugaucagucugggcaacauagugagaugucaucucuaaaacaaauaaacguauacccccccccccacacacacacacaugagugcauaacagccaggccucugcugaaugccaagcugcuagaggauagguaucacggaagucacuucuagagaaauagccuauuagucacuuagaaacaaacaugaauuccugaccacagagaacaacucagaggugaagccuugcuuagcugcaucacuauccuguuauagaaucaagaauuuuuuuuaauguuuuaaaccauugaaucaucauuuagacaggggaauuaacaaguuauaauuuuaauugucauugauuaaugaaaauagauuuaggucuagggguagaacucauaauagcaaagagugacuuucagugccuucucagacaucccuguauauacauuugagccaaguuacucugcuggccuccaacucgcagagacaaccugucucugacuuccaagugcuggguuagaagaaugugccaccauacccagcuaagccaguuccuugccaguggaguacccaccuacaaggaaugaugaggagcugaaaggucuuagaacuuugugaaugaugacagaguugugugucuccacauggagaaaauaacagaggaguugauacaugacagagaacucgaacacgucagaaguuaauccaaauacuuucuaaagcuuccaugauacuacaaagucaaaaaaacaguuacagauaugugauuuuucugacaaguaaguuguaucacugggcuuuugaccaguuguuuugcuaaagaacagcuuccuccauauuugaucucagcuuuguauuucaaaucugcuuucuucuauaaugaaaucaucuugucuuggaacugagaaaccaacgugagcagauaaguaaacuaauguuuucuuuucccaaaucuuaguuguagagaaaauggacaaugucacagauggcauggagacaucucaccagacuuaugacaacaaacucacugcuguggaaagugaccugaagaaauuagguaaacugcagcaagagugaaccaucgaguggaggggagucccccuguaugaguggugacagauuuuuagaauggugaugcacuuagggucucuguuguugcgugcuacaaucuuuccuugucuuuucauuguaauacuuccauuuuuaaaaguaaggacucucaccuuaaauuuuuauguacuauauaaaaucugcuucccacucuugacugaacaggacaguaaguccugccucuagaaagcugagauuagccuauaaccugcagaguugacuuuuaauauaaaagaauguagccuguucuguuucuuuuuuuuaaugauuuauaaauuuuauuguaugugcauugugucuugccugcguguacgucuguggaagggguuggauccucuggaacuggaguuacagacaguugugagcugcuaugugggugcuggggauugaacccaaagccucuggaagagcagccagugcuccagccccugcauguuugguuucuugauguuuguuuuuaauuauuaaaagaauaagacagcucaaaugauguauaaagcuuuaugaguaugauucugcucuugaaaauugguaguaauuucuaccauucaaauaauuaaauauccauuaagccaaagaauuuugcauugcaaaaucuuuuaggauggacaucauuaguuuuaaucccaauauaguucaucauuuuuauugacaguaaaaaaaugaauuuugguaaauuuagaagguugauuucuuauaaguacauucugccugguauccuagcaucugggaaaucccccucugucuuugaaaaaaguguccacccaaguuuguaaguccuaugcugaacacuacagaccccauuuuaaauagauacagauucuuaguaauaaagccuagccugcauguaccacaaacuuuacaucuaaaauacuccuagugaaguauaugggaucuuuacuuaaaauuacauuuauuugguugguugguuaaagaggcauacacaugccacagcacgcauguagaggucagagaaaaaaaaugaguuguaagagucuguucucuuccucuacuauauagguugaggaauugaacucauguuguuagaucaguuagugggaaauuccuuuacccgcugagccaucucuauggcccauaucugggugucuggccuugccuaagcaucucuaccaccagucuaaguaacaagcaucucuucuuccaggggaucaagcugggaagaaagcucuaaguaccaacucugagcuuucuaccuucagaucagauauucuggaucuccgucaacaacuucaggagaucacagaaaaaaccagcaagaacaaagauacgcuggagaaguugcaagcaaauggggacucauugguugauaggcagagucagcugaaggaaacucugcagaauaauucuuuccucauuaccaccgucaacaaaacacuccaggcauauaauggcuaugucacaaaucugcaacaagauacuagugugcuccagggcaaucugcagagccaaauguauucucagagcgugguuaucaugaaccucaacaaccugaaccuaacccagguucagcagaggaaccuuaucucaaaucugcagcagucuguggaugacacaagccuggccauccagcgaauuaagaaugauuuccaaaaucugcagcagguuuuccuucaagccaagaaggacaccgauuggcuaaaggaaaaaguacagagcuugcagacauuggcugccaacaacucugcccuggccaaagccaacaaugacacccuagaggauaugaauagccagcucagcucauucacaggucagauggacaacauuaccacuaucucacaggccaacgagcagagccugaaagaccuucaggacuuacacaaggauacagaaaauagaacagcugucaaguucagccaacuugaggaacgcuuccaggucuuugagacagauauugugaacaucauuagcaacaucagcuacacagcccaucaccugaggacacugaccagcaaucugaaugauguuaggaccacaugcacagacaccuugaccagacacacggaugaccugaccuccuugaauaacacacuagucaacauccgcuuggauucuauuucucucaggaugcagcaagacaugaugaggucaaaguuagacacugaaguggccaacuuaucagugguuauggaagagaugaaacugguugacuccaagcacggucagcucaucaagaacuuuaccauucuacaagguaaguguaaauucuguauugggauuuguaucuauugcuuauauaacaaauuguucugaaauaugggaacuuaaaacaaauauguauuauauaauagguuuuauggguugggaacuuaaaacucaugugugugugugcaugugucucuguguaugugugugucuauaucuguguacaucuguguauaucuauguguguguguguaucugucuguauaugucuauguggguguuugugugugucugugugugcguccguguccguguccauguguguguguccgugugugucuguaugucugugugauugcaguuaagauguuagcuggugcgcccaacaucugaaggcuugacagguugggacauggauguaacacgacuuacucacauggcccucagcagggagcucaguucaucaccaggugaguuuccuuauuguugucacaacaggaaagcugccauagauccauagagagagaaagauggaaaccauuuguaagcucaccucaguaggcacacucuuagcacuacugaucauccauaaccccauugggaggcuugggaaggaggguucucaaguucaaagucagccugggcuacagagcaagacccuucucaaaggaaaaagaacaagcguucagaugcuuguaaucccagcaguaaagaggcaaagacaggaaagucaggaguucaaugugaguucccagauggaaccggagugacuagcauagaaaaugaguuuugcugucauccagggugucuguggcuuggauucaaaucuauuccuaacaauaaacuuccauccuagguuugaagguacaagaacaacuagcugcuaugcuccucuaucuggggcauacaaagauggcuaaauagauguucaacuuuuaguagcucaaccuaaaagauuuuaaagccuuaaagccucugaaguuggggaacaaguaaucaaucuugacuuucaaaaagggaauaaaagguagacuuuaccuacuauauucaguggaggauuagcuuucuuuggggggggggguauuuaaacaauuuuuauuauauauuuucuucauuuacaauucaaaugcuaucccuaaaguccccuauacccucccccugcccugcuccccaacccacccacuccugcuuccuggaccuggcauuccccuguacugggacauauaaaguuugcgagaccaagggccucucuuccaucuucuacuacauacauaugcagcuagagacacgagcucuagggguacugguuaguucauguuguuguuccuccuauagaguugcagaccccuucagcuccuuggguacucucucuagcuccuccauugagggccccgaguuccauccaauagaugacugugagcauccacuucuguauuugccaggcacuagcauagccucacaaaagacagcuauaucaagguccugucagcaaaaucuugcuggcauaugcaauaguaucugcauuugguggcugauuaugggauaaauuccuggguggggcagucucuacaugguccuuccuuccaucucagcuccaaacuuugucucuguaacuccuuacauggguauuuuguugcccauucuaaggagggauaaaguaucuacacuuuggucuuccuucuucuugaguuucauguguuuugcaaauuguaucuuggguauucuaaguuucuggguuaauauccacuuaucggugaguguauaucauguguguucuuuuaugacuggguuaccucacucaggaugauauccuacagauccauccauuugccuaagaauuucauaaguucauuguuuugaauagcuucguagaacuccauuguguaaauguaccacauuuucuguauccacuccucuguugagggacaucuggguucuuuccaguuucuggcuauuaaaaauaaggcugcuaugaacaugguggagcauguguccuuauuacaaguuggagcaucuucuggacauaugccccagagagguaucgcuggaggaggauuagcuuucgauccugaaaaaguuuaagaaggaauuagauaauuugugauccuuuaagaaaguuacuaucacaacaaguucacaaaaugggaagcaugugaccucaucuuauuuccuuacaccaaccaaguucuuagaguagucaaacuuggaaaauuaaaacaacaugucugcauuucaccaaggcauugggcauugagccuguuagaaaaaauaggaggacugcaacgaguugggugacugcauugaugguaauggguuguuuguuuguuuguuuguuuguuuugaauacauaccuacauaaaguaaaaccaguuucugccagucacaguccugauggaaugcaguugggucaucuguuugaggucuucccaugcugccaguuccccaaggaguuuugaauucaucagaaacuguucuggggaaauguauauuuccauguuucuauguugcuucagacucuuggcauaauucauugucuugaaccuaagggucaucaucugaguaauacccugagcucuuggggguuauucaauucuuggccaggcagccauaucacaauaucuccguuucuauaaagccaucaagaagccugucucugucuagucugcuaagguggaacaugaauggcaugaccuauuaagaaaauuacuuucuauccccuuugucauguacuguugguuagaaguaagucccagguuucagacuuaaaagaaagucacacaugcaucacuggaggucacuuuaaggggugucugucacauuaguugaaugaucaacuauaaagcaccuguggacaugaaguacauauucagguagcagauggaagaaucauuuucaacaguuuugucaguaacacaaaacauauaguaaguaaagaugauagaaucacccagaaccugagagccuagaaucguagccagauguuagccugauagaucagaucuguuaagaucuugcuuagugguagacaagacccagcagacccccauucuuuugggagagacaggaucuaacuauauaauucuggcaaaucucaaagucuaauccuaccucagccuuuguaugaagcucgccuaaauagcuauuuucaguugccuucagaacagcagucccaagcagauguuucaagguaaugagagguugagaaagcacucccauucuggagacaagugcuucauccuacauacgcucauccuacccuauucugcuuuccuuaacuaugaagaaucaggauagauugauguugguguuugugguuuuaugugagccuucugugagauucaaaacacuguaguauuauccaagaaagucuuguuauuaugcauuuaauaagaccaugugcugguagcuaccagaggcauacucaccaagauguauaccuguaaucccagcauccucauuaagaugcagaaaacagggcgagcaagauggcacagcggguaagaauaaagguccugaguucaaaucccaacaccacauaguggcucacaaccacccguaaugagaucugacacccucuucuggugugucugaagucagcuacagugugcuuauguacaauaaauaaaucuuugggccagagcaagcagagacugagagagcagaguugacccaagcaagcagggguccuaaaaauugcaauucccaacaaccacaugguugcucacaaccaucuguauagcuacaguguacucacauacauaaaauaaauaagucuuuacaagaaaaaaaagaugcagaaaacaaagucauucacacccaaaaucccagcaccuaggagaccaaagaagcaggacugcaaguucaaggccagucuaggcuauguggaagcccuuauaucaaaaaaauuaaguaaggcaaaagagaacuagauagacagucauauguugaccucuggcaacagccaucuguacauucaucaaccaaaacuuuuguuaaggauccuuuccuuuucuuucuuuugguuagaaaugauaugcuuuuuaucccaaguauguauacagacggcuucgaaugcacacugcucugcuggaaguuccugcucuguccagaacugcuccucuccaggcugaguccuacacauagcauuugagcccucuguauagugugauauuuuccucuuagcccuucugagacaauaggaauguuucaugaauauggaaugagacagcauuugaguaccaaguucuuccuuuaggaacccucaucuguguguaccuugcagacuuuugaagagugcauuugaguuaagagcaaguauggagugagaugucuggcuugaguuagaaagcaccugugugaguguggauuucccaugugcuguuccuguagccagcauagugcaguggagacaugcacucugcuggcuacagugucacaugcauguggaggauaaucuuacaacacacaggguuaaaguggcuuugagccugaguccuuccugcuggcuucuggagacuuaccuggaggugagucauacucagcccaauuaugaaugugcaacaugcaggccacacuucugggcccucaaauaaauggucuacuuacaucauuacaacuccuuaaggugggaaauauuagcauucuucuuugcugggggagggaacuaaaccauagagagccggaguaacuguuccaaguucacacagaggguucuguagcagcaguguugguugccgggccugggcuuccccucaccacgguacccuggugccuuuagagaccagcauguuuggcaagguugaaaagaugaagcacuuacuuugacgaguggauccuuggcuuagauauugacaugaacuaaacucugcgauguguagcaaggcuagaagagcagggaacaaugccaaguacagggcagaugagauauaagucccauguauaagguggguugucaaugugguauuguugguuugguuugguuuugagacauauaccugccuguacuggaacucacuauguagaccaggcuggccuugaacugacggagaccagccugccucugucuccuaagugcagugcuggggcuuaaaggugugugccaccaugccaaacuaucuauuguuuuguuuuuguuuuuaauuugcacauuccuucugaccuugauuaagcuauuaacaguugcuuauuacgaauugcuauaguuuggaucuggaauggacccuaacagucuguguauuaaaggcuuagcccuuggcuuguuguuacugggaaguacuagaauguugaagggguagggcugguuuaguggggacuuaccuacccuugaccuugaacggguugccaguuucuuuucuaaucuuagccauaagguaauaguuuauucuaccagguguucccacucuugauaaaauugaugcuuuggugucacaggcccaagagcaagaugucaugccauggaccagaagcuccaaaacaaugaacuaacauaaauauuuccucuuaagguauuuugcuauaguaacagaaaguuaacacuuggcugauuaauacauuuaguuaauuccagucaaaguaguuuuuuuuuuuaaaugagaagaaaacugcauuauauuguaucuuuuuuauuucuacccugucuguuguuguuguuguuguuguuguuguuguuguuguuguuguuguuguuacagaauuuuauauuguaucccaggaugaagaagaguaaauauguagccugggcugccucaaauucguagcagucuucugcuucagccucccagguacuaucauucaaaguucuuaacaucauauguccaagaacuuggaugucaggcaaaacuuaggccauuucucuacuuuaugucacauagaaguuuuguuggaaaacauguuuaaaacugucucaagugggauucaggaggaaaagcacuucucaaaauccauaauccauaugacaaagccaaaacgaggcagugagggaaagucuaacaucugagaauucagcuucuuaagguucccuacaucucugacaucugggagccacaccaugacagugcaaauauagggcuacccagcauccuguuuggguugucugggugaauuuuggaagccuguaacaacuuuuugaaccacauggggacccugguaauugagaacuacacacucagccuugacauucaaugagcaaaucucaguuguacuucugcagugagcauccacauaccuccauaauaugacacucuugauucuaaauucauguuguugaacacauacguauaauacuuucccauuuuaugugugggaguaugggguaggaguaugcaacauauuuucauuuauuuauuuguucauuugugcauguguguuugugugugugugugugugugugugugugugugugugugugugugugugcgcgcgcgcgcgugcauauaggcacacauauggcacagcuuacaugaggaggucuaagaauaacuuugcucuugcucuuaagccuguugaagcagguuuucccuuguuccugcugcuccaccacacuugacuagcauguaagugagucuuuggguggugugccugccuuucuaucccugaccucucugcaugaaagcugugacuguaacuacaugagucccagggaucaagcuuggguugucaggcuugcacagcuagcaccuuuacccagugcaccaucccccucguuucaguuuacuuucacuucaguaaccacccaauaaaagacuuaaguaagaccagaagcccugagaucauccagaggcaaaccagugaugggccaucuugggcccuagaggaaagcauuccauguccaagguuggcuuuuaaaaugcuuugguucuuuucaucaauuuucuuuaaguaacaaaaaaaguaaaccucuaauauuuuagugagcaaaaacgucauaugaauccuguuaucuauagaacucagcaucuuuguggacuaucugcuuuuugcaaggugaagguagcugugaguaagccaguaauaugacgggccugcuaguuuaugcauaguuucagacauuaagcuugaucuuacuguaaaacugcgaacaguggauaagugcaacaccuuacaagaagagacuguuuuauacuaaccuagcugggagucuauugaaaguuagauuuuuauuaaagacauaaacuugagccacauugcuaugccuauuccuuuccauugugugauuuagaaacuagcaucugcugguguuuugugcugacucuggaacccauguuugaugcccuccuucaaacaaagagugucucuauguacacuagcugaggacauucagccauuuccaauucgggggagggaucaucuagacccuagucagaaauaauaaauaguaaaaaaaaaaagcugccaccccaaaugaggaagauagauuuaggucugcaaugggaagcugugugcauuuggagucuggggaggguugcaaaaagaagucuaacugagaugagaggcaagcccugagaaaccacuguuuccuucuugcauauaaacucauuuccaggagcuuucaggaaaacaucaacccauagugugaagaguugagaaacuaauuauuggcugaaaguuuagaaauuuagaaaguauuaucaagaauugcuaaaacgauuggauuuucuaauagaucuucacuuuguggguuuucugaggucuaauauauacuuugagugaaacacacaguuaagaaguuaugauuuuuaugugccuguuuuauagaccuuugcauaauaauauacccaucacaagcuaccuuucccauucuaagccacuagggcaccauuuugcaaugacacacgccccaacuuacuuuaaggagauuacauuuaauaguaagaggucuuccugcuugucucucaaugacauagauuggcuaauauacuccuucauauuaaagagaagaaaacucagguugcagauaagaccaaugaacucauucuuaaaugucauuuaagagucaggaaagaaaauccuuuggugaugugagggacauucaaguacagccuuauugcaaugaacuccaaugucuaaaaacuguucuuauuuuguauuuguaccacaguaagagccaagauauuaagcucuacuaaaaacaaaacaaagaaacaaaaagacuuuaucaauuuauguucauuaaaaaaacuaauagugguauauuauuuuaaauaucauacaguuaacauguuuggaguuauuuaaaauuuauauugagaaaaacauauguauuuucaguauugcuguagacaaacaucuacauaagauuguucaauugauuguuguuuuauaucaaacaaauuuuauaauacuaauuuuuauuguuacaauauuuuauaaauuuuaaagaauaugauaaaaaaugaaagguauugcagguuuugagguggugggcucuccgggagaaauugggguacaaaagggaaagaagaaugugauguaagucuauuacucaaaauauguuuuuaaacauuaacaaauucagauaaauugaaauuauguaucuuuucucaucauaaugcaauaaaacuuaaaucaaaggggggaaaaagagucaggaaagacaggucucuccauagccaauccauagcuagaucuaggaucuaccuaacacauagguggggaagaguuaccucuuggaauaagguaacaccuggaaaccucuuccuucugaugucuccugaugcagaauguugauauauuaaggugcugggcuuuagacagugaggcucaugcauuugauaaacaguccuaaauaaaacugccaggcaaggugaugucuacaugaucucagcaagccaaagacuaaauacauagaaacagaagggaaacugcguagcuuuucuuuugcugacaaacauuggugucuguuucagcauggaucccauuggugaacacuguugagcuucauccuaaacacugugcacagggagaguaggguuauuaaaaagaaaaauaaaccagcacaucauuguauuguuuugcacagacuuaaacccgaugaagcaacagaauucuuuccuucuagcucuuaaagucuaggagccuaguucuugcacggugguuucuuccaaggucucucuccuucgauugcagauggcugucuaucaccuucuucugucuucaucugguucucccucuguaucuggaucuuuuuuuauauaggcauaugggugguacaugugugugguguuuuuacauguguggggagugauagccauacauucacauugaagccagaggaagauacugggugagcugcuucucaauccgucuuauuccucaaagccaacaguauauuaaagauaguaagcacuccuuaaugccugcguuugugugcuggguuguuuuuuaauuguaggcuauauaagcauauacacucaaaauggaacauauauauauguuuuuauguuuuagguccuccuggccccagagguccaaaaggugacagaggaucucagggaccaccugguccaacuggcaacaagggacagaaaggagagaagggagagccugguccaccuggcccugcgggugagaggggcacaauuggaccagucggcccuccuggagagcguggcagcaaaggauccaaaggcucacagggucccaaaggaucucguggguccccagggaagccuggcccucaaggaccuaguggggacccaggaccaccagguccaccaggcaaggauggacucccuggcccucagggcccuccuggcuuccagggacuacagggcacugugggugagccuggaguaccuggaccucggggguugccaggcuugccaggggugccaggcaugccugggccuaagggaccaccuggcccuccaggccccucaggagcaauggagccauuggcucugcagaaugaaccaaccccagcaucagaggucaacgguaaguccaaaucguccuucucagcuagaauuguggaggaauaaggcaguguguaggcuuggcuaaaccaacccccaggaguccccuaauuacacaaaacagcagggacccuguguaucccucuggaugcuucagugcugucacucaggacccuguguuccugcuuagacauuaucaggucucuacucauuuagaugagccaggccuucagaagaccccuguaccccaaauacuuccuucaagauauucuacacuggcugcucccugaccauccuccuucaucuuucuucuuucuccuuagaaacagaccauuuuaucaguuaacuccaccaguaugcagauaggguuucugugacagaguccacauucugguuuugcuuaagaagcuguuguggugccuuucugucucuuugacagaaagucuuuugcaaaacuauacuaguuaggagccaagcgugugggucccucaugcugguccacaagccagacuuugguucugaagugugcuuauuuacaaccuccagccgauccaagccgacaguguaucagaacccaccccacuuucuuuuuucugucgucauaaagccuagcccaacccagucccaccuuucuucacugugugguguucacugcugugugcuguacaguccacaucugagaacaucugcccggguucuacacagggacacccauuggcaugcaagugguacaaggcugugacuuugauaucuuaaacacagcugaggaaaugcaggguuccuucuguguuuuuuaaaucaacaguuaaaacuuuacauuccuaggauguccgccucacuggaagaacuucacagauaaaugcuacuauuuuucauuggaaaaagaaauuuuugaagaugcuaagcuuuucugugaagacaaaucuucccaucucguuuucauaaacucaagagaagaacagguaugauaugucagcugcacacuugguuggagaaaacuauaauuuagagauaaguuauacuuggaaauugcaugccuuugagagagucaaagagaucaaaaauucauggucucauaaacaaaggaaggcugcaguuugcaugggcuuuuuccagguaugagaguauaugaaugaauucaaaauuuauaagguagaagcaaccuaaaggaaaccuaaagcaacuguaacucacagaggagacucauucaaauucuaagggcagaggaaauauuugucacaugaguuuuacaaauacaaaaagcuaguaucuggaaauuacccccgccuuuuuuauuuuuuauuuuuauuauauauuuucuuuauuuacauuucaaauuuuaguaccuuuccugguuucccuucuaaaaaacuccuauccccucugcccccccccccaccaaccuacccauucacacuucuugguccuggcauuccccuacacuggggcaucaagccuucacaggaccaagggccucuccucccauugaugacugacaaggccauccucugcuacauauagagcuggagccaugggucccuugauguguacucuuugguuggugguuuagucccugggagcccuggggguacugguugguuccuauuguuguuucuccuauagggcuacaaaccccuuccgcuccuucccuagcuccuccauuggggacucugugcucagucuacugguuggcugaaagcauccaccucuguauuugugagucucuggcagagccucucaggagagagcuauaucagucuccuaauguagccuguguaucugcuguuacuuuccuuggguacagagaugacacaucagacaaaaguucuuugaacugaauuucugucccuagauaccuauauguuuuagagcugguuaggacuaauuuucacugaagcagcugucacaaauaauucagucugcuaaauuccaaugugugggcaggauggauaagcagucuuuugaaaaaaggaaguuuugccuuccauucagugccagcacugggccaccuugggcccaaccucggcaggcagucccacagucuccagaggacucuccacccacaggcacccuagcaagcccagaaucuuaggaucacuggugaguggaauacaacgucuauuccaacagaaccagggguaccuggggacagcuggagcacagacaaaggaacccgccugaucaguggcucagguuccuuccagucagcacuagucuaccuugguuuagaacacaccagacagccccacuguccccagaggagguaccacuuccaggugcucuaacacccccaggauauuaggaucccaggaucccaggagcuuggucacaccggacucucagagucucaaaggaagcuugacugcuaagaacucugacauacccaaaucucaggaucccaggaucccagaaucacaggaucacaaagaaggcuggauucugagaaguucugacucaacuggaauuacagaaaggacaggcucugaucagauauaucaaggacagggagcacaugagauaaucagauggugggaggcaagcauaagaacagaagcaacagaaaccaagguuucuuggcauaaucagaaccaaacucucccaccauagcaaauccuggauauaccaucacaccagaaaagcaagauaaggaucuaaacucacuucucaugaugaugauggaagacuuuaagaaggaaauaaaugacucccuuaaagaaauagaauagaacacauccaauccggugaaagaauugaacaaaaccauccaggaucuaaaaauggaaguagaaacaauaaagaaaucacaaagggagacaacucuggaaauagaaaaccuaggaaagaagucaggagucauagaugcaagcauaacaaacagaaugcaagagauggaagagagaaucucaggugcagaagauuccauagaaaacauugacacaacaaucaaagaaaauacgaaaugcaaaaauauccuaacaaaacaucgaggaaauccaggacacaaugagaagaacaaaccuaaggauaauaaguauagaagaggaggaagauuuccaacuuaaagggccaguaaauaucuucaacaaaauuauagaagaaaacuuccucaaccuaaagaaagaguugcccaugaacauuaaagaagccuacagaaguccaaacaguuuggaccagaaaagaaauuccuccugucacauaauaaguaaaacaccaaauacacaaaacaaagaaagaauauuaaaagcaguaagggaaaaaggucaaguaacauaaagaggcaggccuaucagaauuacaccugacuucuucccagagacuauauaagccagaagauccugggcagauguuauacaaacccuaagagagcacaaauggcagcccaggcuacuauacccagcaaaacucuccauuaccauagauggagaaacgaaagcauuccaugacaaaaccaaauuuacacacuaucuuuccacaacuccagcccuucaaaggauaauaaaggaaaaaccgcaacacaaggggggaaacuacacucaagaaaaagcaagaaaucuuucaacaaacccaaaaaagaauagcaacaugaacaaaauuccaacucuaacaacaaaaauaauacaaagcaacaauauccuuuuccuuaauaucucuuaauaucaauggacucaauucccuaauaaaaagacauagacuaacaaacugguuacacaaacaggaccaguagucaacaucaaacuacauggaggaaaacuggaagcaaucccacuaaaaucagggacuagacaaggcugccuacugucucccuaccuauucaauauacuacuugaaguucuugccagagcaauuagacaacaaaaggagaucaaagggauacaaauuggaaaggcagaaaucaacuaucacuauuugagaugaugcgauaguauacuuaagugacccaaaaaauuccaccagagaaguccuaaaccugauaaacaacuucagugaaguagcuggauacaaaauuaacucaaacaaaucaguggccuuucucuacacaaaggauaaacaggcugagaaagaaauuaggaaaacaacacccuucaaaauagucacaaauaauauaaaauaccuuggagugacucucuaacuaaggaaaugaaauaucuguaagauaagaacuucaagucucugaagaaagaaaauugaagaucucagaagauggaaagaucucccaugcucauggauuggcaggauuaauauagucuaaauggcuaucuugcugaaagcaauuuucagauucaaugcaauccccaucaaaauucuaacccaauucuuuacagaguuagaaagggcaguuugcaaauucaucuggaauaagaaaaaccuaggauaguaaaaacuauucucaacaauaaaagaaccucugguagaaucaccuugccugaccucaaguuguacuacagagcaauugugauuaaaaacugcaugguacugguacagugacagacagguagaucaauggaauggaacugaagacccagaaaugaacccacacacacuugaacuuugacaaaggugcuaaaaccauccaguggaaaaaagacagcauuuucaacauauggugcuggcacaacuggcaguuaucauguagaagacugugaauugguccauucuuaucucuuguacaaagcucaagucuaaguggaucgaggaacuccacauaaaaccagagacacugaaacuuauagaggagaaaguggggaagagccuggaagauaugggcacgggaaaauuuccugaacagaacaccaauggcuugugcuguaagaucaagaauugacaaaugggacgucauaaaauugcaaagcuucuguaagacaaaagacacugucacuaagacaaaauggcaaccaguagauugggaaaaguucuuaaccaauccuaaaucugauauggggcuaauauccaauauauauaaagaacucaagaaguuggacuccagaaaaccaaauaacccuauaaaaaugggguacagagcuaaagaaagaauucucaacugaggaauaccgaaugucugagaagcaccuaaaaaaaaaaaaaaauguucaacauccuuagucaucagggaaaugcaaaucaaaacaacccugagauuccaccucauaccagucagaauggcuaagauaaaaaacucaggugacagcagaugcuggcgaggauguggaaaaagaggaacacuccuccauugucggugggauugcaagcugguacaaccacucuggaaaucagucuggugguuccucagaaaauuggacauauuucuaccagaagauccagcaauaccacuccugggcauaugcccagaagaugcucaacuuuuaauaaggacacauguucuacuauguucauagcaggcuuauuuauaauagccagaagcuggaaagaacccagauguuccucaacagaggaauggauacaaaaaaugugguacauuuacacaauggaguacuacucagcaauuaaaaacaaugaauuuaugaaauucuuaggcaaauggauggaucuguaggauaucauccuaagugagguaacucaaucacaaaagaacacacaugauauucacuuacugauaaguggauauuagcccagaagcucagaauacccaagauacaauuugcgaaacucaugaaacucaagaagaaggaagaccaacaugugcauacuuugauccuuccuagaagggggaacaaaauacucauagaaggaguuacacagaccaaguuuggaacagagacugaaggcaugaccauccagagacugccccaccuggggauccaucccguaaacaaccaccaaacccagacacuauugcagaugccaacaacagccugcuaacaugacccugauauagcugucuccugagaggcucugccagugccugacaaauacagaauuggaugcccacugucauccauuagauggagcacaggguccacaaugaaggagccagagaaaguaaccaaggagcugaagggguuugaagccccauaggaggaacaacaauaugaacuagccaguacucccagagcuccuuggaacuauaccaucaaucaaagaaaacacaugguggaacuugugcuucuagcugcauauguagcagaggauggccuggucaucaaugggaagagaggcccuugguccugugaaaguucuaugccccaguauaggggaaugccugggccaggaagggggagugagugcguuggggagcaggaggagcaggaaagaggauaaggcauuuucagaggggaaaccaggaaaagggauaacauuugaaauguaaacaaagaaaauaucuauuuaaaaaaaaaaaaaaggaaguuucagacuuucaucaguguuuaguuguuucccaaagguagaaaauacugguaacuaauagcaucagguaguucuuuccauauuucuaucuuguguugaucuacauguacaugaaaguuaggauucaguucucaugcccucaaaguguguacagaaugauguacugauggcuguggaacugagagacuacucaggaaauguccuucuccuuggggggugggggugggggucucauuaucuaaacucccaagaaucaaaccaauucuagaaaaaguuagaggggggagggagagagagagagagagagagagagagagagagagagagagagagagagagagagagagagaggggggagagagagagagagagagagagagagagagagagagagagagagagagagagagagagagagagagagaauaugagaaugaaucaguucucaugaguucuaggcuuacagauauauagcuccaccugguggcuuacuggagaauugcagcacagcugccgaucaugggggcaggaaccacuagacacaugaagagacagagaggcgugaguagguuggggguggagcaccacaaaccagacuuguugguucaaaggagguugguaagggcccaugugugagaaugauaguggcccuuuauuaagccccugucaugugcaaggcccuuuuuuaaaaccucacagcaacccuguaauauaaaccuuauaauugccauccuuccccuuggguuuuuuuguuugguuuguuuuguuuuuaaacaaagccuagcaaugucuggaauuugccauguaaacuaguguggccuagagacugugaugauuucccggcauccccuccccaggggcugggaauacagccguguacaacugauuuugguucccccauuucacagauaaguuacucugaggccucacaaggucuacauaacuucuucucagagggcagagaguagaagcaaagccaaaacccaacugacaacaacgcucauguccucccccucacuacccgucucuaccagacacaacccugaaaucuggguuauuguaacaugcacggagcauaggaaacagcagucaggccgugagcccaaacauuucucaucagcguggcagaggcccacagaugggugacugaagggaaacagggcccacaccagucacucuuagggauccuaaagaagaaccuugcuuuuacuuguuaaacauagucuuagugaaacacuguccacaauacaaaugcauuacaaaguggacagcuuaggacccuaaaaauggugagaaaugauuuuugucaguuuuauuaaacaagagcucuuuuguaugggcuaagaacaccuccugcuuucuuuucagcaauggauaaaaaagcauaccguggggagagaaagccauuggaucggccucacagacucagaacaggaaagcgaauggaaguggcuagacgggucaccuguugauuacaagugaguguggggcuuguggacagcagcaugcacuugcuucccauguuuucacaacggccuagcuuccugcgacuuucccuuaaugacguuuugcuuaucccacaccauccucuugagggccugggcuccuuguaccaguugccuauucccaguagggaagcagugguggacagucacggugcugucaaguagagcacuucggaaggauaacguggcccagagccucuccgaaugaucgguguucacuuggacauauuucugaggacuugggaacuccuagccuugaucaggcuucugacccaaaugugauuugaguccaaguuguacacaccaagguuguagaucucucaugcacaggaaguccaagugugcacagaggaucccagaauguccaucuucugcaggauaagagaaaacuaaauucucccaacucuuuucucaaaucuugccuuucuucuucuggagagaaaguggagaaccuguaaauuuccaccugugaggggccuucaguuugcuagagacaaacaagccagcccuaucagcagcaugucacaggaagcugcucucccaugggggaaggaugcuucugcucugagguagucuacaggcacugaaguaagacucagguagcucaagaguugcccagaggcugaggugauggacagaaggccagauggucucaaaccagcauagggacagccaggucugaguuacacauguaaccugcacugaccuggaaugugcagucuucugcccucagcacccaaaugcugcaucagaccugcaucgaugcgccuugcaguucucuccuuuuaaacccuccccaugaagaccgugagagagacaguagaugggaucagaaggccaucucugaagggaaaagacaaauaugagcaaacauggaguggaucuuaggucugccccaaagcuggagguacaccugugcuuaccugaucucagguacucuaucugcucuuugugccugccucugagagacacuggggucaggccagcaccuagaauggcagggaugcuuugugagacuccacacuugugugggcuuuggugugcaaagcaggagcggccaugacuuugaagcaggaauggcagucggagguuagugcuuuuucuuugguagucaagagagccaaaauaucuuuuuaagggaguugagagaaacuaagaagaaaaauccaucucccccuuuucugcaguaaauggaaagaaaguuuggguuugacugcaaaauucaaucuuaaauuuuauuggcuuguaugggauugauugagcgggaauauuacuaagugcuccagcuuucaaagguaaagcuuugcccccuuucccugggauccaggaagaauucuguggcugggaggagagacuagaauuggucccuggaccccaagaaggaugacaucacucaccuuacugggaguuuugccaccagccacagccacccuggaguccaccccgcccccacccuggaagcugagacuccuacacuucagccaccauagacacugugugucucauuuucuacccaaaggcauauauguacauggaaaauuccccaggaucaagcucuaaaggcaaguguaaaucaggcagauguuguuugaggucucagagacuaacuuaguuugacauauaauaauaaacacuacaaucuagacaaagagccaggcccguccagggaauacaaauacaaacuugaaugagaacuggacuuaggcugucacccaugacaccucagucacaugaaaucaccauguccccgugguaaaaugaaguugacaaaaggacuguguuaauacuuacacacacacacacacacacacacacacacuggggucaggccagcaccuagaauggcagggauaugcuuugcaagacuccacacuucugugggcauugguaugcacacacagaugugcaugcagagacaguguguaugugugugaauuuaguauacagcuuguccccuggaaagcacuagagaaagccuguggguguuacaacuguugucauaauugugacugcuuccacaguaaaauaugucaggguuggggacuauuacuccccagaauuuguagugugcaugaucuuaacuagagacacaaagcaucuuacaauagguuuaugaaguauccaaaaauaauccccaucauggcuuaggaaaggaaagaggcgucaucaucccuagccucccagauaaaucuucugaaacacuuucccaagaugcucagacucuccuuuguccuccucuuuugauucugagccuccaagacuccguccacuugccuucccuuccuucucuuaccagcagugauuucuagaucauaaccaucaaagaccauuauaaacuguuacuaugaacaacuauacaccaacaaaucaaacagccuagaugaacacacacauuucgagaaacaaagugguuuagaaagaucaagucaaaaagaaacaggaaggcagagcaaauacuaacaaaucagauucgcacagucaucaaacgccucccagcagagaagaacaguccaggaccagaggcuucauggcugaguucuaccaaacagucaaggaaggacucuggccagccaucuuaaauguuuucaaaaccagaagccaauggcucuggagccaucccaggccuugcccagccaccaaggaauuaaguacacaacuuuccuuuuacccuuuuucuccaaaacacacacacccgucccuuugaaauuauuuaaggauuuugugguuacuguaaaagaggagccgguuuucaaggacagaccucuccuccauugccucugcucuacgcuguuauuuucacugauacaugguucgggaagacagggcuagaacacacagauaaaaagcuguagugacagagaagaaauuccagcugcuucaggcacauucagaccugacucagguguauuauccucagacacacugacucgcagagccuuucacguaacuguacuaaaggagguaaggaccagcuagauaaagggaguaugucagaugcccugggcuggggccauggccaguuuucaugugccauaagccuacauaccaaugugauuucaacauaauacugaaggacaauguagauugcuggacauaccaguuguagauaugguuuuuaaaaauaacaauaacauaauccuaucagagaaaagacaacuuccuauccuacacacaccaccuuuguuucuuucaugucaccacagcccugugacuuuauauccaguaucuauaccaugacuggagauuaagauccauccacagucaauacauugucccuagauguccacagggagguggcagcuggaacaggaggauaggaguguaaaugagagguguuauccuugugugaaagauaaaugacacagugggacaccaagcacaacucaauaaauucaagaacugggauuauagagacuaugcucuguagccucaaacaaguagauagcuaaagagcuauaaaguauuuggaaguuaaaaaacauagaccaaagaagaggcuauggccauaccacccuggcaaugccugauuuuguccauagaucaaagaggaaauuacagugaaagucuaaaaaugucuuuaaacaaugagaacauaucaaaauuuaugagcugaagcuaaaauagugcuuagggagacauuaacagcucugaaacacuguguuuggguuuuuguuguuaguucugagauaaugucuuucuauguagcucuggcugucucaaaacuugaugugcagaccaggcuggccccaaauucagagagaucuaugugcuucugccucccaaguauugggauuaaaacuacaugccaccaugcuuggcccuaaauuuucuuaaagguuagaaaggaaugaccuaagcuuccacuuuaugaggguagaaauaaagaagaaaugaaccucaaaauaagcagaggggcuuguacaaagcccugggugggaucuccagcuccacacaugacuaaguagaaggaaaagaauagaaaaaucaggaaagcagcaacacagggaucgcagaaguguugguaagaccaggggcacagugauucauuccacuauuuuuuuauuuacuuuauguuccaaucugagcucccaucuccuccauugccccuuccccuucuccuaagagaagggcagcuccccuuggguuccaccccucccugggaugucuagucccagcaggacuaugcacauccucucuuacugaggcauaauaacucuuaauggaauaacugcagaugaguugguuggcuaauugucacuguuacuaaaucaaggcugccuuccccgggguaaaccagauucauauggaaaggaucaagacuguccaccuuaaaucaguccacccacucugccaaaagcccuuauacauuuucuuuuccccgcucugcggucuaccagauaguaaaauaauugcuuuuauuuuuauguuacaaagauaaaaugggcuguuguccugcucaguuauguaacucauguuguaguuuuauaguacugugcuauagagcaguaagggccagaagagacucuucaguuucuucuacuucaacaacagcucaugcuagucaacacuucauguuccugcccaggguggcacuggcccaggccacaagagaggaaucuuccacaacaggggccuuguagugggaaaacaucuugcuucaagagacguuucucaacaguaacauuuucuuguuuggaagccagacccuuaccagcagaagcuucuugacuguagucuugguuaaucuugugguugauggaaaaaauauuaaguuguaaaguuagagggaucuauucccaagauagaaaguauauguucugcuaacauuaagaguggcccaaaauucugggaugcugcacucuccauaguucauguuuguguguuugcaaaucacuuacagcucaaguguaucuaagguuccuggggugcucagaagcguucacguugcuaugacauauguguuguaauauggccaagcucauguuauucuuuccagagccuaccugugaaugcagucaaggcacuguuuaggcuaacauuccaaaauauuacauacacauucugcuuaucugacaugcucuguucucuguuacgagcauacaaacuaaggguuuugcccagagguugcuccauggaauuuuagcuuuuccagagaugcucugagacuccaucuucucaucccagcugccacccaugcuggguaucuuaguugccucugcuccacagaauuuaugcugccuuuagucauaaagaaaucucugagcacucuacauaaagaauucuagugauuugaacccaguugggaaugguucccuuucuguuuaaucaguaaguccuucuuaccugaaugaucuuaaaugacuuaaaguaaaaugcaagagaaucauacuaaacagauccucugagucuaaauaaaccauauguguuugugugaguguguguauauacauacauacacuuuuauaauuaacugagaaaucaagaauaucaaacauauguguauaugauauauauacauauauaucaaauacauaauauauuuugaaaucagagauauaaagagauguaaaauuaauauauuauaauuaauauaaaauuauagaaaaugaaaucaccauuacuauuagacaugaacaaaaugcauguuucugagaacaagcuacuuggguacugcuaaccuuugcagagguggccuucaaggaagcucccuuucuuuccaaucugucccucugggcaccacugacaguuugagucuuaacuucauccucaagucuguuaugcaaguucccugagaacuggaacuucguucugugcuccuuuguuaccauugccugaauuaaacucagcucgucguuacauucucucugaggaucagugcagugaguaauauuuucuaauucuuccuaguaguuuccucucguugguagauuguuccuucugaaucaccuuugcuucacuagauuaucauggggucagaguuuuuaucaagucccuagauagauagguuuagaauuaguugaguauuacuucuaucaugcugccccccuguuuaacuauaaucaccuuuucuuucucacugccuucugacucugaugaucucauugucaaaagaugaagggcaauaugaguucucaccuaaggagagcccucagguacccuguaguuaaugugggugagucauugcugggaguaccuuuauuacagauguuuuaggguaagaagucaguuucuuuccuuaagcagaaaccacaaccaugaacuugcuucuucaaaaggaccuuccagaaaagagucugagccacacuuaauuugcugcauggaaccagaaucaagaacuauaaagucacaagaaguccugcuuugagcagcagcauccaaauaaaagagcuucaaauaaacucauccuaauaaaaacuuguucaggcuuggaauucaagcuacucaggaggcugaggcaggaugaucacaagauuuaaaaaaaaaaagguuagcauagaguacagaaugaauucaaggccagcugggcaaguuagugagaccuaaucguaaaauaaaguaaaaagaaggcuuagcaugggcagaggcagugguagaagacucaaccuagcaugcacaaaugucuugguucuuucucaggccugccuaaaucacccccucaaaccccuugcaaaaaacucagaaaacuuguuuuaagaacccucuuucugacacuuuuagggagguagaggcaggaagaucucugugaauuugaggccagcccaaucuacauagugaacuccuggacagcuagaacuacauagagagacaugucuuuaaaaagaauaagaaaagggaggagaagagggagaaggaggaggagaagggagaugaaaaggaggagaaagaggaggaggaggaggacaacgacgaugacgacgacgacgauggcaaaugcucuucuagucaggcauggugguacacaccuuuaauccaaacaugucagaggacuuacagguagauaucugaguucauauccagcuaggacuauucacugucaaucaaucauucaauaaaucaauaaaaaugaaaaucuucucuccugagcuagagagauuucgcaguggguagaggcaucagccaccaaggcugaugacacagggcccacaugcuagaaggagacaguugauucucucaaguuguccucugacacacacuguaguucucccucccucccuuccuccccaacucacucacucauucccccucucucccucucucuuucccucucccucuaucauacaugaaaauagaagcucuuucccaaaagagguuguaaaauauuugaguuguuuucaguaagauuaaauuauuauuuucugaaauugucaaccauguacagcuaggccauagccacaacuaauuguuugugguuguggguuuuuguaacuguguaucaaggugcucucacuuucucuucuagaccuuuugaccuguuagagacaagacacaccauugacacacauugaucccuguguauucucagaagagcaugcaugcaugcauauuuguguaagauaucccaagagugcauauuaccuacuguauacacaagaccagaaguccacacugcaggacacaguugaaggccauucaccagcuaugucaaaggauucauccccuccacaauguaauaaugagguucacuggguugaucucacuaugguagagauaacaagccugcaaggacaggcugcuuuucagccucucugcaaacagcuaagugaaagugagcaguuuucuaaauaauguguuuccauuccacagcaaauggcauguuuuggcuuuguguuuacaucccucaacuguuuuugagcaaagaaaaccucugcaugcuguacagauaacaguucuuuucuguuuuguuaaaagaaacuggaaagcuggacaaccagauaacuggggcaguggccaugggccaggagaagacugugcuggcuugauuuacgcaggacaguggaaugacuuccagugugaugaaaucaauaacuucauuugugagaaggaaagggaggcagguaagcagccucacaguuuacuauggagcugcagggcuugggucuuguuaaaggggagagguguugagaaggacucugaauguaggcucucaggccugagcuuccagcucacuucuacuuaauggcaagguaaguuaucaagcucaggggaauaacaauaacucuuuaauuuaucauauugccaguuaauuguucuuuaauauaugguaccagugugauaucuuuggagugguguggacauucacauccagccaacucagugaaaccacauguacuuaacugagcauuuaguauaagccagguuuugugcuaauguaguggagaguuauaaucugcauaacuuaaaaaugcuuacaucaaaaaaucuuguagauauucuucuugacuacauaagaaguuuaucuaaagcuucauuuacuauuugacccuuuuuuaaacagagugucuuccuuuucauuagaacuaaguuuguaguggcagguggaaggaaugcuaagaguaugggcuuucuuuggaguugacagcaaucuuuagaccuauggcacaacuuugaaaauauacuaaggggauuguagaguuggcucagcaguuaagagcacuugcuccucuaacuuaggacccugguuugauucucagcauccacauggcaucucaccaccaucuguaacuccaauccaguggauauggugcccucggcuggucucuguagacaccaggccagugaugcacagauauguacaggcaaaacacucauaugcauuauauaaauaaaauuaaaauuaagaagaaauacacuaagacgcacugaaguaaaaagcaauuuuacauggaugaucugcauuaccuguaaauuagaguucaguaaaucuauuuuuguuaauuaguaauuuuaaaagaccuaucuauauucuacucauauuauuuuuggagguaacugggacauaaauuacauauacauucauuuccagaguacuuugauguaucgaauaguagugugaaugcuacaggucucaaaacaaauaaggaacacacaguguggucagcuaaggggcagaagcauggaucacuaaacaugggguuauaguugauggcgacaaucaggcaugauguguuugucuuguuugcucaaaagaguguugaauagggaacauaguuccccaaaauugacccugccagcaagccacucaggggagacagaacacaguccaugauaagggucagccuguguuuuucuggacgagaucuaggacagaugcugugguccuugggcuccuguguacccagacaccacuggggauauuggagaguugagaaugggggucauggggcugcacuucuccuaugcccuaggcaggagggguauggcugacaagacagaauccauuuugguuccaaaugagugccagaguacacaaaggcugaaacagagacggccucucugggagauuuaggugaggcucuuuaagccccuaccaugcuaccaccaccaggugauccuugaugaaggagacgguccuggcuuguccaaaaccgcuugauuuaugguaaauguaaaugcaugugucuuacucauggugaaccaaggguuacauaccuuuugcaggaaggaaagcccaauaagggaaguucauuggcuaaacauuuggagccuaucuagauaacuggucagcauggaggacuccagaauuuuauguuaugugaugaguugucaugguccucucaguggggugucaugguuacacauuccagaacagguagagcuuggcuuggcaggaaacugguuccacaccuaccauuuucaauucugagauucuccgggguuuugaacuuacuucaaucuuaccaguuuuucugucugguggcacggucugcuugcuccacauugcuuaaucuggaaaaaacaaaaaacaaaaacaaaaaaaaaacaacuucccaacauuuuucuuucaauaaugccauuugugcucuuuccuaaagauuccuccuguuuuaaguuguuaauaauuuuauuauucaaacaaaacuaaugcccauccuuuuuuuucuguuucaguaccaucauccauauuauaacagcaugauauaauagcagaaacauauuuucugaugccucugaaagccgaagaaugcucguuuuugauuccaucacuucucaccagauugaauggaaaaagcucugaaaaguaguuauucaaaauaaauggacaccuacugcacaauaacccaaggacuagggggcuaaaaugcucccccaaguugauauauugauuuccaguguacaaauggacugaaucgcauagauuuucucagccauuaaccauagaauuuaugcaaaguauaucuuuccaaauauggaaugcuccaaucagaaaaagacuaucauugguuguugaguuacugacugucuuagucaggguuucuauuccugcacaaacaucaugaccaagaaggaaguuggggaggaaaggguuuauucggcuuacacuuccauacugcuguucaucaccaaaggaagucaggacuggaacucaagcagaucaggaagcagaagcugaugcagaggccauggagggauguucuuuacuggcuugcuuccccuggcuugcucagccugcucucuuacagaaccaagacuaccagcccagggauggucccacccacaagggaccuuucccccuugaucacuaauugagaaaaugccuuacaguuagaucucauggaggcauuuccucaacugaagcuccuuucucugugauaacuccagcugugucaaguugacacaaaacuagccaguacacuggcucuguguaaacaguguguuucuaaaaucccaaauguaggaaaaauaugcagaugcacacauauaggccacauuuuaguaauaauaugaaauauacuuaaagagcuuuuaaacuucguauuuuuauacaaaauauuugccuuuuacaaucauuuuccuuuuuuuaauguaccuauaugauacauaaagccaaagauaauaauagcgguacuaauaaaauuucauggaguuucucuucagauuuaaucuguccagcugaagaaaauuuuuguuguaugugucuaugucugugugauuucuucagaaccgugaaucacaugaagcaucuggaaaugcccuuguacauuuuggugauggcggagcucaagccugagaacaucaugacagcucauucaaguaggcugugccacuagcccagcacuggccacuuccaguaagaggaaguguuaagcugggaaguggugguguacgccuuuaaucccagcacuugggaggcagaggcaggcggauuucugaguucgagaccagccuggucuacagagugaguuccaggacagccagggcuacacagagaaacccugucuugaaaaacca

SEQ ID NO: 8807 - RNA, 2747 nt, Mus musculus
cuaaagagaaacaggaagaguggaucugggggagugagaagaauggggggagugggaaguucagucaggauuaauuuuuuuuaaaugaacaaacuuuuuuaaaaaacagaaaaaaaagcaaguauauuaacugugauauuugaauuugccaaauguacacuggauauacuuauaccugucucacagagucauugcaaauuuuaaugaggugauaugcagaaaucaccuacuacagugucuggcuccaaagauacaugucaugcucuuaguuccuuucucuguuuagaaaucuuucaaguaccugguucagcuaaggaaauaacaaguuuuaagucauugcagacaccuaauaacuugacccagguaagugagggaacaguucuuuauagaguaguagcucccauuaaagcaggcuugguuccaugccaggaaaaaauggaaccuuggguagaaagcaaggaaguaauuuuucuuugucagagacaggcugacaagcaugucuugaaucccacuagggacauuccacacacgggagguuguaagggaaagauuguaguaaguucuuuauaugguacaugcucacacuagacuaggaaucagcaaauauggccgauagucuguuuuuauaaacaaacuuguuaaaacacagguucauugguuuauuuacuuucugucacacacaaauguuugauccccagccuauggcaucacugggagaugaggucuugugagagggaacugugucacugggaaaaugucuuucuaucucuuuacuucauggccacaauaagguagaugggccuuugcuaccacauuguucccacugccauaagcccaaggcaguaggagcaagagaccucugaagccucuaaaacuaugaaaugaaagaaaaucuuuuccuucuucuaccuugcguuuguugaguauguagugauggaaacuaaugcagugccugaggugguugcuucugagcuguaacagcaaaguugagcaguuacaagggaccguuacuacaaaacuggcaauagucacaaucugucccuuuacagaaguuugcaaaauucaguaucaacuuauagccuacuccuuuaugguacuuagaaaaauacaccuaauuucauuuauuuuagauuauuucauugucauauagaugaaaaugcuaugaauauaaagauaauuaguaguauuaauuaguaguguuuauuauuagaauuaucaguagguaauuccucaaggcacccagaacaucuaaaggaauuuuaaaaacaaaauaguucucuccacaaccacucuugugccaugaaugugagcuuuaucgugucuugccaggcauaguaccugggacaagaggaucacuuaagucaaggccagccuagccaacaucaugaaacucugucucaagaaaaucccaaaacuaaacccuauagguggaacaacaauaagaacuaaccaguacccccuggagcucgugucucuagcugcauauguaucagaagauggccuagucggccaucaguggaaagagaggcccauuggucgugcaaacuuuauaugccucaguacaggggaacgccagggccaagaagugggaguggguagauaggggaguuguggggggggggguuaugggagacuguugggauagcauuggaaauguaaaugaggaaaauaccuaauaaaaaauuuaaaaaaagaaaagaaaaucccaaaacuaaaacuacacagaugcuuaaaaugcucccaaauagaagcaaccaagcuguccuucagugacuuaggaaaauaaacagggauaacagaauguuaaucaacagcaaaagaagcgagccaccaaagcacagaaagauuuggaagagaccuaaauggccacugcuaagcaaaagcagauauauauauauauauaucgaaaggcagagcagagcagagcaugaguaaguggaacauaguuauuuuuagggaacuuuuaggaaauaaaacaaugcagauacaaugguagauacaugacuucuuuuugucaaaacccucagaacuuugcaacacaaagaguaucccacaaugcauacaacuuaaaaaaaaaucucuaaaucuccaaagaauuguagaugauaauaguggcucaacuuaaacauuuuugacuuuacaaugagaccaauguauacucauucaaauauucugguuuucacuuucaguucauaauucaauuauauaaggcagucaagacuucauuauaaaauagguuucauauuauaugauuguagucuccccucccccagccugaaaccugcuugcucagggguggagcuuccugcucaauuguucugccaugcccacugcuggaaccugcugcuuugcugugcacauggucacccugcuauuggaccucaagauuaauuggccggaaucaggcccccuuccccugcuuuauaauugcgugcgaaacaguaaacuugagcuuugaucagaaugacugucuuagcuacauuucuuuaucuugccacguagccccucuucucuuccagguuuccaaaaugccuuuccaggcuagaacccauguugugaucugcuggccggacacaacauaugauuuugcccaacuguagguuaauguuaaguguccuaagcacauuuaaaauaagcuagagaaauaauaaaguccaggacucugguguauuaaacuuacuuuuuaauuacacuauuuuccacuugugauggguuuuuuuuaagguaauaaauacccccugaaguua

SEQ ID NO: 8808 - RNA, 38382 nt, Mus musculus
uucucgcgagcgcuaccuuccggcaccgcccuugaagcggcaccaagccgucauucacccucuaggaaaaccagccuugccgugcccagggcggagcugacaacacgaaacacccuaggccgcuccacugcuaguggagucccagagcccggccuacgcgccacauggcugagccacaccgcaccggagaucuucaccgcuggccacucuagccguugccgucucuuugcucccaaccugacgucaucacugggcgccgcagugcaguggugggcacgcgcaaccaagaugucuccgacgccggcgcuuuucaguuugccggaggcgcggacgcgauuuacggugagcugaggggcugaaggccgugguucugaccuggcgcuauucuuucccuuucucucgcugaagggacugagggauuuucgccgccggguccguuccuggccccuuccgggacugacauuaagggaaaggcgcacuggcuacgcgucuguggguccugacccucccuccgcgggcaagucccgagaccccuggucguuaccgucguccugcgggcgagcguggaaagcucacccaggcuagcucagucagcuucagcucauuagcuagcugggcgggacggguuucucaggcaggagcccugaagucaguuuccaccccgccaagaaaggaaccucucccucugccccuuguccucaguccuggggguagaacgugccaagcaaagaacuccacuacugaauuacagcauuuagauaaguaguucucaagcuuugcuuugugguauugucuuuuggauuguuguuguuuagucaggguuuuguuaugcagccuaggcuaggcuggaacucagagaauucagguugaccguaaacugauguuuccccagcacugguuacaugaugccccaucaaacuuagcaagguuuuuuuaaagcaggaaacauagauuggugugauacauaggaaagggaaaccuguggcgcaaaugucuaguuagcucuuggcagguuuucaugggauaaggauuacgaucacuagaaauaaaaguuaauaaaaaugacuggcagaaaauauuucccaguuuaaaacauuuuuuuuuuuuuaguuagaaagacuuauaauugaugaaugguaaauuuuuauaaacagcaaaagcuuucuacuuauuugucauuuuuauuuuuguagaaaucuaccagagaagccuugaauaacaaaaauaucaagccguuguugacugccuucagucaguuaccuggcagguaaagcacacuguccaugaaaagaggacuccaugauguuugugaacuauuugugaaaugaagguauuuuauguuuuuaauagugaaaaugaaaaaaaauguacccuugaccaagcuuucagagguguucuggaagaagaaauuguaaguauuuacccccuuuguuaaaauaugcuggccgguuaauaagucauguuguuaaaaauugcuuuauuauuagaauggauauuuaaacaugacauguuuucugggcaugagcauucugccuuugagacaaugcauuaggcucuugauggcucagguacaguuuaagcuuugaugauaagaaaugguuugacauucagucuuaaagagcaagaaguaaagacugacucagggagaugccucagcaagucaaggcacuugcuacagagcgccauguccugacuuuggucucuagauccuagauguuggaaggagaggacuccugcaaguuguccucugaccuccauaaagaacacacacagguacacaaaauacaguuuuuaaaauguaguuuuaaaaguagagucucacuuuguuauauaaaugaugacacacuguguaaaaguggucuaguccaaagauguuaagcauagagcgaggauuccauguccucauuuucuugugggauuuuuccucagcuauaagcauacauaaauaacuaaggcuuguuuaacccugcugaagaaauuuaaccaugaagaaucuaaauauuaccuuuagcagggauccugaaugaaagauuuuuuaacauuuauauuugauuaagcagaaauugggucccauggugguagauucucuucugaugaccauaauauaguauccccccucuuuuugucagauaauucugggucagaccaauugaucuuuuuuucagcuuuaaucguuucucuguuaugaggugcuaagaaagucacuuuuccuauuguuaccuuccugcagaaggcccucugcuaagucugcaguguuacuauggauucaguccaggcccugcuuuuguccugcuguugccuuucacccacaaccuuagaacuucugugcccaauaaucuuauaaccguagucaugcaaaaguuaacauuucacaaguuggguuuugauugacucacucuuuacugcuugauauacuuaguguguauauuacuguucaugguuuuucaucuuauaaaauaacuuuguauaagauauuuucauuccuguuuguaugacugcuuaauuucauagaacuugucuuuauuguuaacaaauuagugcaaauucuugcuucuaaauaaacuuguuucucuguugguagauaaaucauuccgcaugugagaacguuuuagcuauuauuucucuugcuauugggggagugaccgaaaguaaguaucuuucuguuucuccuaaaaguuguuuuagaucugaccuguuuuauuuaagacucucgacauaccucuuccucugucugguuuuguucaucuuuuauguguguugcuagagaccaaauauagggccucaugcaugcugugcuaccacugacccacacucacagccccugcucauuguuugacuccuuccuuugccaagaagauguuccuacuuacugcucaucacgauuaugucauguacauuacaguuuguuuguuuucaaguguuuuaaucauauaucaguacuuagugagcauuuauuguaugcauguacuaaguuaggauugggagguucaguguaagagucuacuggguaaugcagggcagacgugugugagugugugagugcuguaagcgcuaugguuagaguuuguugaugaauuuuaaaaaguaagaugagcuuggaucugugacaaauaccuauuaucccacacuuguaaggcugaaucaggacagucagaaauuggagucaaaauaaaacaaaaugaaaaaaagaagaucuggucuacaaauagaaauaaaguuugccagaaauagagaagaagauagauauaggaaggccacguucagcauagcuagaaaauuauaugagaugagaauggcaaaggaacuaagauuuguggguuaguuuaaaggccaguguaucucguacugagaagacuaaguacauugggguagacugcuagcagaaaaacuaggcagaaauuaaaaaaaaaaaacagcacuggggcacuggaagauggcucauuggcuaagauuacuugaugcucuuacagaggaccuauguucaguuccaacaucuaugacaggcagcucauaacuaacuaccuuuaacuccagcuccauaggauaugaaggccucuucuggccuuugcaggcaccugcacacauggagcgcacauacauauacucgggcacacacauacaaauaaaauaaauaaaucuuuuguaaaaauguaucagugccaauauaagauugguuuaaaagacuuuaaacacaggacauaggcgcguagaggcugauacaugauaagaccuuauuaaauauuuucaggaaguaaaaauuaaaagcaguucaucaauauuucuuaacccugugauuaauuuaaauaauauuugugaaaaugaccuuugaaccuguuaaguaucauuuguaucacauauucuuuugagcacacaagguaaaaaugguuucccauugucaaagugagcuguuuuguaaaucuaacuuccuaaauuuuuauuuacuuauuaaacuuuuguguaggcuguuuauuaguucgguuguugauucauuuauccaguguacuuagaugaguuccccaaaaguuuuccuuucccuguuacucaguuuacaaugugugcuuaguucauuaacuugcuaugucauuuacuuaagauuggugauggcuuuccugcgaacuaugccuagaacacggacuugucuacuuaagcugcaaauaaaggcuuaaauacaauagucugcaguggaaaaucuuauuuuugaaagagauuauuaguaguaguacuuuauguuuuguguuuccaguuugucuauaaauaauguucauucagcuugacacauacuuauugaacuucuagucaauggcugaaacauucuuuuuuugaaacauucuuuacugacauugauuuuagaggcauauaguaacuuucacuuuauuauuacuuuguaauauagccuguccauggauucucuuucuugugcuggaaggcagugucacuagcucuucauugauuuauaccccauuuguagguguuuguacugcguccacaccauuugugcuauugggagaugucuuagacugccuuccuuuggaucagugugacacaauauucacuuuuguugaaaaaaauguugcuacuuggaagucaguaagugccuugguuuccuuuccugauaauccuagcacuauagagauagaauucagaagaaagcuuuguuuguaguuuauuugguaauaauucuaauacuggugguugccaaaacauuugucccugugaaagaauuauauauuauguaauaauaagaaucaaauguagagaaaauuuugagguacaaaauuuaauaaguaacuugaaaguacaugcuuucaagcaggcauaguauuguaaaguuaugagguauagguaggaaugcuguguuccaagcuagccuggucuccacagggagaaccugucacaaacaaagaaagaaagcugggggauggcuuagcaguuuagaguacuuguuacuccuuuagagaaccuggguuugauuuccaguacucaaacaugguggcuuaccaucauacauaacuccaguucaaggugaucugaugcccucuucuagccuuuuugcauacacacauacauagauguauguauaguacacauacauagaugcaggaagaacacucauaaaauaaacaaauauaaaacaaauuuuuaaagauaaagcaaacacacacacacacacuucuagauguuuacaaguuauucagugauaugcuguuaaugcauauucaaguggaaaugcuugaaaucaguaacaguagugaaauagacucuuauacauuagugcucuuuaauauuuuaauuccuaugacuuauugaagggagugggcaacuuucaaaguauaguaauaauuuuggucuuaauuucagaauacauucuauucugcuggcaaaaauuauuuacugcguaugugcaaugguaaguaacucaguauuaaauuacucuuuuaaaacugugaacgugaccagaagaauagguguuggugguuuaauauuuaacaaugacgaugucuuuuguuuguuuguuuguuuuuguuuuuuucgagacaggguuucucuguguagcccuggcuguccuggaacucacuguagaccaggcuggccucaaacucagaaauccgccugccucugccucugccucccgagugcugggaucaaaggcgugcgccaccacuccccagcaaugaagauguuuuaaaagugaauuaggaucuuuguuuuuaaguuaaguaauuuauuaaaacucaucauucacuuucauugguuuuuacccacagauuuuuguuucuaacuuauaguacuuucuuugacaaugacugauacuuccauuugcuuuaggaaaauccugggcaaauggcuaaaaauucagguacaauuauaauaaacauaaaaugauuucuucugucuuauucauuucugaacauuguuagaucuccucagaagauugucuaaaucucagaauacaguuuucuguggaagaauucaacucuuuuuggccaggcuuuuuccucuaucugagaaaucagguaaguuucuauacauuauauucuuuuuaaggaacucucucccaguuuuuauggaguaaaaucugucauaauaagaaaacuuaacauaaaauauugaaagcauuauaaaauugcuuuacuuucuuauaaauucgccagcucuauguaugauauagauagucuuaaauucaaaguuuauuaacagggugcuacugaaucauaguaauauguguagguaugaacuauucugucuguauucaauuucagaauauaagccuauucuguuuccauuuucuguuacaguaauugcuguuuaguacacaugaaauuccuuuaauuuuauaauuuuuuaaacaacaacaaaaaaaaaaccuuauuuuauacauaugagugauuuaccuggcuguguaaaugcauguguauaugcaugccaugcauauguugccuguggagcuggcauuacagaugguuacaagccaucuauguaauggcuuuguccucuguaacaggacagucucuucagccccuauuucacaauguuuuauuaugaaauguaacucauugcaaaguauguaacauaaauauaaugaugaagcaaauacuuguagaaccauugcuuggcuccagaauuggagccuucccugucuuuuaucuauucagauguacuagaauuugguaucucuuugauuugguuuuucccugccuuuaauauguuauugugaugauuguauuaaaaugugauaugcaugcaauggcgcgugcuuauaguaagcuuauagaauauguuaauguuggauuugugugcuuucuuuuugucaugcuaguucuagguuuucucuuucccagucauuucuugguuagucuuaauauguauauacuccucauucaucuguggucauugucccuuacucuuuuuuuuuuuuaauacagaacuuaucuuaguuaggauuucuggguuuuuuuuuguuuguuuguuuuguuuuuuguuuuuuuuugauuuuuuugguuuuucgagacaggguuucucuguauagcccuggcuguccugaagcucacuuuguagaccaggcuggccucaaacucagaaaucugccugccucugccucccaagugcugggauuaaaggcgugugccaccacacccggcuuaguuaggauuucuaauguugcaauaaauaccaucaacaguaacuuggggaagaaaggauuuauuucagcuuaaaacuccgucacacucccaucacggagagaauguaggggaagaacucaaggcaggaaccuaaacguaggagaugacacaaacuguagaggagugcugcuuacuggcuugcuccuuauggcuugcucauuuugccuuuuuucccccuuugagacaagaucucauuauauaguucugucugucuuggaacucacuguguagaccgugcuggccuugaacucacugcuucugccuccugagugcuaggauuaaaagcaugcaccaguacuauacccagcuuucuaacauacucugauacuagagcugcacagccagcaguggcacagcccacccccucucccccauuaaccacuaauuaagaagaugccaauaggcuugccuauaggccaagcuuagagaggcauuuucucaguugugguugccucuucucagaugacuuuaguuuaugucaaguuaacacacauaccacacacacacaccaaacacacaaccagacagaacuauaaucauauaugacaucucuuucaugaaaucuuaauuucucuguaauccuuguaugaaugaguucaguggcuuuaaaaugcuagguuaguacuagauagauuucauuucauuuguaauaaucuuaauauuuagucucucauucuuuguuauucuuuuuaaacuuuuuaugugugugugugugugugugugugugugugugugugcauguauauauauggagaucaaaggacaauuuaugggaguccauuccaaccuaccauguggguccugggaguugaacucauguuaucaagcuaagccauuucauggcccucauuuuauguucuauagacuaaucaguugucuagcuuuugaaagauaauuuuuucacugcuuuuaagauguucuuugauuuuacuaugauguauguauguguggauugcuuuuuaccuaauauucuuuggauuuguugacauuuuaaauuuggauucaugccuuuuaccacuucuaaaaguuguggugaugacaacuuuacauuuuauaaaugccuuuuuuuuuuauuuugcaucuccaauuauauaugaucuguucuuugacuguaucaguaguacgacaacuuuaugcuuauccugacuagcuuacaaauaaaugagauucauacuaugguuauuuuauuuggguuugacaguuacuguuggggguguggggguuaaucccuaaucuccuaucugcuggccuggcaaucuccccaacgguauaucucauauuugcuguuucuccugaccaugugcuuaugguccaucuccccuaauggaugcauccuccucuccuccuguuuuuccuccuucucuccuggcuccccacucuucuccacucccacccccaaccagguaacccaccuaccucuaaucccucuaguaauuaacuguagucaauuuuauguaaccaguuguuuuaaaucaaggaacaagguuugcaaacauuuguaaacaagagaauucacuugcaggccuagcccuuggauacagaauuuaccauuacaauacauagcagcagaccaaaccugucuugucuuuuauucuaccugcuugccuucuuauaugaauaucugucugucugucugucugucugucugucugucucuauuacacucuaaaucauuugaugugguucucauaucugggagaucuuuucacuuuuuagcuuuuuacucccuguugauacuuugaacuuugcuuucuaguuuuaaaauaugguaagcaugugucuauaucugaucauuucaguguguuguauuuuugugauaucuuuuuugguuuuaacuuagaaugucuuguguuucugauaacuguuguauuuuuuuuuuuucuuuuugguuuuuugaaacaggguuucucuguguagcccuggcugcccugaaauucuguagaucagucuggccucaaacucagaaauccgccuuccucugccucccaagcgcugggauuaaaagcaugugccaccacugcccggugagaagaauaguuuugagucccaugauggauaacuuucuugagagaagguuuucauugcuuguauauggugccucuaagaucagagccuucaucguccagaaaauucggcaccauacuacaguuuuucaauguugucuaaagauguagauuaaaagaugucuugauaagagaucuuuuuagaucauuuauuagauuuuucaucuuuuggggggggcaaaagcuacuaguagaauaacugaauuuccuaucuaauucucugugacaggaauuauaaggauaguauagauaucugaauacgguuauauaguaucacuagugucuaauacaauuauuaacacuaagaaauccauugcuacaguccugguugccagcuggagacauuagaauuucaucaccuugaucacuacuucccuuuccuauuccaggaucuugaugugcccuagucucuccagucacagucccuuagucucucuuaucucuugugacuuaacacauaggaauuaaaguuagguguuuuaagaacucagagggaacugauguaccuucucaaagcaucauuuugaaguugauguugacaugucuuauacugggaguguuauuaucacucauugccuaguuaagaugguaucuccuauuuggauugcagcuuuucccuuugugaucuguaauacuuaugaggaggguugauauuuugagacaacgcucacauugucuucuuuuccucuuaagcuuugucugcuaauauccaucaguggaucuugccugauaugaauauuauuaaggcaucauggcaauuuucuuacuuuuucuauguuuauuaauggugauccuuccauaaggggaaaguugucuucuugcuggcauguuaguuuaguuaccucuuuccaaaugaacuguggauauuuuauuccuuagauuauaaaugucauauuguccagacuuccccagcaauagcuuccagcccugugcuguagaaaugaaaugucccuagaaauggaacaagguaaaggucaccuaccccagaauccccuaauguaguuuaaaucaggcaugcuagcucauuugguugucucucuguccugguaauggagaccucaacaugcuggacuugggcagaauggucacucuuuguguuuauguacgauuugaguccaggguaucauucuucagcaagucauggacucuuagaauauguuuucuuuuccucacauaauuccuguuucugccacugggagcucuuucauagauuauccaggcucauucuuuuuuccuuucccagccuuggagucacccauuuuuucaaagaacuuuguauuucagaaugguaguuaaagcuaaucuggacccuaaauaaaagccaggaucugaaucuacgauacacuuauugugagacgcucggcaggcagaacaaagaaagcuaaauaauuuggccuucuuuauaauauuuuaauucauuuuauucuaucaaacugaaauaaaugcuuuaggaaaauucuaaauacuauauauuauguauuuuuguuuugaauuuugggaauaaaaagggcuaacucagccugguauaguaucaaaugccuauuucuagcacucagaggcagaaaacugacagugcauuuucaugaaaaucucuuuccacaggucuuaauuugcagagucaguuuaaccuggaaaacgucacuguuuucaauacaaacgagcaggagagcacccugggucagaagguaaggcugaccagaaaccuucuuacagagcauacuuagacguuuuaguuaagauaauugauguaaauagggucuuuaaaucaccaaaaauuggaagaccuuuaacuucauucaaaauuguuuguuaguuuguguguacaugugcacguggggagaggacacauggaaauuagaagacaguucuguggaauugguccuacuuuucuuccucugugaaucucaaggauuggauuuggguaacuaggccugcacagcagaugaauuuaccugcugagaaaucucacuuggcccuucauuuuuaauacauuaaauuaguaugcguuggguguaaaaauuucaagcaguauuuagaguucaaaggauauugacuguaaucagaauuagauuguguuguuacugauuagcuugucuucuguuaaaguggauguuagagaagggcucagcucuuucauguacauaaccauaagguaacuagagagggaaaguguuuuccacuuugaacauuauuuauggucuuuacauguuuucuguaaguauguauuaucucuauaaccaccccuaauauucuccaucuaaucuuuuaagacuuuuuugaguacuuguacaaaguaauguuauuuuucccaaauaagauacuauauaaaguucuuaaguucauuuucuuuuuuaaacugauauguuucaguuuaauuacagauuagauucuagaaugaauguacccuaauuucuugucaguagacauuuaaaucaucuguuuuguuuaauuuuaagccagggucucacauaccccaagcugcucuugaauucacuguagcuggagauggccuggcgcucuugauccuccugccuucaucucccagugcuggcuuguguuaccuugccuggcucaaguaguguguaguaguaagaaauuguuaauauuacagugaauuguguguauaauuacuaacccauguuguaucuccuuaggauaagugaaauugcuuagucaaaguguacaucauguauuucagauuuuguuguuacuucucagaaaaaguacauccauauauauuacugccagugacaagggaagacugccugugcauuuuucuacggcauuaacacccauguuagcgucuauucuuuaguaguaguaguaguaguaguaguaguaguaguagacuauuuguuucagugaugaaaaaauauuuggagaauaaggcagaucuugugucuuuacauauguccaugcuauguuauugucauacuacuguugguuuccugucacccaaaaugccauugccuuaaagaacaauuacuguaucuaggcuucccuaauaauaauguguagcaauauagaaauuacuuaaccuauaacaugucaucuuuugcucagugacuacuucaugacagaauggguuugguuuuguuuuauucagcauacugaggauagagaggaagggauggauguagaagaaggugaaaugggagaugaugaagccccgacaacuuggugaguuuuuagagcuuaagaugucuugauuuacaaagauaacccuuuaaugagauaucaaauacugaaacgaagauacagacaggagggaggaagucgugcuuauaggauuuucuuauacauacccuucguguguguuaaauaaaauaauaaauccugagucacuaguaggcuguuaucaguugccuucuaaauuauggacaaauacuuugaacuguuugagcagcccaucuuacacauacccuagccauggcaaccuuagcccccucuucucccuuccauuaaacuaugguccugguacucauggugaguguacugacauaauguacugacguaauguacugacguaaugacaugcaaagaacuggaagccucccuuucucuuucucuuuuucuuucuuuuuuuuaguuuuucaagucuuuuucuuaucauucuuuucuuacucugugaguucugagucuuuguugcagguaguuucuuuauugugcuaguuuagaagaggugaugagaagggggaccagaaaaccaaaaucuuccugggcugucagaauaguacucuuccaugucugaagcaauaggccauacugucaguuguaaaugaaagaauuucuauaauugcugcccagaagaucaaaaagggagagguauuucugauaucccagauuucaaauucgauccuauauucacauaggaagcauuuagaagugauguauucccagauuuaacucuagugcuugcuugcgggucauaugaccuugaacaagguuuccuacaacugaguguugguuccuuuaaaauguagcagugcugccuacuuacuacaguuguugaaagcauucagaaagacgacgauaaaaaguggucuacuaaggcacuuaguauuuuucauuguaguugcugaugaaacauacaguggaaaucauaaagcacacagaaaaguaucucauuuucuagucauuuucuaaccauuauucauuauucuaguuguggcuacucucuuuauagagaccaacuuguuuacauauaucauggauaaaauggaccuuuagggucugucugugcaacucugggcaaaaguaguagguucuaagauaaugaguuaucugaaguguaaauagacucucagaaauacucugcuagcuagucgcugcuuaaugcauucaggucuauuguuguaaggucauaaaguagcccaaagggcuggcaaagauggcccaugaguaaaggugccgcugccagcuccugauagccugacuuugauccccaggacagaaaugguggagagaacuaacuuguacaaguuguccaaggaccccgccacuuguccuauggcacacuccuguacauacacacuaaacaaauaaauauauaaguagaaaacuaaauaaacucaaccacaggaauacuguuuaaauaggaucaggcacuuggcuaucuuugucuauuguaaauuauuuuaugaauggaggaggaaaguguauggagaauuguaauucuuuuuuuuuuuaagauuuauuuauuuauucuauguaaguacacuguagcugucuuuugacauuccagaaaagggugucaaaucucauuacggaugguugugagccaccaugugguugcugggguuugagcucaggaucuuuggaagagcagucaguguucuuaaccacugagccaucucuccagcccgagaauuauaauuuuuuuuuuuuuuuuuuuuuuuuuguagaaaguaaacacuuuuuauugagccaaccaauagcaucuaaacagguuuaggaaaggugauuuaauuuugauaacugaaagguaauuuuagacuugcuacgagaauuauaauucuugaugaguaacugaguuaccaguuagucuuucccccucagcccccuguuagucuuaagaagugaauuuagcugcuggagagauaguucagauguugaacuuguucuuauagaggacccagauuugguucccagcaccuacaugguggcuuacaacuauauaauacuccaguucuaggggaagcugaugcccuguucugaccucauaguacacacacacacacauauauauauauauauguauauauauauauauauauauauauauauauauauauauauauauauauauacauauauauauauauaugcaaaacugucauacuauuaaaauuaauaaaccuaaaauaaaagaacugaauuuauggcuggacaugguggcacacuucuaaucccagccuuuggagcuaaacaagugguucucuaugaguucaaggcuaguaguuugguuuacauagcaaguaucaggccagccaggcuaaacauugagacccugacucaaaaaaauagaaauaaccaccaccauaacaacaaaaacuggauugcaaaguaaauauauuaccauaaauuuguaaugugaagucuagucuagauauuuugauucaaauaauaaauguuuguuuuucuuuuuuuccccuggaccucuuagcuacagaaauguguaagcuggggauugaacccagguccucuggaagagcagccucugagcuaccucuccagccccugaauaaacauuuuuauacuaaaauuaauauauaagaguguguaaaaugguucggugggccaggaauguuaguguaaaccuuuaaucccagaaccugagaggauuaggcuagaggacuggcucgaauuugagggcaacuugaguaauauaguaagacuaucucaaaauaaagacaccaaaaauguucaacacuuuuuuaaaaaaugguuuuugaaacauuucaguuuaagauacuuagguaacauucuauuuuguuguucauguuaugauggcuauuccuuuguuguccauauuguucuuaaaauucuaagcucaagagaccuuccugacucauauccagaugucuggguuugacugaaucuuacuucagacauucuauuuuagacaguaacucuuaccucuaauuuguuauugcuuacaaauguaguaaguugggucuacugguacaggccuauaauucuagcugcuuaggaggcugagaugggaagagccaagguucagaguaggccagacccuacuuaaacaacuucccuauggaugaguuuauguacuuuuacauuugugaauuuauuuguuuaguguguauguauaugcaugugccaacacaaaagggaagaucagaggacaccuuguggaagucgguucucuuuuuccauuauguggguggaaagauagcaaaaaccuguccuuaaaaaaagcuggaggugaggguggugcaugccuuuaaucccagcagaggaaggcaaggcagguggaucucugaguucaaggccccaggguuucaaagaggaacccugucucaaaaaacaaaacaaaacaaaaaccaacgaggcaaaggaugcagcucagucguugagcacuugccuaucaugcaugaaauccugggcucaacccucuguuccauaacauugugcgcaugagugugugugugugcgugcaugcaugcgugugucauauaccuuguguggguaaauagccaaucuguacguuucuaaagaauaguacaaguggacaguaaauugguauuuggcguguagacucuuccaaguuuaucugaagagcuggagguauagcucagugaaacucuuaccuagcaaacacaaacccuagauucaauacucaacaccaaaaaaaaaaaaaacccaauuaauuuagccaugaaagaauauauccagccaaggggaauauaaccaucaagugggagauguuuuagugccucaacuauaaaaguuucuuaguguguugauauugcuugaaaauuuacucuggaaagggggcauaucucaauggcaaaguauuugcugaguuugauucccccagcaccacagauaauaaaugaaacugauucuguaaagccaguaaagaagaagaaaauaaggagaagaacuuguggagaccuaaguuugaauccucagaacccauguagaaccaggcacuguagcgugcaucuguacucccagagcuccuacaagagaauaccuggaagcucacagaccagcuaaccuaguguacacugccuugaagaaaguggaaagcaaacaccuguacccaacauguugucuuccaguguccacacauguaccuacaugcauacccaaggacaacauaugucauaaauauaacauacacaugcacacacaaagaaaaauagcuaaaaacaaaagaucccuuuuuaaaaaggauuuguuuggccgggcaguaguggcgcacaccuuuaaucccagcacucaggaggcagaggcaggcggauuucugaguucgaggccagccuggucuacagagugaguuccaggacagccagggcuacacagagaaacccugucucgaaaaacuaaaaaaaaaaaaaaaaaaaaaaaaaaaagauuuguuuuuauuuauauuuauauguaugugugucucuguguagauauguacacaugagugcaggugccucuggaggcuagagaggugucccggugucccaguccccuacaacugaaguuuugugcaguuuuuagcugccuuauaugccuaauauagcugccaagcugaacuccagucuucugcaagacacuaagggcuguuaaucacugaaccaucucucuagcccuuaaauaaacaaaauauccuuauuggugucaaacauucaauuauauuuagaucuucuaguuacugagacaaagaugagcauauaaaugguugcaugauucucucugccagagauaaccuuccauauuuucuagaagaauccacuggucccacacaguaucauagccaaacuggaaguuaagucaguaaggccauagugaagucacuggagaaagggcugcuuuugugaugcugacuugguuugucccguacacaucugucuuguacuagcauuauccacuuacuuuggguuaagucuagaaagaggcauuccaggauaguacuuacucaugguauccuaggaaacucauuucuucucacuguuuuucagcauauguuuguccuuuucccuuuagugcaauaaaacagaugguaaaacauggcccacauauugcacauaugacuuuuuccaacuaacuccgcauagcuacuccuagcauguuuuccaaacccuucagacuguuucuaaaaguuuaugucauuaauuuuuuuaaauguauacuuuuuaggggaaagaaacuuuuuaugagcuucugugucugucaaauaauuuaagugauguaauacaguauuuauuuuauaguucuauuccaauugauuacaaccuguauagaaaauucuggucacuucaggauuacuucaggaacccagugcaaugcuaugagaagauuucuuggaaaacguuucucaaggugagucauaggccucugaagcugacauuucucagguaaugacagggguagacuuugucuuguucaaggacuuuucacuauagaacuccccgucugaugcuuucauaccuauucuauaguauacagaaauuaaguuguaaauugauucuuagccacugauuuuuguaguauaguuuuuaaguggcuuuagguuuaaagguuagucauuaaagccucaaggguugauuuuuuuuuuuuuucauaguaauugcuguccacauaaagugaugauuuuguuucaggaugucuucuguauuugaagugcuuuuguaauuuguguaaguugugcuuuugaagagcacacaccaauauuuauugagagguagggagcagagucuacagaagcgagaaagcuugaaaaaaguuguccugcccaacuguuguuuuauucuaguuuuccuuuuaaaacagacuucauaaaacgauugccccaaacuaagucagucugcuuuauaaaaagguuuguuggcuuacagccaugaagguucauuuaucugugguuuucuacagugugguggcagguugagcauuugagcugacaguauacaugccacaaagcccaaauacuugcugucugcaccuuuacaaaacauuugccaacccuaucuuaaaagaaucuccauaugucuugucgacauggaagacugugauucaaauaaaaaacauagauaauuuuuaaagcaacauaaguggucuguguucauuuaucuuagaggaaugucaccuucuaaauugagauucaaauggugagauaagggagucucuucuugggugaauuacaucuuacugauuuguuagucuuagcacauaaaauggcuuugaggguuccauagcuaguuaaacaaucacuuuuacugcuaaguuuuuaaaaguucuuuaacaguuuuaauacaugaauuuuagguauuuuuaccucguuccuuuuuaucaccaccacucccaaaacuuccuucccagcaaguuuucuuccuuccuucaugucuucuuugugcaucugacccaacuaaguuaaugcuuugcuugcaugcaugugggaggaguuacuuacuggaguauagcagugaauuaguggcuauacccugaagaaaaugaucuguucuccccaauaaccauuagcugccagcagacaugcaggggaagggggcuuaaggguucauccccaauccgugaccaagugcugacaggcaggcccaguccugugcaguccugugcagguaaccacagcugcaaugaggucuugaguacagugucugugucuuauccagaagguagcuuuuugcugcauuucucaccuaguccucuuaccuuuacaucuuucagccccuucuaccauguucucugcacuuggugauaaugacauauauguucuccuuacgguuugagcucuccacugucacuuacugucacauuuuggccauuucccauccccugcugcaguaagaggcuucucugaugaaauccaagcacagcacuaguuuguucacauaaacacgucuuuaggaugcaaugacaucauaaccacauaacaaaacaauucacugguaaauuuuuauauauaaucaucucuucauaucaguagguucuaugacaucaguuauccauagauugaaaauauuuggaaaauuugugccuauacuaacaaacacgcagacugauugcuuauaaaaguaucuucauagcauuuacauuagauacuacuuguaugagaugauuuagugaacuauaacaggaggguaugcauacauacugugccauaaaugagacauuucaguagcuuaauauuuucuuaucccagagacagaauugagcagauacucacgggaaaugauuaugcuaucaagauauauccuuuucuguuugcugcaaaagucuuauaguuuuugagggauaguauuuauuccugcuuuuaaauauuauaaaaucucauucaaaaguacuuuuacuccccauguugcuguuagaauuuuuuaugccuuuuugaaaauaugccuuauauuauacauguuaacugggaguaaauucuaaagcauuugaugcagaaaaccaccgaaugaguuuuucauaacaaugucaaaggaaacucuuuuuuguucuuugcaguauucugaagaaguuuuagcuguuuuuaaaaguuauaaauuagaugauacucaagccuccaggaaaaagauggaagaauugaaaacaggaggagagcauguauacuucgccaaguuucuaacaagugaaaagguaugaugcuccuuugccacugaggaugaggcauuuuguccuaaacgugcagucuguucauggucaguaggauugcuguacuuacagccaagauugguuuuaguuugagauucccauuucuuacuuggacaagacuaauuuauaacagcguuauucuccauuaagucacuuuagaagacuuacuuuagaaccaauguaccuaauuacuaugaaguguauauauuuuaaauuuuaaguuaggauauaauuugcauuuauaaaaauauuuugcaauucauuuauuauauaguuaaaacuaaggggcuuuaaaguucccuguuuuuauaugcauuucagugauuuuuguucaaaguggcacaucgaguuuguguuuugacuuacuuauuuauacuccuuuuucugaaaauauacaggaaugacaaguaaaguauaaagagagcaccaaaaagaaagcugugcuuacagaaauaaauaucuucauagaucagaaaaaaacaaauuaugcccagugguaguggugcaugccuuuaaucccagcauuugggagacaaaaauaggcagucucugaguucaaggccagccugcucugcagaauugaguuccagcacagccagggauacacagaaaaauucugucucagaaacuaaauaaauaaauaaauaaauaauaaggaaauagcaaguuaugagagugaaacugaagccauggcccauuagacuauauccaaagcagaugguggccacacuguuugauugcaaguaacagaggucaagugugcucccuguuggaccagaguagagccacguacugcuggaaacugggacuauuguagaauuuuaacguauauuacugauaccugccaagagcaaugauuuuauaggaaguuaccagcucaggaauaacaaagcuauagauuugucucauaucugcuuacucaaugacugcauacauaaugccaccuaugaucucauaaagcagcuacucccagaagucagaauacuucacacuugggcucuugggccaugauugauauaaaugcaaaaacuacuugauaaugauguguguacacagugagaaaaugaaagugaaguaaauaccucaagaaaagcuucccauucaaacacucuaauuaaaacuccaaaguuuaggggacucaaguuaaagaucacuaucaaaaacuggacagaugacucagcgguuaagaaaacugacuacucuuccagagguccugaguucaguucccagcacacacaaccaucuguaaugggauccaaugcccucuucugauguuacucauauacauuuaauuaauuaauuaauuaauuaauuaauuuuaagaaagacaagaaauuggaaaacagaaauggguauaaagacaguagaacuuuuuuuaaaagacaaagccacuugaacaucaaagaauuggcaggaaaaaguauaaaguuuaaaaauguacauaacaaaggaaugaaccaccaagaacugacuuacacuaacuauauucuuaaaacaguaagaguggggggcuggugagauggcucaguggguaagagcacccgacugcucuuccaaagguccggaguucaaaucccagcaaccacaugguggcucacaaccauccguaacaagaucugaugcccucuucuggugugucugaagacagcuacaguguacuuacauauaauaaauaaauaaaucuuuaaaaaaaaaaaaaaaaaaaaaacaguaagaguguaaaauuaugugaaguugguacuuucauaauuaugauggagcuaugugaagcggcuggguuagggauaaaagauugggaagcauguggaagauugaauaacagaagcacuaaacuugauagaauacaucuggagaccuguacaaaacagguagugcugcuugggugggguggggggcggcauucacaaauauauguauaagaucacaagggaagucuuagcaaauuucaaagauuacauacuguacuaaacacagugucuggcuacaguauaauuaaauuuaaaaugaaacaaaugaaauuuacaauaacuuagaaagaagcauauuugguagcauaacucugcauucuuggaaguuaagaaaucauugcagagcuaggcuuaguuguaugucauuuaggauuuuauuagcuuugguucugucugucugucugucugucugucuaucuaucuaucuauccauccaucuaucuaucuuccuguauagcccuagauggucuagugugcucagaagacagagguaggccaaucucggaguuugaggccagccuauucuacauagcaaguuccaggagagccagggcuauauagcaagaccuugucuuuaaaaaaaaaaaaaaaaaaaaaaaaacccaagauaaauuguuuugacaaagguaugagaaaauaccgauucaacauuuuaacaguuuuaaguguuaaaguuaaaaaugcuuauuacuaauugcaccuccuagagcagcaguucuuaaucugucaguugcagccccuuugggaguugaaugacucugucauagaugucuuaguuucuauugcugagacaaaacacaauaaccaaaaaacaaguugaggaggaagagcacacacacacacacacacacacacacacacacacacacacaauuuguuuuuuaguuccugaaccuaaagcuacauguauuuauguggguagauuucaaaccuaguauugugugaaaauagcaaauuacagaacaaugaaugugauauaguuugaguauaucuguauaguguuuauagaugccacauauauauuaauguuauaaaauaugccuaagaaucauaauuaccacuaggcagugguggugcacgccuuuaaucccagcacucgggaggcagaggcaggcagauuucugaguucaaggccagccuggucuacagagugaguuucaggacagccagggcuacacagagaagcccugucucgggaaaaagaaaaucauaauuaccaaacacaugagaaugguugucguagcaggagaggggaauaggaauauggaggguauuaggcacuaagcaguuucagaauguguuuuuuuauuuuuaaacaaaugugaaacaaguaacuaggugguaauaugugaauauugaacauuugugccuuuuaaacuuuugaaauauuuaauuuuagaaggaauauuuuuguuucaugguauuauuacaguuaaugaaaguuuuaauaaugaaaugcacuaaacuuuuuuccuaguacagauuuguaaaguauuuuauguugaauugauagaaauggaagauuucagauuuagccuuugcuuuaccaagaauauuucauggaaauuuuucauggaaaauugaugacagcauaagugauccaauaugagccauuuuauguuuagaauaaugugaggcaagcugaggccugagcuaagcaauuagcaaaagucaagaaguauaaaaggccuuuauucuagaaacaaaaauguuuacaaagcaauauuugauccaugacacaaugaaaauggcaaccaauagaaaaggaacuaaaaaaauguguaaauaauguaaaggaagaguaaggcugaagauguuuagucucugcuggcacuggcuggcucguagauuuaaauaaguaguucugucuucugagcuucaucucccucagaauaugguaagcaguuagugugcauggucacgcagucucaucucagccugcgcugucuaguugagugcuacuuuuaauccauguuccuagcaauaaaaguuggcuuccagcaugagauaaaugaagaagguaaaugugguaaagggcacuuagaaaugaagacaaagaauuaguaaucaccuccuccccacugugguccucucucaguguucuuggugucugcuuuuguguucugcccuuguucuuuuauucccuuaauuugcugcuggggguugcagucaagcuacugcuuccuccagaugucuucuuagacaaauggcuauugcuuugguaaguggguggugaauuagccaguucuaaagaacuggccuuaggagaaaaacugaugcuuuguuuuauucaugaaccagauagcaguugaacaugaaauagaauuguugagcagcuaaguauaugauucuggagguuuggaacaagaucuggguuaacaguauagauuuggaauuugauucguuuuuaaguggcaaauaauguauacaauauaugagaucagcuggaaaguguagauuagaaaaagaaguguggaaccaaagucugaagaaaaccaagacuuaaucaggaggaaagaggguggagagacuaggaaauagaagacuaaggcuguggaggcacuaagaaaggaguggggggauguagaagauugagaaagcaggaaugacuaguuaaauaggaaagcuugaguuuaugggaaccaagcaaugcccaguagaauaaaacuagugcucagacuuauauacucagcauauauucauaucagcauagacucauuagugaucuuagauacagaaugguaagaaagacaaaucagagcagguaaaggacaaauugaaaaccauaaauauagcuguuucuuuuucuuucaucuuugccauuggggagggugaagaaaguauggugagguaucuuucagggaggcuauuuaauaucaacaaaauagaacuugggaagaaggaagagagaguagaagggucgggaggcagggguaacaaauggggcuugguuagacugaggcacacaaauaaaaggauuuucuuugagcagggagggagaugcaacagaagcagaugagaaagcaggugcaggucuagguacagcuaaguuuuccuuugaggaggaagcaagaaauuaaauggguucugauuaaaugaacuuuuuugcucuuggaaagcaaauagaaauugaggggucaaaauggaauacgagagauggcuuuaaagaauaaagauggcugaguaaaaugaagauauuccucuuaggacaucaguagaaacaguguuuguccagccacgugauuugucuauuuguucaaacaacuuggcuuuuuaucuggguagaaccguaggguugguauaaagaagguaguuguuauaaucaaguugugggcuucguaggugugauagacugugguacaaaagaguguucaguaagugguugaaaaugguuuagccaaaucugacccacuaauuacuuuuuuguuuugcuacucuauuuuaagugcuuauguauuuacacaauacuguuaauauauuucuuggcccacaacaccuuaaggaaacaacuaaaccaaaauucaauuauaauaaaaaaacuguaggauucacagauaaacaagggucugucuuaguaagacuuaaguauuagcuacauugggagcaguucagagugagcccugaaaggauaugagauuguaauugcuccuccuguacaggacugugagaguaagacuccagagcugaaaugacugaguggucaguagucuaacuugugacuggaacaaacaucaaaguaaaagggcugugccugucaguuggggcagaauccagaagcuaagagccuuuauguugccaguaaagucaguugggaucuagaggaaaggaaaaccacuggugugccauucacauguggagggugaauaugaaaaauaauuuuggaaaacuaaauugcauuguaacuguauuacagaacauggagcagaguggaccugaggaucaugaaugaggauauucucuaggaauccuaucaccuugcugcuucuacuuugagagugaguggugguaaaaggaaagacauucugauaacaacccccagacagagggaaucaaauacucacuucccaacgcugaagaaaggccaguuauaauaagacaacagugcagcuuguugagucaugagugugaaagaaggugcuaguaauagaacacccugguaugugauggaagaaagaaaagaaaggaaaaggaaagaaaagaaaagcaauaagaaaagcaaggcaaaacuacaaguguguagaaagucuuuagcgauccuugagcucugucuggggguuguuaucagaaugucuuuccuuuuaccaccacucacucucaaaguagaagcagcgaggugauaggauuccuagagaauauccucacuuaugauccucagguccacucugcuccauguucugugauacaguuacaaugcaauuuaguucuccaaaaucuaaagagaagcagcccauuuuuaauuugcagauaauucccuccuuguuucugcucgcuuacucaaccccaucuguuugcagggcuagaaagugaguggugcucuugcugcucuguucuugggcugagcgaggaggaagcuuucagcauuuuuuuuuugaaugaaacagaaucuuccauuucuacaacuauauaauuugugcuuuuagucauacuugguuuuaauguguuguuuuguguaugugcuuauauuuugaauaguugauggauuuacaacugagugacaguaacuuucgucgacacauccuguugcaguaucucauuuuauuucaauaucucaagggacaggucaaauucaaaaggugaguuaauguguguagcauauaaacagugacaaugagaagaccuugcaaagaauuuuucauauuuuaggccacagggcuuugcuuuugggggauguuuugguuuguuuuuuauuugguggggugggggguguuguuuuggagacaugguuugggucuguagcccuagguguccugaaacucgaucuguagaccaggcuggccucuaauucagagaucugucuggcacugccuccccaguacugguauuaaaagugugcgccaccacugccuagcauuauuuacauuuuguaauuaaaauuuacuauuacagggaggggugccauggugcaccuguggaggucccaggacacauuucaaaagucaguucucuuucugucauagggucuagguauggaauucagguugucaaauuugcacagaaagagcuuuuacccacugagguaguaucucacuggcuacugcaugccuuaaaguacuaaugcuacagcaaccagacagcuaacugggaacuuuuagauguaugauauuuguuuuagguaaagugucaaaauauacauuugauaaugugagucucugcagaauccuagacuuucacaguuuuucuuucuagugcguagaagucucuguuaccucaccuaggcaucaugcuaaauuguaaacuaaggaaauaacaccuuccaauugcauaaacuuucugggauauuagaacugaaagaaccaaagaaaaucuugaaacaaaugugaauucuagggauuaggaagauugcucaguuggugaagugauugauaugaaugagaauccaaagucguucuccagcaccuacauagucagguacaagacacaucuuguaaucucaguguugcagauguggagacaggagaaucucugaggcuugcuggccaucuagccuagucuagucaucaaaacccagaucucaauaagacacaguuuuuucacaaacaaggugaaaagcacuugaggaauaauacucaggguugaccucugcccccguacccccuacauacuguucucuuguuuuagguuuucauacaaccuugucaggaucuguauugugucuaaaccccuccaacaaaaagcauaccauuuauucuugucuuguccauaacugaagccagaauccuguugcuuguacacaaaucggugcaauaugaaaugcauaaaggccaugccauuguugccugcugaacccauaguccuguaucagcaguaccgcaguuccuucagaacugucauuaaguagcacacgguacccaaccaaaauguaauuuuuucuucuauuucaaaguuuagugugauguagaaagaucaagagcuugaaaucagacauagguugaauuaaagcuuugggcguuggggaagucaccgaaucaauguauucucuuuaaaaugugcauggaaugguucugcaguugguucugcauauggaguaugauacauauagaauaugauauguuaaugcuuucucagauucuuaucucuccuaaauuuaugaaauauuauuacucuauagucagaccagguaauugaaugucuuauuugccuuuauacuuucaugacuucaauuuuaacacuugacaaugaagugcaagaauuuucucaauaauucucauguuugucacaguuguagguaauuuuucacacaguaugauuaauuuaaggugccaugaauagcuucaauauaaaaacauaugcuauaacuuagacaugcauuuguucuuucuuucccuaguucaaauuauguuuuaacugaugagcaaucacucuggauugaagauacuacaaaaucagucuaccaaguaaguccaacaugcaacaaacccaugauugaaaaaauggaaauuuagaauuuucuuuguuucagccccaaauaggaaaauaaggauaaaguuaagcucagguacaagaacacaaacacgucuugguucucugccuacaaaccacuccuaugaugcagaaaguuguugaaaccuuaguauauucuuucuaaucacagcugcuaucugaaaaucccccugauggagaaagauuuucaaagaugguagagguauguauucgaucacuaguuuucuuacuaccaaguaugauuccaaaauauuuuuauguagauauguaugucuuuuguuuauucuagcauauauuaaacacugaggaaaauuggaacucauggaagaaugaagguugcccaaguuuuguuaaagaaagguaaauaaucagcacaagaucaggacgcucgcgagcgcgugcacaggacacgcuggugugacugagaauggcgugucuacuugcccuauaaugugcuaauucugucuucugucugaugacuguucuaucacaccaugaagauuuuguauuuuaggguaaaagcaauauguagcucacuuguucucuuuuuuuuuucugauaguuuugcuguaaguaggauuaaaugaauccaggagcuugugcacauuaggcaaaugcuuacuacauauccauauacaguccccagaauauguauguucuguucacagagcgucagauaccaagcccacaagaguggugaggaagagagcagccccagaagacuucuuaggcaaagggcccaacaagaaaauccucauuggaaaguauguccuucauuuuccuauguuccugauuguucuuuuuauaguuugaaaauauuacuacaagaacucucuaguuaggcuaaagagauggcccugcuguuaaggcuaggcaacuacuuaagccuuccuguugucucccacuuuaaaagcccuuggcucuaggcuguaaucuuuucuaggccauggacaguauaaauguuugggccagugcagcucacuuauauuuacugaaagggcacugaucauucaguucaauucugucaccuuccaguuaauucuccauuuuuuauuauuauugaauaguuucugagaaaugguuaucauuuuagacuaggggucaccacccccagacccacuacucauguuaaauacgcaguuuuaugauguccuaugagaaugcuacaauacaaacuaugacugccuuauuuuguagugaggagcucacaaggcuuuggaaucucuguccugauaauauggaagccuguaaaucagagacaaggcaaguguaaaacuucuguucguuuucucaguguucaguaaacuauaauaaaaccuuuucuuaggaaugaucaaagcuuaaaaguuuauugugguuauuaacuuugggccuggcagaauauaguuuaccuuaaaacaccuagaaaugcugguaaauuuuuauaggucacaagaaaauaaagaaaugggaacucaacaccaaaagaauaauuuaguuaggaaugauuugauauuccaagugagcaagcaguaagaugguccaaguuacucacagagaugcaggagaggaaccugaguaugguucccugguuuaaggagagacacugccugcaaaggaagagaagcaucaggagacaagaacaguggaaaccagaaagcuuguuuguuucugcuagggguuuucccgagaaacaagaacaugucaugcagcugacauuucuaguaccagcagcaauugggaacccaaggcuaaaauugucagcuaggaaauccuaggcuggugguaaacucucugaaggucagaccuucagauggagcuauuaacaggaaaaagccuaaaaaauauccagcugggcgugguagcgcacgccuuuaaucccagcacuagggaggcaaaggcaggcggacuucugaguaggaggccagccuggucuacaaagugaguuccaggacagucagagcuacacaaagaaacccugucucgaaaacaacaacaacaaaaaacaaaacaaacaaacaaaaaaacccauccaaauuuacugucaagggaacaaucuaccaugaguuucauaaagaaucuagagagagauggcucagugguuaauaaugcuggcuauucuuccagaggacccaaguucuauuccuagcacuccuucucuccaguccuaggggauccaacacccucuucuggcuuccaugggcaccaaggacacacacaagugguacacagauggacaugaagacaaaauacucauacucauaaauuaguagauaaaacuagaaucagauaaaggcuguaaaauaaagaaguagcaguuaaaacaagaaaaacuuagcacugucaaaaaggaccagauaguuggguaugguggcucguuacuguaaucccaucagcugggagacguaagagacaauacaacacaaagcugagcaaaagcccagcagagagagcacacgaaugugaaagaagcucuucuuaagaucaggacuaaauaggcuuaauucguaaauucuuuggcuuaagauaucugggcuuuagcauuaaauagauaagccagaccugucuaugugaaaaaugaagggugagugaaaagagaaaacaaaaguaaaauuaaacuaacagcagacuucaauaacaaaaucagaagacaggaauaagagccucaaagaguuguaaagacagaguauguaaucucuaaaauaaaugaggagugcaaagguacauagggagggagggagggaguggggaggaagggaggaaggagagaggggagaaaggaaggaaggaaaagaagaaagagagaggaaggaaggaagaagguaggaaggaaggaaaagaaaaagagagagagagagagaaaggaccaaagguacacagagaauuaaauucaaaugaacaaaaaucaggcauucuggugugaagaaagauugauagguauuuuaaauuuuuaccuacauauugauuauaaaacaccauaaagacaaagauaugaccauguugaaacuaaaagaauaaagguaugauaggcagagcuuaucagaucagacagaagucuucaaaaaugaauaguacagucuaucacagugcaugguuugaugaaauauggagugaaucguuuuuagaccuauaccuucuuuauugucccauuuuagaauugagcuuucagucuuuauguucucaaagagaucuagagucccugcauuuaggucuuagauguaauuaucacauguggaugcuguuaaaauuaauauugccaccauuuuagaguacuacacauaaaccucacuguuuacuuuacaaugaccagagaauacaugccaacuuuggaggaguucuuugaagaagcuauugaacaagcagauccugaaaacaugguugaaagugaauauaaguaaguaaugguauacugaaaugaugcuaauuucagcauguuuucuugggaauccucugaaugcuacaguuaagucagcaaaguagugcuuuuagaugaguuuaugcaugcaguucacauuacuauaacauccuuauuuccaugucaauuccaaaacaugacagaauaaccccucagcccucaccccauaccuccuucugaccuucaccucuacuguuuauucuccacaagucuuuucugcuagccaauuuagguuuugaccucguuuccucaccagccucccauucuggucagcccacccacuugagacuguguucccuaucacuccaguauucuuuuuuuuuuaaggucccaacagcaucugucaauagaccugucucaauuuugguggaaccacucaccaucaccuugcugcccccuccaccugccuccacaccugcugucuuacucuaaauuccugcaguaacuuuuaagauucagucuuuucucuaaagugucccaugugacagcaguuuuaguuuuuaggaagcuguucuggaauugugauuuaaaggcaggggcccucuugucaaaaugcauagguucucuucccguguaccacuacuggccaggcucuaacaaauaagcccugugccacuuuucucguuugcuacaugguaaccacucauuucacauucugaagauuaaauaacugauuuugauccaugcauagcauguaguuaguacaugacauagcuagcuuugacccugugguaaguuuuuacauacuccaaccucuuaauuuuguguucuauucuccuugcaccagagugaucuuuaugggcuggagaaaugacucagguuaagaacacuaacugcucuuccagaagauccagguuucauccccagcacccacaugguggcuaaccauccaguuccagaggauguaaugugcucuucuggccuucuuuagcacugcaugcauaugacacagucaugcaggcaaaacaauacacaauugaauuuuuuuuuuaauuuuauuuauuucuuauuagauauuuucuuuauauacauuucaaaugcuuucccuauauccccuucuccccugcccugcuccccuacccacccgcucccacuucuuggcccuggcauuccccuguacuggggaauauaaaguuugcaaugcaaaggggccucucuucccagugauggccgacuaguaaucuaaaauagauauacacaccuuuaaucccagugccggugauuucuuugccuggucuauacaguaagaaccugccuaagccggugauggcgcacgacuuuaaucccagcacuugggaggcagaggcagguggauuucugaguucgaggucagccuggucuacaaagugaguuccaggacagccagaacuguacagagacacucugucucaaaaaaaaacaaacaaaacaaaaagaaccugccuaaaauaaauacacaugugcaugcaugcacagcagcaggcuugguuagcacagaccuuauaauccuagcacccaggaagcugaagauuaaguuugagguuaguguggcuuacaaagucuaucaguauaauaauaacaaaguaagauaugcccaagucucaucucaugcuuaaaaucuuucucauacuuaaaguuaacuguuuauacaccacuaaauaaaucagauugcaagucuguauuugggguucccgaggugggcaaauccuaaaaaguccuaaguggaauccauuuguacuugcugcaguucugucauuggugguggugggagugggguguuuaagauuucucaugggucccuuguuucucgguuucccauucuauucuugacaucaguaugucauuacugcggccacuggauauuuacugcuuuagcauucugagccauuuuuuaauucauugagguugauguuaauaugaauuaaagauuagccauuauauaauacaacucuuaaauacaggucccuauuacaaaauacuugaagcccuaaguguucuuuuuccagauuuguaacauuuuagacuuuagcaaguaagacaaauuagauuuugaaacauuuaggcuuuagauuaaacacgcaucuauagguaacauuacagauaauggauacaauuaucuuuuucuuuucuuuauaacugggugguuucuaugcauagugucuaguagccaggacuagggacauaagaccauugacuugcuaaaauaaagcaaaauauauacuuucaaauuauaagaugguauacuuugagcuguuauuugcaagagagcauaaaauuuugugacacuuguuacaugaaaauaacuauggaacugaguaacuauaaauuacaaggcugacaucucuucuuauagagccguaaauaauucaaauuauggauggagagcucuuagacucuuagcccggagaagcccucacuucuuucagccaaccaaccagcaguuuaagagucuaccagaguaucuggaaaacauggugauaaagcuggccaaggaacuaccaguaagugaugcacuucauuguucccguuacccuaguagacaugaucugcuuuaaaacuauuauuauuugagcagaauucacuuuagcuuuucucacaaaaauaguaaucugcagaccaucauguuuuagaaugggggugaggauguuguugaauauauuuacagagaaaauguaaaacuaagaguaagagauacugguaauuuucugugcagcaugcaauuuacccaaaguguuaaaauuacuaucuucaguaaacuagaucagauuuuccacauugccaauguguuuuacugucuuuugucaaaagcagggucuaagaguggcaguagcucaccuggcagagccccuucuacucugcucucuuccacuguuguaacaguaugguaaugaugggcauuaucaguuuucugucgccccuuagacaguacugccuaaagcuuagguauuugcaaaccugccuaugcuucucaaucuucuuucuacccaaagucguacaccuuagcuaucuucagaaacugguguccuuuuaaacaucacuguucuucauuuacuauagcccccuucugaagaaauaaagacaggugaggaugaagacgaggaagauaaugaugcuuuacuaaaggaaaaugaaaguaagaacugaauuuucuuggcuuuuuuacaaaauuggaaaaggcugggggaucuuuguugagcuaauuugaucuacuucucaguucuaccauuuuaucucuaucuuuugacuuaaaauaugaaauuuaaaacacuagucacuuaaaacacauuuuauagaugaaauguggaaaugauaauuuuaagagguaaagaagaaagguguuuuacagcagagcuuaaacucuaacuagugggaauuggagcaucuccucuacaagaaaguguuucuaauuaaaauagcuuugaguguauacgccuauggaaaauuuucaaguuuuaaaguaaaguuuuaggggacuaguaacccaguggucauuucagcuuugcaguuauuucagauacuuuaauugcacaucucuauauuuucuagguccagauguucggcgagauaaaccuauaacaggggagcagauagagucauuugccaacaaacuuggugagcaguggaagauuuuggcuccuuaccuggaaauuaaagacucugauauuaggcagauugagugugacagugaagacaugaagaugagagccaagcagcuccuuguugccuggcaagaucaagaaggaguucaugcaacaacugauaaccugauuagugcacuaaacaagucuggauuaagugaccuugcagaaagucuaacuaaugacacugaaacaaacaguuagcuuucuuccuuucuuuucuuuuuuauuaaacagugauaagauuuuguuaccaagcagcauuugauaaaagguucacugguuuugguaaacaauaaacacuuuuauaacagcuauuguacaguuggcuggugcuccaaaaaccacauacagaacaggcauuggaguggagaacagggugggaaaacaaaguaaaaggaccucaagaucacaccaauuuuuguuaaguauuucuacagugaaguuaaaugaguacuacuaacaguacugucccaaauuaguuuccugcaugcuaucgguuauaaaauuuuauucugaaauuacaagaugacacuucugaaaccuuaggacuggagagaagaggaucagcaaaccauggauaguuuuaaguguuuuccuggcacucugacaugcugacacuacaauagcaaagaguucaaacugauagccaggggccugcaaaaaccaaaucauuagcuguuuguccaaaacagaaaauguuuguuugcuagcucuaaguuuauaugaaguggagucuaagacccaacuacuccuuuagcuuuacaaagauuacuugaccuccuuaagucuuuaaacacccagggauuccugucaguucacuugagaugugaaaauacccuauauguagcagagcaugugugguacuggcugacgguuaagauguucguguucuagucccauacagcauuuccuguggguguuuaguauacuagugaagggcgacugggcagaccacuguuaaguguucuugcuugaacugcacucuacuagcuggggaagcagugacuaagcacaacccuggccuccagaugucuucugcauuaagcaaauuaaggcaaguucagggauugaaagggaggagaauguuuuuuuaccucauucuaaaacacuuaacaccuuauuuaaaacaaaaugauggaaguccaauuucuacuuuaaagaauuauuuuuggaaugccuuuuuaggucaaauaaacuaucaccacacuuuuuguauaauaguuuucuuaaugcauucuaaacauaguuuuggcauauuuguucuaaaucuaccucaccugguuuaguaggaaaacacaggugccaaauuccuucguucuacaacuguucuagcaaauaacacugaaucccaggggucaugacacaaacuauuacaguacacacagcacuguuucauuccauguuucacuccccauuguaaggcgucuuaacugcuaauaauguuuaaguuagcaaacuauuuacaaaccuaaaaugcugacuuacccacacuauuacagauuuauuauccuauaggaaucuuggguacuuuacagagcauuaaaacaugagguggaagaugucaugauauuccugacauuccuagucaacucaaaucagaccagaucacgaauauucaacacuucauccuuuccuuagauugcuaaaguuccugaaacaucuaaggacuuacucacuggguagucaauagauuaauaaacaauacucuugguaauguauaccuuaaucuuaaaaaucaguaacuuucaagaugggcacaaagacuuugggaaagaaaauagaaacaacaaacgugugagggaaugaaacugaucacagaauucacuguccaaaggaacucaucaccuuuacuacuuuguauuucuuuuguaauaacacuggacaagcuaaaguuucuuguauuuuaaauagauccuugacugcuuagcauuauuagccauuugcagaaacuguauaguacugaauucauuugacucuuaagccaagcucuaauacuaaaaagaaaugucaaaaguuguuaaucccucuuuuuccuuauuuuuauuauuaaauauccuugguuuccaagcaaccagagcuuguuuacacauuaugauuacuacaaaaaccaaugcaaaguuuaacauauaaaccacaguacauuagagacacaauaauaaguguauaaucaaguguguucuuauugaucacaauuuauuguaaagucaugaaaggccagcaacagucagucuggacaauacuugauugcacccaguugaugggauguggacagcagcacugaguuacacgaagagagcaacacuuuuccaccuuccuagaaaaauauugguuagauaaggcagaggacgggcagcuacugaaggugauaguaaccaugcaagaacaacagauaggugugcaauaaacaucacugcuaaagcuugggcugaaaaggcaagggauaaaauggauuucagccaagaauuucuaaggauuaaugcaaaaaaugagauuuuuaaagaaugucuugaagcuaccucuauacaagguaggacccaaacguaauuucccguagucuuaagauugaagaugcacaaguggcuugguucuguucucauuuucuuuagagcucaagauuauagaaauguucaacaacaacaacaaaaacauucacaccuaagcauaaauagcuaaauugaagauuacuguucacuuucuucuuccauuauuucaacucuucgaggcccauaaaguagaacauaagcaaugugccagucuccaccaccagacagccgcagaauaucuucugggguuacaaugcugaccuuaucaucaucaaauuugauccauucaucuaaauuaagaagauacacaccauuauucucagaguuc

SEQ ID NO: 8809 - RNA, 38382 nt, Mus musculus
gaacucugagaauaaugguguguaucuucuuaauuuagaugaauggaucaaauuugaugaugauaaggucagcauuguaaccccagaagauauucugcggcugucuggugguggagacuggcacauugcuuauguucuacuuuaugggccucgaagaguugaaauaauggaagaagaaagugaacaguaaucuucaauuuagcuauuuaugcuuaggugugaauguuuuuguuguuguuguugaacauuucuauaaucuugagcucuaaagaaaaugagaacagaaccaagccacuugugcaucuucaaucuuaagacuacgggaaauuacguuuggguccuaccuuguauagagguagcuucaagacauucuuuaaaaaucucauuuuuugcauuaauccuuagaaauucuuggcugaaauccauuuuaucccuugccuuuucagcccaagcuuuagcagugauguuuauugcacaccuaucuguuguucuugcaugguuacuaucaccuucaguagcugcccguccucugccuuaucuaaccaauauuuuucuaggaagguggaaaaguguugcucucuucguguaacucagugcugcuguccacaucccaucaacugggugcaaucaaguauuguccagacugacuguugcuggccuuucaugacuuuacaauaaauugugaucaauaagaacacacuugauuauacacuuauuauugugucucuaauguacugugguuuauauguuaaacuuugcauugguuuuuguaguaaucauaauguguaaacaagcucugguugcuuggaaaccaaggauauuuaauaauaaaaauaaggaaaaagagggauuaacaacuuuugacauuucuuuuuaguauuagagcuuggcuuaagagucaaaugaauucaguacuauacaguuucugcaaauggcuaauaaugcuaagcagucaaggaucuauuuaaaauacaagaaacuuuagcuuguccaguguuauuacaaaagaaauacaaaguaguaaaggugaugaguuccuuuggacagugaauucugugaucaguuucauucccucacacguuuguuguuucuauuuucuuucccaaagucuuugugcccaucuugaaaguuacugauuuuuaagauuaagguauacauuaccaagaguauuguuuauuaaucuauugacuacccagugaguaaguccuuagauguuucaggaacuuuagcaaucuaaggaaaggaugaaguguugaauauucgugaucuggucugauuugaguugacuaggaaugucaggaauaucaugacaucuuccaccucauguuuuaaugcucuguaaaguacccaagauuccuauaggauaauaaaucuguaauaguguggguaagucagcauuuuagguuuguaaauaguuugcuaacuuaaacauuauuagcaguuaagacgccuuacaauggggagugaaacauggaaugaaacagugcuguguguacuguaauaguuugugucaugaccccugggauucaguguuauuugcuagaacaguuguagaacgaaggaauuuggcaccuguguuuuccuacuaaaccaggugagguagauuuagaacaaauaugccaaaacuauguuuagaaugcauuaagaaaacuauuauacaaaaaguguggugauaguuuauuugaccuaaaaaggcauuccaaaaauaauucuuuaaaguagaaauuggacuuccaucauuuuguuuuaaauaagguguuaaguguuuuagaaugagguaaaaaaacauucuccucccuuucaaucccugaacuugccuuaauuugcuuaaugcagaagacaucuggaggccaggguugugcuuagucacugcuuccccagcuaguagagugcaguucaagcaagaacacuuaacaguggucugcccagucgcccuucacuaguauacuaaacacccacaggaaaugcuguaugggacuagaacacgaacaucuuaaccgucagccaguaccacacaugcucugcuacauauaggguauuuucacaucucaagugaacugacaggaaucccuggguguuuaaagacuuaaggaggucaaguaaucuuuguaaagcuaaaggaguaguugggucuuagacuccacuucauauaaacuuagagcuagcaaacaaacauuuucuguuuuggacaaacagcuaaugauuugguuuuugcaggccccuggcuaucaguuugaacucuuugcuauuguagugucagcaugucagagugccaggaaaacacuuaaaacuauccaugguuugcugauccucuucucuccaguccuaagguuucagaagugucaucuuguaauuucagaauaaaauuuuauaaccgauagcaugcaggaaacuaauuugggacaguacuguuaguaguacucauuuaacuucacuguagaaauacuuaacaaaaauuggugugaucuugagguccuuuuacuuuguuuucccacccuguucuccacuccaaugccuguucuguaugugguuuuuggagcaccagccaacuguacaauagcuguuauaaaaguguuuauuguuuaccaaaaccagugaaccuuuuaucaaaugcugcuugguaacaaaaucuuaucacuguuuaauaaaaaagaaaagaaaggaagaaagcuaacuguuuguuucagugucauuaguuagacuuucugcaaggucacuuaauccagacuuguuuagugcacuaaucagguuaucaguuguugcaugaacuccuucuugaucuugccaggcaacaaggagcugcuuggcucucaucuucaugucuucacugucacacucaaucugccuaauaucagagucuuuaauuuccagguaaggagccaaaaucuuccacugcucaccaaguuuguuggcaaaugacucuaucugcuccccuguuauagguuuaucucgccgaacaucuggaccuagaaaauauagagaugugcaauuaaaguaucugaaauaacugcaaagcugaaaugaccacuggguuacuaguccccuaaaacuuuacuuuaaaacuugaaaauuuuccauaggcguauacacucaaagcuauuuuaauuagaaacacuuucuuguagaggagaugcuccaauucccacuaguuagaguuuaagcucugcuguaaaacaccuuucuucuuuaccucuuaaaauuaucauuuccacauuucaucuauaaaauguguuuuaagugacuaguguuuuaaauuucauauuuuaagucaaaagauagagauaaaaugguagaacugagaaguagaucaaauuagcucaacaaagaucccccagccuuuuccaauuuuguaaaaaagccaagaaaauucaguucuuacuuucauuuuccuuuaguaaagcaucauuaucuuccucgucuucauccucaccugucuuuauuucuucagaagggggcuauaguaaaugaagaacagugauguuuaaaaggacaccaguuucugaagauagcuaagguguacgacuuuggguagaaagaagauugagaagcauaggcagguuugcaaauaccuaagcuuuaggcaguacugucuaaggggcgacagaaaacugauaaugcccaucauuaccauacuguuacaacaguggaagagagcagaguagaaggggcucugccaggugagcuacugccacucuuagacccugcuuuugacaaaagacaguaaaacacauuggcaauguggaaaaucugaucuaguuuacugaagauaguaauuuuaacacuuuggguaaauugcaugcugcacagaaaauuaccaguaucucuuacucuuaguuuuacauuuucucuguaaauauauucaacaacauccucacccccauucuaaaacaugauggucugcagauuacuauuuuugugagaaaagcuaaagugaauucugcucaaauaauaauaguuuuaaagcagaucaugucuacuaggguaacgggaacaaugaagugcaucacuuacugguaguuccuuggccagcuuuaucaccauguuuuccagauacucugguagacucuuaaacugcugguugguuggcugaaagaagugagggcuucuccgggcuaagagucuaagagcucuccauccauaauuugaauuauuuacggcucuauaagaagagaugucagccuuguaauuuauaguuacucaguuccauaguuauuuucauguaacaagugucacaaaauuuuaugcucucuugcaaauaacagcucaaaguauaccaucuuauaauuugaaaguauauauuuugcuuuauuuuagcaagucaauggucuuaugucccuaguccuggcuacuagacacuaugcauagaaaccacccaguuauaaagaaaagaaaaagauaauuguauccauuaucuguaauguuaccuauagaugcguguuuaaucuaaagccuaaauguuucaaaaucuaauuugucuuacuugcuaaagucuaaaauguuacaaaucuggaaaaagaacacuuagggcuucaaguauuuuguaauagggaccuguauuuaagaguuguauuauauaauggcuaaucuuuaauucauauuaacaucaaccucaaugaauuaaaaaauggcucagaaugcuaaagcaguaaauauccaguggccgcaguaaugacauacugaugucaagaauagaaugggaaaccgagaaacaagggacccaugagaaaucuuaaacaccccacucccaccaccaccaaugacagaacugcagcaaguacaaauggauuccacuuaggacuuuuuaggauuugcccaccucgggaaccccaaauacagacuugcaaucugauuuauuuagugguguauaaacaguuaacuuuaaguaugagaaagauuuuaagcaugagaugagacuugggcauaucuuacuuuguuauuauuauacugauagacuuuguaagccacacuaaccucaaacuuaaucuucagcuuccugggugcuaggauuauaaggucugugcuaaccaagccugcugcugugcaugcaugcacauguguauuuauuuuaggcagguucuuuuuguuuuguuuguuuuuuuuugagacagagugucucuguacaguucuggcuguccuggaacucacuuuguagaccaggcugaccucgaacucagaaauccaccugccucugccucccaagugcugggauuaaagucgugcgccaucaccggcuuaggcagguucuuacuguauagaccaggcaaagaaaucaccggcacugggauuaaagguguguauaucuauuuuagauuacuagucggccaucacugggaagagaggccccuuugcauugcaaacuuuauauuccccaguacaggggaaugccagggccaagaagugggagcggguggguaggggagcagggcaggggagaaggggauauagggaaagcauuugaaauguauauaaagaaaauaucuaauaagaaauaaauaaaauuaaaaaaaaaauucaauuguguauuguuuugccugcaugacugugucauaugcaugcagugcuaaagaaggccagaagagcacauuacauccucuggaacuggaugguuagccaccaugugggugcuggggaugaaaccuggaucuucuggaagagcaguuaguguucuuaaccugagucauuucuccagcccauaaagaucacucuggugcaaggagaauagaacacaaaauuaagagguuggaguauguaaaaacuuaccacagggucaaagcuagcuaugucauguacuaacuacaugcuaugcauggaucaaaaucaguuauuuaaucuucagaaugugaaaugagugguuaccauguagcaaacgagaaaaguggcacagggcuuauuuguuagagccuggccaguagugguacacgggaagagaaccuaugcauuuugacaagagggccccugccuuuaaaucacaauuccagaacagcuuccuaaaaacuaaaacugcugucacaugggacacuuuagagaaaagacugaaucuuaaaaguuacugcaggaauuuagaguaagacagcagguguggaggcagguggagggggcagcaaggugauggugagugguuccaccaaaauugagacaggucuauugacagaugcuguugggaccuuaaaaaaaaaagaauacuggagugauagggaacacagucucaagugggugggcugaccagaaugggaggcuggugaggaaacgaggucaaaaccuaaauuggcuagcagaaaagacuuguggagaauaaacaguagaggugaaggucagaaggagguauggggugagggcugagggguuauucugucauguuuuggaauugacauggaaauaaggauguuauaguaaugugaacugcaugcauaaacucaucuaaaagcacuacuuugcugacuuaacuguagcauucagaggauucccaagaaaacaugcugaaauuagcaucauuucaguauaccauuacuuacuuauauucacuuucaaccauguuuucaggaucugcuuguucaauagcuucuucaaagaacuccuccaaaguuggcauguauucucuggucauuguaaaguaaacagugagguuuauguguaguacucuaaaaugguggcaauauuaauuuuaacagcauccacaugugauaauuacaucuaagaccuaaaugcagggacucuagaucucuuugagaacauaaagacugaaagcucaauucuaaaaugggacaauaaagaagguauaggucuaaaaacgauucacuccauauuucaucaaaccaugcacugugauagacuguacuauucauuuuugaagacuucugucugaucugauaagcucugccuaucauaccuuuauucuuuuaguuucaacauggucauaucuuugucuuuaugguguuuuauaaucaauauguagguaaaaauuuaaaauaccuaucaaucuuucuucacaccagaaugccugauuuuuguucauuugaauuuaauucucuguguaccuuugguccuuucucucucucucucucuuuuucuuuuccuuccuuccuaccuucuuccuuccuuccucucucuuucuucuuuuccuuccuuccuuucuccccucucuccuuccucccuuccuccccacucccucccucccucccuauguaccuuugcacuccucauuuauuuuagagauuacauacucugucuuuacaacucuuugaggcucuuauuccugucuucugauuuuguuauugaagucugcuguuaguuuaauuuuacuuuuguuuucucuuuucacucacccuucauuuuucacauagacaggucuggcuuaucuauuuaaugcuaaagcccagauaucuuaagccaaagaauuuacgaauuaagccuauuuaguccugaucuuaagaagagcuucuuucacauucgugugcucucucugcugggcuuuugcucagcuuuguguuguauugucucuuacgucucccagcugaugggauuacaguaacgagccaccauacccaacuaucugguccuuuuugacagugcuaaguuuuucuuguuuuaacugcuacuucuuuauuuuacagccuuuaucugauucuaguuuuaucuacuaauuuaugaguaugaguauuuugucuucauguccaucuguguaccacuuguguguguccuuggugcccauggaagccagaagaggguguuggauccccuaggacuggagagaaggagugcuaggaauagaacuuggguccucuggaagaauagccagcauuauuaaccacugagccaucucucucuagauucuuuaugaaacucaugguagauuguucccuugacaguaaauuuggauggguuuuuuuguuuguuuguuuuguuuuuuguuguuguuguuuucgagacaggguuucuuuguguagcucugacuguccuggaacucacuuuguagaccaggcuggccuccuacucagaaguccgccugccuuugccucccuagugcugggauuaaaggcgugcgcuaccacgcccagcuggauauuuuuuaggcuuuuuccuguuaauagcuccaucugaaggucugaccuucagagaguuuaccaccagccuaggauuuccuagcugacaauuuuagccuuggguucccaauugcugcugguacuagaaaugucagcugcaugacauguucuuguuucucgggaaaaccccuagcagaaacaaacaagcuuucugguuuccacuguucuugucuccugaugcuucucuuccuuugcaggcagugucucuccuuaaaccagggaaccauacucagguuccucuccugcaucucugugaguaacuuggaccaucuuacugcuugcucacuuggaauaucaaaucauuccuaacuaaauuauucuuuugguguugaguucccauuucuuuauuuucuugugaccuauaaaaauuuaccagcauuucuagguguuuuaagguaaacuauauucugccaggcccaaaguuaauaaccacaauaaacuuuuaagcuuugaucauuccuaagaaaagguuuuauuauaguuuacugaacacugagaaaacgaacagaaguuuuacacuugccuugucucugauuuacaggcuuccauauuaucaggacagagauuccaaagccuugugagcuccucacuacaaaauaaggcagucauaguuuguauuguagcauucucauaggacaucauaaaacugcguauuuaacaugaguagugggucuggggguggugaccccuagucuaaaaugauaaccauuucucagaaacuauucaauaauaauaaaaaauggagaauuaacuggaaggugacagaauugaacugaaugaucagugcccuuucaguaaauauaagugagcugcacuggcccaaacauuuauacuguccauggccuagaaaagauuacagccuagagccaagggcuuuuaaagugggagacaacaggaaggcuuaaguaguugccuagccuuaacagcagggccaucucuuuagccuaacuagagaguucuuguaguaauauuuucaaacuauaaaaagaacaaucaggaacauaggaaaaugaaggacauacuuuccaaugaggauuuucuuguugggcccuuugccuaagaagucuucuggggcugcucucuuccucaccacucuugugggcuugguaucugacgcucugugaacagaacauacauauucuggggacuguauauggauauguaguaagcauuugccuaaugugcacaagcuccuggauucauuuaauccuacuuacagcaaaacuaucagaaaaaaaaaagagaacaagugagcuacauauugcuuuuacccuaaaauacaaaaucuucauggugugauagaacagucaucagacagaagacagaauuagcacauuauagggcaaguagacacgccauucucagucacaccagcguguccugugcacgcgcucgcgagcguccugaucuugugcugauuauuuaccuuucuuuaacaaaacuugggcaaccuucauucuuccaugaguuccaauuuuccucaguguuuaauauaugcuagaauaaacaaaagacauacauaucuacauaaaaauauuuuggaaucauacuugguaguaagaaaacuagugaucgaauacauaccucuaccaucuuugaaaaucuuucuccaucagggggauuuucagauagcagcugugauuagaaagaauauacuaagguuucaacaacuuucugcaucauaggagugguuuguaggcagagaaccaagacguguuuguguucuuguaccugagcuuaacuuuauccuuauuuuccuauuuggggcugaaacaaagaaaauucuaaauuuccauuuuuucaaucauggguuuguugcauguuggacuuacuugguagacugauuuuguaguaucuucaauccagagugauugcucaucaguuaaaacauaauuugaacuagggaaagaaagaacaaaugcaugucuaaguuauagcauauguuuuuauauugaagcuauucauggcaccuuaaauuaaucauacugugugaaaaauuaccuacaacugugacaaacaugagaauuauugagaaaauucuugcacuucauugucaaguguuaaaauugaagucaugaaaguauaaaggcaaauaagacauucaauuaccuggucugacuauagaguaauaauauuucauaaauuuaggagagauaagaaucugagaaagcauuaacauaucauauucuauauguaucauacuccauaugcagaaccaacugcagaaccauuccaugcacauuuuaaagagaauacauugauucggugacuuccccaacgcccaaagcuuuaauucaaccuaugucugauuucaagcucuugaucuuucuacaucacacuaaacuuugaaauagaagaaaaaauuacauuuugguuggguaccgugugcuacuuaaugacaguucugaaggaacugcgguacugcugauacaggacuauggguucagcaggcaacaauggcauggccuuuaugcauuucauauugcaccgauuuguguacaagcaacaggauucuggcuucaguuauggacaagacaagaauaaaugguaugcuuuuuguuggagggguuuagacacaauacagauccugacaagguuguaugaaaaccuaaaacaagagaacaguauguaggggguacgggggcagaggucaacccugaguauuauuccucaagugcuuuucaccuuguuugugaaaaaacugugucuuauugagaucuggguuuugaugacuagacuaggcuagauggccagcaagccucagagauucuccugucuccacaucugcaacacugagauuacaagaugugucuuguaccugacuauguaggugcuggagaacgacuuuggauucucauucauaucaaucacuucaccaacugagcaaucuuccuaaucccuagaauucacauuuguuucaagauuuucuuugguucuuucaguucuaauaucccagaaaguuuaugcaauuggaagguguuauuuccuuaguuuacaauuuagcaugaugccuaggugagguaacagagacuucuacgcacuagaaagaaaaacugugaaagucuaggauucugcagagacucacauuaucaaauguauauuuugacacuuuaccuaaaacaaauaucauacaucuaaaaguucccaguuagcugucugguugcuguagcauuaguacuuuaaggcaugcaguagccagugagauacuaccucaguggguaaaagcucuuucugugcaaauuugacaaccugaauuccauaccuagacccuaugacagaaagagaacugacuuuugaaauguguccugggaccuccacaggugcaccauggcaccccucccuguaauaguaaauuuuaauuacaaaauguaaauaaugcuaggcagugguggcgcacacuuuuaauaccaguacuggggaggcagugccagacagaucucugaauuagaggccagccuggucuacagaucgaguuucaggacaccuagggcuacagacccaaaccaugucuccaaaacaacaccccccaccccaccaaauaaaaaacaaaccaaaacaucccccaaaagcaaagcccuguggccuaaaauaugaaaaauucuuugcaaggucuucucauugucacuguuuauaugcuacacacauuaacucaccuuuugaauuugaccugucccuugagauauugaaauaaaaugagauacugcaacaggaugugucgacgaaaguuacugucacucaguuguaaauccaucaacuauucaaaauauaagcacauacacaaaacaacacauuaaaaccaaguaugacuaaaagcacaaauuauauaguuguagaaauggaagauucuguuucauucaaaaaaaaaaugcugaaagcuuccuccucgcucagcccaagaacagagcagcaagagcaccacucacuuucuagcccugcaaacagaugggguugaguaagcgagcagaaacaaggagggaauuaucugcaaauuaaaaaugggcugcuucucuuuagauuuuggagaacuaaauugcauuguaacuguaucacagaacauggagcagaguggaccugaggaucauaagugaggauauucucuaggaauccuaucaccucgcugcuucuacuuugagagugaguggugguaaaaggaaagacauucugauaacaacccccagacagagcucaaggaucgcuaaagacuuucuacacacuuguaguuuugccuugcuuuucuuauugcuuuucuuuucuuuccuuuuccuuucuuuucuuucuuccaucacauaccaggguguucuauuacuagcaccuucuuucacacucaugacucaacaagcugcacuguugucuuauuauaacuggccuuucuucagcguugggaagugaguauuugauucccucugucuggggguuguuaucagaaugucuuuccuuuuaccaccacucacucucaaaguagaagcagcaaggugauaggauuccuagagaauauccucauucaugauccucagguccacucugcuccauguucuguaauacaguuacaaugcaauuuaguuuuccaaaauuauuuuucauauucacccuccacaugugaauggcacaccagugguuuuccuuuccucuagaucccaacugacuuuacuggcaacauaaaggcucuuagcuucuggauucugccccaacugacaggcacagcccuuuuacuuugauguuuguuccagucacaaguuagacuacugaccacucagucauuucagcucuggagucuuacucucacaguccuguacaggaggagcaauuacaaucucauauccuuucagggcucacucugaacugcucccaauguagcuaauacuuaagucuuacuaagacagacccuuguuuaucugugaauccuacaguuuuuuuauuauaauugaauuuugguuuaguuguuuccuuaagguguugugggccaagaaauauauuaacaguauuguguaaauacauaagcacuuaaaauagaguagcaaaacaaaaaaguaauuagugggucagauuuggcuaaaccauuuucaaccacuuacugaacacucuuuuguaccacagucuaucacaccuacgaagcccacaacuugauuauaacaacuaccuucuuuauaccaacccuacgguucuacccagauaaaaagccaaguuguuugaacaaauagacaaaucacguggcuggacaaacacuguuucuacugauguccuaagaggaauaucuucauuuuacucagccaucuuuauucuuuaaagccaucucucguauuccauuuugaccccucaauuucuauuugcuuuccaagagcaaaaaaguucauuuaaucagaacccauuuaauuucuugcuuccuccucaaaggaaaacuuagcuguaccuagaccugcaccugcuuucucaucugcuucuguugcaucucccucccugcucaaagaaaauccuuuuauuugugugccucagucuaaccaagccccauuuguuaccccugccucccgacccuucuacucucucuuccuucuucccaaguucuauuuuguugauauuaaauagccucccugaaagauaccucaccauacuuucuucacccuccccaauggcaaagaugaaagaaaaagaaacagcuauauuuaugguuuucaauuuguccuuuaccugcucugauuugucuuucuuaccauucuguaucuaagaucacuaaugagucuaugcugauaugaauauaugcugaguauauaagucugagcacuaguuuuauucuacugggcauugcuugguucccauaaacucaagcuuuccuauuuaacuagucauuccugcuuucucaaucuucuacauccccccacuccuuucuuagugccuccacagccuuagucuucuauuuccuagucucuccacccucuuuccuccugauuaagucuugguuuucuucagacuuugguuccacacuucuuuuucuaaucuacacuuuccagcugaucucauauauuguauacauuauuugccacuuaaaaacgaaucaaauuccaaaucuauacuguuaacccagaucuuguuccaaaccuccagaaucauauacuuagcugcucaacaauucuauuucauguucaacugcuaucugguucaugaauaaaacaaagcaucaguuuuucuccuaaggccaguucuuuagaacuggcuaauucaccacccacuuaccaaagcaauagccauuugucuaagaagacaucuggaggaagcaguagcuugacugcaacccccagcagcaaauuaagggaauaaaagaacaagggcagaacacaaaagcagacaccaagaacacugagagaggaccacaguggggaggaggugauuacuaauucuuugucuucauuucuaagugcccuuuaccacauuuaccuucuucauuuaucucaugcuggaagccaacuuuuauugcuaggaacauggauuaaaaguagcacucaacuagacagcgcaggcugagaugagacugcgugaccaugcacacuaacugcuuaccauauucugagggagaugaagcucagaagacagaacuacuuauuuaaaucuacgagccagccagugccagcagagacuaaacaucuucagccuuacucuuccuuuacauuauuuacacauuuuuuuaguuccuuuucuauugguugccauuuucauugugucauggaucaaauauugcuuuguaaacauuuuuguuucuagaauaaaggccuuuuauacuucuugacuuuugcuaauugcuuagcucaggccucagcuugccucacauuauucuaaacauaaaauggcucauauuggaucacuuaugcugucaucaauuuuccaugaaaaauuuccaugaaauauucuugguaaagcaaaggcuaaaucugaaaucuuccauuucuaucaauucaacauaaaauacuuuacaaaucuguacuaggaaaaaaguuuagugcauuucauuauuaaaacuuucauuaacuguaauaauaccaugaaacaaaaauauuccuucuaaaauuaaauauuucaaaaguuuaaaaggcacaaauguucaauauucacauauuaccaccuaguuacuuguuucacauuuguuuaaaaauaaaaaaacacauucugaaacugcuuagugccuaauacccuccauauuccuauuccccucuccugcuacgacaaccauucucauguguuugguaauuaugauuuucuuuuucccgagacagggcuucucuguguagcccuggcuguccugaaacucacucuguagaccaggcuggccuugaacucagaaaucugccugccucugccucccgagugcugggauuaaaggcgugcaccaccacugccuagugguaauuaugauucuuaggcauauuuuauaacauuaauauauauguggcaucuauaaacacuauacagauauacucaaacuauaucacauucauuguucuguaauuugcuauuuucacacaauacuagguuugaaaucuacccacauaaauacauguagcuuuagguucaggaacuaaaaaacaaauugugugugugugugugugugugugugugugugugugugugugcucuuccuccucaacuuguuuuuugguuauuguguuuugucucagcaauagaaacuaagacaucuaugacagagucauucaacucccaaaggggcugcaacugacagauuaagaacugcugcucuaggaggugcaauuaguaauaagcauuuuuaacuuuaacacuuaaaacuguuaaaauguugaaucgguauuuucucauaccuuugucaaaacaauuuaucuuggguuuuuuuuuuuuuuuuuuuuuuuuuaaagacaaggucuugcuauauagcccuggcucuccuggaacuugcuauguagaauaggcuggccucaaacuccgagauuggccuaccucugucuucugagcacacuagaccaucuagggcuauacaggaagauagauagauggauggauagauagauagauagacagacagacagacagacagacagaaccaaagcuaauaaaauccuaaaugacauacaacuaagccuagcucugcaaugauuucuuaacuuccaagaaugcagaguuaugcuaccaaauaugcuucuuucuaaguuauuguaaauuucauuuguuucauuuuaaauuuaauuauacuguagccagacacuguguuuaguacaguauguaaucuuugaaauuugcuaagacuucccuugugaucuuauacauauauuugugaaugccgccccccaccccacccaagcagcacuaccuguuuuguacaggucuccagauguauucuaucaaguuuagugcuucuguuauucaaucuuccacaugcuucccaaucuuuuaucccuaacccagccgcuucacauagcuccaucauaauuaugaaaguaccaacuucacauaauuuuacacucuuacuguuuuuuuuuuuuuuuuuuuuuuaaagauuuauuuauuuauuauauguaaguacacuguagcugucuucagacacaccagaagagggcaucagaucuuguuacggaugguugugagccaccaugugguugcugggauuugaacuccggaccuuuggaagagcagucgggugcucuuacccacugagccaucucaccagccccccacucuuacuguuuuaagaauauaguuaguguaagucaguucuuggugguucauuccuuuguuauguacauuuuuaaacuuuauacuuuuuccugccaauucuuugauguucaaguggcuuugucuuuuaaaaaaaguucuacugucuuuauacccauuucuguuuuccaauuucuugucuuucuuaaaauuaauuaauuaauuaauuaauuaauuaaauguauaugaguaacaucagaagagggcauuggaucccauuacagaugguugugugugcugggaacugaacucaggaccucuggaagaguagucaguuuucuuaaccgcugagucaucuguccaguuuuugauagugaucuuuaacuugaguccccuaaacuuuggaguuuuaauuagaguguuugaaugggaagcuuuucuugagguauuuacuucacuuucauuuucucacuguguacacacaucauuaucaaguaguuuuugcauuuauaucaaucauggcccaagagcccaagugugaaguauucugacuucugggaguagcugcuuuaugagaucauagguggcauuauguaugcagucauugaguaagcagauaugagacaaaucuauagcuuuguuauuccugagcugguaacuuccuauaaaaucauugcucuuggcagguaucaguaauauacguuaaaauucuacaauagucccaguuuccagcaguacguggcucuacucugguccaacagggagcacacuugaccucuguuacuugcaaucaaacaguguggccaccaucugcuuuggauauagucuaaugggccauggcuucaguuucacucucauaacuugcuauuuccuuauuauuuauuuauuuauuuauuuaguuucugagacagaauuuuucuguguaucccuggcugugcuggaacucaauucugcagagcaggcuggccuugaacucagagacugccuauuuuugucucccaaaugcugggauuaaaggcaugcaccacuaccacugggcauaauuuguuuuuuucugaucuaugaagauauuuauuucuguaagcacagcuuucuuuuuggugcucucuuuauacuuuacuugucauuccuguauauuuucagaaaaaggaguauaaauaaguaagucaaaacacaaacucgaugugccacuuugaacaaaaaucacugaaaugcauauaaaaacagggaacuuuaaagccccuuaguuuuaacuauauaauaaaugaauugcaaaauauuuuuauaaaugcaaauuauauccuaacuuaaaauuuaaaauauauacacuucauaguaauuagguacauugguucuaaaguaagucuucuaaagugacuuaauggagaauaacgcuguuauaaauuagucuuguccaaguaagaaaugggaaucucaaacuaaaaccaaucuuggcuguaaguacagcaauccuacugaccaugaacagacugcacguuuaggacaaaaugccucauccucaguggcaaaggagcaucauaccuuuucacuuguuagaaacuuggcgaaguauacaugcucuccuccuguuuucaauucuuccaucuuuuuccuggaggcuugaguaucaucuaauuuauaacuuuuaaaaacagcuaaaacuucuucagaauacugcaaagaacaaaaaagaguuuccuuugacauuguuaugaaaaacucauucggugguuuucugcaucaaaugcuuuagaauuuacucccaguuaacauguauaauauaaggcauauuuucaaaaaggcauaaaaaauucuaacagcaacauggggaguaaaaguacuuuugaaugagauuuuauaauauuuaaaagcaggaauaaauacuaucccucaaaaacuauaagacuuuugcagcaaacagaaaaggauauaucuugauagcauaaucauuucccgugaguaucugcucaauucugucucugggauaagaaaauauuaagcuacugaaaugucucauuuauggcacaguauguaugcauacccuccuguuauaguucacuaaaucaucucauacaaguaguaucuaauguaaaugcuaugaagauacuuuuauaagcaaucagucugcguguuuguuaguauaggcacaaauuuuccaaauauuuucaaucuauggauaacugaugucauagaaccuacugauaugaagagaugauuauauauaaaaauuuaccagugaauuguuuuguuaugugguuaugaugucauugcauccuaaagacguguuuaugugaacaaacuagugcugugcuuggauuucaucagagaagccucuuacugcagcaggggaugggaaauggccaaaaugugacaguaagugacaguggagagcucaaaccguaaggagaacauauaugucauuaucaccaagugcagagaacaugguagaaggggcugaaagauguaaagguaagaggacuaggugagaaaugcagcaaaaagcuaccuucuggauaagacacagacacuguacucaagaccucauugcagcugugguuaccugcacaggacugcacaggacugggccugccugucagcacuuggucacggauuggggaugaacccuuaagcccccuuccccugcaugucugcuggcagcuaaugguuauuggggagaacagaucauuuucuucaggguauagccacuaauucacugcuauacuccaguaaguaacuccucccacaugcaugcaagcaaagcauuaacuuaguugggucagaugcacaaagaagacaugaaggaaggaagaaaacuugcugggaaggaaguuuugggagugguggugauaaaaaggaacgagguaaaaauaccuaaaauucauguauuaaaacuguuaaagaacuuuuaaaaacuuagcaguaaaagugauuguuuaacuagcuauggaacccucaaagccauuuuaugugcuaagacuaacaaaucaguaagauguaauucacccaagaagagacucccuuaucucaccauuugaaucucaauuuagaaggugacauuccucuaagauaaaugaacacagaccacuuauguugcuuuaaaaauuaucuauguuuuuuauuugaaucacagucuuccaugucgacaagacauauggagauucuuuuaagauaggguuggcaaauguuuuguaaaggugcagacagcaaguauuugggcuuuguggcauguauacugucagcucaaaugcucaaccugccaccacacuguagaaaaccacagauaaaugaaccuucauggcuguaagccaacaaaccuuuuuauaaagcagacugacuuaguuuggggcaaucguuuuaugaagucuguuuuaaaaggaaaacuagaauaaaacaacaguugggcaggacaacuuuuuucaagcuuucucgcuucuguagacucugcucccuaccucucaauaaauauuggugugugcucuucaaaagcacaacuuacacaaauuacaaaagcacuucaaauacagaagacauccugaaacaaaaucaucacuuuauguggacagcaauuacuaugaaaaaaaaaaaaaaucaacccuugaggcuuuaaugacuaaccuuuaaaccuaaagccacuuaaaaacuauacuacaaaaaucaguggcuaagaaucaauuuacaacuuaauuucuguauacuauagaauagguaugaaagcaucagacggggaguucuauagugaaaaguccuugaacaagacaaagucuaccccugucauuaccugagaaaugucagcuucagaggccuaugacucaccuugagaaacguuuuccaagaaaucuucucauagcauugcacuggguuccugaaguaauccugaagugaccagaauuuucuauacagguuguaaucaauuggaauagaacuauaaaauaaauacuguauuacaucacuuaaauuauuugacagacacagaagcucauaaaaaguuucuuuccccuaaaaaguauacauuuaaaaaaauuaaugacauaaacuuuuagaaacagucugaaggguuuggaaaacaugcuaggaguagcuaugcggaguuaguuggaaaaagucauaugugcaauaugugggccauguuuuaccaucuguuuuauugcacuaaagggaaaaggacaaacauaugcugaaaaacagugagaagaaaugaguuuccuaggauaccaugaguaaguacuauccuggaaugccucuuucuagacuuaacccaaaguaaguggauaaugcuaguacaagacagauguguacgggacaaaccaagucagcaucacaaaagcagcccuuucuccagugacuucacuauggccuuacugacuuaacuuccaguuuggcuaugauacugugugggaccaguggauucuucuagaaaauauggaagguuaucucuggcagagagaaucaugcaaccauuuauaugcucaucuuugucucaguaacuagaagaucuaaauauaauugaauguuugacaccaauaaggauauuuuguuuauuuaagggcuagagagaugguucagugauuaacagcccuuagugucuugcagaagacuggaguucagcuuggcagcuauauuaggcauauaaggcagcuaaaaacugcacaaaacuucaguuguaggggacugggacaccgggacaccucucuagccuccagaggcaccugcacucauguguacauaucuacacagagacacacauacauauaaauauaaauaaaaacaaaucuuuuuuuuuuuuuuuuuuuuuuuuuuuuaguuuuucgagacaggguuucucuguguagcccuggcuguccuggaacucacucuguagaccaggcuggccucgaacucagaaauccgccugccucugccuccugagugcugggauuaaaggugugcgccacuacugcccggccaaacaaauccuuuuuaaaaagggaucuuuuguuuuuagcuauuuuucuuugugugugcauguguauguuauauuuaugacauauguuguccuuggguaugcauguagguacauguguggacacuggaagacaacauguuggguacagguguuugcuuuccacuuucuucaaggcaguguacacuagguuagcuggucugugagcuuccagguauucucuuguaggagcucugggaguacagaugcacgcuacagugccugguucuacauggguucugaggauucaaacuuaggucuccacaaguucuucuccuuauuuucuucuucuuuacuggcuuuacagaaucaguuucauuuauuaucuguggugcugggggaaucaaacucagcaaauacuuugccauugagauaugcccccuuuccagaguaaauuuucaagcaauaucaacacacuaagaaacuuuuauaguugaggcacuaaaacaucucccacuugaugguuauauuccccuuggcuggauauauucuuucauggcuaaauuaauuggguuuuuuuuuuuuuugguguugaguauugaaucuaggguuuguguuugcuagguaagaguuucacugagcuauaccuccagcucuucagauaaacuuggaagagucuacacgccaaauaccaauuuacuguccacuuguacuauucuuuagaaacguacagauuggcuauuuacccacacaagguauaugacacacgcaugcaugcacgcacacacacacacucaugcgcacaauguuauggaacagaggguugagcccaggauuucaugcaugauaggcaagugcucaacgacugagcugcauccuuugccucguugguuuuuguuuuguuuuguuuuuugagacaggguuccucuuugaaacccuggggccuugaacucagagauccaccugccuugccuuccucugcugggauuaaaggcaugcaccacccucaccuccagcuuuuuuuaaggacagguuuuugcuaucuuuccacccacauaauggaaaaagagaaccgacuuccacaagguguccucugaucuucccuuuuguguuggcacaugcauauacauacacacuaaacaaauaaauucacaaauguaaaaguacauaaacucauccauagggaaguuguuuaaguagggucuggccuacucugaaccuuggcucuucccaucucagccuccuaagcagcuagaauuauaggccuguaccaguagacccaacuuacuacauuuguaagcaauaacaaauuagagguaagaguuacugucuaaaauagaaugucugaaguaagauucagucaaacccagacaucuggauaugagucaggaaggucucuugagcuuagaauuuuaagaacaauauggacaacaaaggaauagccaucauaacaugaacaacaaaauagaauguuaccuaaguaucuuaaacugaaauguuucaaaaaccauuuuuuaaaaaaguguugaacauuuuuggugucuuuauuuugagauagucuuacuauauuacucaaguugcccucaaauucgagccaguccucuagccuaauccucucagguucugggauuaaagguuuacacuaacauuccuggcccaccgaaccauuuuacacacucuuauauauuaauuuuaguauaaaaauguuuauucaggggcuggagagguagcucagaggcugcucuuccagaggaccuggguucaauccccagcuuacacauuucuguagcuaagagguccaggggaaaaaaagaaaaacaaacauuuauuauuugaaucaaaauaucuagacuagacuucacauuacaaauuuaugguaauauauuuacuuugcaauccaguuuuuguuguuaugguggugguuauuucuauuuuuuugagucagggucucaauguuuagccuggcuggccugauacuugcuauguaaaccaaacuacuagccuugaacucauagagaaccacuuguuuagcuccaaaggcugggauuagaagugugccaccauguccagccauaaauucaguucuuuuauuuuagguuuauuaauuuuaauaguaugacaguuuugcauauauauauauauauguauauauauauauauauauauauauauauauauauauauauauauauauauacauauauauauauauauguguguguguguguacuaugaggucagaacagggcaucagcuuccccuagaacuggaguauuauauaguuguaagccaccauguaggugcugggaaccaaaucuggguccucuauaagaacaaguucaacaucugaacuaucucuccagcagcuaaauucacuucuuaagacuaacagggggcugagggggaaagacuaacugguaacucaguuacucaucaagaauuauaauucucguagcaagucuaaaauuaccuuucaguuaucaaaauuaaaucaccuuuccuaaaccuguuuagaugcuauugguuggcucaauaaaaaguguuuacuuucuacaaaaaaaaaaaaaaaaaaaaaaaaauuauaauucucgggcuggagagauggcucagugguuaagaacacugacugcucuuccaaagauccugagcucaaaccccagcaaccacaugguggcucacaaccauccguaaugagauuugacacccuuuucuggaaugucaaaagacagcuacaguguacuuacauagaauaaauaaauaaaucuuaaaaaaaaaaagaauuacaauucuccauacacuuuccuccuccauucauaaaauaauuuacaauagacaaagauagccaagugccugauccuauuuaaacaguauuccugugguugaguuuauuuaguuuucuacuuauauauuuauuuguuuaguguguauguacaggagugugccauaggacaaguggcgggguccuuggacaacuuguacaaguuaguucucuccaccauuucuguccuggggaucaaagucaggcuaucaggagcuggcagcggcaccuuuacucaugggccaucuuugccagcccuuugggcuacuuuaugaccuuacaacaauagaccugaaugcauuaagcagcgacuagcuagcagaguauuucugagagucuauuuacacuucagauaacucauuaucuuagaaccuacuacuuuugcccagaguugcacagacagacccuaaagguccauuuuauccaugauauauguaaacaaguuggucucuauaaagagaguagccacaacuagaauaaugaauaaugguuagaaaaugacuagaaaaugagauacuuuucugugugcuuuaugauuuccacuguauguuucaucagcaacuacaaugaaaaauacuaagugccuuaguagaccacuuuuuaucgucgucuuucugaaugcuuucaacaacuguaguaaguaggcagcacugcuacauuuuaaaggaaccaacacucaguuguaggaaaccuuguucaaggucauaugacccgcaagcaagcacuagaguuaaaucugggaauacaucacuucuaaaugcuuccuaugugaauauaggaucgaauuugaaaucugggauaucagaaauaccucucccuuuuugaucuucugggcagcaauuauagaaauucuuucauuuacaacugacaguauggccuauugcuucagacauggaagaguacuauucugacagcccaggaagauuuugguuuucuggucccccuucucaucaccucuucuaaacuagcacaauaaagaaacuaccugcaacaaagacucagaacucacagaguaagaaaagaaugauaagaaaaagacuugaaaaacuaaaaaaaagaaagaaaaagagaaagagaaagggaggcuuccaguucuuugcaugucauuacgucaguacauuacgucaguacauuaugucaguacacucaccaugaguaccaggaccauaguuuaauggaagggagaagagggggcuaagguugccauggcuaggguauguguaagaugggcugcucaaacaguucaaaguauuuguccauaauuuagaaggcaacugauaacagccuacuagugacucaggauuuauuauuuuauuuaacacacacgaaggguauguauaagaaaauccuauaagcacgacuuccucccuccugucuguaucuucguuucaguauuugauaucucauuaaaggguuaucuuuguaaaucaagacaucuuaagcucuaaaaacucaccaaguugucggggcuucaucaucucccauuucaccuucuucuacauccaucccuuccucucuauccucaguaugcugaauaaaacaaaaccaaacccauucugucaugaaguagucacugagcaaaagaugacauguuauagguuaaguaauuucuauauugcuacacauuauuauuagggaagccuagauacaguaauuguucuuuaaggcaauggcauuuugggugacaggaaaccaacaguaguaugacaauaacauagcauggacauauguaaagacacaagaucugccuuauucuccaaauauuuuuucaucacugaaacaaauagucuacuacuacuacuacuacuacuacuacuacuacuaaagaauagacgcuaacauggguguuaaugccguagaaaaaugcacaggcagucuucccuugucacuggcaguaauauauauggauguacuuuuucugagaaguaacaacaaaaucugaaauacaugauguacacuuugacuaagcaauuucacuuauccuaaggagauacaacauggguuaguaauuauacacacaauucacuguaauauuaacaauuucuuacuacuacacacuacuugagccaggcaagguaacacaagccagcacugggagaugaaggcaggaggaucaagagcgccaggccaucuccagcuacagugaauucaagagcagcuugggguaugugagacccuggcuuaaaauuaaacaaaacagaugauuuaaaugucuacugacaagaaauuaggguacauucauucuagaaucuaaucuguaauuaaacugaaacauaucaguuuaaaaaagaaaaugaacuuaagaacuuuauauaguaucuuauuugggaaaaauaacauuacuuuguacaaguacucaaaaaagucuuaaaagauuagauggagaauauuaggggugguuauagagauaauacauacuuacagaaaacauguaaagaccauaaauaauguucaaaguggaaaacacuuucccucucuaguuaccuuaugguuauguacaugaaagagcugagcccuucucuaacauccacuuuaacagaagacaagcuaaucaguaacaacacaaucuaauucugauuacagucaauauccuuugaacucuaaauacugcuugaaauuuuuacacccaacgcauacuaauuuaauguauuaaaaaugaagggccaagugagauuucucagcagguaaauucaucugcugugcaggccuaguuacccaaauccaauccuugagauucacagaggaagaaaaguaggaccaauuccacagaacugucuucuaauuuccauguguccucuccccacgugcacauguacacacaaacuaacaaacaauuuugaaugaaguuaaaggucuuccaauuuuuggugauuuaaagacccuauuuacaucaauuaucuuaacuaaaacgucuaaguaugcucuguaagaagguuucuggucagccuuaccuucugacccagggugcucuccugcucguuuguauugaaaacagugacguuuuccagguuaaacugacucugcaaauuaagaccuguggaaagagauuuucaugaaaaugcacugucaguuuucugccucugagugcuagaaauaggcauuugauacuauaccaggcugaguuagcccuuuuuauucccaaaauucaaaacaaaaauacauaauauauaguauuuagaauuuuccuaaagcauuuauuucaguuugauagaauaaaaugaauuaaaauauuauaaagaaggccaaauuauuuagcuuucuuuguucugccugccgagcgucucacaauaaguguaucguagauucagauccuggcuuuuauuuaggguccagauuagcuuuaacuaccauucugaaauacaaaguucuuugaaaaaaugggugacuccaaggcugggaaaggaaaaaagaaugagccuggauaaucuaugaaagagcucccaguggcagaaacaggaauuaugugaggaaaagaaaacauauucuaagaguccaugacuugcugaagaaugauacccuggacucaaaucguacauaaacacaaagagugaccauucugcccaaguccagcauguugaggucuccauuaccaggacagagagacaaccaaaugagcuagcaugccugauuuaaacuacauuaggggauucugggguaggugaccuuuaccuuguuccauuucuagggacauuucauuucuacagcacagggcuggaagcuauugcuggggaagucuggacaauaugacauuuauaaucuaaggaauaaaauauccacaguucauuuggaaagagguaacuaaacuaacaugccagcaagaagacaacuuuccccuuauggaaggaucaccauuaauaaacauagaaaaaguaagaaaauugccaugaugccuuaauaauauucauaucaggcaagauccacugauggauauuagcagacaaagcuuaagaggaaaagaagacaaugugagcguugucucaaaauaucaacccuccucauaaguauuacagaucacaaagggaaaagcugcaauccaaauaggagauaccaucuuaacuaggcaaugagugauaauaacacucccaguauaagacaugucaacaucaacuucaaaaugaugcuuugagaagguacaucaguucccucugaguucuuaaaacaccuaacuuuaauuccuauguguuaagucacaagagauaagagagacuaagggacugugacuggagagacuagggcacaucaagauccuggaauaggaaagggaaguagugaucaaggugaugaaauucuaaugucuccagcuggcaaccaggacuguagcaauggauuucuuaguguuaauaauuguauuagacacuagugauacuauauaaccguauucagauaucuauacuauccuuauaauuccugucacagagaauuagauaggaaauucaguuauucuacuaguagcuuuugccccccccaaaagaugaaaaaucuaauaaaugaucuaaaaagaucucuuaucaagacaucuuuuaaucuacaucuuuagacaacauugaaaaacuguaguauggugccgaauuuucuggacgaugaaggcucugaucuuagaggcaccauauacaagcaaugaaaaccuucucucaagaaaguuauccaucaugggacucaaaacuauucuucucaccgggcagugguggcacaugcuuuuaaucccagcgcuugggaggcagaggaaggcggauuucugaguuugaggccagacugaucuacagaauuucagggcagccagggcuacacagagaaacccuguuucaaaaaaccaaaaagaaaaaaaaaaaauacaacaguuaucagaaacacaagacauucuaaguuaaaaccaaaaaagauaucacaaaaauacaacacacugaaaugaucagauauagacacaugcuuaccauauuuuaaaacuagaaagcaaaguucaaaguaucaacagggaguaaaaagcuaaaaagugaaaagaucucccagauaugagaaccacaucaaaugauuuagaguguaauagagacagacagacagacagacagacagacagacagauauucauauaagaaggcaagcagguagaauaaaagacaagacagguuuggucugcugcuauguauuguaaugguaaauucuguauccaagggcuaggccugcaagugaauucucuuguuuacaaauguuugcaaaccuuguuccuugauuuaaaacaacugguuacauaaaauugacuacaguuaauuacuagagggauuagagguagguggguuaccugguugggggugggaguggagaagaguggggagccaggagagaaggaggaaaaacaggaggagaggaggaugcauccauuaggggagauggaccauaagcacauggucaggagaaacagcaaauaugagauauaccguuggggagauugccaggccagcagauaggagauuagggauuaacccccacacccccaacaguaacugucaaacccaaauaaaauaaccauaguaugaaucucauuuauuuguaagcuagucaggauaagcauaaaguugucguacuacugauacagucaaagaacagaucauauauaauuggagaugcaaaauaaaaaaaaaaggcauuuauaaaauguaaaguugucaucaccacaacuuuuagaagugguaaaaggcaugaauccaaauuuaaaaugucaacaaauccaaagaauauuagguaaaaagcaauccacacauacauacaucauaguaaaaucaaagaacaucuuaaaagcagugaaaaaauuaucuuucaaaagcuagacaacugauuagucuauagaacauaaaaugagggccaugaaauggcuuagcuugauaacaugaguucaacucccaggacccacaugguagguuggaauggacucccauaaauuguccuuugaucuccauauauauacaugcacacacacacacacacacacacacacacacacacauaaaaaguuuaaaaagaauaacaaagaaugagagacuaaauauuaagauuauuacaaaugaaaugaaaucuaucuaguacuaaccuagcauuuuaaagccacugaacucauucauacaaggauuacagagaaauuaagauuucaugaaagagaugucauauaugauuauaguucugucugguuguguguuuggugugugugugugguauguguguuaacuugacauaaacuaaagucaucugagaagaggcaaccacaacugagaaaaugccucucuaagcuuggccuauaggcaagccuauuggcaucuucuuaauuagugguuaaugggggagagggggugggcugugccacugcuggcugugcagcucuaguaucagaguauguuagaaagcuggguauaguacuggugcaugcuuuuaauccuagcacucaggaggcagaagcagugaguucaaggccagcacggucuacacagugaguuccaagacagacagaacuauauaaugagaucuugucucaaagggggaaaaaaggcaaaaugagcaagccauaaggagcaagccaguaagcagcacuccucuacaguuugugucaucuccuacguuuagguuccugccuugaguucuuccccuacauucucuccgugaugggagugugacggaguuuuaagcugaaauaaauccuuucuuccccaaguuacuguugaugguauuuauugcaacauuagaaauccuaacuaagccgggugugguggcacacgccuuuaaucccagcacuugggaggcagaggcaggcagauuucugaguuugaggccagccuggucuacaaagugagcuucaggacagccagggcuauacagagaaacccugucucgaaaaaccaaaaaaaucaaaaaaaaacaaaaaacaaaacaaacaaacaaaaaaaaacccagaaauccuaacuaagauaaguucuguauuaaaaaaaaaaaagaguaagggacaaugaccacagaugaaugaggaguauauacauauuaagacuaaccaagaaaugacugggaaagagaaaaccuagaacuagcaugacaaaaagaaagcacacaaauccaacauuaacauauucuauaagcuuacuauaagcacgcgccauugcaugcauaucacauuuuaauacaaucaucacaauaacauauuaaaggcagggaaaaaccaaaucaaagagauaccaaauucuaguacaucugaauagauaaaagacagggaaggcuccaauucuggagccaagcaaugguucuacaaguauuugcuucaucauuauauuuauguuacauacuuugcaaugaguuacauuucauaauaaaacauugugaaauaggggcugaagagacuguccuguuacagaggacaaagccauuacauagauggcuuguaaccaucuguaaugccagcuccacaggcaacauaugcauggcaugcauauacacaugcauuuacacagccagguaaaucacucauauguauaaaauaagguuuuuuuuuuguuguuguuuaaaaaauuauaaaauuaaaggaauuucauguguacuaaacagcaauuacuguaacagaaaauggaaacagaauaggcuuauauucugaaauugaauacagacagaauaguucauaccuacacauauuacuaugauucaguagcacccuguuaauaaacuuugaauuuaagacuaucuauaucauacauagagcuggcgaauuuauaagaaaguaaagcaauuuuauaaugcuuucaauauuuuauguuaaguuuucuuauuaugacagauuuuacuccauaaaaacugggagagaguuccuuaaaaagaauauaauguauagaaacuuaccugauuucucagauagaggaaaaagccuggccaaaaagaguugaauucuuccacagaaaacuguauucugagauuuagacaaucuucugaggagaucuaacaauguucagaaaugaauaagacagaagaaaucauuuuauguuuauuauaauuguaccugaauuuuuagccauuugcccaggauuuuccuaaagcaaauggaaguaucagucauugucaaagaaaguacuauaaguuagaaacaaaaaucuguggguaaaaaccaaugaaagugaaugaugaguuuuaauaaauuacuuaacuuaaaaacaaagauccuaauucacuuuuaaaacaucuucauugcuggggagugguggcgcacgccuuugaucccagcacucgggaggcagaggcagaggcaggcggauuucugaguuugaggccagccuggucuacagugaguuccaggacagccagggcuacacagagaaacccugucucgaaaaaaacaaaaacaaacaaacaaacaaaagacaucgucauuguuaaauauuaaaccaccaacaccuauucuucuggucacguucacaguuuuaaaagaguaauuuaauacugaguuacuuaccauugcacauacgcaguaaauaauuuuugccagcagaauagaauguauucugaaauuaagaccaaaauuauuacuauacuuugaaaguugcccacucccuucaauaagucauaggaauuaaaauauuaaagagcacuaauguauaagagucuauuucacuacuguuacugauuucaagcauuuccacuugaauaugcauuaacagcauaucacugaauaacuuguaaacaucuagaaguguguguguguguguuugcuuuaucuuuaaaaauuuguuuuauauuuguuuauuuuaugaguguucuuccugcaucuauguauguguacuauacauacaucuauguauguguguaugcaaaaaggcuagaagagggcaucagaucaccuugaacuggaguuauguaugaugguaagccaccauguuugaguacuggaaaucaaacccagguucucuaaaggaguaacaaguacucuaaacugcuaagccaucccccagcuuucuuucuuuguuugugacagguucucccuguggagaccaggcuagcuuggaacacagcauuccuaccuauaccucauaacuuuacaauacuaugccugcuugaaagcauguacuuucaaguuacuuauuaaauuuuguaccucaaaauuuucucuacauuugauucuuauuauuacauaauauauaauucuuucacagggacaaauguuuuggcaaccaccaguauuagaauuauuaccaaauaaacuacaaacaaagcuuucuucugaauucuaucucuauagugcuaggauuaucaggaaaggaaaccaaggcacuuacugacuuccaaguagcaacauuuuuuucaacaaaagugaauauugugucacacugauccaaaggaaggcagucuaagacaucucccaauagcacaaaugguguggacgcaguacaaacaccuacaaaugggguauaaaucaaugaagagcuagugacacugccuuccagcacaagaaagagaauccauggacaggcuauauuacaaaguaauaauaaagugaaaguuacuauaugccucuaaaaucaaugucaguaaagaauguuucaaaaaaagaauguuucagccauugacuagaaguucaauaaguaugugucaagcugaaugaacauuauuuauagacaaacuggaaacacaaaacauaaaguacuacuacuaauaaucucuuucaaaaauaagauuuuccacugcagacuauuguauuuaagccuuuauuugcagcuuaaguagacaaguccguguucuaggcauaguucgcaggaaagccaucaccaaucuuaaguaaaugacauagcaaguuaaugaacuaagcacacauuguaaacugaguaacagggaaaggaaaacuuuuggggaacucaucuaaguacacuggauaaaugaaucaacaaccgaacuaauaaacagccuacacaaaaguuuaauaaguaaauaaaaauuuaggaaguuagauuuacaaaacagcucacuuugacaaugggaaaccauuuuuaccuugugugcucaaaagaauaugugauacaaaugauacuuaacagguucaaaggucauuuucacaaauauuauuuaaauuaaucacaggguuaagaaauauugaugaacugcuuuuaauuuuuacuuccugaaaauauuuaauaaggucuuaucauguaucagccucuacgcgccuauguccuguguuuaaagucuuuuaaaccaaucuuauauuggcacugauacauuuuuacaaaagauuuauuuauuuuauuuguaugugugugcccgaguauauguaugugcgcuccaugugugcaggugccugcaaaggccagaagaggccuucauauccuauggagcuggaguuaaagguaguuaguuaugagcugccugucauagauguuggaacugaacauagguccucuguaagagcaucaaguaaucuuagccaaugagccaucuuccagugccccagugcuguuuuuuuuuuuuaauuucugccuaguuuuucugcuagcagucuaccccaauguacuuagucuucucaguacgagauacacuggccuuuaaacuaacccacaaaucuuaguuccuuugccauucucaucucauauaauuuucuagcuaugcugaacguggccuuccuauaucuaucuucuucucuauuucuggcaaacuuuauuucuauuuguagaccagaucuucuuuuuuucauuuuguuuuauuuugacuccaauuucugacuguccugauucagccuuacaagugugggauaauagguauuugucacagauccaagcucaucuuacuuuuuaaaauucaucaacaaacucuaaccauagcgcuuacagcacucacacacucacacacgucugcccugcauuacccaguagacucuuacacugaaccucccaauccuaacuuaguacaugcauacaauaaaugcucacuaaguacugauauaugauuaaaacacuugaaaacaaacaaacuguaauguacaugacauaaucgugaugagcaguaaguaggaacaucuucuuggcaaaggaaggagucaaacaaugagcaggggcugugagugugggucagugguagcacagcaugcaugaggcccuauauuuggucucuagcaacacacauaaaagaugaacaaaaccagacagaggaagagguaugucgagagucuuaaauaaaacaggucagaucuaaaacaacuuuuaggagaaacagaaagauacuuacuuucggucacucccccaauagcaagagaaauaauagcuaaaacguucucacaugcggaaugauuuaucuaccaacagagaaacaaguuuauuuagaagcaagaauuugcacuaauuuguuaacaauaaagacaaguucuaugaaauuaagcagucauacaaacaggaaugaaaauaucuuauacaaaguuauuuuauaagaugaaaaaccaugaacaguaauauacacacuaaguauaucaagcaguaaagagugagucaaucaaaacccaacuugugaaauguuaacuuuugcaugacuacgguuauaagauuauugggcacagaaguucuaagguugugggugaaaggcaacagcaggacaaaagcagggccuggacugaauccauaguaacacugcagacuuagcagagggccuucugcaggaagguaacaauaggaaaagugacuuucuuagcaccucauaacagagaaacgauuaaagcugaaaaaaagaucaauuggucugacccagaauuaucugacaaaaagaggggggauacuauauuauggucaucagaagagaaucuaccaccaugggacccaauuucugcuuaaucaaauauaaauguuaaaaaaucuuucauucaggaucccugcuaaagguaauauuuagauucuucaugguuaaauuucuucagcaggguuaaacaagccuuaguuauuuauguaugcuuauagcugaggaaaaaucccacaagaaaaugaggacauggaauccucgcucuaugcuuaacaucuuuggacuagaccacuuuuacacagugugucaucauuuauauaacaaagugagacucuacuuuuaaaacuacauuuuaaaaacuguauuuuguguaccuguguguguucuuuauggaggucagaggacaacuugcaggaguccucuccuuccaacaucuaggaucuagagaccaaagucaggacauggcgcucuguagcaagugccuugacuugcugaggcaucucccugagucagucuuuacuucuugcucuuuaagacugaaugucaaaccauuucuuaucaucaaagcuuaaacuguaccugagccaucaagagccuaaugcauugucucaaaggcagaaugcucaugcccagaaaacaugucauguuuaaauauccauucuaauaauaaagcaauuuuuaacaacaugacuuauuaaccggccagcauauuuuaacaaaggggguaaauacuuacaauuucuucuuccagaacaccucugaaagcuuggucaaggguacauuuuuuuucauuuucacuauuaaaaacauaaaauaccuucauuucacaaauaguucacaaacaucauggaguccucuuuucauggacagugugcuuuaccugccagguaacugacugaaggcagucaacaacggcuugauauuuuuguuauucaaggcuucucugguagauuucuacaaaaauaaaaaugacaaauaaguagaaagcuuuugcuguuuauaaaaauuuaccauucaucaauuauaagucuuucuaacuaaaaaaaaaaaaauguuuuaaacugggaaauauuuucugccagucauuuuuauuaacuuuuauuucuagugaucguaauccuuaucccaugaaaaccugccaagagcuaacuagacauuugcgccacagguuucccuuuccuauguaucacaccaaucuauguuuccugcuuuaaaaaaaccuugcuaaguuugauggggcaucauguaaccagugcuggggaaacaucaguuuacggucaaccugaauucucugaguuccagccuagccuaggcugcauaacaaaacccugacuaaacaacaacaauccaaaagacaauaccacaaagcaaagcuugagaacuacuuaucuaaaugcuguaauucaguaguggaguucuuugcuuggcacguucuacccccaggacugaggacaaggggcagagggagagguuccuuucuuggcgggguggaaacugacuucagggcuccugccugagaaacccgucccgcccagcuagcuaaugagcugaagcugacugagcuagccugggugagcuuuccacgcucgcccgcaggacgacgguaacgaccaggggucucgggacuugcccgcggagggagggucaggacccacagacgcguagccagugcgccuuucccuuaaugucagucccggaaggggccaggaacggacccggcggcgaaaaucccucagucccuucagcgagagaaagggaaagaauagcgccaggucagaaccacggccuucagccccucagcucaccguaaaucgcguccgcgccuccggcaaacugaaaagcgccggcgucggagacaucuugguugcgcgugcccaccacugcacugcggcgcccagugaugacgucagguugggagcaaagagacggcaacggcuagaguggccagcggugaagaucuccggugcgguguggcucagccauguggcgcguaggccgggcucugggacuccacuagcaguggagcggccuaggguguuucguguugucagcuccgcccugggcacggcaaggcugguuuuccuagagggugaaugacggcuuggugccgcuucaagggcggugccggaagguagcgcucgcgagaa

SEQ ID NO: 8810 - RNA, 52056 nt, Mus musculus
uugaaaccacugucuccugcaugagauaugcuucgacccggagcuccaccauuaaacuaccucguguucuuacaucaaguuggucgucuguucgugauucuugggugcacguugaaucggaaauugaguggggguuuccccacuagguucuuucauuuggaggccccagcgagaucgaaagaccccuuggagguacguuuguuugugugcgucuuacauguuguccguugucuaaguguggcaccacuaaauuugugucuugguuuguaaauuugugucuugguuuaugaauuugugucuuaguuuguaaauuugugucuugguuugugaauuugugucuugguuuuaggguuacgagaucguggguucgagucccaccucgugccuugguuuuacaucuggcagagugaggaaugagugcuuagauacuggugucuuuuauucucuguugcugucuuguuuuuguguugcugucuuguuuuuguuugugguuuuugucaugggacagacuguguguguggugccgacuguggacuuggacuuacauuaggacagaauuugucagugauaguuaagaaaaacaacucugcacaucccuggcugaacacagccgcaggaccggacugagaacuuccggcuucggcggcagcagcagcgugcacuugccaaggcgaggugucacgugagaaacuguggccuggggggaacacugauguggagguuuccccgggaugccugcuccaccaccgccauacauuucaccaccugcggaacgggcaagaaaagaaagaggggugaggcccacagggcccacgcuggccccuccuggcuuucuaggguugacuagaguugcugccuccaccacauuccccuccgcccccuuccccaaguuggcccagugcagccagcugugagagcugccuucucuucccugccccacguguuuucucuucuagggucaccccacccuaagcugcuaaccuucgaagggagacaucugcccacuuaaaacuucugucccagguaaggagcaccuaugagucuaaucaccaggcucugacaaauggguauagaggucuaaaaaaaggugagcuuaaacuguaaggaagagcaaagcuucagcagacucaggagagauagauacuagugaaauagagaugaaagagauuagagaggucugagaugagagagauaccccaaauaagaaauauuuagaguagaaccaguaaguaagaggcagagaaggcauaugacgagaggagaggaagagagagagagagagagagagagaggagagagagagagagagagagagagagagagagagagagagagagagagaggcgagaggcagaagaaagaaaagacaagagggaucuagacaagagagaaauuugacuaaaaucuuggccgcagagauaagagagaaagaaaaagacaagaucuagacaggaaaucugggcaacagaaguccgagccuccacuaaaaaggcucagcugugucagauugaaguuacuugagauacauccuucgagacgggaaguaguggcuaaagaaagccagaaaaaagacuguaacucagauccccaccccaacuacacaaagacaaguaagaaaauucuugggcaccgcugguuucugcaggcucuaaauaccuggguuggcgaccuuagcugcccauuguacacccuaaccaaggaaggagaaguguuuguguggaccccagaucaccagaaagacuuuagaaaaaugaaaaaggcccuacugauggccagccuuugccugaccuaaccaagccuuucacucuauguagaagagagaucacgggucgccaaaggaauccuuacucagacuuugggacuuugaaaaaggccaguggcuuaccuauccaagaaguuagauccuguugccagcgggugguuuucuugccuguaagcuauugcugccauagcucugcuugucaaagaugcuaauaagcucacucugggacagcaaauaacuguagugacaucccacacucuuaaaagcauuaucugaaagcccccugacugauggaugacgaccaacgcuccugugacacaucagagcuuuuuguugacuaaacgaguggcguucgcuccaccuucuguccucaaucucacuacccuacugccugagacuucaccuacucaucacugugcugacauucugguagaagaaacugguacucaaaaugaucugaaggaucagaucagccuuggccugagaguucgagcugguacacugauggcaguagccucgagguugaagguaagcagaaggcagagacagcaguacggugguggacagaaaccaaguaaucuaggccagcagccucccuaaagggacaucggcccaaaaagcuaaacuugugacuuugauacaaagagggcuguugacaucugcagaaaaagaccuaagaugcuguggcuaaaagaaaucagauggcaaaucuaaccgccaaacauguggcccaaagagcaaugauccuggcagucaaggagccuaaagauuauuaugaugucagagauaccagcuuuagauacaccccugaacacuaucaaguuauggacauuacuugacccaccugggggccaagaaauuaaaaggugugguuagguccuuuaacuacuauguuacaggacucucugacuuggcagaaaaaaauagucaaaagcuacaaggccugugcuaugaugaaguagaauuuacagaaauuaagccagcuagauauggcaacaaguacuuauuaguguuuauagacaccguuucaagauagauaaaagcuuuuccuaccaggacugagaugaccaaugugauagccaagaagauccuaaaagaaaucuucccgagguaauggaccugccuuuguugcccagguaaaucagggacuggccaagauauuagagauuaauuagaaguuacauuguacauacaagcuccaaagcucaggacagguagaaaagauaaauaaaauucuaaaagagacuggugcagacuuggugcuccuuccccaugcccaauuuaaaacuagaaauacucccuuuugauucagccuuucucuuuuuaagauccuuuaugggacucccauguucaucacugucuuaaaugauguguuuaaaccuacauauuguuguaauaauaaucuguaugcuaagauaauaaucuguaugcuaaguuaaaaggcuuacagguggugcagaaagaaggcuagucacaauuggcuacagugaacgagccagguaccacaaaagacaucucaccaguugcagccagacaucugauccacguacaccuacaucaugcccagacccucaagccucacuagaagggccccugcauaguucuguuuacuaucccuucuuguucuuaugauuucuauucuccacauagagauaauaaacuucuaaaauucuaagauuagaauuacuuaguagaagaagaggggaaugaaaggaaauaaaauuugagaccugugauucauguaauuuaugucaaauaucccaaagaguuguuugugagcuuuaaaaccuggggcugcaaacauagcagaacaggccaggacaugcccgggcaggcccguccugacuggccuagugccucccuaucucccgcccuucugacagucuguugauguuuaaauggaccaaucaugugaaaccgcgccaauuccucccccagccccaccccuuuucuauaaaaaccccuagcuuccaagccucauggucaaaaccacugucuccugcaugagauaugcuucgacccggagcucugccauuaaacuaccucguguuguuacaucaagguguuguguucuauucgugauucuugggugcacguugaaucggaaauugaguggggguuuccccacuagguucuuucaaaaccaaauaaagcagcuacacaaaucauauaaauuuaggccaaucaaagaauuuuacuuuuucuagcuauaauuucaagauaaaauacacuuugucauuugcugaacccaauaauuacaauugcagagaauuuucuaggaaaaaacaacuaucagcuuauuugccuuagaacuaagaagcugcagacuccuuuuaaaaaacaguuuuucagcaggagcuauccugcuugccugucuccuggcuaaggugcggggcaacuuagauagccuccacuguguaaacugagacugaaucaagagauggauagauagucagcagauaaaguuuuaaaaauuuuuucuuuucaacaugaaauauagaauaacagucauucagacaacaaaacaaaaccagacaugaauugacccguggacagauugguguaccaaacacagacaauacagaguauagagaacuugauguaaccagaacuaaggaugucuucuguaggggccaaagagaaagcagggcaucucccgauuucccucugucccugggagagcucugaaauccauuuuccuucucucuucaucucucucucucucaugucauuuguauaucuagcaucuccuuuuauuuuauuuuauuuuauuuuauuuuauuuuauuuuauuuuauuauuuuaagcccuacuccucucaccugaugcaguucuugacuguggacaaaugccugguuagaauuuucuacucccauuuuccacugucaacccuuagcuuauaucagcgcugggccaaugcugacucaguguagccuguauccuuuuugcacccuuaagaucaacagccuucaaaagaugacauuuguaguguuaauauuaauucuguguguuguuuacugugcaaggauacauuuuuuuucaauuuaaaugaaaauauugcauauuuauucaaauuauguauuucauugacuucugugacuucuauacaguuuuauacauuucaauuacaaguuugcaaacuaaucugucuguauuuuuaacaacucccuucacuuuuugugaacuacugugaagauuuucagugguaggaaaaggaaaguggauaaagauuuucauuuuuauaauguaauaucucucaucacccaaauaagugaauuuuguaguacagcauucauuccacuaaagaaucuccaaauucuauucucugauccauaucuuauccaccucauaucugccucugcuuuuuuuuuaauuucaagauucuuuuuuuuuauuagauauuuucuucauuuacauuucaaaugcuaucccgaagguccccuauacccucccccugcccugcuucccuacccacucauucccacuucuugguccuggcauuccccuguacuggggcauauaaaguuugcaugaccaaggagccucucuuaccaguaauggccgacuaggccaucuucugcuccauaugcagcuagagacacggauauuagcccaaaaacuuagaacacccaauuugcaaaacacaagaaaaucaagaaggaagaccaacgcauggauacuucauuccuacuuagaauagggauacuucuuccuaccuuucuuguggagcuccaccaagacaguguuuuccucaguuggucauuacguauucaggccgccugaucgaggcaccaccuguagcugcccacagcuacaugaacuggguuucugaaagggaggcuggggcuguaugggagaaaaugagagagaaauaaugagccaagacaaaguuuucugaccaaggcccaaaguuuacuuaagagucugagcuuauaaaggggaagguucaucuaccaccaagccaggcucucgucacaacuggaccauauucagagagugagagacuuuggagcacucaguccuaaguggaaugucuucaucaaccccuccuuucaggccucagggaacuguagguaaaggaggaagauuuugaaagcuacagucaauggaugacaccaaggaaacagggucuuccagauacaacaggacugaugcauguaagaacucacagagaguguggcagcaugcacagguccaagccagcaguggucccaacacuaaaagcggguaguggacauaaccaggaauaaguuaucuccaguugagauccaguagcaaaggaacaacuaguuuucuccaauggcauuucacuggguauauaaccacauuuaaagguaggccucaugcccagcaguaaauagccaacauaagaagaauucugguauuuccauagacauuuugucucauguugcuuuguuuggacaucuuuugcguuacugaucuuucaguuguauauuuugguuuccauuuuuguaguuuaugguauaugucuguauguguuucucuguuucuuguguuuucucuguuauuuuuuuucuuucuuuucuuuccuuuuugcuaaaugauagggguucucguguagcccuggcuguauuguaacucucuauguagacaaggguggccucgaacucagagaucaaccugccuccagagugcugggauuaaaggcaugccacaccauaucuggcauauuuuucuuuuucuuuuuuuuuuuuaaguucugguuuuuuuuuacauuuuuuugucugacuguucuucaaagagaaagaaagugugagguggggugggugggaaaugagaguaucagggaggaguuuggggagaggaaacugugaucagaauauauuuuauauuucaugacaaaauguauuuucaauaaaaaauaauuauuagacaggagagagguagauuguaacauaauaaauacuuuuucauaguuuacaguguaaauucaggaaauauuccauuaaacuugauaaauuaaauaauaagguuauguuauuuagaauuauagaauuacaggagaucugaaaugaaagagucaaaaugcagcuacuuguaagauauaaaacuaaggcauggggagauagauagaagaguuuuauauuucuuuaaaaggcuuuccuguaaauaaucagcccucuaaaucaucauuuccauaugcuggaacagcccagcauguagaaaugucaauauuacuuuucuuuugugauaaauagugacuuuaagaagggagcucuguuaaauugagacugaacauuuuccucaguuaccuaggcucucuauaaucaucacaucccauauugcccauccugccuuaucuauccucacagucccacacaugcacccgcugcugggagcuauuuucccuccuaaccuccauauacacuuagauauugugauaguucuaguuuucucuucuucuuuuuaaaagauuuauuuauuuauuauauguaaguacacuguagcugucuuuagacacuccagaagaaggugccagaucuuauuacagaugguugugagccaccaugugguugcugggauuugaacucaggaccuucagaagagcagucagugcucuuaaucgcugagccaucucuccagcccucucuaguuuucuuucuuuucuucuuuccuuuccuuuccuuuccuuuccuuuccuuuccuuuccuuuccuuuccuuuccuuuccuuuccuuuccuuuccuuuccuuuccuuuccuuucccuuucuuucuuucuuucuuucuuucuuucuuucuuucuuucuuucuuucuuucuuucuuuuuuuuugguuuuucgagacaggguuucuuuguauagcccgggcuguccuggaacucacuuuguagaccaggcuggccuugaacucaccucucuaguuuucuaagacagguucuuacuguauaguccagguuagcuuacaacucacaaccucguguuucuguuucuugaaugcuaagauuauggguauaagcuacuauuccuagccauauauuuuaauauaguuuauuuuauuuugauaccgagucucacuauuuagcccuagaaccuacuauguagacuaggcuggccucacauucacagagauccaccugacucccgugcuugguguaaaggcuugugccuggcauuguuuuuuuuccuuuucuuuucuuuucuuuucuuuucuuuucuuuucuuuucuuuucuucucuuuucuuuucuucucuuuucuuuuugcuuuucgagauaagguuucucuguguagcccugguuguccuggaacucacucuguagaccaggcuggccucgaacucagaaauccacuugccucugccucccgagugcugggauuaaaggugugcaccacccugcccggcuguuuccuuauuuucugauggucuauuacuucuuggaauguaggguccaugaguauauaauuaacaaauaauuaucaaauuaauggacuuuauugcuucaagguuuuccuuuuuucuguaauuaucuagagcucugaugcccccaaaugucuucaauauccuucaauuucuuucuucuuugauuucuaguaucaacauucaguugauauauacauacauauauauugcaaacauuaaguagauaauacagaucauaaucuauuauuuauuuauuuguauguucauguguguguaagugcagaugugugcaugccauaugugguauucacaggaaagcucuuaggacucaguucucucaugccaccugcugagauaugggaauugaacucaaguuuucaagcuugcauguaguuacuucuacccacucagucaccuagcuggcccuacagauauaaauauugccguaccucacguagaggguagaaugaacuauucauagucuaaggggaaauacaaaauauaacugcuauauauccacauaaauaggauaauauacaucauuaacugcuaauaaauagcaaauacuaaaaaagcaaaugaagcacuaaaagggccaguagaugcaaagaucaguuguuuacaaaggcagagaaggggcaggagagcugguuccaaagauuggcugcuuuuccauagaauguguguucaacucagguuccaaggaguccagcacccucuucuggccucugugggcaccagauacacacgugguccacagacauacaugaaggcaaaacacacauacacacaauacauuucugaagaaauaaaaaggcuucggagaccauuacagaaaaguauaaccaucaaagaucagugcuauggagcccagucccaguggacacaucuaccagaccucaggcuccagcaccucaggcucaggaaacccuuuggaaagggagguggaauccucagggaucagggaguuugcugugagauuguauauccuagaaaugucagacauuacauuuauaaagucuuacaaaauggcugucuaaacaugagccaaacaaggaugacaccaaaauacaugccaaagugugugugugugggggggagagccacaaagaucuacaggcaacuaaggaaugcugagaggggaagaauccgucuucuccagggaagaacacaccaacugguuacccaaguccaaguggugauccauaaaacauacauacaaauagcauuguacagauuaagcauguuauaucuagaaauacauacaugcauggaacaacgauuggugaaaaaagagaaugugaauuugaaagagagcaaagaggagcauauugacauauaauauaacguaauuauauuauaauuccccaaagaaaaacuuuaacauacaaaauagagaagaacuuccauauuguacgguuuaaacaucuaucaucagaguaaguggagagaaauuggggucuguaggagugaagagcaaaaauuggacguaggucaccagguaaaagccuuugauauauaagccagacaaucugaguucuaacccacauaaagguagaaggagagaacugaccuacaauguuguccuuugacucccacaugcauauuguggcacauacacacacacacacacacacacacacacacacacacacacacacacacacacaccaucacugucaauaacaacaacaucaauaauaauaauaaugacugacagaguaaaagcuggaaggcaugaaaaggcauucuucaguguccaguagguucuaggaaucccugcagauacccacauuuucaaagcucaugucucucauacaacuugauauauuugcuuauacccuauucauacucuguuauacacaugggaccaucucuguuacuuauaauaccuaguguaauaaaaaugguuguuauaguguuuuguuuuguguuuagauguaaaaaaaaaaaacugggguuuuuuguuuguuguuuuguuuuuugagacaccuuuuucauggagaccaagcuggcugcaaacuugcaagguagcuaaagcuggccuuuaacuccugauuuccccacuuccacuccccaaacauuaggauuacaggcaugugcugccuuccuuggcucaucugugaaauuguuuugagaguaaagauuaaaaauuauauacuuccauuugggcuacaauaauauaacuuugguaauugaacuuauucuaaaauguagauguuuaucauucaaguacgccuacuauuuacucuguuguggacuaucuuuguuugauaguuauuuugacauauaaucauucaguagaaaauuuaacuuuacaacccugaggaggaucuguaucaguauaauuguuaucaaugcaugacugacaaaacugaacugccaggagcuuugucacucauaaacauaaacauaagcuuugagauaauuuacaaaagaucaacaugagcagaacagguacuguugguuuccuguuaaaacccacuguccuuccugaacacugauggcuuuaaguguguauaccugggcuccuaugauucauuucucaggauucuauguuggcagguauguccauguaauuaguuucuagugaagugugaguaggagcaguugauguacguucccucuuuuuuuaaaaaauauuuuuaaagauuuauuuauuuuaugaaaguacacuguagcugucuucagacacuccagaagaucuuguuacagaugguugugagccaccaugugguugcugggauuugaacuccgaaccuucagaagagcagucaggugcucuuacccacugagcuaucucaccagcccacauucccucuuuuuauuuaaaaggaaaccacuugggcuggauagaagucucagcaguuaguacuugcugcuucuuagaagaggugauuuuugggccuagcugccugcauggauguguauaauaauuccagcuucagaggacccagugcuuuucucugacuuccuuggguaacacacacacacacacacacacacacacacacacacacacuguucuuauuuauauaccuuuaggcaaaggcauucauacacaagaaaauaaaucuuuuuaaaaagugcugucuuguacuuucuuuucuugcuucuuuuuugggggggaccaaagucugcauauacauguaaccuauuaaaucaaagugaaaaagcagaaaaaaaacacuuuuuaacaccuuccuccacaaugagugauuuuuagacugucucaguauuuucugagaacuuguuagugcuuuagacuuaucuaagaucuauagaggaauuugaauuuacauuugaaaaaggcaaguaacucauguucacauuuaauuuguguguguguguguguguguguacauguauacacauuuuguuucuuguaccugcuuagaagucagaggacaacuuguguguguguguguguguguguggggggggucagcucucuuuuuccagcggguuccagagaucgaacucagacccucaaucucagcagcaggcgcauuugcccacugagccaucugauaggccccguucacuuccaguuagagauacaaguacuucuguaguagguggcagaugaauuuuacagauucuuaacguucacauuuggucuguuacuauguauuguaaugcuaagugcggaccccuaaggcuuggcugccccagagacaagagaguucacacuagaccccagggaugcugaguugaugaaacccugcuaucucagcucccucacagaucuugccucagacugaugccauuuccagagacuuugcuuccaaaacagccucaggaaagacugcugauccuggugaccuuggcucauccagccuuucagauuguuacagucaagacuucaacuaacuccucaacuuucuaagacauagagaccagacaacaaaugaugucaacuagcuuucuuuugacguaaccaguuuuucauuuccuuuuggaccuccaaacgggaauucuuugcuccaauucagcaggaagcaauuauaaggaguaugccauccauucccuuaaauugggguagaugauuuuggucauuuuauaaauuauagauauguugucacuuuaagggaugauuuauaaauaauaauagucuuggacagggaguaaacuaaauagagaacuuagacucaggaauuuuuuuuuaauuaucuuuuuuuuaagauuuauuuauuuauuuaauguauaugagcacacuguugcugucuucauauauaccagaagagggcaucagaucccauuacagaugguugugagccaccauguagggaauugaacucaggaccuuuggaagagcagucagugcacuuaaccacugagccauuucuccagccugauuuguacacuuucuuuccucuucuauauccuucuuucuuuuuuagguaaaggguuaaaaagaaaaagggggaauauauuaauauuauaagaaaauagauagagaaaauggauuauugaaucuacucuuaaaagcauuuuguagccauaauugguagaaaucuuuauauuuugauguagaauuaaaguuauauuuuguuauguuaguacagaauuuuguucacugauacagguuuuuuucauugguauacauuuuuguauuuugauaaaaaauuuaaaauuaacuuuguuacgauauguaugcuucaacucugagauaagcauugugccuuugcaucucauuuaaaaauauaagguuuagucccaucccuuuuuuguuuguuuguuuuuuuuuuguuuuguuuuucaagcccggcucagccccaucccuuuuaauagcugccauuacaaacuguuuaggauaauuacgugaugcaaguuaacagucacucaaacucauggccuugacaguuacuagucuauauuaucacaaaaauguaugcccuggguuguacagauaauagguagcuggagacaggcaauguuugcuuguucagauaugcuaugaauagauagauggucuucaaaaaucucagagacucgcagaauguggcauuuaaaaauguuuuuauuaauuuaagauuuuuuagaauugagacaugucaguuccugacagcaacccauaagacuuggaagaagauggugggcauagaaaggccuccauauggaguugcuucaacuguggcaagcuagccacugggcaagaaaaugcucuaacuuuaucuacagacagaacgcucuccagaaaggauaaaguacuaacuaaacucugccaagacaguguaagcucgaucuucauacuucuugcuucacaaaaggucugugagauauucuggacuagaaggcugaagauagaugcuccaauacuauaaggaauauuggggacuguccagguggugagcugucucagucauuucuaugguuuuuggaagcuaggucccugugcuuucuguauacucaaauaauauuuauuguuucucagaucugauggaguugaagacaagacaguuauagugucacaauuaaacuuuaaguuguuuaagauuuaagaagaaggggggaggguaugggggacuuuugggauagcauuggaaauguaaaugaggaaaauaccuaauuaaaauaaaagauuuaagaagaaguugugggucuaaaggauguuuuuaggauggaaauacaaguuaagauaaaaaaauaacuuaaauaaaaaauucuaacucacuaaggauagaugauuaagugcuuuaucuaaauugucaaauguaaugaacuggacauuauuaaugcauacgauaccuuauaacuuucauaauuguuauaauuguauucaauuuauaucugagagaaaaggagucuuuuauuggauuaaaaagcagaauuguuaagauuuggucaguugcuauguauuguaaugcuacaugugagcccccaaggccucguugccccagagacaagagaauccacaagugaugcuaugugaccuugccccucccuaaguuacuucugauuggugaauaaaaaugccuauagccuaugacugggcaaaacugagauagguggggcuuggaauuuccuugucuugaggucagaggagaccaugaaggagagaagaagguggagagaggagaaagauaccaugaguuaggagucaagaaagcauaaugaugagggcuggccaacuggaguuaagagcagcccagaugaaacauaguaagugauagcucaggguuauggauagaaaaguggauucuaauagcauagaugguagauauaguccugauuaaggcuuauuauaaauauaaagguugugugugucuuuuaucugggaauuaaauggucaaaggaagaguagaaacccuggauugggacuaaaaaugucaacaacaucuugguccaccaauaaccuuuccuccuuucuucccuaacucuuccacaaccaucuaucuucuucaaacagcuggaccuugaggccuuuuuuuuuguuguuguuguuacagaaucaugcauuuacuugguauagucugaaucuuuauugauuuccaacuauguuuugcauccacuuaggaaauauuuacugaaaaucuuucaaggcaaugcgacaaagacaacaauagguuaaugaaagcacaguagugaggaugaucuagccauaaguguuaauuccagguuucuaccuguggccgaguguucuccuguucucucuccccucucucucugcucucucccuccuucucucccucucccucucucucauuuuguccugccuucccauccuuuacccccccccccccgccccuagagcuucucccccccaagccccgcccccacaacgucaguccuucccccccuuuaugccccucccucaggccccgccccugccccgugcugcucucccccgcaccuccccgcgguggcuucuugggcgaacagcgugcggcugcgucaucgccaguggccgguuugaaugaggcuugucgcaccggagcugccgccuccaccucgcuuccaccccggccgccuccacgaguugcuucguauuccucggcugcccuugucagacccagccucccgcgccuuuucuuccuuccugccucgccaugccacucuacucuggugagcuccguccucccccgcgccgcgcccucgcagcggacgcuaggccuccgcguaggcccagccugcagaggcgcgcgcagggcacagccgugggacacggugggaagugcggaguggcggccgcgcgaguuggagcccagcuacgcguaggagcuugucugcugugucuccgaguggguugggugggagcaggaguagagacgggggaaaucucaagagucgugacucugcagaauaguuucugucgcugcccuagagugugcugggaaaggugagggugugucuuggggcucggagaccaggcugcuggagugugauugcuuugaguuccuagaugauagcaguggguggaaugagcauggaggggaaguuggagauagaaggucucaggaauuagguuugcuuacuuucugcuugguauugcacucaguagcucccuucgcucacacguuugguucuacugcucccuuuguaccgauuucaguucuaucuccaagccccugcaaaucagucuuuagugcuuaguuuuaauuucagcauacaucguuuuggauuucgaagauaaaacauaguguuaguuucgaaaggcagaugaauacaaauacuggcaaaugcuauuucuuucacuguggcauuuggcaggagucuuuucuugaugucuuuccaagguauugaccgaggaucacguuguccuuacuuaauggacuucccuguacuuccucuuagucaaaauggccuccgaaauguguguggcgacucugguuggcuauagauaugugauuuauugguucucucugacccuccacuuuaggcagacauaauuccuuuauaagauacugcguuuaaagaaugauaugaaccaagaaaaaaaaucguuggucuuaggguagauucuuuuauucauuuauuuggagacagggucugcuguguaggcuuaacuggccuggaauuuaagaaauugccuaucuuugccuaccaauugcuggcauuaaagaugugcaccacugugccuggccuccucuccuuauuucuaauacuguuuucauuuagucuuauguuaucuuuagcuuguacuauuauacauuacuuuuucauuuuaggccuguguuaucucuagcuuguacaauuauacauuacauguaguggcccacguacuugggaggcagagugggguggaucucugauuuuugaggccagccuggucucaccccccuccccccccccaaaaaaaaaacccaacccaacaacaacaaauaacaaaaacccaaccaaacaaccagaaaaacccaucaugcuacucuuauaauguugaggaggaucaaaccgacccaggaccuuguguaugcuaaguagaaacugucccucuaaacuauguucccagugccuuuuccuuuguuucuuuaugauugcaguuuguaccgauuugaaucuauuuuuccugcuacugcuagagauaucuaauaaucuaacagaccagccagccuuuauuuaaauuuacaagcaauuacacauuucguauaccauaacaggccauauguauguuuuagcaugccacaugcuaccuuuuuuguuuguuuguuuuuugaaauuggguuucucuguuguagccuuggcuguccuggaacucguuuuguaggcaagacuggccucagacucagagauccaucugccucugccuucccagugcugggauuaaggugugcaccacugccuggccacaugcaaccuuucugacuuggcccguauuaucuagcuuucaguuuacuuuucuacugucuaauucacucugggaauuacugcuaucucagaacucaugcuaaguguuuuucuuguccauuuuaggaauacuucuauuuauacugauaccuuuguuuggagauucaacucaaaguuggcaaugagaauucaaaaguuaauacuuccucuaagaaaucuuuccuaguuguguuaugguggcucauaucucuuaucuaagacagaaggaucauaaauuuugguacaguguaguuuacagagggagaccccguuccaaaaagcaagaccaaacagaacaacaaauaggaauacuuucuuacucaagaucuuugcuuggcuguuuguggugguacaugcccuuaaucccagcacuugagaggcagaguccuucugugaguucaaggccacuauguaggcuacauagugagacgugucuuagaaaaauaaaaaauuguugcucuuuaagccuuuaguauuuaugguaagcauugucacuacuauguccucuugucuuuauuaggcuguauuagcuugguugcuaugaagucaauguuuguuuauuguauaugaguggguauuuacaugcagaaugugauggucagaggaauugcuuucuuuucuucuucuuuuuuuuaaccuuguggguuauguggacucacuaaaucaggcuuuaacacacucaaugaacuguugauagcauugagauguagaguccggguuaagaauuaaaauuuugagucuagaaguuagaacuuuguuuugaaauucccauuuuuuuuaagaaaauacauuuuucaauguaugugcuuguuuuauuauuuauauguuucaaaauauauaaauagcuauuuggugaacuugagcaaagcuuuuuaauugcaguauauuuuaucuuugugaccuuuuuccuccuuuuccuucugggguggcuucacucuaaauccucagaaugagguagugcucaguuucuugaguagcugaaauuacaggcacaugucacaucucagauauuuuuaaguguuuaaguucuuugucaccuaaauucauucacauuuuugugcaaccaucauuauuucuagagucuucauucucaagcuggcacucuugcuguuaaaaacauuucuguuacuuauuagcucuugacagccaccguucuuuuaguguuuaaagaucuugacuuugaaugccucaauaaaauagacacauauuuacccuuuuauggucgauuugucucacuuuaugccauaucaccacacuugagcugucuugugguguguguaagaauuuuucuacuuaaaauugaaugugggugagcuuuucccagcaugccccuucccugccuucucuuuuucccucccauuuccauuuauauucccuuacccucuugccacagggaucagccccagagccucacacgugcuaggcagcagcuuucccacuggccucauccuaguccuuucucaacuuuugucugaaugaugcugcucugaaggaguacacaguuagcuacuuugaguccuugcuuauguacuucugggugagaaauuuaauaugguaauacucgggcuggcaagauggcucagcggguaagagcacugacuguucuucugaaggccccaaguucaaaucccagcaaccacaugguagcacacaaucaccuauaaugagauuugaugcccuguucuggugugucugaagucagcuacuguacuuacauauaauaauaaauaaaucuuuuaaaaaauaugguaauucucugcuuaaauuuuuuugagccagugucccauagcaaccacuguugcacaggauucuacuuucucuacuuccuuacgaacccuuguguuuuccuguuguaagcagcauuuugggugggccagcaaagugagugugcuuguugugccgccugaggucaucuguagcaccuacccacauggugggaggagagaaccagcucauaggaacucuccucugaccacagcgauugcagaggcaugggcaccucccaugcacauccauggacacucaggaauaaggaaaaggcaguacaaaauuaaaagacacuuuuuuuuuuuuuuaaaaacuaugcuugcgugcuuguccacuucuaaggcugaggcaaaggaaaacaaaauugagcucagucucagcaaugcugauuuucaaccucaagaagcccccaauuaaucgggggaaaacagcuauuuuauguagcuaaugcauauuuguaguuuuguauacuugaguaccucuugcuugggaaacagccuuucauuucucucaugccuuucuuauaguuuagaacuguaagauuuuuuuucaaaaacugguguggugcacguaugucugcuuuugcagguacaagacaacuuucggggguuggcucugucuuuccacucugagagcuggggauugaguucuugucaucaggcuugugagccaagggccaaacucuauccucugaaccgucucauaggcccaaggauuguuacaaccucucuagcgcucgcuugcucucucucugucucucaaauugagacaaugucucauguauaucuuguuggccuggaacucuggaaaggcuggcagugaacucacagggguucaccuccuucugcuuccugagugcuagcauuaaagguguguauccacauauccaacaugaauuauguaauuccuuacccuguucucaaugcucuuuuauucucucaagauuuauuuucucauaaccucucuuuuguaccaacaguauguauugcuuuaaaccagugauuuuuuaaccugucggucuugacccuuuaauaggggcugccaaagaccuucaaaaaacacaguagcaaaauuacaguuuugaaguagcaauggaaauaauuuaaugauuggggucaccgcaacaugaggaacaaaguuaaaguuccuaaugcuggaguuaggaagcauuaggaagguuaagagccacugcuuuaaggcuaaccacaucaugaaggccaggaacuuuauccugggaaaugauucagugugcuuagagguucaccuuaguuuacagagugacauuaguggaucagucacuucucaagucagucuccuccccucuuccuucuucuucccuuccuuuuccuuuuguccucuugccuucccuuuccuccuuuauccugcagcacugggaaagcuguacuuucaacacauuuguauuuagauaaugggaacugaguuagauccagugaaguuuugcuuuggauccauugcauuuauacuggcucugaaacaugacguugguagguaggggcggaauugagacacagucucucuguguugucucugcuggcuuugaacucacaaaaguagcuugccucugccucccaggugguaggaccugguauauuuucaccuuuaaaagguuaugcccuaaugauuuucuaaauuugaggucuauaaauuugaacauuauguaagugaaaauauuuguuuuuguuuacaguuacaguaaaauggggaaaggagaaguuugaagguguagaauugaauacugaugaaccuccaaugguguucaaagcccagcuuuuugcauugacuggaguccagccagccagacaaaaaguuauggugaaaggaggaacccugaagguaaaacugauguaaaaugucauaaaugcugcuuaacaggacgaaugcuagagacuagguuauuggagacauggucucaugauguaacccugacuggucugaaucuuccugguagaucaggcuggccuuaaacucucagaucugucugcuucugccucccauuuaaacuguucuagugauguuguguaugugaggagcaucaugucuguuucaaaauguagcauuuauuuaguagauaccuccaguggucaggacuauagcaugcuauaauuaucuguaguguuugaaauuuuugguaugaagauguuaauuuuauuuuuguuugggcuaguaaaaaauggauugguauaucuuuaguaauuuuacauacagggauagaaaauuuuauuuguuauaaguauacaaccagggguuggaaagauggcucaguaguuaggagcacuuguuucacuuacagaggacucagguuggagucccaacauccgucuggggacccacgacagucuauaauuuaagucccuuaugguuucccaggguaugcaaaauaccugcgcacaugagcuauaggagaauaaaaaugcaacaguaggaauaauuuuuuuuuaaacagcacagaauguacuuuuguaauauguauuugaauguugaaauuuaguuuaacaucuucaucagagcccugcuucucaaguaaugggacacauuuuuauacauuauucuuaccuuuucucauagucugcauuuuaaagaagagucuuuuucucuuaagaguaacugcugucggggccuggagagaugcucacuggugaagagcacugacgguuuuuccagaugaccuggguucaauuuccagcagccacagcacaagcuuauaacuaucuguaacuccagggguucugauacccucacauaggcauauauauauauauauauauauaugcaggcaaaaucacuacugcacauaaaauuuuuaaaaaagauaaaagaaaaagacaguaauuaucuaauuccuaucuagagcuggaaggaaaaaugucuauuuaaaaggagaaaaaaaaaccccaacauuuucuccuuuggagaccauauaaacccuauaguaaggguucaagcuuaguagccuuugauggaggaccauaaaaauaaugaggguuuuuuugcuuuuguguuuguuuccucuuauuguucuucauaccacauaaggaucgcugaaaaauauuuuuguaggcucgaugugacauucugaagaacaguaguuaacuuaggauaaggacugccugcccauugguugguauagauagagauauugaugaaaacuuguuuacuccccaaagccuaugagccuuuggcuuucagggacuuggauagcuaguuuguggugggcuguguccuaaugggauacuuuagaauauagcagaaaauacuaaccaaacaaaauugacuaaaaauaaauaauauuuacuguauauaucuucuauaccagacuuuuaugauuuuucauuacuuuugaauuauauauuauuuauauuuuaaagcuaagggaacauaaaaugugagauguaaaaggcaagcaggucugaauugaagcuuuaguuuuggggcaggcauguaaauuuuguuuugagguagcuucaaauuuaaaauugugcagaugugguuaaacauguuuguuugucuuugaaauaggaugaugacuggggaaacaucaaaaugaaaaauguaaguauuaagaacacucauuacaaugaagugagccagcuaucucaccaaaauaaaucucaaggucccuuuuuaaauguguauuuccaguuguucagcaccauuuauuuauaauucuuauucaauuauaauuuuagaagaagucauuuccacaaguuaauuuuguuugaaaauacauagguguuuagaccaauuaggagaggaugagccuacuuugaguacucuaucuucuaaaucuuagagugugggaugcguccuauuuuguuuaggucuuuaauuuggcacaacagaguuguguuucaguauggagaccuugccuggcuuuuguuagauuuucagaaucuaguguucuguugcaguaggagcaauauuuuaaaaaauuguuucucaauguuuauggcuaguguauaaaauauaauugauuuucaauuuuauucuuauucugugaucuuaauucacauaauauuccaguaauguuuuuggagauugcauugucuuugcaucuucaaauaaugaauuugcucuuccccuuuuaguuauugugacuuuuauugagauauaauugcuaaaccaaauaacuucuguuuuguuuuuuuuuccuugaauucuuaguagaauuucuaguauacuacugaauagaaaauagagaguggagauuuucucuugaaucacuaacauuuaaaauuaugaacaacuguuaaaugucguuaaguccuuuuucuguuacuuguuaaaaugaucaucugauuuuauuuuauuuuuauacuuuguucagugucauuguuaccugucaccauccucuguccuugguacuggggauggaacuuugggucuagugcaugcuaggcaagcucuuuaacacugagaagguacacaccaagugugcucucacugauucucaacccaucccuaacaccugauacuuugcuauguuguuuaggcugguucugaacuccugggcucaggcagucuugcuucagccucaaaaaaugaaaaauguguaucugguggguaugguugguauacuugccuugaaucccagcacucuggaggcagagauaaguagaucucugggagguccaggucagccagggauacuuaauaagacuccaugucaaagaaaaaaaaugcaacuaaccccaaaggggaucuuguauguggacuuuacccauugauauuuaucauauggagauauuaaaacugagauauuuagggggcuggagagauggcucagcgguuaagagcaccgacugcucuuccaaagguccugaguucaaaucccagcaaccacaugguggcucacaaccauccauaacaagaucugacgcccucuucuggagugucugaagacagcuacaguguaacuuauauauaauaaauacaucuuuaaaaaaaacugagauauuuaaaaauauuauucauugauuuaaaauaauuacaaagaaaguuggcaauugacuuuguggguaagggugcuugcagcuaagccugggguccugaguucaaucccugaaacccauaggguagaaggagagaccuggccucugcaaauuguccucuggccauuauguguuguacguacacacacacacacacacacacacacgcacacacacacuuaaaaaucauaaauaaauaaauaaaaaacugagaaaagugccuagcccaguuugugaguugacauuuucaggagugauaaccuugagaacuagcaucacucagugggauguaacuguuuauggcuucucaguguacugcagaggaucagcuguauucagagaugagauuuauuuauaacaauauuugcgaguuuaugauucugaaagaaucucaggauccaguggagguucacagacaauaucuagaguacugagacuguuuaagaggaagaaauguuuaucuccuuaauauauugcuggguuccaauuuuuuuuuauuuuuaaauauauuuuuaaaagauuuauuuaauguauaugaguacaguguugcugucucagacacaccagaagagagcauuggaucucauuacaaaugguugugagucaccaugugguugcugggaauugaacucaggaccucuggaagagcagucaguguucuuuaaucuuugagccaucucuccagcccggguuccaauucuuaauuaggauguuugcguguaugaucaugagacuuguuagccuucauuucuauauugauuuacggacuuacuuugugacucugguuggccuugaacuucguauguaguggaggaugaauggccuugaacugaucuugccuuugccuccuggugcuaggacuagaggccugugucaccauaccuggcuagucuguauuuuuauuacauacuuaacuuuauugucagaauuaugcugagcuuauuaagagaguuggagaaguauuucuucuuuccugaugaguuaaagaguagauguucuucacauaugugaaguaauuuaccagugaguucuuuuggaccagguuuuuccuugugugugauuauuuuaacuuccuuaagagauuuguaacuuucgcuuuuucuuacauuaguuuucaaugaggguguuuuaaagaaagggauagaaggagagagaacgcugagcauccguccuugucucccacuguguuugagauagggcuucuuugcugcuguguaggccaggagcguuagccccugcccuucuggagauuuuccuguaugugguuccuuuuuugucuaggagcacugggauuagagauguaugcuggcauguccuguuuuaugaguugugucucuucaaacucauauccuugcuugcauggcaaguacuuucccuauugaguuaauauuuucccaguccuguaggaugacuuuuaaagacauccuaugcccauggauuugcagauccuccuguuucuaucucccaaguucuaggauuagaacauauagguuugugcuaucaugccuaacuuaauacugucuccuguuuucuucuucuuuuuuuuuuuuuaaaaaauaaauggccugauuuauuuuaaaauucaucaguuuuuuuuccauuuuuuauuagguauuuagcucauuuacauuuccaaugcuauaccaaaagucccccauauccacccacccccacuccccugcccacccacucccccuuuuuggcccugguguuccccuguacuggggcauauaaaguuugcaaguccaaugggccucucuuuccagugauggccaacuaggccaucuuuugauauauaugcagcuagagucaagagcuccgggguauugguuaguucauaauguuguuccaccuauaggguugcagaucccuuuagcuccuuggcuacuuucucuagcuccuccauugggagcccuaugauccauccauuagcugacugugagcauccacuucuguguuugcuaggccccggcauagucucacaagagacagcuacaucuggguccuuucaauaaaaugucuccuguuuucauacugaguauuaauggucuauuuaaauauuugcauccuuaguuuuggaagaaguuuccuuagucauauuuugguaguguauuagaaaaaguucauggagaaauaaaaugaagguuugaaaguuauugaauucaacauagauauuuugugugugugugugugugugugugugugugugcggugguuguuuuaauccugaucacaguuucccuucuacuccuuucagcucucuccccuacuucccuucuuccgcagauccacuccuucucuguuucucuucagaaaagaaaucaaccaaauguagcauaacaagucacaaucagacuaaccacauacccugauauuaaggcuaguugagguaacccaguagaaggaaaagggucccaagagcagccaacagucagagaacccucacccccuauauuaggagucccauaagaacaccaagcuacacaaccauaguaugugcaaaggacuuaguucggacccauucaaacuuccugauagucaccucaggcucuguagcccccguaagccaaaugagcccugcuuaguugacucugugggcuauauucaugugguguccuugacuucuccugcucccauaauccuuccucuaccucuuuugcgggguucucugaguucugccuaauguugacugugggucucuguaccugcucaacucugcaucaguugcuggaggaagccucucugaugacagcuggucuagugugaguauagcagaauaucauuaggaaucauuucacuaaccuuuuuuuuucuucuuucuuuggccaguugaguuugguucuaucuuaaguuucuggguuauccagccucugguuccuggccauccaagcaugucuuuuggugugguggccucaaguuggccagucauugguuuguuguuguuuugaggcaggaucucaccacauuaucauagcuguccuggaacuugcuauggaguccagacuggacuagaacucagaguauuccauguugugacuucucuggagcuggaauuaagguauuugccauggugcccagcucagauacugcucaccuuucuaaagaaacacagucacucccuccaacuacuaccagggcuagguugccaggcaucuguuuuguguagauuuuccuuuuuucagcuagucgucaugcuguagucugagugcuuuugagauuuccuuuauugagcauaccauugucagcuuuuaaguguuuucaugaauuuauuucuuuuguacagggaaugacuguacuaaugauggggucagcagaugcucuuccagaagaacccucugcuaaaacugucuucguagaagacaugacagaagaacaguuagcaaccgcuguaagacgcaccagauuuuauguugaagggcaguuauuaagaugccuuccagaaaguaguaucuaaagguucuaacuauuaacauugauguagcaauaaguagaauuuuaauauuuuugaaacuagcuuaagcuuggccuauugucaggucaccauaaaacucagaaggauauuguauacuuugauuguuguugcuuuucuuaauuuagaagugauuuugacuuagccuuaauuuacauuuagcauuacauacggaauuucuaauucagggcuuaugcuuuuauacuucaaagcaaugagauauuaaaaaaaauuauuugggcuggagagauggcucagugguuaagagcauugacuucucuaccagaggcccugaguuuauuucccagcaaccagaugguggcucacagccaucuguaaugagauccgaugaccucuucuggugugucugaagacagcaacaguguacugauauacauuaaauaaauaagucuuaaacaaacaagccccccaaaaccaaacuauuuuacagaugguguuauaaaaugcacacauaaauauacagauauaaauugauauacaguaaguauauauugggaauauucaauugaaauauuuacuacuuauaagaaagcaggaucaaagagaagcuuaaaugcuagaauauuuaaauucuuaaaaccuuccguguuaaauacaguuuaucuucauauauauuuuuuaaaugguacagagggucaaaacuagggugugcuaaagcaggugcuuuccaccaaggucggccuggccuuuaucccaaaauaaauguaaagucaauauauaaaauggccaagacaugucaaauuaaagcgaacaaauacuuacuauuagauacauuguuuuuggaagugagggaagaucuuuugagacugagacucacuguguuacccagacaaucuugaauucaugauacuccuuuguucugacuauugagauugcaggcaugcacuaucaagcccagcucauuuguauauuuguuuuuguguacuuguuuuaagucuuucuaccuguuucuuuugcuaccuguuuuuuuuuuuuguuuuuuuuuuuuuuuuguuuuuuuuuuggccaggugaauugauaggcuuauccucuuauuuucuagacaguaauuacuacagaauucuugccagcaugaugcaaguaaaauuuuucuguugggggaagugagacacuguuuuagugugaaguuagaguauuaguuaauagggcuaaaugauuccugacucagagugugaaguuuagagauuaaaguaugucaugccauuuuauaaauguguuuauuuuacuccauccccuuuuaucagauggaauugccauguggauugacaaaccuugguaacacuuguuacaugaaugcuacaguucaguguauucguucugugccugaacucaaagaugcccuuaaaagguaaggcugaaaagacuuuguuuaaagccagguaguaguagcugcacaccuuuaaucccaggcagaggcagcugaaucucugugaguuggaggccagcaaucaagcaauccccccacgucccccaaagacgucucugaguaaaggugguugacuuuuggaugaguggcauggcugucuuucauggacuucuuugaggggcucauuuacuaauaccaguccacucuuaaugcacucauaguuuuuauucacagaauuguacaacuguuagcacacuaaguuuugaaacccuccucucuucuaagaaaggaaauguggccaggcaugauagugcauacuuuagugucuggucuacaugugaggucaaaagaaagaaaggaagggcaugugcucacugcagucacuuuuauuuucucuacccaccuuuagcaauucauuuacuuucuguugugaaaaguuugcccauuugcagacauuucaucuauaucuaucuauaucuauauauauauauauauauacaccauauaauauguggucuuccaguuggauuuauucuuucauaauaguuucagagguuuauccaugaagaacauguauuacugucaccauuucuagguaugcacauauauaauaguuuacuuaauucuguugacauuuggguuguguccacucuuuaucaugagaaaugcuggcauggacaguguguuaauuuccuaaugcugugauaaaauaccauaacuaaguuagcagcuuaaagaagaaaggguuuauguaggagauacaccuaaagaaagcauuggaggaaccagauuuguugaacacuagggccuauuuucuucaaaggaagaaaaucacugaugccugguuacugggaaggcuggaguggauguugucuaaccuugugaucuuuucgcuguucuguggagccagccuuccugaauccccuccauauccugagcaucguuuagcccuuauccucagcauuagcccauauccugagcauuagcccauauccugagcaccguuuagcccuuauccugagcauuagcccauauccugagcauuagcccauauccugagcaucguuuagcccuuauccucagcguccuuucucagugacuagaauucauccuuaugauagauguacuuuguauccuccaucaauagacuauccuuauguuuauuacaaauccuucuuauguccuuuucccgaguacuauuuauuagucaguacaacucauuguaaaggucacagguguuuugcuacuuggcuagggaguuuucauaaagcuauaccuaaagcuuuguugugauaauuguacauggaaaccuuuucccaaaguuuuacuguuauuaaauguauaagaaaaauaaacccggggcuggagagauggcucagggguuaagagcuuugacugcucuuccgaagguccugaguucaaaucccagcaaccacaugguggcucacaaccaucccuaaugagaucugacuccuucuucuggagugucugaagacaacuacaguguacuuacguauaauaaauaaauaaauaaaucuuuaaaaaagcaaaaaagagcugggcgugguagcucacgccuuuaaaaaaaaaaaaaaagaaaagaaaaauaaacccuaaggccacacucuaguagaaguuuugaccuagcacuugcuaaaguggugcugacccugaguucauucuucaccuugcuuccuugcugguaugaggcaugcuggguaccgacagcuuuauuuuggcuuacagguccagacucauagugucuuuaguugugggaaagguuugauagcaaagaggcauggcugcaggaacaggaaucagagaugggagacaagagguggugcaacucuucaagucacuccaaaugaagugcuuacuccagcaaguuccauaacuucccccaaacagcaucgugaacuggggacuguguccaaacacaugaaccugugggggacauuucucagucaaacuaccacaagcauucauguacaaaaguuuagacagugcuuucauuucucuuguuuauguacauaggaguggauugcuuagucauuggauaacuguuuaagauuuugagaaacuccaaagagacugcaguguuuuacauuuuaccgguaguggaagaggguucuaauuucuccaucuuuguucaguacuuguuacagucugacuuugauugcagccauccugaaggugugaaauggugacugauaaucuucuuuauguuucuaaugucuaaugaugaugagcaucuuuucacuugacuauuggacauuuguauacguuuagaaaaugucuuuuuaaauccuuggucuguuuuuuuuaauuauuugcccuuuuagaaaaaaauuaguuacuguuuuuaaaauauauucuaaauugacuuauuggcuaauuuucuucuguauuccgaguuguuuaauuuugugaauaguaugucuacagcacauuaaaaguuauuuuaauguaggagcucggaagauggcccagugagugaauaugguugaccugaguaugguuccuggaaccuauguaaauugcaagcuacaauggcaugcaucuguaauccagcacuuccuguggcugaaugggaggaagcacaaagacaggcaacucggaagcuuauaagcuagcuagcugguguaugcuguaagacauuccucaacaaaguagaaggagagaaugaaugacugaaagcccuuuaauccucaugugugcacugcacgacaugagggcacauggaguaaauuuaaagaacauuuuaauguaguuaaauuuuaauuucuuauuuuaucucauacuuuugguguuguguuagaaauuaacucuguaauauaacaucacagacuuuuuguuugagccagggucucuggcuuuccuggaacucacuauauagacuuggcugguauugaauuuauagaaauucaucugucucuaccucuaccgggauuaaagaugugaccuaccauacuuggccacauuuccuuuuuuagggaagaggaauuuuucuugaggcaugugacucauuaguuaaagauguucuuuguccccugccuccauuugguucucuuagguuuuuuuuuuugaaaaaaaaaaaaaaaaaaaaaaaaaaaagguuucgucacuauaguuuugaaaguuagaagcgaugauaggaaggcaaagcucuugaguuggaggcaguuuaacgucuuuuuugugccgguuuucauccuauuuacauaagcaaauugcuuuuauguuuuuaaauugagacauacuuuauaucuacaggaauacauggcaaucauguuugauuugauuguuuuuauuuuuuuccuuguuagauuugauugguuuugagagaugugagugcucuguagucugcuuuccugucagccuggagcauuucauacuccagaggccaugcuuucucuacaguucauugcucauccccccagaucccuccagugacuucagcuuucaugucccuuugcaguucugggaugcacauggaucauguaggcuucucuuuuugguuuagcuuuuuacucaaccuaaaguugagauucaugaagguuguuccuacuuguaguucugcuugaucucuuaacaguaguuacuuuaguggauacauuagaaaagucauauuuuaccauagugacuuugucaugaguggagauggagauucuuuuugugaggucaugggugacaaaugaccaugguuggauuuuuuuuuuuuuuuuuuuuuuuggaugcuucauguucugugcugauguaaauuaacugagcaucauaaaguuggaagugaaaguagaaacuauucuaggaccuuaagcugacaaugacuuacuuaguuuaucuuagacaaguuaaugcuggaaguagguauauggcuuuugcuccaagcagugcuauacaggaaguuaguacagcaucuaaggguguggcuuuuacauuuauaauuuauuuuuauuuuuuauguacauuggcauuuuccccgcaggaacaggaguuguagacaguugugagcugcuauguuggugcugggaauugaaccuggguacucuggaagagcagccagugcucuuaaagcuaucucugcagcuccuggcuuuuaaauuuaaauagccauuuaagguccauuguaagaacagaagagaaaaaaauacuuugagaaauuucaaggguauccuaauaaguucuuuuaaguaauuucuucucauuuuaauuucaggaugaauuuaaucaugcuauauuuaauuuuccuagguaugcaggugcguugagagcuucaggagaaauggcuucagcacaguauauuacugcaggucaguauguguacugaggggcuguaauaguuagugaaaguuauuuuaugugugugugugcauagagaccagagggacaacuuuacuggguugguucucuccuuggauuguguggguguccuuggggaauugaacucccagcuuuucggcuuggcaacagccaccuuuaccucuuaaaccaucuuuucagguaaaaccauagugccuuuuuuauuaaaaaacaaaaaagaagaacaacaacaauguggcgaugaugguacaagucuuuaaucccagcguuuaggagucagaggcagguagaucucugaguucaaggauagccagggcuacauaaagagacccugucucaaaacaaauggacaaacaaauagcaacaaauuucuuuucuuuauuucuuuuuuuuuuguacgucacuuuauuuauauuggaguaucuuuaccuuuucauuaaguagcuuagacuguauccagauuauaaaccagugauaaauuuuuucuugaaaaauaaacuaaugaaguggaaccaggcaugguaguacaugcauauaaucccaguacuuaggagacagaggcaggagauuacaaggccaaagauaaccuggaauaucaacaggcacaucuugcccuuaaaagacguaaaauagccagguaggagugguauacacguuuaguucuaggccuugggaagaaacaggcagauggaucucugaguucgaggccagccuggucuacacagaguuccaggacagccagggcuauaagagagacucugucucaaaaaaaagaaaaaggaaaauaauccuuuggguuuuuuuuucuucuuuguuuagugucuguuaauguguguguucuugcagguauauuuuugugugcuguguguugugcauuuguguauguugagccaggacucagccuuagguguuacucaucuggagccauuucuauuuuuguuugagacaaggccuuucauuagccuggaacuuaggcaaauguguggucaucgaacccagggaugcgccuauugccaccacccuaguuuuggaguaacaaguguguaccacugucucuagcuauuuugugugguucugggaguugaauucaagcuccugugcuuucugauaaccacuugauugacuaggucaucuccccagcccagaccuuuggauuuuuuguguuguaauuuuguuuucagguucuaauaaaucucuaggaaugacauuuagggggugacagaaauaagacuuaguauugaugugauuguuauaaaacaaaacuuaguugguguuaauaaggaaguaauauguaugaaaauaaaucuaaauuacuauuuuuguggugcuaaggauugaaccuagcgaugcaugcaagcuaagggugcuuccuuccuacuacuaagcauuugcuauucuuuaaagguuagacaucccgugcuucuuuacucugugagaaaaaucugacauuguaauaauuuauuugauuuuaaugcauuggugcgaggguuuuagauccucuggaacuacaguuacaguacaguugugagccgccaugcgggugcugaguauugaacuugggucuucuggaaccaccgagccaucucugcagcccacugacauuauaauaaauuaauagcccccacuuuuuuaguuacugagacaggauguugccauguaguccaaguugguauugaacucaagagcuuauugccacagccucuuaagagauuggauuauggaugccuaccaccaugcccgacuaaaaaugagccaucccauaaguaauuggauuagauaagguuuuagaguuguacuauuuuuccucagaaguuuuauugaaauguaaguaacauaucauacaagccacucauuugaagugugcccaucaguauucauaguguuguauaguuuuagaacuuuuuuuuuuuuuuuuccgagacaggguuucucuguguagcccuggcuguccuggaacucacuuuguagaccaggcuggccuugaacucagcaaucugccucugaagugcugggauuaaaagcaugugcaaccaccuggcgaacaucuucuuuacuacaaaaacaaccauguauucaaugcauuacuguuuuucuuaaccaauguuuguuuucuuuuuaagcucuuagagauuuguuugauuccauggauaaaacuucuucuaguaucccaccuauuauucugcugcaguuucugcacauggccuuuccacaguuugcagagaagggcgaacaagggcaguaucuucagcagguaaaagggacgggugucucucaucuuguaaaaaguuuauauuaucuuuguguuuauauguaaauguggguacacacaugucacaguaugcaugugauggucagaggacaaccucuggugcugguccuugcuuuccaacuuaauacagccacucuuguuuuuccacugugcccuccaggcuggcuggcauacagguucugaggguucucucuccugcuagcacugcgauuacaaaugcuuaagcugcaggucugacuuugacauggguucugggcauucaagcucagguccuuaugcuuggacagcaaggauuucccacuuagucaucucuaauccaagguuuucugcacucaguauaguaauuggagacacaaguaucagucugcucuuguucauaucaguaucuugucuagauuguguauaaucuuaccuggucaucuugauguuguuuuuaaucccuguauauuugucacacaggcccaaguguuucuuuaaacauucagauaagaggagggguacagcuaaaugauuaggcacuucuuuagcaucaaugaagcuuuggguuugaguucuauacccacacccucaccccacccugcaaaaaaaaaaaaaaaaaaaacgauagauaaauuaaaaauaaguggaauuuugggguuggagagauagaugauucuuuucccaaaucccccauuuuuuuuguuuuuuuguuuuuuaaaugugugagcauuuauugcucuuccauaagacccaaguucuguuccuagcacucauauuggguagcucagaacuacucuuaacugcagcuccaggaaaacgugcuguugagcuuuccucgggcacucacauaugugucauacaccuacacacauacacaugaggcaaaaaaugaauauuagaaauugauucuuguuugguaccaauaagguagucacuaugagugauuugcugccucagucuaaaucuguuugaugccucugauuuuaaucacguauuuucugccuugcucaucuuucuucagcuuguggcuccuuccuuuugcuuaaauuaugaaaacccacucuguaguguuuuggucuuguccuugauugucauuuaugugauuguggcucucuuaggucucaccacucuguggcucccuuccgcaaaucuucagcucucacccuuucuucuggcucuagucccugcauggaaauuguauuccuauauauguguauucacuaccaggaccuuuuguagucaauaauauuuugaaauaccugcaauaguguagugcaauuuaggaacacaaaaucuguagaugaaucuucugaaauuuuuuauguuuugaaaacucuuauaccaauuugauuaaaguaguuauuauuguggaugaccaaaauacaauuaagggacugaagguacagcccagugguugagagugcuugcugcucuucaggggacucagguuuggcgcucaguacucaaauccuccaguuccagggauccauacacucaggaacacgcacagauaaauguuuaaaaaguuuagaaaaauuggaauuacauuucuauucauuuugugugaaauguguaaauguaugugggcuugggauauguguggcacugugcauauauggagguugggggucaggggucaguuuucccuuucuaucauguggauuucaaggaucaaacucauguuaccagguuuggcagcagguguuuuacuucuugagaaugaguuuugcuaugcaacccaggcuggccuccaacuuagauguaacuuaguuuggucucaaacugauggccaucuuccugccuuacgccuucugagugcugagaguaagaugggcacugcugcauccagccagguaagaaugguguuuguuuugagacaggguuuuucuguauaaccccaacuggccugggauucuauguauaucagacagccuugaauuuguggcagucuuucuaccucugcuucccaaggguaggauuguaggugugcaucaucauacccagaucugcuugaauaauuuuaaagaagaaauuaucuuccuucccuaaggaaacaauagcuuaaaagaguuuuauagauuaaacccugucucauuuuauaucacaggaugcuaacgaaugcuggauacaaaugaugagaguccugcaacagaaacuagaagccauagaggaugauucugguagagagguaagugaaguguguugugauuagagauuuucaucaugccacuuuguguaguauaacaaauuuaagcuuaucccugaauaguuuacaaauaaacaagacucagacuaugguuauuuuauuugguuuugacaguuauugggggucaccccuaaucuacuuuucuaauugcugaccugguugcuucccuagcaguguacccuauaaucuugcuguuucuucuggccaugugcucauggucuaucuccccucaugguggcuuccuccucuccucuuguucuucuuccuccuucuccaccugaucucuccucacucccuuuucuuuucuaccccuagcaagguaacucaaaacccaccuaccucuaaucccuccaguaauuggcuguagccaauuuaauuaaaucaaggaacaagguuugcaaaaccaaagcugguaaacaugagaauucacuaguaggccuagacuagaauucagcauuaaaauacauacuaacagagcaaacaucaacaauaccccccacuuuuuuuugccuuaauaaaaaagcucuuuaauaauaauaauaauaauaauaauaauaaaaaacauagccuaggaacaauuaugaaauuauuauaaaaauuauguaagagauauauucaaaaagucuagucuguucauauuuggcaacucaugagaaaguauucuauuacuugaccuaucauggugaauuuaaggcucuguaucuaaaucaguuuuuauccaaacuuguauuaccauccuaaaaauaacuucuuagaccuagaauaucuuaaauccuaaacagcuuaagcuuauaguaagacuauggcuaucagaggucugaaaaggaaauauuaccugaguauauaggaagcacaagagcguagcuuccaaaaaucauagaaaugacagaccaaaccucaacaacuuuguguuuuauuuuaauuuucuuuuuguuuuuuuccucugaaaagcuuuaaaucaauccaucuuaauagguagauaucaggcuggggagauggcucagcaguuaagagcacuggauacuagucagagguuauaaauucaauucccagaaaucacaugguggcucacaauugucaguaaugagaucugauguccucuucugucauguaggcauacaugcauauagagagagugugcgugcaugcgugcgugcgugugugugugcguauguguauaugauaaucuucugcaucagccuauacagccuguacuuagauuuuaaggacuugcauuuuaguccauuucuaaauguaaccuauucauguuuaucuacauguuuaaucuuuugguaauguuuuugaaucagaaugaaguacaauaucuuaaaucauuuuuaaaucauuuaaaaaucuuaaguauccugggcagugguggcgcacgccuuugaucccagcacuugggaggcagaggcaggcagguuucugaguucgaggccagccuggucuacagauaaaucucuucgccuggaugaccugucaauugaugaaugaguauuguuuagcccucaacuccagaguuagagaguuuaucucucuuuucagauacaauuauguuuacuuuaugucauugaguccagcuuuggcuggguaccuuuauaauugucauuucuuucuguuaaucauaugccuccauccaugaacaaauguauuuuauguguuuuuaaccuuuuuauacugccaugcucccaccuugaugauuggugggggcgugguuguggcuugaguggauacgcuucugagauugcaagcagucacuacuguucuugcuuuuuaaauaugaguucugggcauuggauucagguccucuugcuugcagggccaguacuuuacaaacugagcccaucucuccaggcccuguccccaucuuugucacaggauuucacaaguuccaggacagccagggcuacacagagaaacugucucgaaaaaccauccaaccaaccaaacaaaaucuuaaguaugcauuaguaauuaggauuguguugagaucuacaaaaaguaaaacuagaauuuucuuuuuaauuuuguagacggauucuucaucugcaccagcggugacaccuucuaaaaagaaaagcuuaauugaucaauauuuugguguugaguuugaaacuacguauccuuuuugagccaagcuuuguauagauggucuuuauaauuuuuaagaaguaauugucacuaaaagcauaguuggcugauuggcacugcaggccucagguuucuaugccuaaaaacuuauaguugugagaauuagaaaauaauaaaauagucuuucagggauuuugagcuuuagauaaauguauauauaucuuaaggauauucauuacuuuuuucuuaagaacauguuuuucugugucucuuuaauuuaucucauagaguaguuucaguuaugugaaauucguauauuaauaauguacaugaauucaaggaacuuguuuucuuggguuaaagguagaaauuuggagaauaucucuguuuaccuuuggauuauuaagauacauuagaaucauaaugacaacuuauauuuuguaagaguccuuguuucucuuaaacacauacucauuuuugauaaaguggguaggcaaaugaacauuuuuaagcauguugcagugaauuuuaauugggagauuaauauuuagaauaaaucaaugaaugacuauuacuaacucuaugauaauuuauucuuuucaagauuaacaaauugaauaccuguugccauuccuuaauuuacaaagcaugaaauguacagaaucugaagaagaagaggucaccaaaggaaaggaaaaucaacuucaacuuaguuguuucauuaaccaggaagugaaguaucuuuucacagggcugaaauugguaaggaagucaugguugagccucauuuguggguuccauauuuguggauaugucucuuggcugaaauguauuuguaaagucaaaggugguucuuuauuuucguuguuaauuuugguguuuagaauuuauccccaagcauacagcauuccuaaguaugaggauacuguacugugccuuacgaagaaggcauuuggucugaguaugaguuaggcuacuaucauggagguucaacacuguagguaaaguaagauaucuuuaaauggaaacaccccaaagguuaccuguugauugguugauggaaacguggccagaaguguccaggaaucuaccuaggagcauagcuuagugaguucauggcucaggguguccucgauagauagagcacagcuuuucuguauaccaaggauuaccugggugauucuucacacuucauuugggcuuuuaucucaugagacauuaacauaguuuuauauauuacugaauucaauuuagagggcaugcaaaauauaauguuaauguuauugcauuagaauugaaugcuguggcaaggauucugcaggcagauuuuuuaauuuuguaaaauuauagccaagugauacuugggaguccuagaugacaacuuauaguagcuaauguauguauucauguguguauauaaguccaggaccuuacaguccucuugcaucagcuaccauagugcuggaauugcuguguaccaccacaccuacuucuacuugauugaaauacacauuuuugaauuauuuucuuuauaauuuuaaagauuuuauuauuuguuugaauuuuuucuuuucuuuucuuuuuccuuauuuggguuucucuguuucauccuggcuguccuggaaauuacucuguaugucaggcuggucuccaccugggcauaaaggcauuacuguuacuacauagcuauuuuugucgauuuucuuaagucauuuuacuccaugcuucaccugugcauagcuauguguuaaagcuccacagugauccuuuuauaaugugauugguaauuuuuuuuuaaaaacuagacuuaaguugcacaauuguaagauacuaaauuauaaacaguaagguuuucuaguccauauuuguuuaguuuugcuuauauauauauguauguauauauaacacuguauauauacauacauauauacuuauauauauauauauauacauauauauauuguuauaguggcaauauuagagacuccuuauuacagaugagcuauaugccagguuguuuccgagguuuccagcaugcacuaauuuguguuguuuuuacaucacucugaaaacgugacugggggaaguaaaccacaccuaagauuuucucacaucccuuguaucagugguucucagcuuuccuaaucugugacccuuaaauagcauucauguugugcugacccccaaccauaaaauuauuuuuguuucuccauaaauguaauuuugcuacuguugugggucauuauguaaauauuugauaggcaggauauaugauauccaaucccugugaaaaggugguucaucccccaaagggguugugacuuauagguugaggacugcugcguuagauuaacaaguuuucuuuguuaauucuucuuagauuuaaaauuaaccuaauugaugcuggcaggcuuuuauauauaaugcaugaagaaccaggguuuccuacauucucuuaauuucuagucucaguauucugauaauucauagauacaggguaacagaaggcuuuauuauuuaauaaaauaacacuauagcauaccuuccugacuuagagcaacauuguauucagagccuuuuaaaaauuaauuuuucucuucuauaguacaucguaauugcagccaucccccccccccgccccagucccauuccccauuuugacucucacuccccuacccucuguucccaucuccuccuccauuuccuaucagaaaaggacagaccucccagggauaucaaccaaacagggcauaacaaguuacaguaacacuagguaccuccccuaguauucaggcaacccaguaggaagaaaaagguuccaaaguaggcaaaagaaucagagacaccugcacucccacugauuugaguucuuuaagaacaccaagcuacacaaccaaagcaugugcgcagggcacagcucagucccaugucaggcuuuuugauuguugcgucagucucugugagcuccuauaagccuugccuaguuaguucugugggccguguucuuguguccuugacccccucagagggguucuuaauaguguauauuauaugauuucuuaucuuaugauacuauaucauguuuauucuaauuguuauuuauugggauaaauccacugauauauuauuauagugcuguuuuuaaaaauuagauaugugauuuuuguguugcaggggauaguuuuuaaauuugauguuugguuguuuguaauguccuuuuuuagcgacuucaggaagaaauuacuaaacagucuccaacacugcagagaaaugcuuuguacaucaaaucuguaaguuauauauuuccuuuugagauugaguuccauuccauugaaaggguucaaggggaaggagguggcucauuaggaaaccugcuugcugugcaagccugagaacuggaguuuggagccucagaacucaugaagaaacuggggaggcaugacuuccugucucuaaucccagggugcuggagguggagcuggcugguuggagcagugacuccacaugcacagucagucacacaugugcucuugcacauauacacuguaaacaugcauguaaguacacaugcauguaaauacacaugcauguaaguacacaugcagaugcucacccucacuacacacagaaaagcaaagagacugugugccaguuaaucuugucuaaucuuuauuuuuaugugcuccugucaaaaaccaacaaaccaacaaaacaaaacaaaacaaaaaaccaacaacaacagaaaacccuuauauggcauagauuaaacgaauuuuucucauuucucuccuuagucuaagaucagccggcuaccugcuuacuuaacuauucaaaugguucgauuuuuuuauaaagagaaagaaucugugaacgccaaaguucuuaagguuaguaaugaauuuuagucuguauauuaaauauaauccugaaggcaauuccuaaccuguaauagauguauuuaucuuauuagggauagcuuugcgaugcuuagaggugauuacauuagacagugauucuuagcccacaauuuauaaggauuauguauuauccauuuuguuuuacacaugccuggcuucuuucuccagucucaaacagcuaagccuuugacccaccuuuuuauauuuuucaaaagacucacagauaaucauuaauucuuauacuccucagaaauccugccugagauuagauuggaaaugaggacagcugcaguaagcacauugcaauugcauuuaagccccacagagcuucaacuguguagcuuagcuguauguauacagucuuccuuuggaagagguguaugaaucuagccucuggagcugaaauucauaacauuuucugguaguuacaggugaagguuaaauaaagcuuggucuuuauuuuuuauuuauuguaauuauuuuaauauugcucuuuaacuguuucaguguuuguauagaaacagcaaagcagagccugguuuaaaccccacauugggacccauuacuugacuagcaucucacauauuacuucugaaucacuguccugccauacacguauaguuucuaugcccacguguaugggcuugauuaucuaauaggaaagaucaugaaaaguaguuacuguacagaaguuagaaucagaucauucugucaauuuuuuuuaguguuaggaauuuugaauauggauauaauuuaucuuggugagaucuacuccucuuuccuccuauuuucucucagucuuauagcacuauuacuucccaauuucaugggucacuaugauaucacagagucauuuucaacuuuauaugaauuaugaaauauuauuuugaaagucuuauaugacugggcagugguggcaaaugccuuuaauccuagaacucuggaggcagaggcagguggaucucugcguucaggacagccagggcuacacagaaaaacccugcauuaaaaaagacagaaaaacccugcauuaaaaaggaagaaaaaaagagaguuauauguaguuugaauaauuguccuuuuucauuuguuuuuuuuuuuuuuugguuuguugcaggauguuaaguuuccucuuauguuggauguguaugaacucugcacaccagaacuucaagagaaaauggucucuuuucggucaaaauucaaggaucuagaagauaaaaaagugaaucagcaaccaaaugcaguagguuccuuuugcuguauuuuuaccacugccauuuaaaucuucauuuagugcccaggaguuacuguuaugagugaccagccugcauaucaguuaggaggugcauauaucuugaugcaggccucuuauagcuggauaugcauuaacacugcaggaagcagggcucugcugucauaaagcagacuccuuaucauccuugcucugcagucuacagcacauguagacuucacaugaaaccugaauuucucauaugggaugauauuccuugugaggcauuuuaauuggaaguacaaaauauaccuuccuagucucauuaucuauccuucaucauguuucuaugcuuuuguaauuucaaaaaaguuacuaugugaaauuaagcucccaauuuuuuuagacauaaacuuuugaauuaacucauucauauuucauaauuucucagaagucauccagguuuuguaugucaguaguuauguuuugcuccugaauaguauuuccuugucugggcauucuguaguuaaaccauuccccuguuaagugacacauuauuuucaguuauugucuauuaugaauaaagcugauaaauguuuauuugcagaaauuaguguaagcaggaguuuaauuuuucugaaaugaauguccaaaaguguaauugcuauguugcauggugguaaaugcccaguuugucaagaaagugccaaaugauacuugcuuuauauuccugugagcacugccuaacugacucgugcucugagcugagcagcuguugcuguuguuacuagguuucauuugagcugauggauaaguuugugguacuaccuuaaugauacuguuuuucauguuuugguugcccuguguguccucugcugaacuuucuauucuguuguagauuguaauucuuagcuaugcagauugcaaguauuuuucucaaagucuguaauuuuaucucuucaugcuccuuguggcagagaagaaaguuuaagaauuugauaguuucuuuagguauuuugauucauuuaauuucugugugauaagauguucagauccauucuuucggguaugauuauccagaucuccaggauauuaaacaaacaaacaaacaaaaagugaaaccuacuauuuuccaguugaauuauucuggcaucuuuauagauaauugguugacaguagaugugaauguguuuaugaaguuuucaauucuauuccaauuauuuguaugucuguucuuuggccauacuacauuguuuuuguuuuauaagaugggauucaugggguccaggcuagccaugaauuugcuagauaguugaggguauccuccugacuccagaccuccaaagugcuugguuuucaggcuugugccacaauauuacccauaccuaaugcagguuccuuauaaagacuggacuugugaucucaaguuugcucuuuucaguccuucugcaaguggcaucacuugcuuuguuggugcugaucuuccauccugagcuauugucuuuuuuuuuuuaaccuauuguucaaacagacuuuguagaauuguuuucuucuuuuuuuguuuuuguuuuuugagacaggguuucucuguguagcccuggcuguccuggaauucacuguguagaccaggcuggccucaaauuuagaaaucugccugccucugccucccaagugcugggauuacaggcgugugccaccacugcccgugguagaauuguuuucuauuugaugaaacuguggaaauaaucaauguuuggagacuuuuuaguuuucaaaggucugauucaguuuccuguauaggacauguacagaauuauucaagugaacuauuucacaauguaucuguucuuauguaauugacuaauuucauuagcauuucccauuugucuauggagauuuucauuaacuguuuucauguguguagggcaaaucuaacccauuucuuuacuguuaacugaaauuugucucuauucuugaggauucccaauuuuauugguauuuuaaggucuggccuuguuuuguugaguuuucuguuuuccauuauuuuuauuugauuugaggccuguuuaauuuuuccccauuaguaagaugaguugagguagugaauucuuacuacauuuuaguuaaucauacuacuuuuuuuuuuuuguuuguucgagacaggguuucucuguguagcccuggcuguccuggcacucacuuuguagaccagacuggccuugaacucagaaauccaccugccucugccucccgagugcugggauuaaaggcgugcgccaccacgcccggcucauacuacuuuuaguguaggccuuuauucauuuuagcuggcauggcuucgagugcugaaacuuuacuuagcuucuuguucucguuauuuuuuuguuuuguuuugagguagccuuugcuccugcagguucacagacauggauuauuaaccucacugcucuaccucuggcauguuaaaguuuuaguuaauggcuuaacauuagccauauauccaggcaacauguuacuguacugugauaauauugcauauuauuaaagucuuuggccuuacaguuuuuaugauaaguguaguuuauuguuuaauuauuucacaaggcagacuauuauguuguccgugauucauugauuuguagauaguguaaauauuuauauaauuaaguacucaacaagaauauguauucauuuccaauaucacaaguuaaaauucagauuuuucuccucagaaugacaagaauaguccuccgaaagagauuaaguaugaacccuuuucauuugcugacgguaaguggaugucucaguuugauuguauacauuuaaguuagauugcauguucuaccauuuaucuuuuuaaucauauaccuugcacucuucacgcuaucuuucuucuuuggcucacucaguaguccagaauggucuggaauuccccauguagcuaacgguggucuuaagguuauuuguacucuacccuagcuucccaagaauuggugugacagauauaagccaccaucccuggucuaaaguuaggcuuuuugaaaaauaauguccuuaauauaacuuaaauaaaguacuuuagaccuaauuguagcucugcacaguaauauguaauggaguccaguaaagcaguguuucucuagucuuaacuugauaauuguuacuuugacugagcacagcacaugucuauuuguugccuguuuuaauugaaucccuucucuuuaagauauuggcuccaauaauuguggcuacuaugacuuacaagcaguguuaacucaccagggaagaucuaguucuucaggucauuauguaucaugggugagaagaaaacaagguaaagaguauuauuacaguuguuaacuacuuuauuauuacagacuuuauagcauuguagguguuuuuguuugugaacuucaugccuuuuaaaaaggaaauauaauugccuagucuguaugcagguguguguguguauguguaugggugcauguguauauaggccaggaucuuccauuagcauuuccuugacacuuucuugcugagccugagcuagguugaacuggacuggcuagccagggagcccagguaacugcucauuucccuagccccucagcacuagggauacagacgggagccaucacacagcuuuugccuggagaucaaaacucagguuugcauuugugugagaggcacauaugucacugacugaauaaacccccagacucuucucagucuuaaggcccucaaagcuugcuuaucuuuucuaccgaaacuuacaacaucagcaguuauggcugagaagagcuugaagcgacaaucucuaggggaugaugaagugcucggguugacuuguugucuuacuuguugcccggcucaauauggcugcgcucuuacaucuguucuuguuuuguuuuaaaugauacugggaucaagccaaagauaccuuucuugcauaugcugagcaaguacuugacagcaaaguuccuuuuguguuugucuguuuucauacuugauuggcacacaucaugaagcuuuggagcacugcagcauguacuaggaacagugagaguagaauggcagaucaugcauuagaaguuaagaauagcugugaugucacggaaaucgugaaaucauauugaaccugcauggucccugggccaugucugaagagcuguucaucagguggaauauuguugcacaucagaucagucccuuuugcaccagaacucugagaauaaugguguguaucuucuuaauuuagaugaauggaucaaauuugaugaugauaaggucagcauuguaaccccagaagauauucugcggcugucuggugguggagacuggcacauugcuuauguucuacuuuaugggccucgaagaguugaaauaauggaagaagaaagugaacaguaaucuucaauuuagcuauuuaugcuuaggugugaauguuuuuguuguuguuguugaacauuucuauaaucuugagcucuaaagaaaaugagaacagaaccaagccacuugugcaucuucaaucuuaagacuacgggaaauuacguuuggguccuaccuuguauagagguagcuucaagacauucuuuaaaaaucucauuuuuugcauuaauccuuagaaauucuuggcugaaauccauuuuaucccuugccuuuucagcccaagcuuuagcagugauguuuauugcacaccuaucuguuguucuugcaugguuacuaucaccuucaguagcugcccguccucugccuuaucuaaccaauauuuuucuaggaagguggaaaaguguugcucucuucguguaacucagugcugcuguccacaucccaucaacugggugcaaucaaguauuguccagacugacuguugcuggccuuucaugacuuuacaauaaauugugaucaauaagaacacacuugauuauacacuuauuauugugucucuaauguacugugguuuauauguuaaacuuugcauugguuuuuguaguaaucauaauguguaaacaagcucugguugcuuggaaaccaaggauauuuaauaauaaaaauaaggaaaaagagggauuaacaacuuuugacauuucuuuuuaguauuagagcuuggcuuaagagucaaaugaauucaguacuauacaguuucugcaaauggcuaauaaugcuaagcagucaaggaucuauuuaaaauacaagaaacuuuagcuuguccaguguuauuacaaaagaaauacaaaguaguaaaggugaugaguuccuuuggacagugaauucugugaucaguuucauucccucacacguuuguuguuucuauuuucuuucccaaagucuuugugcccaucuugaaaguuacugauuuuuaagauuaagguauacauuaccaagaguauuguuuauuaaucuauugacuacccagugaguaaguccuuagauguuucaggaacuuuagcaaucuaaggaaaggaugaaguguugaauauucgugaucuggucugauuugaguugacuaggaaugucaggaauaucaugacaucuuccaccucauguuuuaaugcucuguaaaguacccaagauuccuauaggauaauaaaucuguaauaguguggguaagucagcauuuuagguuuguaaauaguuugcuaacuuaaacauuauuagcaguuaagacgccuuacaauggggagugaaacauggaaugaaacagugcuguguguacuguaauaguuugugucaugaccccugggauucaguguuauuugcuagaacaguuguagaacgaaggaauuuggcaccuguguuuuccuacuaaaccaggugagguagauuuagaacaaauaugccaaaacuauguuuagaaugcauuaagaaaacuauuauacaaaaaguguggugauaguuuauuugaccuaaaaaggcauuccaaaaauaauucuuuaaaguagaaauuggacuuccaucauuuuguuuuaaauaagguguuaaguguuuuagaaugagguaaaaaaacauucuccucccuuucaaucccugaacuugccuuaauuugcuuaaugcagaagacaucuggaggccaggguugugcuuagucacugcuuccccagcuaguagagugcaguucaagcaagaacacuuaacaguggucugcccagucgcccuucacuaguauacuaaacacccacaggaaaugcuguaugggacuagaacacgaacaucuuaaccgucagccaguaccacacaugcucugcuacauauaggguauuuucacaucucaagugaacugacaggaaucccuggguguuuaaagacuuaaggaggucaaguaaucuuuguaaagcuaaaggaguaguugggucuuagacuccacuucauauaaacuuagagcuagcaaacaaacauuuucuguuuuggacaaacagcuaaugauuugguuuuugcaggccccuggcuaucaguuugaacucuuugcuauuguagugucagcaugucagagugccaggaaaacacuuaaaacuauccaugguuugcugauccucuucucuccaguccuaagguuucagaagugucaucuuguaauuucagaauaaaauuuuauaaccgauagcaugcaggaaacuaauuugggacaguacuguuaguaguacucauuuaacuucacuguagaaauacuuaacaaaaauuggugugaucuugagguccuuuuacuuuguuuucccacccuguucuccacuccaaugccuguucuguaugugguuuuuggagcaccagccaacuguacaauagcuguuauaaaaguguuuauuguuuaccaaaaccagugaaccuuuuaucaaaugcugcuugguaacaaaaucuuaucacuguuuaauaaaaaagaaaagaaaggaagaaagcuaacuguuuguuucagugucauuaguuagacuuucugcaaggucacuuaauccagacuuguuuagugcacuaaucagguuaucaguuguugcaugaacuccuucuugaucuugccaggcaacaaggagcugcuuggcucucaucuucaugucuucacugucacacucaaucugccuaauaucagagucuuuaauuuccagguaaggagccaaaaucuuccacugcucaccaaguuuguuggcaaaugacucuaucugcuccccuguuauagguuuaucucgccgaacaucuggaccuagaaaauauagagaugugcaauuaaaguaucugaaauaacugcaaagcugaaaugaccacuggguuacuaguccccuaaaacuuuacuuuaaaacuugaaaauuuuccauaggcguauacacucaaagcuauuuuaauuagaaacacuuucuuguagaggagaugcuccaauucccacuaguuagaguuuaagcucugcuguaaaacaccuuucuucuuuaccucuuaaaauuaucauuuccacauuucaucua

SEQ ID NO: 8811 - RNA, 652 nt, Mus musculus
accaggcuggccucagacucacagaaaucugcuucugccucccaaguacugggauuaaagguguguaccucaggcucgcgcguccguggaggcccggccagugagcguucuggauccgacugcaagaugagcccggggccaugacaggugaaauggugaugaguuacgaaagcugcacagauaauuaaguagcagagauuagaacucagguuuccugccucccaagauuguuaaacaugagccugcagaagcaaaccccuagcaacuucuuaaagaagaucaucaggcggccaguugugaugaaauuaaauucuggcguggauuaucaagggguccuggccugccuggauggcuacaugaauauagcccuggaacagacagaggaguauguaaauggacagcugaagaauaaguacggagaugcguucauccaaggaaacaaugugcuguacauaaguacacaggaggcagaugugaagacaccaggaggcacugcucuucaaagauggauagaugaaguaguuuugguucucuuaccugucuuaguuggccuguuuucauggugguuggugggguuuuuuuguuuguuuguuuaauugacauuggaauaagauagagguauuacauuacagauugacuguuuaaaaaaaaa

SEQ ID NO: 8812 - RNA, 1123 nt, Mus musculus
caugaaucuguuuggaucaaccucuggauuuaggacugguaggaccagcaugucugggagaauaaccacagauaacaacgacccaaugaaggauauugaaguagcaucuucucccgaugacagcaucgguugucugucuuucagcccaccaaccuuaccaggcaacuuccuuauugcaggaucaugggcuaaugauguucacugcugggaagugaaagacagcgggcaaaccauuccaaaggcucagcagaugcaccuggggccagugcuugaugucugcuggagugaugaugggagcaaaguauucacagcaucgugugacaagacagccaagaugugagaucugaacagcaaccaggccauucagauagcacagcaugaugcuccuguuaagaccauacauuggaucaaagccccaaacuacagcugugugaugaccaggagcugggauaagacugaaguuuugggauacgcaguugucaaauccuaugauggucucccugaacgcuguuacuaugcagaugugauauacccgaggguagccacugcagagaggggccugacugucuaucagagaaucagcccucugaguucaggagaauagagucuccccugaagcaccagcaucaauguguggcuauuuuuaaagauaaacagaacaagccgacugguuuugcucuggggagcauugaggggagagcugccauucacuacaucaacccuccaaauccggccaaagauaacuucaccuucaaaugccauccaaugguaccaacacuucagcuccucaagacaucuaugcagugaaugggauugccuuccauccuguccaugguacccuugccacugugggcucugaugguagguucagcuucugggacaaagauaccaggaccaaacuaaagacuucagaacagguagaucagcccauagcagcuugaugcuucaaucacaauggaaacauuugccuaugcuuccagcuacaacugguccaagggacaugaguuuuauaauccccaaaagaaaaauuacauuuucuuguguaaugcagcugaagagcuaaagccaaggaauaagaaguagugaccugaagcugggacuguuggagugucaucuucacucc

SEQ ID NO: 8813 - RNA, 1123 nt, Mus musculus
ggagugaagaugacacuccaacagucccagcuucaggucacuacuucuuauuccuuggcuuuagcucuucagcugcauuacacaagaaaauguaauuuuucuuuuggggauuauaaaacucaugucccuuggaccaguuguagcuggaagcauaggcaaauguuuccauugugauugaagcaucaagcugcuaugggcugaucuaccuguucugaagucuuuaguuugguccugguaucuuugucccagaagcugaaccuaccaucagagcccacaguggcaaggguaccauggacaggauggaaggcaaucccauucacugcauagaugucuugaggagcugaaguguugguaccauuggauggcauuugaaggugaaguuaucuuuggccggauuuggaggguugauguagugaauggcagcucuccccucaaugcuccccagagcaaaaccagucggcuuguucuguuuaucuuuaaaaauagccacacauugaugcuggugcuucaggggagacucuauucuccugaacucagagggcugauucucugauagacagucaggccccucucugcaguggcuacccucggguauaucacaucugcauaguaacagcguucagggagaccaucauaggauuugacaacugcguaucccaaaacuucagucuuaucccagcuccuggucaucacacagcuguaguuuggggcuuugauccaauguauggucuuaacaggagcaucaugcugugcuaucugaauggccugguugcuguucagaucucacaucuuggcugucuugucacacgaugcugugaauacuuugcucccaucaucacuccagcagacaucaagcacuggccccaggugcaucugcugagccuuuggaaugguuugcccgcugucuuucacuucccagcagugaacaucauuagcccaugauccugcaauaaggaaguugccugguaagguuggugggcugaaagacagacaaccgaugcugucaucgggagaagaugcuacuucaauauccuucauugggucguuguuaucugugguuauucucccagacaugcugguccuaccaguccuaaauccagagguugauccaaacagauucaug

SEQ ID NO: 8814 - RNA, 646 nt, Mus musculus
ugcuauauauaaaauuuauuuaaaacucuguccugagagugguuuuucuaguuuuaagaagguacccugcauccccaaaggaaaaccauucuguccaaagauuugauuggcuuagcuuaaugucaagccaaguaaggacaucuugcaggaccgaguucccugcuuccaacaugugaaucccaaguauuaaacucgaaucuuagugggcuucuuucagaacuucucuuccuuuaacaugugaaaguuccaggccuucacaaguaguuuuaauaacuucguaacuggucuaaaaaaaccugcagaagaugucguccaccagcccucccgcccuccgaaggugcaaagcacuccucccgucgcuaggggccgcugucgcccucccgguggccggaaggcagcgcagcuuccgcguucucgucgcgcguccgcaggccuccgcgcgcuuuuccggccauucauaaccccaguccguggaucucuggagccugaauucugugaacagucgggccagaagggagaacugcgucgcuaggaugaagcucgugaggugaggaggguacccccgccgggcgaggacgacggguagaggauuuggggucggcucgggaggccgggccgcugugcucccagggaggcgggaaagccg

SEQ ID NO: 8815 - RNA, 646 nt, Mus musculus
cggcuuucccgccucccugggagcacagcggcccggccucccgagccgaccccaaauccucuacccgucguccucgcccggcggggguacccuccucaccucacgagcuucauccuagcgacgcaguucucccuucuggcccgacuguucacagaauucaggcuccagagauccacggacugggguuaugaauggccggaaaagcgcgcggaggccugcggacgcgcgacgagaacgcggaagcugcgcugccuuccggccaccgggagggcgacagcggccccuagcgacgggaggagugcuuugcaccuucggagggcgggagggcugguggacgacaucuucugcagguuuuuuuagaccaguuacgaaguuauuaaaacuacuugugaaggccuggaacuuucacauguuaaaggaagagaaguucugaaagaagcccacuaagauucgaguuuaauacuugggauucacauguuggaagcagggaacucgguccugcaagauguccuuacuuggcuugacauuaagcuaagccaaucaaaucuuuggacagaaugguuuuccuuuggggaugcaggguaccuucuuaaaacuagaaaaaccacucucaggacagaguuuuaaauaaauuuuauauauagca

SEQ ID NO: 8816 - RNA, 2803 nt, Mus musculus
uauggaucgcagcuccaagaggaggcaggugaagccuuuggccgcuucucuccuggaagcucuugauuaugaugaugacagugauuuuaaaguuggagaugcuucggauucugaagagugugguaauagaagugaacagugaaaaagguuccuguagugauuccgaggaaaacauuuuagaagaacugaaugaagauauucaaguaaaagaagaacagcuuaaaaauucuucagaggaaauaauuucaucagacaaacaguuaauuaaaauggaaaagaaggaagaagaaggaaauggagaaagaccuagaaagaaaaaggagaaagagaaggagaaaaaaaaggaaagggagaaggacaaagagaaagcaacaguaucugauagugcagcugcuucugcugcugaccgcaccagccacaagcccuccugcugucaccuccccuucugucccuaccaccaccaccaccaccaucaccaccaccaccauguaggaacaagucagugagcccaaauggaaucuucgucggaaccguccccucuuggacuuuguauccauggaagaacugaaugcuauggaugauuaugacagugaggaugauaaugacuggagaccuacuguaguaaagaaaaaggggagaucagcaucucagaaggagggcagugauggagacauugaagaugaugaagaugagggaagcaggagugaggaagaugagaaugaugagggcaaugaugaagaccauagcagcccugcuagcgaagcagguggcaagaagaagaagaggaguaaaguucuuagcagaaacagugcugcugcugaggaacuggccaaugauagccugacccuaucuuaaagcaagagcacugaggacucgcugauucuugagaagagucagaacuggaguucucagaaaauggaccacauuccgauuugcuguguuuaucuuggagagaauaguaaagaugcagaugaaauaacucagugugacaauuguggcauuacaguucaugaagguuuuauggagucgauggagagaguaagucuauuaugaguuuggcuucugaaaacgccacugagacuuguuuuugugaugccuauaaaugugguguaucuccuagcugugagcuauguccuaaucaggaugggauuuucaaggagauggaugcuggaagguggguccacauuuuuugugcccuauauguuccuaaaguagccuuuggagauacugauaaauuauaaccaguaacauuaacagaaaugaacuauucuaaauauggugccaaggaguguagcuuuugugaagauccucgcuuuguuagaacugggguuugcauuagcuguaaugcaggcauguguagaaccuauuuucauguuaccugugcccagaaggaaggucugcuuucagaggcagcagcggaagaggauauagcagauccauuuuuuguuuauuguaagcagcaugcagauagguuauccagaaaauggaaaagaaaaaucuauaaaaaacuauuggcucuacaauccuauuguaaaaugucauugcaagagagagagagagagagagagagagagagagagagagagagagagagagagagagaacagcuauucccugaagcacaggcaaggaucaaugcccaacuauagcaauaucaugccaaggcagagcuggcucaaucuaccagaccacaagccuggguuccaggggaaaagcuacccaggccacucacaaguagugcuacggccauuuguaagcagaacugcuaggaauaaguaaggauaucuuuccaguggacaacucagauacuaguucuaguguggauggaaggcggaagcauagcagccagcucucacugcugaauuuaugaauuacuauuuugagagaaauaugcacauuauucaaauugaggaaaauaugacugaacaaaagaauauaaaggauaaugagcaagaaaagcuucauguagaauauaauaagcucugugaaccguuagaggaacugcaaaaucugaaugggaaacuucaaagugaagggcaagggauaugggucuuacuuggcccaauuacagggcagaaguuggauauacuagcaaucuuaugagcaccuaaggaaaggaaaccaaguaagaaagcaggaggcacacaaaggacaucuacucucccuacagugcuauaguuguggacuuaguaagaagaaccaugaucaccaucuucuuuuacugugugacaccuguaaacugcauuaucaucucagcugccuugguccuccucuuacaaggaugcugagaaagacgaaaaacaguuauuggcaaugcucagagugugaccaggcagggagcagugacauggagcagagauggccauggaaauuuugccagagggaaccaaaugaucaagggaacacauuaaggagccagcgaaguuugcuccacaggaugugcuaccagaacccaagcagauucuaaucaggaacacgagaaccagaggacgaaagcgaagcaagaggaaagaguuccuagggaaaggaggcagaggcagucugugcuacagaagaagccaaggcugaggacuuaagaacugaauguucaacuugcaaaggagcuggagauaaugagagucucgucagaugugaugaaugcacacuacuuagauccuccuuugaaaaaaucuccuaaacaaacaggcuaugauauuuaugucaggaaugugauucgucaucuucuaaggaagaugacaaugaagcugaaaagaaaaaugcucucaggagcucagcauggagcagaaaaauccaaagaaguaaa

SEQ ID NO: 8817 - RNA, 2375 nt, Mus musculus
cagcgcugaugggcgcguccucgaagggcgccggagcccggcagacggcguggaguacgagcccggccggcguccuccggaccagccugggcccagccuaccucggcgggugccuuuuucgccuccgcgaaagcgccgcguccgaccggaaguagcugcuccgacccagcacgcaggguaggaagaaggagaauccgucucuucacucacagcuuccgagccucccagcagagccuucgggagcucaaagaagagagcgacgucuuccgggccgggaaggccccgccgcucgcuacugccuaccucucgccgcguccccuccuucuccuggcggcggaacccacggaggggacggccagaaccucccggaggcaggccggagggcugcucgccccgcccggccccggaggcagcggccgucucgugacgucacgccggaguucccgcggcgccacgccccuuucccccgggccgccgggccgcggccgagcgaguuggcgggugggaagugcuuugguguggagcuucccgagggcccgaggagccuggcggacuccggcagccuucguggaguucccgggaaauaguccaccuguugggaacuugaccgcgagcccuuccuuggguugggagaaaguccggacuguccuugacugccgcgcuauucguggcaggccugggauguaccacaccuagagaugagaggaaggauguggugggauggauaggcucauccuugguuucggcguuauagccauugccugcaguucgguaaugggcaccugggcccgcguugggugggaacaccacaacucagaaggaggcugcuaaaguuagaugaugaguuucuggcaagugcggaguaaaacaugugaaaaguguauagaauuauuuguuaacaggccguugaguaccccaggugggcuucaaauucacugugcauggucuugaauugauucuccuguuuccaucuucugaauucugguauuauaccauaauaaucauagacguguggcagccaccacaccaggucaguuuauuguauuuuuuggcagugcugggcaucuaacccagggcuuugugcaugcuacguaaacacuccaucaacuaagccacauuccuagcccugcuguacuuuuuuuuuuuuaaucagaauuuucugcggcuuauuuuaagguuguaagucaguacaauuugaauguaaacaacagguucuauaaaggaagcaaauagaaucacagucucauguuaaaccaguccacuaauuuucugugauacuucugugccuuagaagaucuggggacagauuuuaaaagucgaguagugcuggacauggugacucaagccuauagucccagcucugagaaggcaaaaagagcgguaagacuggccaauuugaggccagccuagaaggcaguuuucuacuccucucaggucuuaagggauaaauacuuuacuuacucuuugggauuacacauuccagggaauucaucuuccacagccauacaaaaguuggaggcuuuaagaggcugccuaguauuuaauacuguuacaauauuuucccaguuuuuuuuuuuuuuaaggauuuuaguauuauuuucuguguauggguguuugccuacauauguauguguaccacaugcaugccugguaccuacagaggccagaagagggcauuggguccucuagaacuggaccaauagaugguugugagccauauguagacauugggaacggaaccugguccucugcaagaguggccaguguucuuaauuuaauuacugaaucaucuuccagccccuucuccauuuuauaagacuuaaugaaaauuggguuauauuuuuccucuagcaaacucucuaucacaaaguuacguacuaaaauuugcauaauaggacuuacauaguuucuaguagaaauagcaaguuuggguauagauggguagagccuaugaucaguuugucauugaaucgaauauuuaagaauaguuuucuaagccuggugguaguggcacacgccuuuaaucccagcacuugggaggcagaagcaggcagauuucugaguucgaggccagccagguuuacagagugaguucuaggacagccagggcuacacagagaaacccugacuccaaaacaaaacaaaaagaauaguuuuccaaagaaaagauccuggagagaugauggcucagucguuaagagaacacuuaaugcucuuagggaggacccagguucuguucuuagcacccccauuaggcaauucacaacaagcugcaguauuuguuucaagauucagaauuaugagugcaucugcauguacauaaauucacacgggacacauacauauaaauacaaaauaaaucuuuucaaaaagau

SEQ ID NO: 8818 - RNA, 1241 nt, Mus musculus
ccacuuggcuagugaaaaacaagagccagcuguuuucccucaaaccucggcguccgugggggacgcuccgcucucguccagaaacaaauggagaagacaaagcgcagauccagucggaccccggagcacccugagcgaagccgucggggucccgccccaggcucgccugacucacgucuccuagcuucggagaccagcauuuggcgugaacuggcucacuugccgugaccaccgcucgcucaccuuacuggguccccaagcugcugcgggcccuggcucaggcgaagacacuccgaccagauccauuccgggaagaaggcagagacgagaacagagucgagaggugacaagaggaagaaagggcuccgccgaggacacgggcggggcacgggcaacccgcugccggugccggaggugaggugacagauggcggcggcggcggcggcggccgcggccggaacuggaccacuucuuuuccgcccuguauacuaaggaucucacuucugauuggcuguucauaacccaggagggcuguacuuccggucucugcgcuuccgauucaaagguuuucuggcaaggguuguugacgagcuccuggcaaggcagggcuggguuuggcuuucucucagcgggcacucccugugcaggcaccgccuuccgguuccuucuucccagucaccgaaucuaauuaauucaaguguggccuccgaaugcuuaagccuggcugucucugaucauuauuucccgggguaauucgaaacccggacggauuggcggaaggggcggcggcggcagaacuggcaucuuuaaagaggggaaagugauagugauacagauugcgacuggguuaagugucaucugagggcagguguggaaugagaaaagcugcugaauauguggccuaauacugagcgaaaaauaagacggcgcaauaaaaugggugauucucuauuuuauugggaaauuuauauaaugacuggaaaagcauaagcauuauacaucacuauauccaagcacuagucgggguuuaaucucaaaaaugauguugaggagaagauuccauccguuccugaaaaugaaacagguacauagaagaaaguaacucaauuuggacauuaaauggccccuccagcuggccgccuagcauuuuaacacaugagcuuuguggggguuguucggaucaaaucacaagagcuaaaauuaaaaaacaacaacaaccucagagcugguuguuaugacca

SEQ ID NO: 8819 - RNA, 21953 nt, Mus musculus
cuuguuucaaugccuacuuuuaauggagguuauuaaacacuuuaaccucccuucuagcccaccaccaaccagagauagugggaaagaaaggauacaggggaaguggaccuguuuagaaaugguucuuuggagcagauccugucugcauuaucaggaaaccagcaauucaguucacgggucagcaguggcagcucgacccacucgcaaacacuucacggauacaccagcaguguugggauaggagcagccaggccucagcaggagggaccagggccgacaggaacaccagagguucuuggcuguuccucuaucagcgaagacuggagaccaacaaacauuacacagcuagcucuauauucucucuguggagucccaacacauggagcucaacuacacaauauaaggcagaccaaccaauacaugccugucauucacguguccuuucaugugcuugcuuuagggaaacaguccuucacaagucugccuuucaccugugucugcuucagcaaaauguucuuucacauuugccccagcaaaaccccaucuaacacaacugacuuuccaaagaacccuuaaguuuccauuucccaguggcaauaacugugaccugaucccuaccccacaugcugucuccuuuucuuugggaguuagcaacauuugaggauguuguagguacuuuauuacauuuuuuuguaguuuaaagagcuuuauuaaugcaauaaauuaacuuuguacauuuuuauauuaaaaaaaaaaaaagacuauuaagggacuucagaauguuguaggccucauuagagcuuguucuccaaaaaccugcuugaaaaaggcaacguguucuucacagugcucuccuguaaggacaacgcggcucagucagcagcugguuauggcccgggaagacaggaugcagacaacgcucauggguuuuaacuuauuuuucuuuaauaaaauaccuccuccuccauuuugaggucuuuuauugcagagcucacaccuucagcagccagagcaucccugaccugucugucacucauaccgucugugcuguguguguauacacagcauaggcucauucucucgaguccugucuuaucacuacuugcuuaaaacugaagcauucaaagcccaagccauuucaaaugcuucuccaccaugugcacuccuguucugauucuauagagagaucccaaagucagauauaagcuaugcccuucagcccugaacuugaugaaagcugccauugucuguggccacccugggcauucccuuaccuggugugaaguuaggguucccucgcaggcgcugguuccgcuguucaaagaagcggaauaugguauagaagagcaugacaucgucggucugccucgcagcaucuaagaauuugcgagcagaaauguugucauggccaccaaugccccggaugaaccucagggcagccaacaccugguguuuagacagaagaacuucuacuaucucaucauuugcuguugaaagucucuggaaguaagaaggagagguaagggcaaccacgggaaggaaugcuggggauaccugaagccguggcagggcaguuaccuucaacauguccagagauagcuggugggcgggaggauaaaagcucucuagggacagcagcaagcaagccugaaagacaggguuuccgcuagcuucaguuugaagggucccacuggaagguuuagugacuacaaaaugggcauccagugguacagaccaaaggcuuggagucgcugagcacgugguacugcaggaacuggugcagcauguagaagagguuaugcuggaccagugucuugaugacaaguucauguaaguagugcuggggacacaggaggaaguaaauuauaucgcugagucacuggaccauggcuggccacacccguucccacugagaaccaaaugucaugguuaaggcaccuggggucugcagauucuuuagccaucucuucugaucucauuccucucucuaacuuaagauggcaaauaccccucugaaaguaccugcacuggaaucugaaacugguucagagaacgaauauauuccaucagcacagcuaucacaaacuugugcggcaucuccuagggaggaagaagggggucuuguaaugucaguugcaaaaggagcuacaggcagcccacugauccccaguaaaguccaguguucuggcuacugguguuagacaaauccuuaugaacuagacgccaaccacacagccccagauccucucccagggcaauaccgcucacuuaaccauaguguggauccuguugcuccccacaguagcccacgcagggaccccacuuacauaccuuguuuuccacgaauggugacagcaccuguguguacacaucagacuggucuaccacugcuuggguucgcacuggccuuuugagagguggguugcuccggcucugcccugcuucuacugccuaaaguggaacaacuugugaccuuggucaucuuccacagacaugguacucacuacaguuaacccaagacuuaaauuucuagacacaagccagacacgugacaagcgagacaaaacucuucccauggcagaccugugcucuggcaaacacuccaggguuugugggagaccucaaguaaauaaccaagccagucacgcucuuuccaaccucugaagacguauaacugaccucagcuuuucucacucuugaccagcugcacugucguucaugaagcuaccagacaguaaaggagcgcagcgugcacuggauccauguuggcauuuuaaaauucauuuuuguagccuuugaaauggauccagggccucaccaaucucuacauuccgaccaucaagucacagccucuggucaguguaaugggaauuauuugacaguaagccagaguuccccaaagaugacagagcugugagcuacaccagcugugugaucucuaaagagcaggcacagcuucagugcggacagccugaccaugacaucagucugacaaagcccagggucugccacugggcucaaacccgcugacuccacagcccaggacaccaccagaaggaccaagaggaggaaggagacagaacaaggacagaggugauguaagcagccuggccuucaguggcccaucagacuaacuucaaagagccaagcaaaguggguucucagcuuguuuaaaacgauguccacuguugcuaagcauauccuugaaguaauuucucccacugaucccaaguuuauuucucgcuuuagaaaaacagaaaugcuaaguucugaaacuaguaagccacaguaauuuuccaucccugucauugaacacaugcugucuauuaacugaaaugcacggugcuggugcugagccaauggcucccaggacacuuaugguagcaguauccaaggauagcuagcuuuguuucuacucuuaggauaaaccguguugcccugucgauaagugcuggugaguacagagauguguggcugcuccagaugcugaggauaucugacuguugaauacucagcccuuucugaggcucagagaacaucaaagaaguaguaguagaauguuaaagccagaagacagggugaaagggcuacaaaauaccauccacagagccugaaacagacaucacaaacaucucacgacagcagucaaucauggaucugggaggagcucacaggacccuaaaccucccugccaaacuaucugggaagagacagucauggccuucgguugaguacccaacagcaaucccaccaggcuccaagggacauuugcaaaucugcuaguagacaguucucauugaaaucaguggauuauaaaacaaagccaucaaaacaggaaagagacuuguaaggaggaggagcaagacaaggcagaaggaagggagugaccggggaugaagacacagguaggaggagugacgggggaugagggcacagguaggaggagugaccggggaugaggaagcuaacagugggaaugaaagaaaacaauguugcagacauagaggaaacugucaaaagauacauuucaucaauaaaauaguuacuuuggccagguguaguggcacaugccuuuaauccuacacuugggaggcaggcggaucucugaguuuaaccuggucuacauaaucaaguuccagggcagccagagguauauagugcaacccucucuugaaagaaagaaagagagagagagagaaagagaaaaagagagaaagaaagaaagacuggcuucaaucccagcacucaggaggaaaaaaacaacaaaaccaaacaaauauauacauucauucuuauuugaaauaaaaaccguuuuuuagaauacaaguacauguugcauggcguuggacauaccuugcccaaauuucccucuagauaacuguaaauauuugcaaaggagaaaggcagcuaacacuggaaaaaaaaaucacaccucuaacuugcuaagugcaggcucugucaaaagccaaggcugauuuucuuucuacgaaauagaggcugaccaagaacauaugcacacauaagcacaaacaaauuuuaaaaggcagaaacagggcuggugagauggcucagcgguuaagagcaccgacugcucuuccaaagguccugaguucaaaucccagcaaccacaugguggcucacaaccauccuuaacaaaaaucugaugcccucuucuggagugucugaagacagcuacaauguacacacauauaauaaaugaauaaauaaauaaauaaauaaauaaaucuuuuuuuaaaaaggcagaaaacagugaagguguugaguugcagccuugagccagcugcacguggggacucugagcaugccgcuggcaccuugcccucuaccauuacggcgacuaacccugucacacugcaagacuccucccacacugucuagcuuaccauuguguagcucugaucagcauccaaguacuucuuauacucaugguugaguuuaucaaacacgguggcuaucacaggcagcguggcucugucugacucacucagcacuggaaaggacaaugcaggucagacucacuguaaugagaauccucaugagcaaucucagaggguggccaaugcaaacccugccuugaaggacccucaaguaaacacgaaaaucagccaggaucccugcaagugacgaggaaaccaacaaggcagugucaccagaagauguaauaggcuuucacuggagugccugccgacuggcuggugucugucaaagucuacaagcccuguguguauuuccaucuuuccuauggguuaagaauccauccuucaagcaugugggccugacugcaaaggcacggucaauuuccagauguaagugggaggggguuggggagcuggcaagaagacuuagcagguaggaagcacaggccaccaggccugacugccugaguucuaucucaugccccacaggauggaaggagagcagacuccuuccugugagucauccucugagguccagacacacaccauggcaugugcauguguaccaugaugugcccagacacggacacaagcaggcagaauuuaaauaaauaaauaaauaaauaaauaaauaaauaaauaaauaaauaaauaagagauggcgccuucccacagaccguggggaagggcccgggcacuuacucugugaacacacagacagaaccaccgccuugcacuccuuccucuggaggagaaaguccaucagccuuccuuuaucuggcaagagauucacuaugggcugaaguuucaccugcagguuccagagguaaccuggauguuaagaggcagcaguucaucaaugugugcaagccagaaccaaagccaacagaaaaugacucaaccucucugucacaucaaaaauaacuaagugaccccuuucucaguuucugagaucucguccuagcgucaguguguggaagggaagugacuaacucccugugugcagcaggugucuaccugagaacccuagaggacgagacugaacacuuaaaaugauagagagaugcaaaguucucaagugcaaagccacaggcaauuauccaggaagagacaacaggcugaaggagcugucaccagcaagaugagauaagggacaggugggcgucuuaggcaggaacaugaggagggggggcuagagagugagacuguagaccacucaucaugggcagcuuuucugaaauggccaugggaaucaagccaggguuggccacuuuaguuauaagaaucauacaugcucauggaagaaaauaaaaaugaccuugcagagaaguauaggguaagaugcagucccacucucaagacggaggggagggucaccucaaagauucacacugaggugacucuggcaagacuaaagugggcacgugcuuuucuagccuggcaacggcccucagaccuaccuuggcuugcacugauaaugaugucugguugaaagacgauccaugaagaggaaucuguauguuaaaggaaacuccacauugggaacacugggucacaaaagggaagccccauuucacuuagcccuugcccaaccaccaccucuugaggccacagaaggccugcauccccagaguagcuccaguaguggggcagggacacauccccuuugugcacagugccaccaccuucgugaggauacagaguuuacaggggacaggagacuggcuggucacggcugcaggaccugcaaacagagaacacgagcauaagaaggcaguagggaaaccugcuggaaugagaacugagccaugaaagagagacucuauaaugccuccagcagccaggacuugacuguaguuaggugaggagaggaaggagggucuugccucacuaaugacacacccaggcaagagggagugcgucagcugcagucaugaaaaugugucuccaggaagaggaaaugugucagagcuucucucaacagugguugguuguaagcuuuacuuuuuaaauguuuuauggguucaguguuuugcauccaggucugguaccugaagaggccaacgaggauguuggauccccugaaacuggagcuacagagaguucuccaccaccagagaccaaacccagguccucugcaaguucagcaagugcucuuaaccaaugugccacgucuccagcacugaguuuguuuuuuaccagaaaugacacauuaccauuuaaauguguacguuaaagccuaagaaauugaccuggagggcucaauaagaagacgcagauucaccaaccaugacgguucaaaugaagacagcuugugguuaacugcucaacaaugggcuccauuacccacugcccugcccugcacugaacaaaucuaggcauaagagggcccaccuaaggagcauucccccucacaugacaggaacucauuccaaccaguucugcugacugaccacugacugcccagcuauaaucagaagggagugcuagugagcugcauacauagacagccauccuaacacagcccacacccagaugaggagcgugcagucaggcaagcuucagcaaaguccucgcacccaggacugaagagggaacuuccacugccuaccaagggccucaggaaagcaggggcauuucaaucuucagagaccccaggugaucuuaacacaaacacaagccaccuguuuagcaagacaaagccaauacagcucucaaaaucagcuugugaauacauacccacccacugacugugccaagugggcacaagucucagauuucccaggggcucaugguccaggaggaaacacaaagggcaaggcaugcccuauaugcccagacugccuaaaaccccaggaacccauggauuccugcccucuuccuaucaggcuuuccuggacuaaugugauccacuucaauuagcaccuuggucaggcaauagccuguuuauugcuccuuuauuacuggauccgaguugaggguuuuuacauguuuacagucaauaauuugcuaucauccauuccuuacugcuaauguuauuauccaggaaaagccagaugccagaaagcacacagaagccaguuaaggccaccagauaccugugagugccagcuguuccuucccacuagaccuuuugcugagcccauaagauaagccagcugcccaaaggcugaaggcuugcugaucaaucuaccacccagagcuuggcucucuacugucuguacaaaaagcacaaggaaaucagaggcugagaacugccacggggcagcugacaagugugccuccuaacaaaacagagacugggagcuucaaucagcuaacuggacugcagucuucuauaaaauuacaguaacacagaauugucaggggccugguaugaaugggauuacuucuuuucagagcuccugaccuacuacucuccugacguccucacccaucuuaguaugaggaaugcucuaaaauaaacucaagaaccacaccuguaagcugguacugugacgaauccuuggccacaucugcuauaaccaagcacaagggcuugauaagggggcucugugguuaagucucuguugcucuaacacagaacugaauucaguccagagcauccacauccucacaacugcaugaaucuccagcuccagggaagccagcacccucuuccgccuucugacaacacccauacauacaugcucacacauacaugcagacaaauacaaacacauaaauaaaaagcaaaucuaaaaaaaaaaaagaagaguaugaaaacguaggagcaugugaccccauuaaaauuauccagccacagucagcugaaugccagggugacagaaacugagaaacagaagauguuaagauccugaguucaauccccagcaucccaaaacaagaaaacaaaaguuccucugcgaaaugaagcagacuggggauucccccugucccuugucccauucugagcaugaccccggaagagucuaccaagaauacagccgugggaaagcuagcacugccagcucacagaaccucuuaccugccagggggaucucguaagguugaauugaucgggcuggaagcacaggaugguggaagguaaccgugccaucgaacucgccccguagccugaugucaaauaucacugacgucuacaguagggaaaacaucaucuguugcuggucuggaagucugugcucgcagccaucccagcccugcucccucagaggacgacugugcacaccacaacucucuuucccacagucacugcuuucacagacgcuuccugcguccuuguaagaucucaaagaguuauagacagaucuuuuucauugaacuugaaacaucuuccuuagucagagacauagcagugggacccuccaagaaaguaggggaaagguguggcauaccaacuacagauguucaguuaaccaucuggaaaagcagaccugucacaaaucgaugggcccaacaguguccaaacaugaugguaaacuguuuucuaugcccacacacaugaaacaggccagggacucaagugacaccaggaucugcaguaggucccagcucugcugguucaaucaaguaagaauccaaacaucaaaucaaaugauauuuucucaaaguuuuuaauuucucuggguuuuuugagacuucguuugaaccucugaccccggcucucccucccaagugcugagguaacaggugugcaccaucacagcugguuuuaagcaacgcuggcaugugacaagcuaggcaagaacucuaccuagcaagcugcauccccaaacuggaaucguuuuuaauaaacugcuggggaaucgguuaaacugcucacuccuuugagcuuaggcucuuucccgcccucgugcaggcuugccagcucucacaaggccuauaaaaaggccccgcacagacgaugaugaugacgacgacgacggccacuucccacaucagacuuuaccucuguguccugaugguggacaacgaccagguuguccacuacauuuagggcaaacuuucccguccuauuuaacuucaguaugugcaucuuuuuacaugcacccucucuguaagacaacacagaggucagagaaagaggucagcaagccuuacuuuaacuuaagagcagagagugccgagagcaugagacagacguaccgugggagaugguacagcaccaccuccgcucccgugcuguuagacguccgagagugauggcgcaggaagaggauguaaagcugcccguaucuagucagagagagagagacaagucaccucuggccauuuuacugcuggacagguaguagcugggcuggcaggguaaggcuggcccagcugcacaaagcccugggcugagaccccugcaggccauaaacugagaaugguggccuauguucagaauuucaccacucaggaggcucagaaguucaagccaucuugacuacauuacaaguucugacccagccuuaaagggacagucugaguucucuacauacaguuugacuacaguccucuggaagaacaccacacagccaagcacagaauuccaaaguaaggaagagauacaggucaagagucacaacacccacugguuauuccacuucuagcuuugugggacgaggacaugucccauaagaaaaggaugagccacacucucuucacaguagaugcuacccacugggugcugcugugagcugccauggaguguggaugucaacucuagcaaugagcucggcccuggccugccaguccccacccaaaacugcacucacuucuuggcucccuaaacuggguggccaaguggaaaacagaagagaaagaaggagggaaguacauucuacuauacugagucacucccggguucaguucccagcacccacagggcagcuaacccccagcugugacuccauuuccaggggacuugacacccucuuauggccucucaugugcacauacauacagacaaagcauacagagaaaaauaaauaaaucuuuuguuaaaagugucacauucaaaacaaaaaccaggcaaguccuagcuauugcuucuaaggguccuuuacucugcgcuccugacacacccuaucgcuugugucacaaagggcaauuacacacaggaccccucugaagacagacauacauggucgccaucgcaaugucucguucugaaaggcuaaguuuaguugacuucggugcagcugguaacucaaucucgaacuugggaagcuucgacauggugccagccuguuuagggaaaguguagcaacauuuagggcaucacucccuccaugcuuccgcagacaccaaagcaaugcagacccugccuucgaugcuuccccacagagcauccguggacugcugggauggugaguuacacccucuaguggucagagacacggguucauugacugccuugcuucagagcuggguagacaagugggcagcaggguuauguuaaggggccggggcuaacucuuacccuaaaauggaaaggcugcaggacauucucaaggacugugguggacagcaggaucacggcgcucucggggcaauacguguaccaguucacauugauguugugacucuucaggaguuugagacuucguuucucaggcaucaccuaggaccacggucaagaaacagaaucucccuguuaaaagacugcuacaauaaauuagguaaauuacgagcacaaaaugcucacugaggucugggguaaaccccgguggaagagagcuugcaaaggacaugugaggcuccaguucaguccccaacaccagcagaaccaaggaaauccagcccagggucccacaggaaacugucguuuguauuuacuagacacacuagcugugugcacccugcuuuccacaccuccauaauucacuccuuccuacacccugagagaugagaaacucaggccgagaaaggcuuggagcaggagacuggcauuuacaaccagggcugagccuccacgugcuccaacaccacgcaccuaagagcaaggaaccacagguuuucauuaagcugagaagcagucaaagugaagcgaucccagggccccaguagugaacgugaagaaacauguaagccggccagcucacucaacuuucuaaccguaacgauaaaaaaagugaaauaagcuagacaucuuguaacagaaguggcaagacaaacagcagaucauccacacagcagaacuguccucagaacaaaaucugggaacaagccccaaagcuuacugcuaugcaggaaaacccacacuacacaaguuuaugugcaggacuucccuuuuugugaaaaauagcaauaagaaaugcauguguauagaggaacacuggaauugugcaccaacuguggcugauggucauuuuacgaacuuguacuuuuugaggcuggccacagagccuuuggcgcagcuaccuuugcuuccucuagcaagccuguaacugauacaauaccugguaaaauucgaugccuuggucaguuaugaagacgaucucaguagagcugguccagcagaauccgaguauguuggcauucuuggucuggaagaauggcaggagcagcguugucagaggacuuugcuugcacggucuauauucccagaacccaggaggcuaaggcagggcacuugggaauucaaggcccuccauggcuacauuucaagaugcaggccagucuggacaugaaauacuaucuccaaaaaauuaaauaaguaaaaauuaacaaaaagcgaggggcuagggagaugccucuguggguaagggcccuugcugaccagcaugaggacuugaguucaaauccccaguacccacauaaauugccacaagcgcccauaacuguagugcuagugugggacauggggagcagagacaggagacaaggacaagucucuggggcuugcuggccacuagccuaucucuagguucaguaagagaccugccucaaggggauacaaaggugcagagcaggacacuccacauccuccacugagcggcacacacugugugcuuacaccacacacaaucaaguccauacuguagcuuuaacacuccacauccuccacugagcggcacgcacugugugcacacaccacacacaaucaaguccauaccauagcuuuaacacuccacauccuccacugaguggcacacacugugugcacacaccacacacaaucaaguccauacuguagcuuuaacacuccacauccuccacugagcggcacacacugugugcuuacaccacacacaaucaaguccauaccauagcuuuaacacuccacauccuccacugagcggcacacacugugugcuuacaccacacacaaucaaguccauaccauagcuuuaacacguauaaaacgcucuaguuuguuaaccagaaggcugugcagcuucucuucaaacccucaaugcuuggcugccacucaucaggcucucagaguggaccucacguuuaugacaaaggcuggcuuugagcgauguagccugggcagucaggaacucagcacuguccugucucacccucccagaugcuggguuacagggaagcaucuccaugcuggagucaaaugcucuuuuaaacacggucuuccccaacuuuuguccuaacacuucuacugaaggcucugagucuuaauuccuucuacucugcugaacggaggcagaagccugaguuuuauggaaagaaaauacccagaggccagagauuccaacuucugccucucaaacugcaacacucuuucagucauuacaauaacacaagggcugaaguucuucaguggacacaaagcaagauggcuuccaggggccugagaccauggguggcuuaaagacugaagggaauagcaggacucagacaaggagcuguuccauacuuaaagcaccugaaggccugaguggagcucgguuaaggccugaggcuccucucauagauaaagaccccaucuugagugccacuuaccaggaacaauaagaugccaaaguuacccccauguauugacagcucuguuuacucucccagcugcccuuggggugaccauggcauggcauggcauggcauagcagagcucccuccagccucauuuauuacacccagcuaauaauuagauuagauauagacuagggucuaucccuacagagggugcagggauacaggacagagacucaucaagcaaagaacacuucagagaaccucacaagauggaacaggugggauccaaggccugagacccagaagccugcaagcacagcgaggaagcuccagacggcacugaaggugacccuucacccaucaggccuccauuuuauagcugaagacacaaaacuggguuaaacuguccaguaucauagcugaacacccagccgaccucuccagcucaucaacaacacagacaucuccccagacagagauuccagccuguguccacuacccaacccaucguucaccacacacaaacaacaauggacacugcagugaggaaugaggccccgcccccuacacacacacacacacacacacacacacacacggguaccuugcacucuuguguguacuccaguugagaguuaucuggaauaaaauuacaaaaguccugaaagacagaaaaaaaaaacacaaagggaaauuuucagauagaacagcuuacugugaaauaaaauggacaaauguuuuugguuuuguucagagacagggucucacuaggaaguccuggcuguccuggaacucagagagaucugccugccucugccuucugagugcuggggcgucuugaagguguguaccccuugaaggugugacaagcagauuuuuaaaaugauuaaaaaacacucagacaaacacccacagacagaaaagacauaaggacaauuagggucaaaugauaccagauuucucagucaacuaagagaaguccaucuaaccacucaguuggagcucacgaacagacugguuuuugagagaacaauuuguuaaaauugaccagaaauacaagauuccacugaaacugacacugacaaaauaugguugaccuuaaaccuucaagagggucaaauaaagccaguuccauggaucagaccgagaaggcugccucuggcugaacccagguaccugcacuucagcacgagcagcacgcgagccuccccagcagucagcgugucaccaguuucccacucucgccucuucugccacuugugcuacaccaacggcugcuucuucucuaugagaggugcagcuuaaaaaucuuuucuuaggguggaaauuccaacuuagccugucagcuaccaucuaugugguuucaauguaggcaacaccaacuuugaccaaaucaaaguugcuaccauguguaacccauucuguggcccaguaguaauaccaacauucccaguuuacuaccuucacuaucaacauggcaaacacgccuuuagcuccagcuauuaacaagaagcuuuuaaagaaagauguagaacucuauuccaaagaccacccaauagugaaaacucuggauccuucugggaucauaaaaaucaacugaggaaauauuuuaaaaugucaaaaaaugacauuaaaaaugacaggcagaggcuggaaaacuguucuacucacaaggccaaugcauucuggucaaacagaugccugggugacuggauaaacaacaaaacaaacucaaccaaauuuaaaggaauauaggguuucauauaacacaguaucaaaaaguagacggaacagacuaaaugcaccaacugguggcagguaaguccacagccuacugggacaggaccuuccagcaucgaucagguuucuccucauguuuucucaagguuguuuuauagauguggugacuuuaacaagagucuaacaggcaggcaggcaggcaggcaggcuucaaucauugguuucaagaucugucugugccauguaggcauccaauucagcauccagguguccuuugguuuuugacauguaugcauccaacugguuguccagcugcuccuuggucaauacagggcgagugaggucaccucuuccucagccacaaccacagccucugccuccaaaggccccucuuccccgaccucucaugccccgaccccuaccaccgauucugccacgacacccuggguccccucucccaggaccgccacgaccucaaacacgaccucuucuuaagcccacuugggcagcuaaggcucggccaccucggagcagguuuugaccucggagcgacaucccaccccuaagcagguuucugguaacacgucccccacaugguccucucuggauuauggguuggccucuuccuccaagugcucccguggccagggcaccuaugggucggccuaacugagccuggauguuacucuuacccaggcgcugcuucuugacaauauuuggaaugaacuacaauccagaauuggaaggcucaccagugacccuuaucuugaggcuuggagauccuuaucuggaucuugguuuggagaucuugagccggaguggcuauggauuccagaagauugaaucuccgaguuuaaggaacacaccuuuaaucugggcuacaccuuuucaucugggauuaagggugugguggaacacaccuuuaaucugggcuacaccuucugcuggagacaauauaaggacauuggaagaagggagucuagcucuuguucuugcuccuucgccugcuugcugcgugagacugaguaacugcuagauccuuggacuucucccugccagcgcucuucugcugccuggacagggggucuauucuccaucugcugggccagccuucuguuucuggcacuggcuagcuacugcugcugcugcaucaaagcccaaauauucacuggcaucagcuguuuuguucuuuagcauauuaguaaagugcucauuuagagacaucuugacagugcuucuuagcacaaauuuuggcgcugacugugcagccaucuucaaaauccgagaauugaaggagauggacaccagcgcuccucccgggguugccacuagcugagcaguugguuuagaugcuuaaacaguaggaugcgaugcucccucguuguggguugaguaucuagcugaccaaucccccccgcucaucaagccugcccuuuccugccuuucgucugugccaccauagccggagcagccaacucccgcuugguguccaaaacaaaaucaugaacagacuuuuaaaacucauucuucaagcuaaguaggcagcucacaacuaggauuucagcacucaagaagcugagacuggaggauugcucuaaguucaacaccaacuuggucuauguaguaaguuccaggucaaccugggccauaaaagagagagagaaauggagagaaagaggaggagagagagaaggagagaaaggaggaaggagggagaggggagggaaggagaaggaagggaagaagaaacgcauucuucaaaugggugacaucacgcuccucaggcugccuggaaaugcgacauaguuuuguuuaaguuaaagcagcagcacacacagcagccugccucucuccccgacagccucucuccccugccagccucucucccugccugccucucuccccaccagccucucuaccugccagccucucucccugccagccucucucccugccugccucucuccccugccagccucucuccccugccagccucucuccccugccagccucucuccccgccagccucucuccccgccagccucucuccccgccagccucucuccccugccagcuucucucccugccagccucucucccugccuuucucccugccagccucucuccccuccagccucucucccugccagccucucuccccugccagccucucucccugccugccucucuccccaccagccucucucccugccucucucccugccagccucucuccccugccugccucucuccccugucagccucucucccugccucucuuccugccugccucucuccccugucagccucucucccugccucucuccccugccugccucucuccccugucagccucucucccugccucucucccugccagccucucuccccgccugccucuuucccugccucuuuccccugccagccucucuacccgccagccucucucccugccucucuccucaccaaccucuucucuacuuugccgaugacaacagugaccaggaggaguaacugacugacacgugacacuaggagaaacccaggaccucuucaugcuaggcuaaggaccacugcaucccaacccacagcaagcaauggugaggauguccaagagaugaaguaccagcaagcugccccaacuguguguaucugccuguuccuacccaaucccacaugcaauggagaaauaccagaugcugaagugacuuaaauaccauucauucaccaaguaaucaaaauauaccucccauaaucuauguugccagucagcaagcaacauaaagauguaugauaacccgaauuacuuaaaaacaaaauggagacuagagagauggcucgacaguuaagaacacaggagcuggauucaauugccagcacccaaccaccucuaucuaguuccuguugcaggagauccuaugcccucuucuggccuccucagguacugcacacacaugguucacagacaaacaacggguagaacauccauacacauaaaaauaaucagaguagaaaauggacuacuucgcaagaggagggaaagcagaacaguggaggcacacgccuuuaaucccagcacuugggaggcagaggcaggugauuucugaguucaaggucagccuggucuacaaaguggaguuccaggacagccaaggcuauacagagaaacccugucucaaaaacaccaaaaaauagaaaaaaagggagaaagaggaggggagccaggagagaagccaggagagggcaaugggggcagagcaugaccaugggacauaauaaacaugaaaaugucauaaugaagcucagcauuucaugucaugaguauauacuguaggcucucagcagccccauaucgcugaccucugagggcgagccucucccaagcaccucucucuugccggcaguauucugagcucugccuuaccacagccuucgcaguccucugcacagccaggaucuuguuuucuaaagaaaacuugaugcacuucaccucuccucugucguccauccugcagaagagagcgcacgucaggagagcaaccgcccucaccuccagcucuucccccacugacaagaagccaggacucucugggaagcagcagacccaagccuaauguuacaauugcaugucugaagcugugaccaaaaucuacaggcaacaacuugcuagugagguggacagaugacacagccaaguggcuggagaauuuaaggucacacacgucacugaggacuacuggacaccuugugggagagaugcacgcauugccuuaauuguaccgauaguuuccuggguguaucaauauaucaaugcaugguaauuguucaauuaauuaugagccaauuauaacuuaguaaagcuguuuuuaaaauaaaguuagggcucagcuggcucacugacaccugagugugaucuccaggguaugagcccauguaaaaaaaucucacagugaggcuggcauucccuucuaacccaguacugggaaggcagagacaagccagcccagaaggaucacuugucaugcuaaugucccaaugagacagcaucucaaaacacaaagaggaaauaaaacguggcacauguauacaaguuaaaugcuguauccuaccaagacuucaagcuccucagauuucugaaauggagccugugauaggcaguucccucucguuugguuuuuguuuguuuguuuguuuguuuguuuguuuugguuuugguuuuuuucagucucacagggcaucucacccacuaaccucugucauaccucuauuagauguccgaaggaaggcaguuuguaucucagagcccuguggcuuugggcaacacguagcugaacuacucaguguucuuaccgucucuguucccaacaacccagccuccagaaugcagacauaugggauuuccaaucccauagaauauguaauguucaagggagguccugcuagcucaccuucccugccccccacaacaccaugccuaugcuccugaugcuauccagggcuggucuccaaccagaaaccucucucuucccaccuugaagcuuugcucaaccccauuauuauuacugaggucaaagcugcaccccuuaagugcucccacacucugaacagagcuuuagcauagacuauggcaaacaguauuugcugaaucucuucucaccaguuaaagcugaauuccccaaaggagucugggcuaauucaaggccuucccuugucuacugcuuucaguguaugcugaguaagggccaccaaaagaaaagccaagcagugguggcucaccccuuuaaucccagcacuuuugagucagaggcaggaggaucucugaguucaaggccagcauggucuacagagugaguuaccugacagccagaacuacacagagaaacccugucucaaaaaaagagagaaggaagaaaaugacuaaggccgggugugguggcgcaugccuuuaaucccagcacuugggaagcagaggcagucggauuucugaguuugaggccagccuggucuacagagugaguuccaggacagccagggcuauacagagaaauccugucucaaacaaacaaaagaaaaaagaaaagaaaaugaugaaggaaaagaaaacaaaguuggcugguuucuucuugaaguaaacuuaaaacagcugacauauauuaagagcgauuuuuauuuauuuuuuacauauauauauauacauauauauuggaaacagggucuugcuacaccaccacuaaccugggagcuauuugcuacuuagcucugcagagggcugggauaggccuguugagagacuugugaaaaugaaagggacugcuauugucaaucaugcugucaaccugcuuaagucggaaagccggucugucacuuuaaacucuguggaagcccggauuuuucuccauuacacgagaacauuggauuuuccaccacccagcgaaaacucuagaagagcugggauaaaugaguaaaugugucuccuggcucagcucugcagaaaugagcgcacggacucaauaacuucaaguaccaggaagugggugcccuaggagaucuucgguucccacuugaacugcuacccauauuucacucuuuacaguugugcugugcccaaacugcaccagcaaaugucuacugcucuguccuacugacacaucaggccgcuuagaggaggcgagacaaaacgauucaacuuucugaguuggaaaaccgccgguguuuacaugugguuauuauucugaaaucgcaaauuaccuaaaagagaugggauuccuaucaucugggccuuuaacgaccacuccuguagcuccacccgaccgaacagcaaaaaccugaggaaaagagacaccguuaauggccagacuuucuaagguccuagacucagucuuucaaggaucacgucuaccauaccacauccucgauugguacgguacaaacuaacagggcaugcucauaggugggugcuuggacgaauuuuaagacggugcaagggcaggccagacacugagacugagcgucugaaagccaccucgcacacuggcaccucccaugcgcuugcacacucgucucugccccuguacaguacaccgggcacucuucggcgagggugcggcgacgcgaaggcgucugggcgccgggcccucgccgcggccgccacucaccugcuuguuggccucaucgaagaacacgcaguuaaccggguucgccuucucgaacugcaccggccgcucgcacagcuccagguaguaguccucgccgcccauggcugggacgcgcacagcucuuccgcagagguugcaguccgcgaucccggccgccgcucgccgcuguccuaggccccgccccgugcuccacgug

SEQ ID NO: 8820 - RNA, 47245 nt, Mus musculus
ugacaccgccuccguccuuccugccuugcgcacacaguccgccgucugcucuugcccccuccuuggucaggcgccgguuccgaaaccgcccgccagugccgcgacgcucgggucgcggugcuccgcgagccgaacugagagcuguagccccgcgcggcgacagcaugggugcgcaccacccggcccucggccugcugcugcugcugcugugcccugcgcaggugagcaccuuccagaaucccaggccggcugggcggaacgcggcggggcggggcggggcgacggcuccggagacccccggcgggggagcugcgggcguggggaaguuggucuucugugcagccguagaggucgccuucuccuccugugucuguccacccucacgcugcccugugcucugggagaggaugacagcuaggggccucuauuuggcuagcuuugagcuauuccagcgguggucaccugauuuaggauguggaauuggagggacaaugggcacagaggauagggacuuugcuuguuagccauuuuaacaaaacaaauucgacaugcacacauuuacuuagcuccgacugcauuacugcuccuugucuccagacgauggagguggaggagaacaaaacucggguaccaaauugaagcuguuuaacguacuuuaaagaauguggguugccucuucucacggucauuuuaacguuucgggaaacugaggcucacagacacaauaguuuaauugccccuucccacaguuagccagggacaggaagacaccuggcacaguguacuggcuucccuccucuggcuuuuucuugcuguggccaacuuggguaugggugugucacuacugcuuauguguguacaguuuucucauuggaaaguggguguguguuuggagaugccuacggagggguacuaauuaaacccccuuagucaucagaaugacuuaagucaauggaaacucuuugcccuuauggccacuaacuccccucuaauggacucugguuaugacgguguggugaauuagaagagacaacagaugaacgggucuaggaaacuuacccuugguucuuuaaaucucugugaagugcucaaaagggcauagggaugcugaccaaggagcugaagagcacacaggcggaucccaggcuaacccaaagcgagggaaagcggagaagacaguuggugggggcaggaacggguuguacuuuguuuucccuagaguuuuagguccuggcccagucagcagacuucacauuauaaaguggcuuaaacuuaucucugcuucucuuaccuuaagguaaccuucaaaauagauaagcgaugugccccucuagggcauuugaaguagaaccgagcuggcgcucuugcaaaacgccugaaagucuuccacccuccucuuaauuaaaacacucccauuguuuggcucccagggcagcugaaccgaugggggugggguaucugguuuugguucucacacagucaguggcugccgcuggucagguuucagucugagcaccagucaaguuguuuggagauuagaggcagcuguccuuuggaagcucacaaaugcauuaggagagaguuuugguuuucuuacguuuucuccuuacagaugaccgacuagcauugccacguugaauguucgguuuuuucucuuuugacuuggcuuuuuuguguguccggucuugcugcagggccuggguucucaugcucacuguauugcccaggugugccuugaauucacuccaguccuguuucagcccccuaaaugcuggaguuacaggugugagccacugcaugggcguagacagcuuuuuuuaaauccccuuguuugcuagucaccauggugugcaagccuuuaaucggagcccugcggaggcagagucaggauugcuuaaguuugaggccaacuuguucugccuugcaaguucuaagccagucaggucaacagacccugccuaguaaacaacucaccuguguucaucaagguaauacguagccguugggaaaguaggccugucuuuccugucuguccccccaccuugagaaacuuggaauucguugaggucagaacucauuaaacacuuagguggcuuuuucagagguaaccuggaauggguugaucuuuuggccuagaggaauggaguggguacauguaaucucuccuagcaucgcuccacuaacaccguaagauuugauaacagacuaucagcuggaaaaggaaggugguuuuuuucuucuuuugcaaguggguaaagaguaaaggacuugcugaauagaacuuuguauuucuccgaauuuauucuaugacccagaacaaagagucucucuguugagagaggcauaggcacccuguccuggccagccugccucacuccacuguuagagaugcacuguuugaaggguggcucaucgccuacugggaagucugggcuuagccaucagggacccuuucauccugucaccuguggcucugcucugcacacaagucagaccauuugauaucaaaaccacaaaaaaucuuggccagacugccagggucccgucaacuggagcuuuacugguggcauugugcugguccccagccaggauaccuucccacucaaguucuuguuuuuugcuuaaacuucugcaguggcguuuucuguuaacaaaagucuuugaacugagaggcccgguguguguugugucggggcguaugggaggguuuccaucucugacugcaacuucaguuuccccuguauaaagucagauuaacuggaccugcuuuccaggguuuuugcaaacuuguauuugcuugcuuuguaacugaaaugcuauauugcaggcuccuugagagcaagaacuauauauuaacagcucugaaugggcgcaacuuuugauuuguggcucuuuuuaaacaguaagucuucuagcaucaaaguggauuuugaagagggacuuaaaaguuaguugugaucagaauguauuugcaauugauucuggcgaagacagugauugacugaucagccaggcuuucuuugccuauguguggugguggugguguguguguguguguguguguguguguucagggcagaggccaagugucucucucagucauucuuccuguucuuuugaggcagggucuuucucaccuagucagcagacuaguuagucagcaagcccuagagaucaucuuccugucucuccucggcucugggaacacuguguauaccacagugccugauuucugaugcuuugcuggagagccacacccugguccccaugcuuguguagcaagcacuaauucaccaacugagcccccuccugcagcucccagccugugucuguuaucuuagucuuuaaaaguaauaugguuuuaagcaauaaguaccucuguggucggugcugcugccuggagccacauugguguccaugggccaguggccuguucugccacuggggacugcugauggcagaggccauguagacgaccuugguccauguucccacuggcuauaaagggcaaggaaacuauuucugcagugguaucagugaccguaaacaccguugagaaagagggacauagaggcuacugugacaacccccaccccaccucccaaaaaaguaacagccuagacaggaagccacugaagagaacucuuaaacugugguaagagugcccagguguaguucugcacaguugaugucuucuggcaggggugccgguaaggaacaacuugauuuucuuugagagcuggccacugggaguuugaccaugcuccggugaguagaugggcaacacacaccagacauguguccuuuuucuuuuuuugagggugggggaagaggaaucauaagaauaggaguggacuuggaaggacugggaaguaagcaugaucaaggguacaugauaugaaauucccaaauaaucaauacaaauauuauguuagaaaaaaauaagcauuuguuuuuaaaaacuuugacucagugaaugagcuucuggaaggcuuugagagacacuugaacauuuguccuugaucuuuuuuacucuccuuuccuuaagucacagaucuaaaguaaagguucugagcacaguguaggaugcagagaucgaagacccaaggccuuggaagagcaguguguuugcuauaaaaggcuguguaauguuagcugcugucuccaucuugugcacacauaaugguagaagaaugagugagaacgauaauguggugagaaauaauaaacauuagggcagauuguuaaauuuuugagcugagcucugagggugaauugugugccaggugaccaagaggaaucugggagauggagacuagccauagaaaugcucacuaguugagaugaaagcacuccuuccccuaaucuaauuauuucaugccauauacuuauauugcauuauccuguauccuauaaauacauagaaauauuuaucaguaaaaauuaaaaauuuuguagcagggcagcaaguguguuuccaguacaagucugagaccugcguucagucccugaaacccauuguuaaaggagaggcgcaacccuuggaaguugucccuugacuuccacaugugccgcauugcaugcuugcacacagcaucagcagcaucauaauaaaaaauaaaugcuagaaaguaaucuaguugcuaacaaaaacuguucuuugcauuuauuguaauuaccgugaauuucgguaugaaacugucuucguaaaauuuaaaauggcggggaucauuuuucuuuuugagucacacuugcuguguaaacaaagcuggccuccgacuggagcugcucuugccucacagccuaagaacuggcauuguagguauucuguagccaugcuucccagcaagcagugggacaguggauuacgacgauuaaagacaaaaaaguagcuaugucguuuuugcacagugucuuauugugaucacacagcuaaccuuauuuugucccccagaaccucuucaauaaaagugcauuuuuccugcuuuuaaaauuuaaugggccuuuuaucggcacacuagaagugagcauuggacccuaugggacuauaguuacagacaguugugagccucaauguggguucuaagaacugaacucaggacuccugaaaggguggccauugcucuuagccacucagcauuucuccaaccacagauuguucuuuaucaacuggaacauuaaaguugauguuugucuuaaggucacagggcuuaguaaauggcagaccagaagucugaacugcuaguuucugauuucugcccgcuauucaaguucaaauguugcuacuugauuccuaaaauggguguccaucaauugucccauuugccuaguaaggcuucccacuugauaccuguucccaucucccuuguggcuggguaauugccagggagucgugagucugcugagcguggcccucuguagauacacaccgacacucaggucaugguugugguuuagagcuaugacuuuggggugguucuucugacccugugcuugcugaagcucauaaaugucuaagaguaacugcuaguguggccuugggugagugaguuacacugugagguaaggggcuaccugccgaaugaagagcugggaugcuugagccuaucacacgcagaaguauuugcuuaaacaccuguauauaggcaagucuggugugugugugugugugugugugugugugagagagagagagagagagagagagagagagagagagagagagagagagacugacugacugucagacuagcuuugaaauagaaccagagguuucuacccuagaacccuagaagucacaucaaaccaagccucuaccuccauguuuguuuaaucugucuucugaauuccaaaggaacagcaggcaguguaaucucugggcaggauucccuccagcccauccugccuugcucugacuugacuguacaggccuguguccaugcuccccagauaggcagcaggcagugggguuaaccagcagccaccggcuucuccuguuggagcuggagccagcugucucccaggucccucuauugccuuuaucuauccacaaucauagcagaaguggcaaugucagcuguaguaugucacagagcugcuggacugucugucacaccugacagccaccuagagaugugagugacggccauugcuucuacaucuguaguuuguggaacuugaagucagugggggcagccugucugcugcgacuuccucuucugaggcugccagugcccaaacgaggcuggaguuugaacugugcaggcacucagugcuugugggaagagacagaagggcuggcagacauuugucuuguuuuucagaauuaugucaccugugagccuugccauggacugucauuucugagccuuuacuucccuucccuguaaauccucauauucugugugacgaugcccuguuagaaaugaaucggugagaaacgaccagcgugugcccgacaccgugggcauccccuccagaucuguggguuuagaccucgguaggguucacuagaggccccaggaguccacguuucucuugaguucagaauuucuucuguguagugugagaagcugcauuccaucugugcucagagauuguagcugcugauagauggccgaaggguucauuuuucuuaaaucuuucuggacugaaggcagcuuucugacucagugagauuucuaguaacuaaaccccaucugaccuaucuuucgaaaguagcaacucucuagccuuuuacuuaccaagccucgguuggagccagguggccggguucucauugcugaacuucaugaaaucagugagauucccuaaacucacuguugcugguuucugaaccgaugaagguuggaugcauuguacuggguguuucaaaagaagacucauaccugggcccagcuguugaggauuucauggucuuaugagggcaucaagacaaacaagaaaauacucuuucaggucucacacaucuuacuugcuccuagagcgacaaccacagacuguggccuggcccacggguuugggacacgcuuuacuucauguguggcugcaacugaacuuuuauaggcaguguugaguauuugccacagagaccugccugaagaauuaaaagucuccauuauuuaauguuuggcccucaggggcagagauugucugccaagcucucguggguccacaggggagcucucaggaugugacaaaacaugucagcauggcaagagacaucggccgccuccaugacugugaggaagggguugggugcuccgccguugagccagcugcugcuucugaucaguuagggcagcucaccuuugggaacugcacuagaccaggguggaaggagacaggguuuagcuuagugaggaaaugagucuugggaggggcaguuaagcagagaucauuagagaggacaaacaggauuugugacaccagagucuggaagaacaaugagccuugguuuucugugacuggaguuuggccuuaaggucuuagauuguagaggguuaagagccaaagagcgaccuguggaagggagcugacgccacacuugugguucugcauaugugacaauuggguguuuaccugugggaggagucagaaagcuaggaagaccugggugugauaaguuauacugguucagucugaggaaugggugggguagagaucugagagaggccguucaguuugaauucaguauaucugcgaaaucuggauaucugugguaggaguguauugauuugcaauuaaaacucugcagucuugaaagaauauuuuagaaauggacaaaaauguaacacuuaaguaauguucucuuuucauuaaaguaucacuauaagagugguauguguggaaaacagugugucugcaguuggcuugaaugugccaacagaguucaugugcugggguucccccacuccaccgacaccccccccccccccccggcaacaguguugauaauuaaaccaugagugaucugucggggcagaucaaucaaugcacccuguggaagugaaucaugcucagaggagauucuaaugaagggugagccugucguuuccugucugggguucuccucucuccuuuccaccauggagugugguggcaagaacaucagaugaagucccugcagcccccacaccugugggccagagaacuuucuguuuauuauuaaucacuuagucucagguguccugacauagcaaaagcucacagacugcgaaguguccccacuacguaagcgaguaggauaugcugugagcgagugggauaugcugugagcgagugggauaugcugugagagauuugcuguauggugugauaacggauucuugauucuugaucccguuugacucccgcaaugguggcagggaacugaagcucaagacacagcuuucacuuuaucuggugaaggacaucugagaccaggcuuuuuugcuuuguguuauuuugguggucaagucauguacgacuuaacguuuagcaguguucaguggccucagugugucacacguguguaaccuucgcuccugucccucucuagaacacagccugugugauuaggcucucuucguggugacaguagaccccaaacacugguguguuucauuuuaauacugcauauagcgcuuccuucccuacgagaauguuucugaguuuaaaaccaggguauguuugucguuugguuuccuuuggauuagguuggguuggguugaguuggugagagucuugcuguguagccugggugguggauuggcugugcuugacucaugagaaguggcacuauuaggagauguggccuuguuggaggacguggggggcuuggagaggucugugcucaggcucuuugccugcagugcgaacgagaccccuccugacgagaccccuccuggcugccuggcugccuggcugccugcagaagacaggugucuuacuuaggguucuacugcugugcacagacaccaugaccaagacaagucuuauaaaaacaacauuuaauuuggggauggcuuacagguucagagguucuguccaucaucaucaaggugggagcauggcaguguccaggcaggcaugacgcaggcagagcugagaguucuacaucuucauccaaaggcugcuaguggaaaacugacuuccaggcaacuagggugaggaucuuaugcccacacccacagugacacaccuacuccaaccaggccgcaccuccaaagggugccacucccuguccgagaauauaccgaccaucacaacagucuuccccgggcaaccuuugggucaggauguagaacucucagcuccuccagcaccaugucugccugcacgcugucacgcucccaaauagcuaccccagugaaaugauuuccuguauaagaauugccuuggucauggugucucuucacagcaaugaaacccuaauuagacagccuccaauagcaauccaggugcagggggggggccauaugucacuacacucaucuuaaacucuggguucuuguaucacaaugaaggaagcuuuaaguuugggaguuggguucuuuguccacgugaguucuucuugcccccagagcauggcugcgcggguuugacagucccaggagacuuggugacacauucauccucguugucagagaagcccugacuaccuaugacuaccuacugucugugauuuugagauuguggagacugucucuaaggcgccacuuagacccuccauagguugcagagaugagcauggcccggcccugccucucuaggucuguagucccuuggugcaguggaaguugggccccagucucccacacaccuaggccacaaguaggugaggucuaccucugcccugacucaguccuucaggugaggcacuuuaccugcucaucuguauuccagaugagucacacaucugcucuaaguggggauugugacaguagggacaaacucagcaagagcccguaaacuaagggagaugugcuauaucccuaugggacuagaacaucuggcgggugcucuggagggacgugcuuaggugcacaagggagguggagaccggagaauggcuuugaccauagguaggaaagaaaacugggaccaguguggaggcagauaggucccuuaggaggggacagaagagaagagccaggacgagcuugcaaaaacguugucauaggcagcaggugaggauggguucuaacuacagacuucggagaugucugaacaaggagcccccuaccaguggaagcuguggaggacugagagaucagccuccccuggagcaucaaaggccagcaggcagagaggcagacauguguagagauugccugaagcagggacaucugugacauuagaauaguguccauaggcaguguagacacugugaaugggaaaguuagcgugcugaaaagagaccagcuggugagguucccugaagagggaggggcuggagacauuuaagguggaaaaaaaggugagcuugcagaggugggagugggaguggguaaacuccugagaagggcuuuaauuguggucuaauuaucuuuuauggagagucugugccuggagccaaaagcugcaguuucaacccuggcuuggccaaugcucucuugaccuugggcaaauuguguuaguagucuccuagugcuuugcuuuguguguuggaguaucugagccugucacgcugaguugacaccuaaggccugugagccacugagugcucuuaagagcacuugagccccucuggcuagggccacugcugugggcaagaugguuuugugagccaauugccuuugaaugaccaggaaaccccaaauauuuuguguucuacuuaaaaaggugaaguaacuucucuaaguguaguggggcucaacuuacugacuuagaguauugacuucuugggauccuaagagcuccugacuccucuccuuuccccugcuuucaaagggggcagaaaaacacuuggcuuugaaaucagugacagcauagaagcagauguuugugaaacaucuugucuggccuuuuggcuggguuucuguuuuuaagguuugugggggccuuggguuuggagcugauacuugcucugggccaguauagauuuaaucaaagucagcgaucugggacuaccuaagugacaccaucagaggacuuuauuuucuuuaccucacccuuuguugugguaaaugccaccuggaugcacucugcccaggaauacccagcucagaauuugcuggugauggcccuacugaauucucuaaucaguuuuuauuuggccuugcucaaauaaacuccaacgggccucugggauuucccuuugaauucuguugugagacaggcuugacaacugguaagaguucuuagaaaggagagaaagcucucaguuuaacuggcacuuccugucagcucugcccgcaccucucaucagcuuuagccauuuaaaacuugaguugcaucggagcccucuugccugcuggaaggccagagugcaguucucugcuagaguugcuggguuugguuuaaaauguggacccuuucccauuuggauaauuucucuccuaaacauaggacuuugaaugaguccagaggggugggccuguagccagugcgaagcagcuuguugcucuugggcuacauaguaacuaaguccuuguccucugucucaaaagaacagccacacacacauagauacaggcagacacauguaucucaugugguuugggggugucuguuuuugguucugcuguuuugaaccccaggcuuuccgaguguugaacaaccacuagcuacaccccugucuguuaaggcaggggcuccaaguugcccagcugggucucgcacuccacuucucucuccuacuuccuguuucgucccuccucugugguagaugagguuccaggcgugcaccacuacauccagcgaccuguaaugguuauuuuacuaaacaaaggauaauuucggaagcaaguucuauugauucuggaccccuugagaguuguguucccuggucuaguuuuuguucuccuucgccuucuucccuucuggaucugcaucguggcugggaaguaaaggugacugacuuagcugccugccuguguggggauuggccugccgcuccuguucaggguguuuaaggcuuugcaacugguaucuugggauccagcuugcuccuaguuuauguuuucccugugggacaguucuaagacagugucccuggcaugcuggucaucugugcugagucaguugugcagcacaguauggauuccucugggcagcacccuugaugggguggugacucacgggaacacuuccuccuuaagcucuaggcagccuugugacggucacauggggaauaugagcagcucuugagacaucuuuucauaagaaauauuagguuaauguugccuugcugaugguccuuaaauuuagcagugcauuccuuggcggucggucuccuuagcccucaggaacaguguucuugcaucuccuuuuagguaaaguuaaugauacagguucuguuccucagguuccuuuugaaguaucagaaguagaacuauacgggaaaauauccuuuugguuguuuaauuuuuugcguacaauucccccaaaaacagugucuuaauaaucucuuacuugcuaaguacaacauugcuucuaccuauccuugcuggaacuagacccucucuuaaguggcaaaucuggcucuuguaaauaguuucuauuccugcaccacacugaccugacaaauccauuugggguuuuaggccuguuuuguuuuguuuuguuuuguuuuguuuuguuuuaaagauauugauggggggggagggaggaggaggaggaggagguggugguaucagauaccaugaagcuggccuacaggucggugcugggaacugggguccucugagcgaaggaaccucucucucuuaaccaccgaaccauugcuccagccccauggccugggugccacccuucguuuguuuucaagacaggguucacuggguaguucagacuggucuuaacuguguagcccagacuggccuugaacucaugcuuuuucugucucagccucacaugugugggauugcugacauaagaccuccccaugucaggcuuguuccaucauuauuaauauuucuugacauguuuagcaagaacuuuuguuacuucauuugcuaggaagcaugaaaggucuguugauugagcauuuauucauuuauuuauuuauuuauuuagcuaaaaucuguuuuccaugauuccguagguguuuucgcaauccuguguuugguauggagaguguggaauugcgacuggagauaagagguacaacuguaaauauucuggcccaccaaaaccccucccaaaggacggcuaugacuuagugcagguaagcgugcuguuuugagagcacccaggcacaucuuauagaaucuuaugaaucauuauagacucuauaaugggaccaaggaugcuggaggugagacuagagggcugaaaucuguaaagacguuuguguguguguguauguaugugagccuucacaugcaggaggucaguuggaucuccugugaaccuccacgugggccaggaacugccaugauuuccccacacgcucagucaucacugcugagcuguugcuccggcuuaaaucuuaaccuagacuccagccuguaccccacaacacagagcugauaagagguuuaacccuccaggcgcugacucugcgucuccuggcguuuccuagugggaguuacuguuuagagaugaccuugguacccacauguuaaguuagcuuucuuguuguugcuccuagauuucaacacuugcuuuuucuuaggcuuugucacuaaaaggcuggcuucucaccaccucuuagugauuucgcuguucccuguaagcccgugaguucuggcuaccucccagacauugcuuuuuguuagugugguucuuagggcuguuugggaaaaaaaaaagaauacugggaaaaaucaggcugaaaagacuggcuuuggggcuucaguaauccaggguagcacuaggucgcguaaauauccuugcuuuuuucuucagaguuaguacaaguuuugacugucccuggagugacaaguggauauagccuuguggcugaacguuugaauagucugacuuacacagcgaaacaguaaaggaaaaaucaauagaguugucucugcuacuuaugaauccccacuuucuugggggucgggagggggacuguccugagacaguguuucucuguguagcccuggcuguccuggaagucucuguagaccacaguggucuuaaacucagagacugaccugccucagccucuggagugcugggguugaaggcgugugccaccacugcccggcugaaucccuacucucugaauggugaacuugauagcgacucagaaagaaccucucgugccugggauuaacaggagugaagggccuccauuaccuguaaugacggggcuuaucugggaacccgcucucuccucacaggaacucuguccaggacucuucuuugacaaugucagucucugcugugacauucaacagcuucagacgcugaagaguaaccugcagcugccccugcaguuccuguccagguaggcggaccacagcagacagugccacucuggggugcuuauacagaccaguuuccccucuguuguacucugagaggguacucaugguguguuagaaggaagaaggaagucacguguccacuaguuucuuccuaguugccuucacagugaagacuugguuuccuucgugguguccuggcucacagaggggccuagggucucucagaacagagcgucuaugcacuguggugaggaguggucccugcuggccugcgggccuggguccuccaucuguguggcucucgguucuuucucacuccuugcugccuugcuuugcccaucauucuuuucuaaguuuuuagaaaauuuaauuaguuacuuauugugugcauguaugcaccauguguaccacugugugcacaugcacauggaaaucaguuauuuacuuacugugugcauguaugcacuauguauacaaacugugugcacaugcacauggaaauuaguggguguuggcucucuccuuacaccauguggguccaagaaucaaacucagguugucaucuuggcagcaugccauuggcucuugccugacguccugguaucucucugugcugagacacugcaguagccuuagcuccuaggugguacacucauucugguguaguuggcagugcaaaacgguuguauaauagauguucuuuaaauauguaaagaacaaguuggugguucucuuuagagcaacagauuuugguggguguaaauuauccagacuuuagcacacucguaaagguggaugagguaggaggugaagaaggaagaugcccucucuagauaccacuguaggcagcaggacccuacucugcuucugcucagggcauugugucuuagaaaguggcuguaccaaguggaaagccuuugcuuuacagaucacagaaugcaauaauggaucaagagcuaagaaucuacucaggccacucuaggcuccuggcauuggcagaaccggaucagaggcucugccacuuagucacaucacauuuauuuacuacccacucuaauugauggauuauggauauaaacauuuacuguagcuagcccccuccccauguuaucaggggguaaagcucaaguuauaauaacaagagaagcaaacuaacuuggaauuuauacagcugcugaaauugaugcucuuggaggguaaaugaagagccguggguuauuuguaauccauuggaaagcagaccgucucgggaaugaaugacucccgucugaguacugcaguuguacuuccugauuuuguuacaguuugcuguguuguaggacuugaccuacaaccauuaaaacaaucucuuuaaaguaucaguuuuaaaauucuucuaauuuuggccugaagagauagcucagcaguuaagagcacauacuggucuuacagaggcucuagugacagccaaggucugcuaagguccccuucucuggagcagagucucuugaggacuggacacaucacccucauucccugucagaucugacugugggacugaagcagaccacacaguaaucucgggugcuccugcuucacgguucccccauggaacagugagguaacauggaccaaagggagcgagaacccuuuugccacauacacaagucaacauuaggagcuuaaacuuugaacccaaaggccagcagucagcuaucaucuucgugguaacccgggugcugcugcaggacacacagcgagcgcugcuguggcgcuucuuaaccuuuuccuguaccacgcucugauccgagaccucauaaggugauggcucuuuuuaaucuucagaacacgcaggggaguccuccuguguuucaggagaggcuaggguuaucugacuuuuagaagaaagcugaagguuuaaauccuauaguggucuuugucacauggacacacacacacacacuuaucuacaccuuauucucuuaaucaaaacugacuuuuuggaauaaagauagaaaucucuaaauucaaagcacagaaaucagaaaagccuccuuuuuucuuuuuaaacauuauuucugaauaaauuaaaugaaauauuagggcaguuuuaaaagguauuucuuuauguuacaauaaaguuuuaagaaugugugagucuaaggacuggagaaauggcuacaguuaagagagcugcuuuuccagaggacccggguucaauucuaaguucacaacugccuauaacuccaggucuguagcucugucuaucugacacccucacacagacaugugugcaagcaaaacaucaaugcacauaaaauaaaaauaaaaagaaucugugggucuggggagaaauaggauuaaacguuuucugagucuacuauguuucaugguaacuugucuccucucaaugaauuuuaaauauucuguagcuauguuaccuuuuuuuagcugcuauagcuggucauaaaauauaauuuacuuuuucuuuagguguccgucauguuuuuauaaccuaaugacccuguuuugugagcuaacauguagcccacaccagagucaguuucugaaugugacagcaacugaggauuauuuugauccuaagacacaggagaauaaaacaaauguaaaggaauuagaguacuuugucggacagagcuucgcgaauggugaguaaacguaauuccuuuuccuuuuaaaaagcugggucaggacauuggguugaguuauacaccuuuuguuguuguccuagcaacuguguccuagucacaguuucaggacauuggucaauguuuuccuauauucugggacuugaacuacaacaauuaaaacugucuccuuaagucuuuguuuuaaaacucgucuacugugggggcugcagugaucguagcaguuaaguguguacacugcucuaucagaggacccucguucaguucucagcacucaugucaggggccuuauaaccacaguuguaaccuucggcccugauuccucuggccucugcgggcaccugcacuuccauacauaugcccacacacagacccacacacucaaacaaaauuaaaaaauaacaaaagucuuggggcuggagagaugacucagccauuaagagcacugguugcucugccaaaggaucuggguucaauucccagcauccacauggcagcugacagccaccucuaacuccaggcccaguggauccaguguccucuuuuggcugaugcccucuucuggccuuagcaagcaauagacacauaagguacacguacauacaugcucucaaaaauagccauacauauaaaagaaauauaaaaucucaagaaaguagcaaguauuuuuagauuguuuucucaaguuaccauguggaaauuuuucaguguaugcaagccuacuuguguacauuuuaguaaccaucccaucauugguucagacagacaagacuugcuuuuaaccucaagagacaauagaaauaaaaauugacagcagccgggcaugguggcacaugccuuuaaucccagcacuugggaggcagagguaggcagauuucuaaguucgaggccagccuggucuacagagugaguucuaggacagccagggcuacacagagaaacccugucuugaaaaacaaaacaaaacaaaaaaauagugacagcagagagagaaauuucgauuugagaaaaucauucaucaaaagaaaaacaguuacaagaugaagagcacccccauacagcaugaggagcacccccauacagcaugaggagcacccccauacagcaugaaugaccaagccagcucagucagucagcagggucucgagggagggagugacgauugaaaagaaaaagacaauuagacaaacguuagaacaugacuccagccagugcugaggcugacgcaccucuauuuuuuuucggucugcuuuuauaccauucuagguucuugcagagaauagggucaguucuuagaucaaagacaaagugauuagacaaggcaaagaacaaaguccccugagucccugggucugggggcucucaggauuaccaagacaaaagggaagucccacauuugauccuugcauccuaucugauccuccuucucccuccgagcgcagugacagauuucuauaagcagcacacaggcucuccauacagacaggagugaguauccccauacagacgagaagcuccacccaucggucaccggaggagaucagaguugugauaaagagauccaucuacuugcuaggaaauuauugaaaucauagaauucaaaaaagaauaaaauacuacagaaaaggaacaaauuacaaauggaagcgauuggaacugaagacagauuaaucauugaaaugggcuaaaaaaccuagcaaaguagaccuggcugaacaagaagugucuaagagcagucuaaaaauuaacaggauccaccuccauuacgccugggcuuauacucagaggacuccaaaucccccgcaagguacgugugcaucugcauccuuugcugccugguucacaagaucuaggaacuggaagccaccuugaugcccaucuguagaugagugggugaagaaaacgugguacgcacgcacaguggaguucugugcagcuguaaagaaaaucggaauuuucaaaaaacgguuggagcuagaaaauagauuaagcaaagugauccaaagcuaagaggaugaaaaacugcauguucugucaccucugcagauccuagguuguagcgcacacacaugcacauacacucgagagcacacacacacaugcacguacacucgagagcacguacagaugugaguacagauguuaaacuagaaugaaaagcaagagcggcuagaagaggugcugaagaugagcugggaaccggaagggagacagcgggagauuacagugcggggcagaggguugggacagaugagggaagaggagaacggaaacagaaagcaugcuucgggacuuuaaaaaugaugcuuaaguguacuagggucaauaagaucagcaaaguuguaggauauuuaauaacuauauuaguucuuauuaugacccauccagcccccaauaauagagucagaguccaauggauuuauuuaaucagcuuuagcacaauuacugugccauuaccucuaaacuauuuuucuaugcuagacuggucauuucccagcugcaccccccauguuacuuccugguugagucucaccugggugauuucugcuccaucagucugagauacacuucucucccuaggccauguccccucuaacugagaccucucucuccaucugcauuuuccucucucucuuguggauccuaccugcaauccucagcccaggaacagaggucccgccuaccucuguucuccccaguaauuggcugucagccacuuuuauucaaccaaucagagaacauaggcgagcauaguuugcagaacaucauuuggugugccugagaacuuccucuaggcugccaccagaucuugggggccaguauuuagcauuagaauacauagcagcaccagaccaacucccaacaaaagaccuauuuaaaaaaugacccagccagauguggucaugugggguuggaggcugaggaggcaagagggucaugaaguggagggcaaccuaaagcacuucuguuggcucucacuacaaccaaccaaacaacuuuuaaaucgcuucauuggaaauaagugccauucacaaugugacacaaaugacagaaucuuccagaagauuugauguagcagccuaaggagagaguccugggucagugcuccacauagcuguaucauuacaaacccuugagagauuggggugggguggggggcuuggucaauggggcaauaaaacgaauauauucaucuauauuuuaguauguauauuaaaaguuguacagauuaaaaauacuugaaaauguguacaaguaaacauaggggugguuuuuuucuuuuucuaucacuuuuaagguaaaauauuucuugacaagaaaaggcagaaaccaaaagugguuaaaguccaaaaccacccaugaaauacagacccuccagugugucuguccucgugccaugucagguuggcacagaguaaauuugucaguuccagcucuuuguaagggcaugaagcaauagggagucaacagacugccccucguggcugcuguaaacguuugaaaccauuugaaaaacaauuuugcaauaccuggugaaacugaagauaaauaugccauuaucucaaugggggggggggggugcgcacgacaaguucaaaucaaaguaaaugcuggagaugcuggggauggcgagcccacggggagccccgcccauccugagagaaucuuaagucaacagaaaguuagcaauaguugggugguuucuugucacaugguucagcagcaugccuaagguggguauguuaugggauauguaguuacauuucuggcauuugguaaaguuuguuuuuguuuauuugggaguuuuugugugggcuuguggguguuauuguuuuugagacagucucagaauuggcuccaaacucaguauaucccaaagguuggccuugaacuccugaucucuuaucucuacauucuuaucucuacaugcuagaaucaaaggcaugcacccacgagccuugcucaaaguuguuuuugauuuuguguuuuuaaagauauccccuugguguagcuuuuuugcuugugguguuuuaaaacagcacacagaguaaugagcuacacugugguguuuucuuguucuuacauauauagcaauauauuuuguucauauuugcauccuugguucaaaaacccaguaagcuccacgggauacaucuugaaacagagggaagcaugggggcucguguccuccucauacucuagggacugaggcaggaggauugagggcuccaaacagaacacaucagugcuuacacacaggaaaauguccuugccagccaggauggaggccaaguggagucuguuccacccuugucacacuggcuugucaccugccuguccgggguaagcagagacuguuaggggaaggugaucccaggaggcugucccgagugaguugauguccuccugcauuguggucuccccaugcagagcugcuagggugagcaucuuucuccugacuuacugagcgacucuguacaaugugggugggguuccucggagcugugagagcaguuguuaucuuuccugcuuugaguccccuuccucccugucuugcagugccccggguucuaaccugcuggcuccugugugccagcacagaggccuucaguuccaucugggcggugaguucaagccagcauaacgucuccaucuuuucccuuggguuccucuuuuagcgauguacaaugccugccgugauguggaggcgccuuccaguaacgagaaggccuuaggacucuugugugggagggaugcccgugccugcaaugccaccaacuggauugaguacauguucaauaaagacaacggacaagcgccauuuaccaucauuccuguguuuucagguagggauggcagcucucaaauuugcugaaguuauuauuuugcuuuaaaacucaagaaucauagucagcuauagaaacauaaauucagagagaaaagucagacauguccugucugguuuaacuugggaaggcugggugagaaaggaauuguucuuagggacugauaauguuacuaaaacgugugugugugugugugugugugugugagaaaagcugagacacuucuacugugguauuagacuaccacagaggagggacgaaucaggaaguaggagagagaaguggagugcgagacccagcugggcaacuuggagccccugccuaaacagacagggguguagcuagugguuguucaacacucggaguggaagccagacacacugaggauccaccuuauaugguugguggaagaucagggcacacgcuguacacagaguugcugacaucacagcagguuagggauggggaacuuagcugagagugcuggccuuggggccuucaggcuugcacugcacaaaaccaguuguacacacaccugcgcuuaggagaugcggggaagaggcaggagcucagcuauacucagcugcauaugucaucggccagccuggccuucguaagacauugucaguacccaccucacucccccaaaacccuaagagacagcaacagggcauaaugcguggucacacagcagcccuccgcccugggugcucagcugugccaugcuguacccuuguugcuucccauuggguuugaaugugagcagauacaaaacuuggaacguauucucagagguucuaauucagcauaauuucuucuuguagaucuuucaauccuugggauggagcccaugagaaaugccaccaaaggcugcaaugagucuguagaugaggucacggggccauguagcugccaggacugcuccaucgucugcggccccaagccccagcccccacccccuccuaugcccuggaggaucuggggcuuggaugccauguaugucaucaugugggucaccuacguggcauuucuguuuguguuuuuuggagcacuguuggcaguguggugccacagguaagcugcuugauugauugguuuucuucaagacaagaacaaaauugcccauguggcacccaaggcucgcaagugacuuuaguuaauccagacagggaguaaauaucaauagggcaccauccccuggauggcuugugccuacagcuaguaaaucaggguuuguuuauauauuaaccauuugaagaaaauuaugccgauguauucaaaauggugugugauuuaagguaccuuguaauagccagucuguaaaccacaucugaucaaaaucuaguuacauguaucuuguuuuaaggcuguguguguguguuugaucauauguguacauaugugugcacaugugcgccaaaguccaauuugaucaguugccuuccauuuuggcugcuaauacuguuucuccuuaggcccgccccugcucuccacugguggguccuuugaaucugugcuguuugccccagggugaugggggggggcuugcucccucccccaccuccccaucucucuucuuugaaauuuacuaaugggccccuucgucugcucacucaguaguguacuuuuuacauuuauccgcucuguggacuguguccaggauuggggcaccggaguuccuccccauuggcuccaggguucuuuggcugggcucccacccaggcucuucucuccccgaggccuggcauccaucauucugcucaagccguuucuggucccuuuguuagacauggcauugaggggcccugucugggcacuggggugcucauugcuauuagcaauaaguuuucaaaggaucuaaaagugacuccuguggauuccaacgugagguuaccugucaguacuuugucaccuuaaugcccuccuagaucuuuccgaggcuggugagcccaggcagggaaacuggcgaugggacaggggacagagugaagagugagcugcacuguaacgcuguaacuaagucugccaucucuaagacaccaccucugugcuucuguuucagaaggcgguacuuugugucugaguacacucccauugacaguaacaucgccuuuucugugaauagcagugacaaagguaggcauguuugcguaagucaggggaucugauuguguuggccugagagccugugugaggcaguacuauugcugaggacgcagccauagugaaggcagacguagcacuugccuucuggcagugacuaggcaucagugagguaccucagaauuuaaguaguuaaugacagaauucugggcugagguaggagucacagaagcucugagggcagaguugagugaaaugaagucaccagagggucuaucccgagcagccaaggagagcgagguaggcuuugggguucccuguccauggcuuugggaauggcuagugaccuccucuccuuuccucucccccaggggaagccucaugcugugacccacuuggugcagcauuugaugacugucugaggcgcauguucacaaaguggggggcuuucuguguccgaaaucccaccugcaucauuuucuucucauuggccuucaucacugugugcucuucuggccugguauuuguccaggucaccaccaauccuguagagcucuggucagccccucacagucaggcccgcuuggaaaaggaguacuuugacaagcacuuugggccuuucuuucgcacggagcagcuuaucauccaggcccccaacaccaguguucauaucuacgaaccguaccccgcaggagccgaugugcccuucgggccuccauugaacaaagagauucugcaccagguaagcugccauuccggucauuguuccaaggacacuggugauuuguucuuuuuauuucuguugugauaaccaaccugacccaaagccacauagggaaagaaagccugauguggcuuaaaguugcagaacgcacaguucgucacuaaggaaagucaagcaggaaugcaaggcaggaacuugaaggcagccugcuugcuuuuccacacagcguuacucccagugaguuccaagggacucacaucacagccuaacaaguacagcaggaacuguugggugcuacuugguaguugucagguaggcuuaugcucagcuagcuuccuuacuauaaaguuuaggaccaccugccuagggaauggugcugcccacaggggcaugagccauucuauauuauuaauaauuaaagacuguccccuacccauauggccacaggccaaucugaccaaggcaauuuuucaauuuuucuuccuagauaauauucucuaucagaaaauacacacacacacacgcacacacauacacacaaauggucacagggcagagcaaggcagggagugguauuuuuuggcaagggacaaugucgagaagacuagaaauuugauucaaagcuggagccuuguugguggacacuggaauagggugagggaugauuuuuuggucuccuguucauaucauggucaugaugucuccgucccagacucugcaaaccagacuucuucaccccggggccuuuggcucucaccagccuguugaauacuguuccccaauccuaggaaguaugcccuccgagcauccuucucgcccgcguucuccggcagggcugguuagugaagggccgaggaauccuuuucuggguuugcuuacuuuccaaauccuucagguucuggacuuacagaucgccauugaaagcaucaccgcaucuuacaacaaugaaaccgugacacugcaggacaucuguguggccccccucucuccauacaacaagaacugcaccauuaugaguguguuaaauuacuuccagaacagccaugcggugcuggacagccaaguaggcgacgacuucuauaucuacgcugauuaccacacacacuuucuguacuguguacgguaaguggcgcggccauucauaugcccucucgguauuugagaacuucuguuacuuacucuguccauacauauggagacccaguagauggaaccagaugugcaucgagaaaaucauguccuaauagaagagaccaacaauauagaaauaaaucauguauguuacuucccaguaggcgcacauucuggaaacauuauuguuaguuuagugcaaacaucauacuguguauuuacccugugaucacauauuacccugugcgaccuucuccuguagcucaucugccaucgagagaagugguugugugguauaugacaucugucaugucagguggagacaggcugcgaggaggacaccaaggcugagaagaaaaggcuuggguuuguguugcuguagcacggagagugcacaggggaaggaaagggaagcuuguggcugugagaggaacguguccaggcagcaugaguagcaaaugcagaggcccugggggaggcgcuuucuccaugaguguguguaccagguaccucucggccuccaaaggagcccguugcaguguuucuuguucuucagauagagcucucugucauugugguuaacuagcuugacugcaugcggccucccuuuuauacguaaugauacuuagacgcaucauuaaagaggaaagggaugcacacaccaaugugguggguaaagacggaaggggaugcccaugccaaugcaguggguaaagaaagacgaaagggggugcacacgucaaugugguggguacagaaagacgaaaagggaugcccaugccaaugcgguggguguacuuacgugcuuucacaucaagaaugaaaucuuggguggacauuggccaugggagaacagaccaucuucaaagccuuucagaguuggucaguauuuugauuuuacaauaaucaauagaguauucucauaaauacauaguauaaaaggacagagguuuuuuggagcaguuagaaauuguuggaaauucugacuuaaugccaagccaugguucuuuuaacaaauuuuaugaaacuuuucaagcauuaguuuugaaaaucaaaucauuuuaauacaauauacuccaaauauauacuauuauaauuugauacaugguggggaaugaucuggacagaaauacucaaagguuuuauuuuccuuagaagagcaaaaaacugugugcgcaguaaaauacugcagucuguaacaugcaggagucuugggucaggcucugucuguuggucuguuugcuaugccaaguguacacauguccagaacccaggcugcagugaagucgcacauuacaucaagacaugagggagcacuaccacaaacacauuggauucuuuuuuuucuuuaagauuuauuuauuuauauguaaguacacuguagcugucuucagacacuccagaagagggagucagaucucguuacagaugguugugagccaccaugugguugcugggauuugaacuccggaccuucggaagagcagucgggugcucuuacccacugaguuaucucaccagccccacauuggauucuuuaugcguuugguuuuuuaauaacuuugguaguugaaaguuuacaaacuuuuauuguugacggguuuuuuuguaccccccacauuuauuugaccccauguggacucaacaacccacagguuaauugucugccauguacaaccuccuucucccaauucuuccucagagagccaggugggucucaugguggccagcugccccuucaccuuucauccugucuauacaaccagcaucaugugucgcuggccucacuggggugauagcuacuccugacuggugcccagugacuugauuuccuggggugugugacugcucuguauucacuaaggaaccagcguguacucagagugcagauaugccaugcauucugaguuuagguuggugugaugacuuggagguccuaaugauguuuuucugaacuuuuggcagggcucccgccuccuugaaugauacgaguuugcuccacgguccuugccuggguacauuuggaggaccgguguucccguggcuuguguuggguggcuaugaugguaagaaguccuuguuccacagugcuguccugguucuagccuuagccagcaagggugcuuacuaaauucagaaaauggguagucuuaguccccuaucuguugaguccccacaauuucuccuuuagcuuuggauuuuaauuuuauccugaauuuuaaaaaagugagccagguguggagguacauuccuaauagacagcauucaggagguauaagcaggaggaucauuggugcgguaaaucuccaacccaaauaagccugagcaauggaaacacaacucaauuaguaugaauacaugcugugcaccuagacugagcagaucuaccacuacacugccaucuuccccaucuaugagaccccuuacaacuugcgguuucuccaggcuaagugcuucugcuccacccuccuccuccuccuccuccuccucggccauccucucucuccuuuucuccccaaaccuucagcuccaccuuccccucuuucuccacccaaccaccaacucuagccuuuauuuuauauacuaagugggaagcagguuuacaggggaucaccugacucacuacuuguucaaagccccucacaggagaacagaauuagcaucaaauauaauuagccccagggcuauccgcaacagauugugaguuugcuacuugccuaggcugcauagugagaccagacagugucucaacaaagcaaggaagcaacccacaccagucaagacaguggacacccagaguggaagggcugcugcugcucgcuugcugcuuccugugguccugcuuugggcauagaucuugcuaggugaacaucugcaauugcugccagccaaacagguuuuucucccacugcuagagaggccagauagcuuuuguucccucgaucccugccacgggagaaguugugauuuguguucugccuuauaaaaagcucagugucauaugaagcucuuuuuugcuggguagugguggcucaagccuuggaaggcagaggcagaggcagguggaucucugaguucuaggccagccugguccauagagcgaguuuuagguuagccagggauacagagagagaccuuauuuguguguagggagcccuuucuuauggggggugggggaugucaguaccuggccuucccaccaggaaaaugggucuggguuuuuauuccuuccaucagaauaaacuccaggaaaucaaagauggguaugugaaaaaugaaacuauuaaagaauuggaagaaaacauaggacagacuuuuaaaaauaauuuuuaagauggaguaugcauuuauaagaaacaaagauaacacaaaagcuacaaaaggaaagauugaauuugacugagauuuuaaagucauguaguuuguuugaaggcaagaggaaaauucauuuuuaguaccuuucuggcuacagggagcuauuuuuuucucgauaaaauuuguuugcuuccuuugaaaaaaauuaaaaguaaauggcagggggccuagagagcuggcucaaugagucagagcacugacugcucuuccagagguccugaguucaaaucccagcaaccacauggaggcucacaaccaucuguaaugggaucugaugcccuuuucuggugcuucugaagacagcuacaguguacucacauaaaauaaauaauucuuuaaaaaaaaaguuaacaagaaacugcauacaugcacacacaaacguauaacuacuuauaacagacaacauucuacuauuaauaaaaaagagcuguauggugaggaaggggaucaaguuuuaaaguacauggaaguugaaagaagcaauauaggugcugugugccauggcacuaacugagugugucugugugugugugugugugugugugugucucaaguggcagggugaggacagagugccuguuuguguguacagaggccagaggaggaccucagguguccugccccaucgcugccuccuuuauuccuuugagacggagucucucacugaagcuggagcuacgcugguggccagcaagcuucagagauccuccuuuguccccauacaaugcuggguaacaggcgggaugagugaccuauucccaccuucuuaggggguucuggaguccaaacucaggucuucguguuuguacagcaagugugucucaccugcuaagccaucucugcagccucacagaugccuuuaguuauauaaggaaauauucauguucacccuuuuugugaagugcaucucacuucugucuuuguacagaacuggcauaggccagauacugagaaaacauagcaagggcuggcuaguuacuagacuggaagccccaggcaggaauggcuacuuuuguaucuacagcucaugaaauaaagccuggcccaagguaggacucaguuacuauuuuguuaaauacaggaucaaaacuuuggagggaauuuugacagaacuuaucaaaaauuauauauguccguaguuuucacucaaagaugacagguaaaaauugauucuacagauaugagauguauauauuaaaauuuuguagggccuuuauuuuguuuguaauuuuuaaaacuuggaaagaucuccaguagugcggaccugguuaaauuauccuggaauauaugguacugcagaaaagaguaagcacacauucuaugucuuuauggacagagcagucucuuuaagauacgauuuucuguuuugaguuuuauuuuguguuuggagacaggaccuugcucuguagcucagggugaccuagaacuuggccaggugacccuggcuagcuacaacuuuaccuuccuuagucuccaaaguccugaggugugugacacaguaagcuuauacuguuguagagcagauguucuuuugugaaagaggcaaagggagaagacacucguguguuugccuggugugcagcaaaagcauccauagccgacugcuuacgucuugaagagaacuaagaauagaaggaaaauuugaaacggauuuggaaaauuugaaguuguacaaugcucauuugccaggcaugguagcacaggccuucgaucgcagcacugggaggcagaggcagguggaucuuugugaguuugaggacagccagggcuauagagagacccugugugagauacagagagacgagaagaggauggaucagcaugggggugugguggggggcaggggagaucauuuagcccaucaugugaaauuaauaaaaauauguagaagaagaaacuaaacaagaauugauuccuagcuugucagaguggaaagguuagucuuccugaauaacggaugccagaauccuuugcauuuacuagcuggaauagcacagaccaguucugugccagccacucacugagucaggaaaccagaggcagcgguggaguguagggcgacucauguuuaucugacuuugcauucugauacuugguuuuuugaugucauauuuugcuuuccagaucagaacuacaacaaugccaccgcgcuugugaucaccuuccccgugaauaauuacuacaaugacacagagaggcuccagagggccugggccugggagaaagagugagucacucauggggcuggaccugggcagcgcgggcacuuacuuggaccucacucugagagccggguuccaggauccuuugcacuugguaggagcuaugcuaagaaguccuugaacagauugccuagacgcagagggcuuaagcaggcacccgggaauacagaagcauugguaaagcguacaggccgcucgcucauucugaguaucccacuuaaggccucagcgauagacgguuuugauuauguuaggauaaaugcuguucccuuuagcugucuggugcaccccgucucagccucucacccacagcaguaggcagccacagaucuuuuuguccuguguuauuuuuaugcugugaauguuacgugaauaugguuauguauggggacguucauggcuggcuuccucugcuuaccauaauguguccagguugugacauguugacgcuguacuucucauuuuguccaaaugccccacugcauaucacucuaccucaucuuauccaugcauuugucauccacaucuaguugggcugccucugucuuuuggcuaucacagagaacggcucugugcgugucuguauacacguuuuuauuauccaugcauuugucauccacauacaguugggcugccucugucuuuuggcuaucacagagaacaacucugugcgugucuguauacacauuuuugccaggcaugguuucauuuccuuuggagauauauguaucuguaggaguagaaucacugcaucuuagaauaacucugcgcuaaccaucugaagaccugauugacaauuucccaccguguggugacaccagucugugcuugcgugcuuugucaggcaucccagcugucccgauggaugacacuggguuacuuacgcuuucuaauuuccuuuuuguguuuuagacaguccuguguggcagaggcuggccuugaacuucugauccucuaggauuacaggcgugcugccccaccauguccuguucaugcagugcuggggacagaaccuagggcuuugugcgugcucacucaguguuccacuaugggagcaacggccucagcccugggauuugcauuuucuugaugauuaaaaauuuuaagcuuuuuuuguuuuguuuuguuuguuuuuuaagacaggguuucucuguauagccuggcuguccuggagcucacuuuguagaccaggcuggccucgaacucagaaauccgccugccucugccucccgagugaagcaucuuuuuauaaacuuauucuccauauccuuugcccauuuuacuuggauaauuugugcuucuucuacuuagaguuauaaaauuuuguuacauaucccuuaucagauacaugacuucaagauuuuuuuccucuauuucuauggucccuccccuuuggguuguuuuucauuuugaaguucaguuuccauccuucuguugccuguguguuuggugggucuauggcuugacaggagcuuuagucuuguguauuauuuugagaauuuuauaauuuuaaguccucuuauuuuggccuuucaaagccaggccccagcacgauaggcaaacgcucugcuguggagcuggcugcccuugguuuuuugagaccagguccugccagccuuugucagguccaggucguucacuuuuguccauggugugagguaaggguccagcuucauucuuugcacacagcugcccaucuaugguuuuaaccauuugcuggaaagauuuuucccuguacuguugaguggucauaguguacuuaccagaagucaguccuucagacacaugugucuguaguucuuacuucugagcauuucugucuaucugcccuugugccggggucaugcuuucuggauuacugugauaauuuggaauuagaaaauauaauuuuacuuuguucgucucagcacuguuaugacugcuuggggcccuaauuguaugggaguuugagaagugccugaucauuuccuguaaagaaaucagacugugucugacagauuguguucgacuuagauguccaucuuuuuuguuccauguacauauauauauauauauauucauucacauguguuccauuucagucuaacauagcacugcaugccagugauccuaguacgcagagacugaggcaggaggaucacguuagcucagaaauucuagaccagcuugggcacauagugagacaggucucugaaaacaggcaggacagaacacaaugagccaauuuuaaacacguucuaaacuauaaacaauuucagggcuaggguuacagcuuugagguugagagcuugccuuagagggcccaggggcuuguguuuuauccccagcaccuccaucaaggguggggcagucagccugacuccugggcuggggccaagcaggauggccuuuguguccuaagugucgaaacacuccucuagccugucauuuuuaauuaaaaauauaaaaaugugcuuauucuuuagguuuauuaguuuugugaaaaacuacaagaauccaaaucugaccauuucuuucacugcugagcgaagcaucgaagaugagcucaaucgggaaaguaacagugacguguucaccgucaucaucagcuacgucgugauguuucuguacauuucccucgcccugggucacauccagagcugcagcaggcuccuggugagugugaggaggaugguagacaugacaggucuucucccuccccucagucagaccuuccucagcaaguuaccuccgaugugaucuuucugugacgucauguuaacucuauaacuuggcuguuuucugcgucugccuucuucacuuccuaagguugacuucacauaacucacauaagccacuuucuuuuaaguccucuguuuuguccauuccaggacccggaagugcaggaacuuuguugcuagggagaaaccugcaaguuucuucuguguucccucacacugugggcuguacauuuaacacuuucagagugagcccuguaacagggaggacagaaagcucucugaugaccugugauuuuugucccauaucagguggauucuaagaucucgcugggcauugcggggauccugaucgugcuaagcucgguggccugcucucugggcaucuucagcuacauggggaugccgcugacccucaucgucauugaggucaucccauuccuggugcuggcugucgggguggacaacaucuucauucuagugcagaccuaccagguaagcucggcaucuucucgggagcucggcgucugucuaagcacucagugacuaaguacuaagugacugcucagcacugccuaugagaacacagcuccguagccuuuccuccauguagccuuuccuccauguaggcuuuccuccauggcucuggggccucauugauuugaucugcacacuuggaaccgagaaucucagcccucucuuacuuggugaaguagcuacaaaaugagaacuugguauuagauuccauugucacauaugugcaguaggaauuaacacacuuaggggaauuacuucagguauuaaugguacuaaagugauuccuagcacacagcagacaaaacagauuugcugggcucugagaugcugcucaaggcagugucaaaauagucugccauuguagaauuuugucugaguuuuuugaaguccuugucugaguggaaacucaaugucauacaagugucauguguugguccaucuucuugcaacccauguaaaccaggcaguugucugauaacaugacucaguuuugcggaguuucgcaccuggugccccaucagugacccaucucaacuaacggcauuagucagcugcugcagcuaccagaagacagaaaccagauggcucugcuacugagaaauuuuaauaaugcauuuuuuuucuugaagagagaugagcgucuucaggaggaaacgcuggaucagcagcugggcaggauccuuggagaaguggccccgaccauguuccuuucauccuuuucugagaccucagcauuuuucuuugguaaauuuacuguagaucauaccaggccuguggcuugcugaggauuugauuaugccccgugucgcucccuuuugagagcuugcuucacccuuggagugucgcuugcuggaccgcagugucuuggcugacuggcagugucucuggagucagcuuuuacaucuucucugucccagcacaguacugaugcugggcuagaggauaacagacucgggcucuucuggcaucuccccucggcagugccaugcaagcuggcuugcaggaugcucugccuuuguuuuuacccaggcuuucucuccugagcauaaacucccaggggaaacaggcuuauuagugagcagagcuucuuggagugcuucaguacaagaagcuauaaugagcuagaacaaaacuccuugggguucuuuugugcaaagcugucgccgaaucaugguguuguccacccagucugucuccaaagugcagaaagagaaaaguggcuugauccuuguagaaacugaaugaggccagaaaugugugcggagaagacagucuucauugucugaggucacagcugcagugcccaugugaccgccagcucuuacacgggccguuguaggcagguucaggaggcuggcaccaugucacuucuuguuucucuggagcccacaggaaaccugugcucuuuauugugccuuugauagucacagaugcagggguggauaaccagcagcuccuacugugccucagggucaggguggcuuuacaaacuugggggcaggaugcuaccaucuaacgucccaucuauggagaggcugacguccuccuucguuugaucaugccacuggcccagcaucacaaagguuuuccucuaaaauaauauggugaaucuagauuuuuuuguuuaaacuuuauucuacuauuaaauacugacaacuuauuacaaauauuuuugauccuaaaauggaucaguauaaugugggucaagagauuagaaaaggcauaugugcacgggaacauaaccugagaccugugguccucuggguggcgugacagugcuuuucucucccuguaggggcgcuguccucgaugccagcugugcacaccuucucucuguuugcgggaauggccguccucauugacuuccuccuucagauuaccugcuuugugagccuguugggguuagauauuaagaggcaagagguaagggcaagggucuauuugagucuggagucuaggugaaguuggagauuguuuccaugcccucucuucaucucugugcucucagaaaaaccaucuggacauccugugcugugucagaggcgcugacgacggacaagguagccacgccuccgaaagcuaccuguuucgcuucuucaaaaacuacuuugccccccuucugcugaaggacuggcugaggccaauugugguacgaacuuuucugugcuuucucucucuacacagaugccuucugagaggccuggaagggcaauuccaacaacuguuaguacaguguaaaaacacaaaggcaaauccauacaauagcagggcccuuuucuagcgcaauuuuuaaaaacauuuuuuaguuuauguuuauuuauuuuucuuuuaugugccuugguguuuugucugcaugugugucuacagucaguacucucaucugcugagccaucucuccugcaccucuagugcaguuguaaaucagucagcaguggcaagaguuuugguaacauuggguuugaguugggguuuuuuguuuuguuuuugugcccaaacccuaaguuuuuguuuuaaaauagucguaguuuugcagaaugcugcaaagaaagccaguggaacccuguuucucucaccuaguaucuucuaguauauacugugucucacacacaaaauugaaauaauccauacauagaauuauaguuugguauuagaguuaggcuugugugcauguguuugcacucaugcacguugagugugcaagagugguaaagcccuguaggugcuguacuauaagucuggcuuuggacugggaguguaguucagugguagaguccuugccuagccuuacgcaaggcaugguguucaaccucuaaugcucccccaaaauaagucaauggagucaugucuuugggguguaagacuuuauuucucuucuucaguuuauuauuacauuagcaaucgucucgcgguuugcuuuuuuccagguagcgguguuugugggcguucugucauucaguguugcgguggugaacaaaguagacaucggguuggaucagucucucucaaugccaaacguaagcugcuuuuuuccguuaacucuguuagcugcuguugaguggaguuuucagagcauguguguagguguuaaugcuugcuucugaaugcaaaucaugcaaggggcaacagugaugagcugcaggacucugcuggacugggcugcuggccugugaacgcagaacucuucaugaugucaccuuaaaggggagcagccagucucgugagagcccucugucuggggcuuagcaacaggugcacucugggaccuuggaggagagaaccaugcgucaccuagguugauggcuugggcccuagcacgcucuauuauuagcaucucccauccagccguacuucacucuuuaaucuucuuuucaggauucguaugugauugacuauuucaaaucacucgcucaguaccugcacucgggcccacccguguacuuuguccuggaggaaggcuauaacuacaguucacgcaaagggcagaacauggugugcggcggcaugggcugugacaaugacucccuggugcagcagauauuuaacgcagcugagcuggacaccuaguuaguaucagagcugucugguccuuuguacuucuuuuucucuuuaauuagcgcuuaguuugagauauguucucccuguauggucuccaaguugaccaugaaccuggagugggcccuaucucagccuccugaguguuaggguuagacuaguucucgccaccugccuggguuugguccuuuucaaucgugaacagaaagguagaaggggcuagagugauggcucauugguuaagagcacugacugcucuuccaaagguccugaguucaauucccagcaaccacgugguggcucacagccaucuguauuaaauaaauaaauaaauaaauaaauaaauaaauaaauaaauaaauaaaucuuugagagagugggggaaggaaugaaagagagaagagaagagaaagagguagaaggaggaacucguggccaggaucaacucaggccugaaauuucucacuaaaaccagauuuucuuuugggaagguugcuuuuuguugucauuucaaaaaguguuagagcaaguuuccugugagcaaagugggcucauuggccauggguuuucuugaagguuuggucaguaguauagcagcagugucaaguggagggaaggaacuagaguuugcaagagucccaacaagccuguuacugucucuccucucuccagcacccgaguaggcuucgcccccucguccuggaucgaugacuacuuugacugggucucgccacagucguccugcugcagacucuacaacgucacucaccaguucugcaaugcuucugguacuucaucuccuuuucuagacuuucucauuucagaaaaaugguagcaucacuuagccauuucacuuucccuucguuugugcguguuugucaguguuggagccgucuccuucccucugucauuguccugugcucagucacacacgugacucucagagcugcgucaagcaaggagagcaccaagggcuugguccccggucagacuucucauuggugcagagcacacuuacugcuuuaagagugccaacugggcucuguucaaaggcaugcuuucuccggccgcuuaagugcuguguuugugaacacgugaguccugggcucuuagguguuccucaaaacagggcaccuacguccaggagggguuugcuauauauuauauagucugcuuaauaugaauggcuugagucugucgcuuauugagaccacauggagcugaagcauuugaggggggaaguguuuagucuuaaacacgcaguccuuaaguguuaagucuugacuguuuguuguuggugcuguuguaagucuugcugcccauuuuucuaaugaguggcucuccuuuuuuugucagugauggacccaaccuguguccgcugcagaccucugacuccagaggguaaacagaggccucaggggaaagaauucaugaaauuccugcccauguuccuuucugauaaccccaaccccaagugcggcaaaggguaagugcuggccagggagcgcugagcuaagcagucacugcugcuucgaccugaaccagaagcagaguuuggauugagcaggcuuguacggaaggguccucugccugcccugcccuaguccuguagggcagagacacgguuuaaagaaacuccuuaggcuucagaaggguuaauccucacugggcacucauucuccaugcuugcuuccuguccuuaccccaggcuauggauggaggcagauuucccaugcauaucacaaaggaguagagaguuaagaggcccagucagucccauugugccagcaggcuuagagacagcaucuuugcuuugauaagguuaccacaguuuaagguuuagguucuaaucccugcuaccccagccuugugagagggagaugagcuauuuaaauccccaaccugucacccauuggccacagggacagggacaggauaucuggcccagaaauaguaaagauaagagguacuuuguccuggacgaagcuuuauaggugaaaguugaauaccgcaugugugugauguaaccaacacggauaggcuugguuuuguaagaagccacauuugagccaggugguggugccaaaugccuuuaguccuagcacuagggaguuugaggacagccugaucuacagagugaguuccaggacagccagggauacacagaagcccugucuggaagagcagccagggggccuccgcugagcaguccugucacuugugagugccauauuuguucugaaacuucugcuaguucuaacaaagacugccucuaaaaauuaaggauagauauuagaacucucuuugcuuuuuaauauugagguuauucuggaauuuucuucaugaaagcaugggaguucuuuggaauuuaggaagcaaaagccaaagggaguauccacugggcagugccccugacugguuagcacucccaggcugaguguguggugguaugcccauucacagcggcgaaggugaggguccuuuacccggaggccugggcuugcguccaggcucuuguccuuucucaccuccugucacacagcaggaacaucucagcugugcaucauguuugguuuugaauggaaccagguagagaaacaauagcggccgugcacaagacaaagcacagcaguacgguaaggcagugccuuccuuccaggcccuucauaggaggccuccuucauccguguggccucugagccgugucacagugcucauauucugcccauagccuuccugacacccauaccucuuccucaggggacaugcugcuuacgguucagcuguuaacauugugggagaugacacuuacauuggggccacuuacuucaugaccuaccacaccauacuuaagaccuccgcugacuauacugaugccaugaagaaagcucggcuaauagccaguaacaucacggaaaccaugcguucuaaggggagugacuaccgcguauucccuuacaggugaagcagggagggcgggcucuagagggugggguagggacugcagauccuucgcucucauucugacagcugcuuuauccucaaccaagaguaguguaugaggggcauuugaggugagcgggccagugucuuuagccucugcugugcucugaggaccgaacacagacguugguguguugucccagcccagagagucacaggagagugagccuugcacaagggacaugcuggcagggaucccugcugccugcucauuccuugggacauugcucugauaacagacuucauuggcuggggucaggguuuguuuuguugcugcugcugcuuucucuguggaaagucaggaaggcagagcagucaaaugauugcucuucucaaacugugugguuaaauaauuccagccuuuacgugcagacuuccggaguagguguccuaguucuugggcaguucccagaacagaccugauugguuucuuucuuuuccaauaugggauuuuucuggaaguguuuauaagguagcaaaaauugagcuuacaaguaaaaagucuauguaagcacacauucgggguaacuaucaggcugucuuuggaugucaguggcuuugcucuaggugcauggugccugugugggguggugucugucagggugggauaaagagggaagaccugggaggacaagcucuaaccagauaacucuuccucucccaaccccccaguguguucuacgucuucuaugaacaguaccugaccauuauugaugacaccaucuuuaaccucagugugucucugggcuccauauuucuggugaccuuggugguucugggcugugagcuguggucugcggucaucauguguaucaccauagccaugauccuggucaacauguucggugucauguggcuguggggcaucagucugaaugcggucuccuuggucaacuuggugaugguuaguccuggccuucucucacuuugucccuagcuccugggagucuugcaugaauuguuccuuggauuucauguaaguccuaaaguggccugaaacacaggugccacuuagcuacauggcaaauaugaggucagccagaaguaaaugaaauugucugaaaacaaaaaaccauguagccuagugacauuaagacacucgaguuugacuuaccaggcuauucuguaggguuuccuguacaaguugcccagcaugcaaguacuuaggaaguauugaagauguagucaggccuggugaugcacaccuuuaguccuaguacucaggaggcagaggcagguggaguuugagaucagucuggucuacacagggaguuccagggcagccagggcuacagagaaaaauggaggggcagcuuaaaacauacuaaugggagguaaacccccagaacaccuucagcaugauggguuggcgguaugcugccucaguggggaaggauagguaaccuugggaaguuuccagaaauguccuuaaucaaaaccaagauacuguagaaaaguagaggccuggguagagccuucaggacccaggguuuccuccuguaguuuagaagaauuuucagcuggaaaagcucuguucuaauggggacgcuuuauuccagagcugcggcauuucuguggaguucugcagccauauaacgagagcauucaccaugaguaccaaaggaagccgagugagccgggcggaagaggcacuggcccacauggguaguucugugaguauuguuggccccagggugggugggcuugcaaugggaaugcuucuucagugacuggcuacuacgucucagaaaaaacacaaauucagaggauaaaacaauuuggauccauucugaaaauggcagcucccagcaaugacaaauucucacaugauucacuaaauagcuaugucugaaacagaccugaaaucccucagacuuguccuugcugugugaugucuuagacaaucagauggcuuaaucaggaaaguuaggaaacguuaggcuugagagagcuggaagccaguauuauggugacacaaggggucucgugaguuccagguggcacuggguugucuguaguuaaugcccugagguccugauccagcccuuuauccugcuguuccccaucacucaguccgccacucuggaaaguaucagugaaaacguaagccucugcuuuguaacaacuccaggccagcaagauagccagcaugucugaggggagcuugcucggcaagccugguuuugauccccaaacccacaugaucgauagaagagaagagaugauuguauagaguugaccucugaccucaauaugugcugcagaaacacacacacacaaagucuucuaaguuuccaucuaagaaucugccuugguucagacugcuuacuuguuuguuuguuuguuuauguauuuugguuuuucgagacaggguuucucuguagcccuggcuguucuggaacucacuuuguagaccaggcuggccuugaacucagaaauccgucugccucugccucccaaugcuuauuuauuuuuuaaagauuuauuuauuuacuauuauauguaaguacacgguagcugucuucauaagagagaagagggcgucagaucucauuacggaugguugugagccaccaugugguugcugggauuugaacucaggaccuuuggaagaacaguccgugcucuuaaccacugagccaucucaccagccccagacugcuugauuuuaacaaaacuagccaagacaguuuucugagaaaaugcauggcucugaaauuuuccuuccuuccugggcugggagauggcuugaguccccagcacucacuuaagaugggcacugcaguaaauaucucugacaccggugcugugaauaaguuggguagauccuguagcucagacaugagccagcccguccagccauaugagcuccaauuucagagagacugucucaaagcauaaaguggggaguugaggaagacauccgaaguugaccucugacagccgcacauuugcacucaaacuuccuuggauucaugcaugcucauaaagcagcaggccagacaguuuggguacggggcaggaugugagugguuggacacucacugcugaggaagguuugcguggcaauagaugcuugcuuacuuauaauaggcuaacagcucacuucugccucuccagguauucaguggaaucacacuuacgaaauuuggagggaucgugguguuagccuuugccaaaucucaaauuuuugagauauuuuacuucaggauguacuuagccauggucuuacucggagccacucauggacuaauauuucuucccgucuuacucaguuacauagguaagagcauuucguucuucucacgggcgugggaggaacgacauuuacuuaacagggcauggugucacaagccugaaaucccagggaguggaagcaggauggauccaaaguucaaggucauuaacagugaguuuaaccuaagcuaaaagacccuggcucaaagaaaaauuuaaacuuggacuuucuaaaguauuugaguuuguacugacagcuagcucauacugcauuaaaaccauagaaggaaacaguaaaaccucccccagggcgucucgguuggccagggcauuuccuuaggcauccuggaggccagggcucacuccaccucauacagugacgcccaguugaaaagguaacaggaugagucugccucacagcuuuguuacuaagucacuggagagacagcucaucgguuaagaaagacacuagcugcucuuccagaggacccaaguucaguccccagcacccccauggcagcucacaacuauaacuccagucagggaaucugacagccucuucuggccucuggagcgcugcauagaugcuguaccaugcagcaucuucuggcuaggcaugcaugcagacaaaacacccacacacaaaaauaaaauagaaaaaagcaacaagagcauggcugguuuccaugccuaggagguuacuuacgccuucucuugucucacacagggccgucggugaauaaagcuaaaagacacaccacuuacgagcgcuacagagggacagagagagaacggcuccucaauuuuuagccuuguagcaggcuuuggugacuguguuuauggauaggucaaguuuacugcaagacagcugcgcugucaagacugagcuggcuucaggcuguguccgagcugugucacaugcagcucuacccacgcuuuuaaacucaggaaugcacaccuaacuugugaagcaguauuaauggaucugaaagcaacaaucgccagccccuacugucguaccaguagaaaccucaucuuggguacaaggaaggauaguucugucacuuuaacuuguuucaaugccuacuuuuaauggagguuauuaaacacuuuaaccucccuucuagcccaccaccaaccagagauagugggaaagaaaggauacaggggaaguggaccuguuuagaaaugguucuuuggagcagauccugucugcauuaucaggaaaccagcaauucaguucacgggucagcaguggcagcucgacccacucgcaaacacuucacggauacaccagcaguguugggauaggagcagccaggccucagcaggagggaccagggccgacaggaacaccagagguucuuggcuguuccucuaucagcgaagacuggagaccaacaaacauuacacagcuagcucuauauucucucuguggagucccaacacauggagcucaacuacacaauauaaggcagaccaaccaauacaugccugucauucacguguccuuucaugugcuugcuuuagggaaacaguccuucacaagucugccuuucaccugugucugcuucagcaaaauguucuuucacauuugccccagcaaaaccccaucuaacacaacugacuuuccaaagaacccuuaaguuuccauuucccaguggcaauaacugugaccugaucccuaccccacaugcugucuccuuuucuuugggaguuagcaacauuugaggauguuguagguacuuuauuacauuuuuuuguaguuuaaagagcuuuauuaaugcaauaaauuaacuuuguacauuuuuauauuaaaaaaaaaaaaagacuauuaagggacuucagaauguuguaggccucauuagagcuuguucuccaaaaaccugcuugaaaaaggcaacguguucuucacagugcucuccuguaaggacaacgcggcucagucagcagcugguuauggcccgggaagacaggaugcagacaacgcucauggguuuuaacuuauuuuucuuuaauaaaauaccuccuccuccauuuugaggucuuuuauugcagagcucacaccuucagcagccagagcaucccugaccugucugucacucauaccgucugugcuguguguguauacacagcauaggcucauucucucgaguccugucuuaucacuacuugcuuaaaacugaagcauucaaagcccaagccauuucaaaugcuucuccaccaugugcacuccuguucugauucuauagagagaucccaaagucagauauaagcuaugcccuucagcccugaacuugaugaaagcugccauugucuguggccacccugggcauucccuuaccuggugugaaguuaggguucccucgcaggcgcugguuccgcuguucaaagaagcggaauaugguauagaagagcaugacaucgucggucugccucgcagcaucuaagaauuugcgagcagaaauguugucauggccaccaaugccccggaugaaccucagggcagccaacaccugguguuuagacagaagaacuucuacuaucucaucauuugcuguugaaagucucug

SEQ ID NO: 8821 - RNA, 4910 nt, Mus musculus
caucaccaggccugacuacaucuucaauacuuccuaaguacuugcaugcugggcaacuuguacaggaaacccuacagaauagccugguaagucaaacucgagugucuuaaugucacuaggcuacaugguuuuuuguuuucagacaauuucauuuacuucuggcugaccucauauuugccauguagcuaaguggcaccuguguuucaggccacuuuaggacuuacaugaaauccaaggaacaauucaugcaagacucccaggagcuagggacaaagugagagaaggccaggacuaaccaucaccaaguugaccaaggagaccgcauucagacugaugccccacagccacaugacaccgaacauguugaccaggaucauggcuauggugauacacaugaugaccgcagaccacagcucacagcccagaaccaccaaggucaccagaaauauggagcccagagacacacugagguuaaagauggugucaucaauaauggucagguacuguucauagaagacguagaacacacugggggguugggagaggaagaguuaucugguuagagcuuguccucccaggucuucccucuuuaucccacccugacagacaccaccccacacaggcaccaugcaccuagagcaaagccacugacauccaaagacagccugauaguuaccccgaaugugugcuuacauagacuuuuuacuuguaagcucaauuuuugcuaccuuauaaacacuuccagaaaaaucccauauuggaaaagaaagaaaccaaucaggucuguucugggaacugcccaagaacuaggacaccuacuccggaagucugcacguaaaggcuggaauuauuuaaccacacaguuugagaagagcaaucauuugacugcucugccuuccugacuuuccacagagaaagcagcagcagcaacaaaacaaacccugaccccagccaaugaagucuguuaucagagcaaugucccaaggaaugagcaggcagcagggaucccugccagcaugucccuugugcaaggcucacucuccugugacucucugggcugggacaacacaccaacgucuguguucgguccucagagcacagcagaggcuaaagacacuggcccgcucaccucaaaugccccucauacacuacucuugguugaggauaaagcagcugucagaaugagagcgaaggaucugcagucccuaccccacccucuagagcccgcccucccugcuucaccuguaagggaauacgcgguagucacuccccuuagaacgcaugguuuccgugauguuacuggcuauuagccgagcuuucuucauggcaucaguauagucagcggaggucuuaaguauggugugguaggucaugaaguaaguggccccaauguaagugucaucucccacaauguuaacagcugaaccguaagcagcauguccccugaggaagagguaugggugucaggaaggcuaugggcagaauaugagcacugugacacggcucagaggccacacggaugaaggaggccuccuaugaagggccuggaaggaaggcacugccuuaccguacugcugugcuuugucuugugcacggccgcuauuguuucucuaccugguuccauucaaaaccaaacaugaugcacagcugagauguuccugcugugugacaggaggugagaaaggacaagagccuggacgcaagcccaggccuccggguaaaggacccucaccuucgccgcugugaaugggcauaccaccacacacucagccugggagugcuaaccagucaggggcacugcccaguggauacucccuuuggcuuuugcuuccuaaauuccaaagaacucccaugcuuucaugaagaaaauuccagaauaaccucaauauuaaaaagcaaagagaguucuaauaucuauccuuaauuuuuagaggcagucuuuguuagaacuagcagaaguuucagaacaaauauggcacucacaagugacaggacugcucagcggaggcccccuggcugcucuuccagacagggcuucuguguaucccuggcuguccuggaacucacucuguagaucaggcuguccucaaacucccuagugcuaggacuaaaggcauuuggcaccaccaccuggcucaaauguggcuucuuacaaaaccaagccuauccguguugguuacaucacacacaugcgguauucaacuuucaccuauaaagcuucguccaggacaaaguaccucuuaucuuuacuauuucugggccagauauccugucccugucccuguggccaaugggugacagguuggggauuuaaauagcucaucucccucucacaaggcugggguagcagggauuagaaccuaaaccuuaaacugugguaaccuuaucaaagcaaagaugcugucucuaagccugcuggcacaaugggacugacugggccucuuaacucucuacuccuuugugauaugcaugggaaaucugccuccauccauagccugggguaaggacaggaagcaagcauggagaaugagugcccagugaggauuaacccuucugaagccuaaggaguuucuuuaaaccgugucucugcccuacaggacuagggcagggcaggcagaggacccuuccguacaagccugcucaauccaaacucugcuucugguucaggucgaagcagcagugacugcuuagcucagcgcucccuggccagcacuuacccuuugccgcacuugggguugggguuaucagaaaggaacaugggcaggaauuucaugaauucuuuccccugaggccucuguuuacccucuggagucagaggucugcagcggacacagguuggguccaucacugacaaaaaaaggagagccacucauuagaaaaaugggcagcaagacuuacaacagcaccaacaacaaacagucaagacuuaacacuuaaggacugcguguuuaagacuaaacacuuccccccucaaaugcuucagcuccauguggucucaauaagcgacagacucaagccauucauauuaagcagacuauauaauauauagcaaaccccuccuggacguaggugcccuguuuugaggaacaccuaagagcccaggacucacguguucacaaacacagcacuuaagcggccggagaaagcaugccuuugaacagagcccaguuggcacucuuaaagcaguaagugugcucugcaccaaugagaagucugaccggggaccaagcccuuggugcucuccuugcuugacgcagcucugagagucacgugugugacugagcacaggacaaugacagagggaaggagacggcuccaacacugacaaacacgcacaaacgaagggaaagugaaauggcuaagugaugcuaccauuuuucugaaaugagaaagucuagaaaaggagaugaaguaccagaagcauugcagaacuggugagugacguuguagagucugcagcaggacgacuguggcgagacccagucaaaguagucaucgauccaggacgagggggcgaagccuacucgggugcuggagagaggagagacaguaacaggcuuguugggacucuugcaaacucuaguuccuucccuccacuugacacugcugcuauacuacugaccaaaccuucaagaaaacccauggccaaugagcccacuuugcucacaggaaacuugcucuaacacuuuuugaaaugacaacaaaaagcaaccuucccaaaagaaaaucugguuuuagugagaaauuucaggccugaguugauccuggccacgaguuccuccuucuaccucuuucucuucucuucucucuuucauuccuucccccacucucucaaagauuuauuuauuuauuuauuuauuuauuuauuuauuuauuuauuuauuuaauacagauggcugugagccaccacgugguugcugggaauugaacucaggaccuuuggaagagcagucagugcucuuaaccaaugagccaucacucuagccccuucuaccuuucuguucacgauugaaaaggaccaaacccaggcagguggcgagaacuagucuaacccuaacacucaggaggcugagauagggcccacuccagguucauggucaacuuggagaccauacagggagaacauaucucaaacuaagcgcuaauuaaagagaaaaagaaguacaaaggaccagacagcucugauacuaacuagguguccagcucagcugcguuaaauaucugcugcaccagggagucauugucacagcccaugccgccgcacaccauguucugcccuuugcgugaacuguaguuauagccuuccuccaggacaaaguacacgggugggcccgagugcagguacugagcgagugauuugaaauagucaaucacauacgaauccugaaaagaagauuaaagagugaaguacggcuggaugggagaugcuaauaauagagcgugcuagggcccaagccaucaaccuaggugacgcaugguucucuccuccaaggucccagagugcaccuguugcuaagccccagacagagggcucucacgagacuggcugcuccccuuuaaggugacaucaugaagaguucugcguucacaggccagcagcccaguccagcagaguccugcagcucaucacuguugccccuugcaugauuugcauucagaagcaagcauuaacaccuacacacaugcucugaaaacuccacucaacagcagcuaacagaguuaacggaaaaaagcagcuuacguuuggcauugagagagacugauccaacccgaugucuacuuuguucaccaccgcaacacugaaugacagaacgcccacaaacaccgcuaccuggaaaaaagcaaaccgcgagacgauugcuaauguaauaauaaacugaagaagagaaauaaagucuuacaccccaaag

SEQ ID NO: 8822 - RNA, 4910 nt, Mus musculus
cuuugggguguaagacuuuauuucucuucuucaguuuauuauuacauuagcaaucgucucgcgguuugcuuuuuuccagguagcgguguuugugggcguucugucauucaguguugcgguggugaacaaaguagacaucggguuggaucagucucucucaaugccaaacguaagcugcuuuuuuccguuaacucuguuagcugcuguugaguggaguuuucagagcauguguguagguguuaaugcuugcuucugaaugcaaaucaugcaaggggcaacagugaugagcugcaggacucugcuggacugggcugcuggccugugaacgcagaacucuucaugaugucaccuuaaaggggagcagccagucucgugagagcccucugucuggggcuuagcaacaggugcacucugggaccuuggaggagagaaccaugcgucaccuagguugauggcuugggcccuagcacgcucuauuauuagcaucucccauccagccguacuucacucuuuaaucuucuuuucaggauucguaugugauugacuauuucaaaucacucgcucaguaccugcacucgggcccacccguguacuuuguccuggaggaaggcuauaacuacaguucacgcaaagggcagaacauggugugcggcggcaugggcugugacaaugacucccuggugcagcagauauuuaacgcagcugagcuggacaccuaguuaguaucagagcugucugguccuuuguacuucuuuuucucuuuaauuagcgcuuaguuugagauauguucucccuguauggucuccaaguugaccaugaaccuggagugggcccuaucucagccuccugaguguuaggguuagacuaguucucgccaccugccuggguuugguccuuuucaaucgugaacagaaagguagaaggggcuagagugauggcucauugguuaagagcacugacugcucuuccaaagguccugaguucaauucccagcaaccacgugguggcucacagccaucuguauuaaauaaauaaauaaauaaauaaauaaauaaauaaauaaauaaauaaaucuuugagagagugggggaaggaaugaaagagagaagagaagagaaagagguagaaggaggaacucguggccaggaucaacucaggccugaaauuucucacuaaaaccagauuuucuuuugggaagguugcuuuuuguugucauuucaaaaaguguuagagcaaguuuccugugagcaaagugggcucauuggccauggguuuucuugaagguuuggucaguaguauagcagcagugucaaguggagggaaggaacuagaguuugcaagagucccaacaagccuguuacugucucuccucucuccagcacccgaguaggcuucgcccccucguccuggaucgaugacuacuuugacugggucucgccacagucguccugcugcagacucuacaacgucacucaccaguucugcaaugcuucugguacuucaucuccuuuucuagacuuucucauuucagaaaaaugguagcaucacuuagccauuucacuuucccuucguuugugcguguuugucaguguuggagccgucuccuucccucugucauuguccugugcucagucacacacgugacucucagagcugcgucaagcaaggagagcaccaagggcuugguccccggucagacuucucauuggugcagagcacacuuacugcuuuaagagugccaacugggcucuguucaaaggcaugcuuucuccggccgcuuaagugcuguguuugugaacacgugaguccugggcucuuagguguuccucaaaacagggcaccuacguccaggagggguuugcuauauauuauauagucugcuuaauaugaauggcuugagucugucgcuuauugagaccacauggagcugaagcauuugaggggggaaguguuuagucuuaaacacgcaguccuuaaguguuaagucuugacuguuuguuguuggugcuguuguaagucuugcugcccauuuuucuaaugaguggcucuccuuuuuuugucagugauggacccaaccuguguccgcugcagaccucugacuccagaggguaaacagaggccucaggggaaagaauucaugaaauuccugcccauguuccuuucugauaaccccaaccccaagugcggcaaaggguaagugcuggccagggagcgcugagcuaagcagucacugcugcuucgaccugaaccagaagcagaguuuggauugagcaggcuuguacggaaggguccucugccugcccugcccuaguccuguagggcagagacacgguuuaaagaaacuccuuaggcuucagaaggguuaauccucacugggcacucauucuccaugcuugcuuccuguccuuaccccaggcuauggauggaggcagauuucccaugcauaucacaaaggaguagagaguuaagaggcccagucagucccauugugccagcaggcuuagagacagcaucuuugcuuugauaagguuaccacaguuuaagguuuagguucuaaucccugcuaccccagccuugugagagggagaugagcuauuuaaauccccaaccugucacccauuggccacagggacagggacaggauaucuggcccagaaauaguaaagauaagagguacuuuguccuggacgaagcuuuauaggugaaaguugaauaccgcaugugugugauguaaccaacacggauaggcuugguuuuguaagaagccacauuugagccaggugguggugccaaaugccuuuaguccuagcacuagggaguuugaggacagccugaucuacagagugaguuccaggacagccagggauacacagaagcccugucuggaagagcagccagggggccuccgcugagcaguccugucacuugugagugccauauuuguucugaaacuucugcuaguucuaacaaagacugccucuaaaaauuaaggauagauauuagaacucucuuugcuuuuuaauauugagguuauucuggaauuuucuucaugaaagcaugggaguucuuuggaauuuaggaagcaaaagccaaagggaguauccacugggcagugccccugacugguuagcacucccaggcugaguguguggugguaugcccauucacagcggcgaaggugaggguccuuuacccggaggccugggcuugcguccaggcucuuguccuuucucaccuccugucacacagcaggaacaucucagcugugcaucauguuugguuuugaauggaaccagguagagaaacaauagcggccgugcacaagacaaagcacagcaguacgguaaggcagugccuuccuuccaggcccuucauaggaggccuccuucauccguguggccucugagccgugucacagugcucauauucugcccauagccuuccugacacccauaccucuuccucaggggacaugcugcuuacgguucagcuguuaacauugugggagaugacacuuacauuggggccacuuacuucaugaccuaccacaccauacuuaagaccuccgcugacuauacugaugccaugaagaaagcucggcuaauagccaguaacaucacggaaaccaugcguucuaaggggagugacuaccgcguauucccuuacaggugaagcagggagggcgggcucuagagggugggguagggacugcagauccuucgcucucauucugacagcugcuuuauccucaaccaagaguaguguaugaggggcauuugaggugagcgggccagugucuuuagccucugcugugcucugaggaccgaacacagacguugguguguugucccagcccagagagucacaggagagugagccuugcacaagggacaugcuggcagggaucccugcugccugcucauuccuugggacauugcucugauaacagacuucauuggcuggggucaggguuuguuuuguugcugcugcugcuuucucuguggaaagucaggaaggcagagcagucaaaugauugcucuucucaaacugugugguuaaauaauuccagccuuuacgugcagacuuccggaguagguguccuaguucuugggcaguucccagaacagaccugauugguuucuuucuuuuccaauaugggauuuuucuggaaguguuuauaagguagcaaaaauugagcuuacaaguaaaaagucuauguaagcacacauucgggguaacuaucaggcugucuuuggaugucaguggcuuugcucuaggugcauggugccugugugggguggugucugucagggugggauaaagagggaagaccugggaggacaagcucuaaccagauaacucuuccucucccaaccccccaguguguucuacgucuucuaugaacaguaccugaccauuauugaugacaccaucuuuaaccucagugugucucugggcuccauauuucuggugaccuuggugguucugggcugugagcuguggucugcggucaucauguguaucaccauagccaugauccuggucaacauguucggugucauguggcuguggggcaucagucugaaugcggucuccuuggucaacuuggugaugguuaguccuggccuucucucacuuugucccuagcuccugggagucuugcaugaauuguuccuuggauuucauguaaguccuaaaguggccugaaacacaggugccacuuagcuacauggcaaauaugaggucagccagaaguaaaugaaauugucugaaaacaaaaaaccauguagccuagugacauuaagacacucgaguuugacuuaccaggcuauucuguaggguuuccuguacaaguugcccagcaugcaaguacuuaggaaguauugaagauguagucaggccuggugaug

SEQ ID NO: 8823 - RNA, 2054 nt, Mus musculus
caggcucgcugcugccucuaaugcaucagccagcccccugggccaaugcgcggugggagaccaggcgacagcuugaaagcaguggagaaauacuggacaccccucggagggcggaaagugaggccguacugcggucauagggagggaagggucagcgcggcgggggaugggguggggaggaggauggggccaaggcgcagggcaaaggcugcagauaaagcccugggaagcgaaggggagcagggaagagagcagccacaggucgcgaagugaccacccggugcgcgcaggcggggcagagagucaggggagccggagucaccuguauuguuugaaaagcugauccgacucccugaagccguuguugagaagcauauugaugccagccaaggccagcuccgcguccugcaggggcgccgcugcggcguccgggucgccguccucccuccgccgcggccacugcuccuccgagccggccaugggcacacgaggccucgagugggccgaggcgaggugccggaggaggcggcugcagcggcccgcgcucccggagcccggcuccgaccugcggggagcagagcacagcagccggcagggggcggggauggacgcgaaggcggagccgccgccgggcugcggcgcggggaacgugggcgcccggccgcccccacccgccgcccgggauuacucagcagccggcucgcggccaccccagccguuucgggugucugcgcccgcuucgauccaggcgucccgagcuaccuccgcuuccugcagccccuccaggccccggaaccggccccagaggcccccaggcuagcgcccaggcugaggacacccacgggaggccccaauggccaacccuccaggacaggaugaacccuggacgcacugggaggggcaggagagcuuaacucggggucagagaacuccugguuugcugcgacggagcgcggcuggacacccagguggcuuuggcuugggccacgcgugucagaacccuuaggaguccagugccagucacucccaacuucguccggaucccagccggcccccaccaggcccaaagcagccaauccucaagcaguugggcggcaggggcguggccuccagaaccuggaccgcuugcuagggcccaccaccaccauuagcuccagagagagauagggauccauaugccacguagcuaaauguuuaaaagcuaagaaguaagcuguuaagguguguucucuuagcacccugacgacuauacucccaugccagugaaacagaaaagcugugguuuuuauauaagcaaaugucagcaaaacaccaagggugaugauuuaaucagaguuagagucucucuucugauggugagcuggugguuucugcgugcaccauuuagacacacacaaaaaaaaucgguuuauggguuuuaaaaauguucucuccuuuacuuuugcagccguuaaacaauacuguuacaacuaagauuauguuaaugccgaaauggacuauauucccugccaaagagcucauucacuuuaaauagaagaaacuucccugcugaagggcucaaagccauucauacucagaucuagacaucaccccaaauauaacauccaacauuauagugagcuaaguacaaaugcacauaaacgcacuguaauuuaaacucaucacaaauguuagcuuuguuaucuguaccauuccuuacaagaccaucuaacuccuaucucaugcucauccaugacacagaaaaguaaugccauaguggucagugcucagcugcagccuucucuuucuccuuuuuuacaggauucuucugcucaggcuggccugcaacucuugggcucagucacccugacugaccucccaccuagcuaggacaacaggcccaugccucaaacacaauguaccauccaacuguuguaagaucaugccaauucuuugagacuuugcucuguagccccaacuaguccugaauucacugcagucucuugcuucggccucuggguuguguaauugcacauucagauacuucugcugggcuaacaaauuccuaacaagaa

SEQ ID NO: 8824 - RNA, 2860 nt, Mus musculus
ucaccaagucugagacuuuaucaaaaagcuagaaauuuguuucauaaacuauauauuucuauguuuuucucauccgaguaugguucuggaaguauuauagagauacaugagagccauccuuggcauuuuccuugcauuaugcuccugagggcuuaaucaaaccaguuuuuccaagucaggaaccugccuguuugaaguugcuagaagcucacuuauaaacaucacauacuuucauguuaagccuccugcagcugagugacccagauguauggcuuggugaugguaguguaauggcagaauuugugcuccucuggauagaacacugauacuguugaagaaaaauugugguuguguggguuuguuacucuuucaaggcauggccucugauguucauuuaacuuccuaugcuuuccauaugcuucagucauuuugugucccuuggcuggaguuugcugauguugaugacaaguccucuaguucccaccccuucuagccaucuccucuucuaggaaaucaguguacauucucagucuguccugugcccucaccucaguguguguguguguguguguguguguguguguguguguacucacgugugcacucaugugcucccuuuuccucuugcuuaggaagcuccucuuucucugcuucugagccguucuuuccuuucacaucuuuccuuacuuguagcucuuguuguguuuauacaucucuuuccaguuugauuccugaaacuaugguacuaugcccugcggcgucuucauuccaccaguccacagacgcgguucuuagcagugcuucgcguuguucagugagaggccguguuuguuguugcuauuugggauaggcguuuauguaguccagcuggcaucaaacucaugugcauccaaggcuaaccuugaacucuugacccuccugcuucugccuuccuagugcugggauuacagaugugugcacuaaaccugucaagagaacacuuccaaaguaucuguuugcuuucugaaggauucuaccuuuggcugggccauccacagugcuucucuucuguccucuguggcugcccugucccuugcuuauucaccuccuaagcauugcuucuucuaccaccgugccuuaaauguuaccuguccugugggugguccuccuggagcauucuuccuggacucuuguccccacuccuuucaguagaaguacacaguuauuacauacugaccuuagacauuuccugagcugucaguuaguaugccagcugcuuuuuggacacuguauguuucuguaagaguuauuucaaaagcaguuuugucuaaaauugaauucuccaauucauagaguaccacugaaguugagaccaugauuuuuaucucuaauugaccauuuuucuucaccccaguucugacuaaauucugccagucugacaucauuucccuccaguccccucuccauccuaacacacauucucccuggcugcugugguaaagcucccaggauagcuguaaggaggggugcaguguccuaaucccagguuccacccuucagaacuagguuaggugcuccuccugucccggauuucuuguugccacauuguaucauugcauacagcacauccagagcccuuuaaaggcgcaggcucuucauugugucuguagcaugggcuuagcauguuguagauuguuaguggauaucucagugcaggaguggugacuguagaaaagaaaaaccccagcuuuugagcggucuaauucuauacugccguuucugcuuuacgcaaauguauaccuucuugggagcuccacuuccaaaucugaaacccgagaugcgauugagcagggucacgugaagugaucagugcagggccccucccccaucccaguguccuuguaaacugccuucuaaaacaaggucccuuuguuguuuaucucugcugggaggacccucaguaaauugaauucuuuuuuuucuaaaucuuugggccugaaggagaaauuuuguagccagggcuuccucuucauggccaaguguucuuaguuaucaguuuagaauuuucaaagacacugaaacuuuuccagacauggauuccaaguuuucugacugagcggugugugcccuacaaauagacugaccacggaucuaagggaacacgagguacuccgggacuuguuaaauaaacaccaguuuuguuuaucacagcccugcucaguaaaguccucuuccaggugagaacagggguguacauuuuagaaguuaguuucuuuuugaaucuccaccagagccuucgucauaguuuuccagcaguaucaugagcaugucagaaguguguguuugucuggggaaggucugccucugcaguccugcucuacccuucaaggcuggucagaaugggaagccacgcuucuaaguggucagcagagcacagccccagcucauacucacugggguguaaguacgaacacucgcucugcuuuagggauagugagcccuucugcagcagccaagacugcaagcaugccuuuugccuuagugaguuuccucagcagcagcgugcuggccguuuaaaaguugucaaggagagggcuugagcacaaggccacucuaggaccuugcaggagccugugugugccgcucaugcuacagccaggaucccuuacuucuccuuggagaaucucagcuuagaggcugugggcaggcucucccgggcggcggucccuaccugagcuucccggagccgacacaccagggaagaggaggagggacugcgaccacaaggaagggaaccgccugcuuucggcugcaggccacacugcccgcccgcucgcucgcucggcucagcucccggcggcugggacuccgcgggcgggug

SEQ ID NO: 8825 - RNA, 37105 nt, Mus musculus
agaaguuaagccauagaagaauauuuauugauaugggaaaauguuaacaauauacuucuauaugaaauauguaggauacaaaacaguauauacgguuuaauaccauuuuuacggaaagaaaaauagccauauauacaaaaucaugcauaauaaaaaauaaaaacuguauacaccauuuauggucaucucuuuaguggacuggaugugauuacaauucacugaagugauuacaguaucacucaccugcccuguaaacaguaucugcuuuaucuguccuguaucagugcuuccuuccaacagccugucucugacagacaccucacuagcagcuucugcucugcccgucuacguggaugccauuugcucauagauacuggcauguggagaacaugucaacuaauaaaauauagagaaggccacagcagacgccuggcuuuacaaaguuauaauugggagaacuagaaaauucucuacauaugauuuucucuacuucaauagagaaaacuaugcuaucauuacuuugcacuaauggcaugugaaauacgcaauuucaggaguuagaagugaggaacuggggucuccccucccaccugcagcgaagguuaaggagcucaacccacaaaaugagguuagcaaucuuguaaaauggggaaacguaauuuuuaagugaaggaaaaugagaucagagauauaaaaaauugucuuuucuucuguaaacacuaauacauuuuagacaaaacuccaggaaagaaauucuaauccagugugcuaggaaaauauuuuaugcuccuuuuuucugcagcauaaaauucuuaguguuuuaaucucuuuucacaggucugaaaugucaagauuauaucauuaucuuuagcaaauacugucuaagcucuguaacaauuaauacauaggauauacuuagcauuucauggaaacagagguaaguguuccaaacacacauauaggucauccuauaacucuugauaauuuacaacauuaaauaauguugaaaauaagacuucugucucagaacccacucuaguguaaagcuggcuacuggauuccuauuuaaaauaccaagugaggauguggaucuuucaagcuuacaaacuaagagaaaaaaccugcacaaccucagacgcugucuaugugugcuccagcacucucccaaggcugccucuuccucgggaggggaaucaaacuagucugcgauccguugaucaauuuagucauuguuggcauuauuucugaaagauaacagguacagcuuaccuacacaaagggaauuuuugucuuauuucuuacaaguaauaugcauguaaaaaauaaauuaaacacguguuuaaaaaaggagauuagacaaaaacuuccgcagggaaagagguuuuuuuuuuaaucuaaucaaaagauuugucccucuaucucuccucaaaaaaaaaaaaaaaaaaaaaaucacagaacuaaaaaaaaaaaaaaucuggccagaguucaaauggcaaauguauaucaaacuggugcagugggcagccugcuccucugguguccugcugccucuaucucguucugcaagugaguugaccagagcacagggaagagcacagggaagugcuuccaggucguucagagacaccggaauguuaccucaacacacguaagggaugggacggaaggacuacugggaaggacuacugagacugaauggucacugugugucacuacaggaaucaaacaacaaaaggcaacaacuaagaaauaguaacuuuuugaaauuccacaaucaccaauuugaaacaacugaggaguaacacuuggacuagcaaauguguaaacuaucacuuuggcacaugaucacagaugaauacucggguuuucacguaaacuaucacuccaugaugaauacuauggaaggaagcgugacucacuugugaaaucacaagagaaagacuccccaagaccuccgucuuccaugcgcccccacucugaaagcaacugggagcugaaaaagcaaugcucacuuaacagcauggcaauuucuaucgcaagacauguggccuuucuauuccucuggagacacgucuucccugccuaacaaaggcacgcgacaauacugaaauugacauuuagcucaggaaaacacugugcaugugucacuuccuaguauuauaugaaaugguaaguaagcucacagcuguucuuccaaauaaaugugaaacacaugugaauauguucuagauucucuaguucuggcaaaugguggaaccagaggaggaaacacaaugcugguggaaccaugaugaacuggcugacuugagcugucagugugcuaucuuaauguacucaugaccacugggaacguguccacaguggcugggaaguuaaccucucacacagguucacgucuuaaugaucauucuucuucuugucuuucuucaccuucuuuuuccccaaauucuuaguugacucguccuggaagagaaagcauucaaugaagcaccacagccauguacaagaccccagagcaguuccacagauggucuacacugggaagucugugugcuuuccaauaucagugccacucggacauaguguacuauaauacuucaugacagucaaggcuagucaagagaaacauuucacccaguauauuuaugcuugaaaaaaaucucaguuacuauuucauuucuccccauucucccaaguaaugcaauaaagccuaaauaaauaguuaugcacauauguaaggcauaagcaaaaaacccucaaaauauaaaaaccacaucuacagaugugcaaggaaaacacagauaguccagugcugauggaaggccaggccucugccggagccuccagaccauauacccagugugacagcucaugucucucugggccucagcuggcuuuucuaauagaaacccuacagaccuguaaacucacacugucccauugugugacugaggccuauguccauggcuuccuaguccacaccucaguaccacauccucccacugccgcccucucgcucgcccuucucucugcagucucggcgagugcacccggucacugcagcaucaagacucacaggaguguucgugaaguucuucuccaccagaauguuccuggcacaguuguugauguguuugaaacggucaggucccagcaggaucccuccauaccagcgggacaccaccaccaugacauucuucacauucaaaaucuauuauuuuuagaagcauaauuagacauacaaagaggcaguuuuaagaaggcugaagcauuaggacaaggagaacuugcuaagucaaugccgaguucuagugcccucaaacucucaacuuuaaagccaccugucaaaaggggaaacgacaaagggaggguucuuccgcucuuacugacucuugccagaaagcuaaguuuaagcaguguuuuaccaguaagcaagaaaacaaaaccagccacacaaaauacccugcuucugaacaaguaacugaggagaaagaagagggcuucacaaguagcagcugugaccugucuaaugcugcuguaaccuguccacgccaccucuaauguaugccugccaaguucaggcuugucgccuaugcuaaacaaguuccugugagaacaaggccugcuuagaaagcaaacucuacacccagaaggagaagaaagcauaguaacuuucuaaggaaaaaacagcccgcucuuaaaauuaauagacaaucaaugaucggacccagcaggguaaacaaaacaaacaagauaaaccaacuaaaaugggccuagagaaacuuaggguugggaacaguugaauaaaggaacucaaguuaauauaugcagacaaaauuuagaagccacuauaucugaggaaaaaacugaaaauuaagcacaggagcuggagagauggcucauucauuagagcacuuacagccuuguagagagaggcccagcaaccacagagaggcucaaccaccuggaaccccagggccagggaagccacuguccucucuggccucuguggcacugcgugcacaugguacacagacauagugcacacaaacacccauacacauaaaaauaagugacuuucugaaagaaggaaaauuauuucuaaaaaggaagagaauaaugcuuaagaaaauuaaauggaaggcuguuaaagguacauaaacuccagaagaaguuaagaaagcagcucagacagucaauuuaauucuuaacaaugaauuauuacgaguauaacccauauuucaccauccaacugacagagaguuucacgaagauggaaagaagaaagacagggaagccacugccaggaaaacaaaaagcaguuuuccagagcuguauaguuacagcaauacaaccacgcuguguuauuucccggaaagcacaccauuggggauggacuguuuguacucuuaccuggggccagggacgaagacgacaccuccucaaccaauguccaugaccgggucuuacaucauucaaauucuuacuucuuccuaaguggugcucugguuuguugagauauauucagguauguuacguacaaacgucaagaguuuaacucuacacucaccuccaugaggugaagaaggcggcccccagcagcuguuucuccaucaucuucacaguccugcaagaaggucuguuuauccucacagaauauccuggaaacacauagaaaggguuacacuuugaaacaucaaaauauaacaacauacauauuacauaaugaauguuaguccuugcuggguggugguggcacacgcuuuuaaucccagagcuugggcagcagaggcaggugaaucucugaguucaagcccaggcuucucuacagagcaugccagccagggcuacagagaaacccuaucuggaaaaacaaaauaaguaaauguuaguccucaauuacugaaugucaucaauaugaucacuuccaaaguuggcauauuugucuuaaaaauucuucuugaacucugucuugaggcauuccugugcacagggacccuaggacccagaggaauuugcaugugcaauuccccucuguuagccugaaaguucugagauaauagagaguagacagugacagucgucaacgggggggggggggggggguggggggugggggggggggguguagacugugccaggcacuauacaggagaaaccugaaagugcuaccugagagguagcacacuauagucuucuaagagccuacggcuaaggguacugagggagaugagggacacgugugaauggcucacacucuuccucucauuuaauccagcuaccaagacuuggauaugcggcaggaaauagugguaugugacugugauccuaacacguggaggguagagggacgaugagugcaauguccaagaaagcaaguuugaggccagcccagguuauaugagacccuaucuaaaauaaauaaauggauguacgaauaaaaaaauaaaaaggauuacauuaaaucucuauccagauaauguucaggagggcacacacucauacacacaaauaacuucuuuuuuaagaugugaaccuacuaauagagaaaacuuccuuaugcaaacugagucuuuugaauuugauguuugacuaaucuagauuuuauaaacauuccauugaauuuuaaauuuauaccaagugccuauaucuauauucuguuucacuuugggucuaaacuacauuucuaaaucuuacuauuuuguguauuuuaaaauguucuuuaugucuucauuugcaaaugaagcaaacaguuguacucccacucccaaggcaugcugucacagcacucuuaacucacuacucacaggagcaggaauugcuggacacaauacaaaaagguuuaaaaacaaccuuugaaaaauucugaaauauggaucaaguuaauauuuuugaugcuucuucuauaccauuuuccuuccuuuuaauucucucuguaucuccuuuuguaaaaacgggaggagcugagggcacagcccaggaggaagugguuucugcaugagcagaaggacuaagucugaguccccagcacccauguacgaagcugggcacgucgaugcauugcccauaacgcagcacugacagcaaaggccaggagauggagcacacuagucagugcugccuaaacaguggccccagggucaguaagugaccuugucucaagaaauaacagagccacagaggacaacauccaacccugaccucugggcaccacacaggaaagcucacguucgugaaugugcacacacccacacaugcaugugcacacacaaagaaggagcaacugaaucuacuaugcagaaguaaucuaauucauauccaaaagaugcagugaaaauuugcaaagcuacaaugaaaaaagagcuaaauaaaccaguguggaacugugacguaucuaguagagaacgcagugcuccuccggcuacuugacucucugcaguuuucaaauacuucacaggucuacuguuguaauaaaaaagcagcuauaucucaaaauccugcauagcuucccagcaacuguuuguaaauugccuauuguaaaaccuggcagucacucaccuguaggcauagauguuguggguggcgcuggcaaucuucuuauucucguacagcuuggcaagaaccaguuucaccuucaaaaacagcaguaauagaaauaaacaaauaugccuuuuauuuucucuguaaaugcuagaaagguagaauuaaagcaauuugauauaaauuuauagcagaacaguuacuuagugaauuuauuaagcucugaagugccguaguagggcaaaccuuaguauaaacaggacagacgcgguacugcugagcaccuguuacccacagacguuuagucucuaugucuaaggcacaguauaugaaaauguguuccccagauagagaacuuuucagguaacugcauuuccagaaacuuagcucucacauuuccugaauguacacacucuaggacagggguacagcaauggcauaguccaaauguuguaaaaucacagcugccuuuaggcugccuuguggcuucacagaugaggccugagccagcucuuguuaaggggcaguuuuucugcaucgagacagguaaaggaagagacaugaagaagacacucacucggggccaaugcagggaaggagguuuggaugacuaacauaacuaaauaacaauaaaaaccuuccagucaaaacaaaaaaaaaaauguaaucaacaauaauuaaauaaauguaagaaugucccaugaacguuuauuugggacucagcuuuaacugguaucuguauguacucugucaacccgacacggaacaggaaacugagugaggaaaugcuacacacugcuguauuaagaagauaugggaaguacagcaugaacgguaaauuaggaaucaaauauaaaggcuguguggaaggaguuuggauucucccuuguacacaauggaaaucagcaaagacugcaugaggaggagaguagguggaagggagagagagagggucagauugccacaaacucucuccugcugacaggaaucuaggagucuggaaaccaaucaaugacgugaaacuuuaacgugagagggaaggugccuacuaggacugcacuagugcucuggguccaagguggggaagacggucacgcaccugcucaggacagacgacaggggccacaugagccugaaaagugcuccuucggucaguaauaggaacgccaugagcaacuggaggcaauucuucaguuucuauaaagucaaagaauuuuuuuuaaagaaaauuagcaauaaaggaaaagaacugcgauauaaauaaaauuauauggcaaaucuaagcaaacagcacaaauaacucccuaccaaaauuaaacuuuuaguaagauguucauguagguauuauauguaagagaaaaaugaaugaucuucaccugccauugcaggugaccugcuacagucagaacucaaacccugaacuccggagcaguuuaaguuggcacaguaucuacuuuuugagggaguaaaagagcuacgcaaaccaaugacugacagaugccgauaccacaacuuacuuguuucuccacauaggccaaccucuggagugggaaaucggauuugauauuguguagcuauaauacauaaugucuuccaauaaaauuauucccacuuuacauaauggaauuagacacauuaauacuauagccagucauuagcccauaaaaagugcaaugauccugucuguuauucucccuuuucaacaaguuuaaaaucacuagguagcuguuugugguggcagcagcugugcauguaccccuguagucccagcagccuuuccucugagcaccugagaggcagaggcagguauuucucugaauuugagggcaggcugcucuaccgagugaguuccaggauagccagggccacacaaagaaacccuggcuucgaaaaccaaaaaacaaacaaacgccuccaaacuuguguguguguguguguguguguguguguguguguguguguguguguguguguguuuacugagucucuaggccucccaagaacaucagcacccucuucuccucaagagaaauuaguuaggaacacaauaccugguugaguuucuucacugauuuugagguccaauguuuuaacuggauuuuccggcgggugcucuagaauagggucuucuucggacucaaccucaaccucuucaguuuucuucuugacaucugggucuauguaaaaaugagacuuuaggauugauccucaaagcaaguaugaaauuacacuuacaaaaaucacuggaauccuagcacuagggagacagaaagaggcaggcagauugugcugagucccaggccagccuaguccacauagcuaguucuaggccauacagugagaugaguuuucugucucuaaaaacaaaacaaaaaaaacaaaaacaaaaaaaaaaagaaaagaaaaaagaaaaaacccaaaagaauugggucuugaucucuacacaccauucuucaacagaaggaaucaugauuuuucuuacaaaagauuucuaagaaaugaaugaaagaaggacauaggaucccugugaguugaggaucagaugcccuggagaagaaaagucucauucuaucccugaucacuaauucuugcccuagguauuucuucaacaagguuuuggguuguuuuuuucuuuaaaauauuagaauacaacaugaugggcacaggauuuucauauguauguauacacacauauauaguacauauacauguauguguauacauauauaaauuauguauauauccuuuguguggacagauuguuuguauuggugguucuggggaucaaacccaaugcuuuguaaugcuagguacaucuccugcuacuaaccuacaucccuaguccaaaaacaauuuuaaagaaaaagauccauacaaaauuucuaagccaaagcuuuaaaguaaucuucaacacaacuucaaagucuaacgagcagaaguuaggagggagguggcgcaucccggcugaagcgaguccaguuuuucuucagagcugaaugacucuacugguccacugucaauuucuacagcuacucaacucuacaagacaagcuaucaaaauuaacuuuguuuuuggagaauuucuagagccuuucucaugcacgcucugcaugcuguaaaauuacaacauggauccaaaagucagagaaaacacuuugaaaaugcugcagaucuuagugacuuuaugucaccgcugcuuugauuguaacuaaagcaguaagaauacuugcugcuauagaaaaccugguaaaagucaucuggacacacagguaccgccaucaacgcucaauauccaaaacagucacuucucugcaaacaauccuuaucuaaaaaugcuauaaccuacaggcuccuuuauaguucuuucccauaaaacugaaaauaauuugaccaguggugacaauaaaaagcaauuuagaaacaaccccaggcuaaaugguaacagggcucuuucucucucaaaggccuuguggugaguggcaagcccagcaagggaagugaggggacuggaaggcccugcacuguccuaucucagcagcucaggaagagccugauaacgcugucauuuuuaaacuucuaaguaaaggucuauuccuucacuuagcaggguaacuaugguguaugaauuacaucucaauuuaaaagucuauuuuuaaguuauccuaauauaaaccaaaauacuuaucaagaguucuuuucugaugaauacuagauuuguuuaagacuaauaucuaauuuauauauccaauucauggggaauucuauaaaguucauaauaccuuaauaacauucaagcagaauauguuuuagaucccaauucuuuccacacaaaauucuaaauucuaagaauauaaucuauagaaaaaccuuagagaaagaaaucacuauagcuacaugaguaagugaacuuucaagagaaacuuacuuuuaugauauagaaucuauaaaucuugcugggcaugguggcacaugcccagcacucaagaggcagaagcaggcagaucucugaguucaagaccagccugaucuacagagugaguucuagggcagggcuauacagagcaaccaugucucagaaacaaccaaccaaccaacccaccuaaaaaagaaaaaaagaaagaacaaaaagaaaccacaaaccagaucacagguguucacgugucauuucaacgauauuaucuacaugaaaauguaagugcucccaauuaaaagagcacaaagagguaccacucacucucaccuggcucgguuaucugagauuucuguaucagagcaucucuuauuuucuccacccacugguaaagaauagauucacccauguuguggcuaaacaaaaucaggggcaaaagucauuauuuaagaaauguaacaacacaaauucaagacguuuacuuacauuuaaauccuaagccacuauuuuauaauaagacacaaucaugacuuuuccaaauaagagauaaaauuuaccaacacuuaugugugacuaauauauauuuuguauaccaacauuaauuaaagacuccaaaauggcucaaaaauuaauacaccuuacuuaaaacuuuagcgaacaauugcauccaaagaagagaaagaaaaugucuaaauaugaacuacaacugagacagguguagacaugacuuguuucuauccauaggugcuucagaugugugcaaucaccaccagcucuucuccacucuuuaaacaauacaaucuacuuguuuugccacaaauccuucaacaagguauauacagacuuuaucaggacauuuggaagaauuuauuuaaagagaucuaaaggauacauagcucaacaguuuuauauccguaaagaaauuuuuuuaacaaauuuagucuguugcauaauugauucauuuugguuucaaauaauguuuggcugccucugguaauuaaacucaucucaaaucacuaagcuaaggaauauguuaaaaguuaaaugauagcauaccaauaaaauaaaagaccaaguaucucacuuuuagaguggcguuguuuuagauuugauguguauuuaaagaaaugcccaaacaguacuggagagauggcucagcaauuaagagcucugacugcucuucuagggguccugaguucaauucccagcaaccacagauagcacauuacagaggcgcacaaccaucuguaauugaauccaaugaaccgguugcugucucugaagagaguggcaguguacuuacauacauaagauaaauaaaucuuuaaaaaagaaaagggggaaaaguguccaaacuaugucacagcagugccuugcugcuugccuuuaacccucaaacccacccaccgcauugguuauaacuguguuccuuuuagcacagaaguuaaugggaaagguuuuuaaagacagaauuucuuuuaaacaauauccacucuucuuugcucuggacagugcaagauccaaauguauuaaauauauacugagucccaaagacauuauauagaccagcacagcugauccucacauuucaaaacugucauuaugaagagaugagaaaacaaauuuacagagaguaguuagcuugucuaacagcuuugcuagcgauuaagaaggcucgagcugcaauaaaaucuaagaacugaaguucaaaguucaaagcacuugcguuuugcuccccuaacagugaaugauaagggcacuuaauggucuaugaaauagguuuguauggacucccaaugcauauacugcuaaagguuugucuguccuaggugaaucuucaaacuuggaggcuuaggaaaaaagcaagacucaaugaccugaaugcaugggagcccauccuuucuagcuggcaguauacaugacugccugagauccuggggcuaugguagaguaaagcacggccccuuucacaguuuuaguaaucaucuucuaaacaaaaucagagcuuuauagaguucuauguccuacucucuucaugccacaaucacauuagugacacuaacucuuccugaacaaccacuguaucaagaaguaccaaaaugcuaacuagccagucagcacucacucgcucccuuugaaauacaaagauuaucccuuuuuuuaauuagguauuuauuucauuuacauuuccaaugcuaucccaaaggucccccacacccucccugacccacucccccacccacucccacuucuugaccuuaguguuccccuguacugaggcauauaaaguuugcaagaccaaggggccucuucccugugacagccgacuaggccaucuucugcuacauaugcagcuagagacaggagcucugggguacugguuaguucauauuguuguuccaccuauaggguugcagaucccuuuagcuccuuggguacuuucucuagcuccuccauugggggcccugcguuccauccaauagcugacugugagcaucagauuuuguucucuaagacagggucuuacuguauggagcacaagcugguuuguaacucacuaucuaguccaagcuaccuugaauccauguucucuaccucaguuucagaacugggcuuacaagagaggaucacaccugacucccacacucagcauuugaaaaauaagaccuuagaagaguuucuacaauuaguaauuucccaccgcaaucaaggaaacuuaaucuuugcuucaaaugucuucucagcauggcuucccaugacgcagccaagagcacgccuacugaacuccgggcaccgcugcuucugucugcacuagcauugaaaagacagcuccuugggaauccaccacaaagaggcacagugcgcagaagcuuucuggguaaaguggagaucacucuguaucucagaccccaagucuaccacuaaaaaacauuucuuguuaacauauuauauauauauauauuugcuuucucuugcaauaagaaucuauuucuguauuuuaauuaucaacuacgauuuaguaugacucauugaaaaacaaaaaccuggucuucaaacuuuugccauucauugcucuaaugaaaggcuuuauugaaucagaagcuaauuaauugacaagagcggcaucuuccuucuuguuuaugcucucuggaucccaggaguuuguuuuucaaacuucaugacaaggugacucagcacagguucgaagcaacagggcugaucggugauacguggggggucuccaaaacuauaaccugaaauaaaccucuuuucugcaagccacaccucaaggguuuuguuugaaugggucaaagcuaaccaacuacuacugugugcuaaauaaaguauauuauaugauguuauuuaauccucacaaagauacuauccuuauucuacugugaugaaaauaaacacaagaaagucauacuauucaaaagcugauuucagaagccugaccaaaacagccuuaaugcagccuaacuaagcuucggacaggcuacuaauauuuuauaaguacacaguuaagguugugugugugcacacguguauauguguguguuccugugugugucgugcuauaugugugcauauguauguguugcuggugaccacacuuaguaccucauucaucuugauuuguaugucuguguauacagcuggagauuaaacccaguacccacccgcuugaggcaagagugcucacacugaacuagauccugcaacgcuccaucuucauuugcuuugaggcagucuuacuaugcaguccuugauauguagacuggacuaaccuugaacacacaaagcuuuauacaccucugccuuccaaguggugggucaaagguguauaacaucacaccuagcucuucaucuuuauuuuuaaaucucagauuccuagcaaaaaaaaguauauagaauauaaaaaauguuuuccaaaagauucaugcuuucuuaccuaagugcccacuaaccauaguuuaucuucuuauauaauaaacaaauauucaauuuaccauuuaaaauuauacuaaauauauacaacaguacuauauuaugaaaauauaaauauuaaaaacuauauugacagauuuguauuugauauuuuaagguuaguaauauuuugcacuuaaugcccaugacuaggauauaaaaucauuaaaaguugucacauaaaacucuaaaaaaaauccauucacauugauguuuaucaauaugaaaacacugucauuagacuguaauuucuauucaagcauuuucaauaagcaugauggacucucucuuaucuuuagagcaaucuguuuaaaacaaaaccuccgugugagguagaagaggcaagcuuuguccugugagaagcucccuuggugcacagggcucuggacucauguacaggaacgugagagccacugcagucauggcacugccuugggcaagcgcaaagugugcuagcaugauggaaacaagcaugggaagauuuuuuuaaaaagaugagcugcaagugaccaccagcuguguaauuguaugcauuauacaauuauacauauaugauuguagauauucauacauguauauacauacaacugcauacaucuauacacauauaauguauauaugcauaauuguaagcaaguggugaagacaagcugguaagcagaaguaauuggauuacaagaagcaugucagaaauacaaacgucggaauggccaguaauguuaaaacagguaucaaaaacauuuaagugauuaaagaaauaauuguguauugaggguaacagaaucacuaaguagggacccaggaaaggucuuuuaggaaggacaagugauaaggauuccaggaugacuuaccauuuucuaauuaaauauuuugggaguaaaagaaaccuggccuugaucccuggggcauaaagggggcacucucauaguaccaaacaggguggacaccuagaacauauaauagaaugcugacuaauuccuggguucagaaaaaacaaacugaugguccagaauacuacuugguuuaauaaaucauauauuucguaaauccaaaucaaucauauuuucucuugacauaucagcgucccaacaaauuucugucaucaguucuuguuacuuucuagucagucuccacagagaagcaggcucacuuuuuaucccacuacucaaacuugagccuccaacagcucucauggcuaagccagugccuacagaacucagauccuccuguccaacuuuccaggucuuuucccugccauguuggucugucucuuaccaucccauuucaugucaccauuacuaugcucuggccucucacugaaaucagugugagcuaauuaacucagcucuuagcaagcaagacagauuagaauaaacuuuuuaaaguuaauuaccaucacauugucuagcuuuguucugacaaaaguuauuacagcugcagagcuguguucacuuuuacagcgcugugauaucuuccgcuuucacacuggaaaauucuaaaggcuacagaaagggauaaucucuaguuuuucuaaaccauguguaucuaggaucuacugcacugccuaccauguaguguuugagggagggagggagggagggagggagggaaaacagugccucuguaggaucuuggucuuuuagauuaguacaagaggaccaucaaaguauugaugguuuaacaaagaaucaugguugaaauucuuccauugucauuuuacccuugauauucuaugagaauacacaagaacagcauuuguaaauuugucuucagaagccaaauaaauagugucuaacuuuaaauauuaccauauuuuucuaucaacugcacacauaaaguuaugcaacuauccuuuuaaguuugcuuaaagugaacguuuuuguuaaugaaagagccuaaaaggccagguaaaggacaagcaucagucaagaaaagcucagagcaaagccacuaggaaaacauuugugaaaagugcccugucacuuacacauauaucuccucaaggcuguucgauaagucugcgcguucuugcccuuucagccagggagcgcuaagauugaauaaaacacaguaaagaacauuagucaagaauuagguauauauuucaaauauucauuagugugguuuuucaucauucuguaaaaugcucuacaccaauguaaaagaugcuuuuaauuucuauauucauuuuaaacaaaguauuuucuauaaacacaaggacuaaauagaagauuaucuuugacagcaaaauauuuuuaaaaaaauauaaacgaaggcgcuagagaaauggaucagcaguuaagagcacuaacugcuccuccaaauauccugaguguaauucucagcagccacaugguggcucacaaccaucuguaaugggaucugaugcccucuucuggugugucugaagacagcaacaguguacucacauacauaaaguaaauacacacacacaccaauauauauaaaggagaagacaaagcuuacuucagcugauaagaaggcggugcuguacccggguacucacuuggcaacaucaccuacaaagaaguuuucaaauaaaucugaugacagcugaaaacaacuacauuuauaaagccaggcaaugaacaggguucuaacucaucuagacaaaagacaaacuauuauuuuauuuauuaucagguaaaaaauccccuccuucauauuuauaguucuacaaaaaauaugcuguuaaagaagcugucauguuucuggaaguuaauucuaugcaaagaagcuauaaaaauaugcaaguucagaugaagaaaaccgaagaugaaaaagaacugcguacaggagcucuaccuccugccaccagucaauguugaucuaucuuucguuuuacaaauauuuuucugaaaacuuaaaaugcccuaugaaauaccauuaaacauacucugcaaaacacacaucucuuuuaaaaaucaguauuaugaagccagagucagggcgcugguugguacacaucuuuaaucccagcccuugagaggaaagggcagguagauugcuaaauucaaggacagccaagacuagaucagagaaacucuaucuugaaaaaacaaagguaaaccaaaacaaauaaaaugaauaaaacuuugaaaaaaaucuauauuaugaaauauucuauaauuuucacaacuuagcauccuuuauuugaaaauauaccagucauggaauaugccacaacuaauaagacagaaagccauaacuaaucuuuucauguaucuuauuuauucuaaacacaacugaaucucuaaagaaacaaguaucugcucuaugaauuuucagucauaauuuccucaucuuaauuuccccaccuuuccaggucuaaaccuucuuuuauuguuuagaguaacaaaaagaggugacucaagacuguaaacaaaacacauguuuaauaauuagaagaauuauggcaagaaggauugcaaccaucaacaaaagcaugauuugagggugaucuguaacuaaucaaauacccacguuugcauaaucacgacaauaaucaacaaaggcaauccaaaaaccaauucauacuggaaucauaaauagacaaugaaaucaauuuuaauauauuaaguucuaaugucuggaaaauagcugcauauauauauauauauucuaauauauuuauucuauauauauauauaaguuaccuguaaacaaaguguccauuuggggucauccaugaagucagugacucuaauacaaaauauuuuggcauuuucaucaaugacacaccacuccucgccauaaauggcugccauugcuucgauuucuucacucugaaaguugauuuuaaaagucaacaaauaaacauucaaccuguucaugcuaccuuuuauagaauuaacaauuaacacagucaauccgaaaaaaacaaaaaugcaucuuaggagugucuacucuagaagcaccagugcaagcagcucgaacacacacucgagguacgcuaacccuacccaucugugccacgcccauaaccaugcugcugugucugcgaaaucucggucucaucggaccugugcaagucacaaugccgagcugagcccagggcuagcucaugugacaacucagcggagccgagcagagccgagccugcucgugugacgcagcagccgagcagggcuugcccaugugacaacucaggcgagcagagcagagccgagccgagcccagccgagccugcucauaugaugcaguagaugaacagggcuugcucaugugacaacucagccgagccgagccgagccgagccgagccgagccgagccgagccgagccgagccgagccgagccgagccgagccaagacugcucgugugacguagcagccgagcagggcuugcccaugugacaacucaggcgagcagagccgagccuagccgagccuagccgagccuagccgagcccagccgagccgagccugcucauaugaugcaguaggugaacagggcuugcucaugugacaacucagccgagccgagccgagccgagccgagccgagacugcucguaugacgcagcagccgagcagggcuugcccaugugacaacucagccgagcugagccgagccugcucgaaugagcagggcuugcccaugugacaacucagccaagccgagccaagccgagccgagccgagccgagccgacucggucgagccgagcucuugugacgcagcagcugagcagggauugcacacgugacaacucggcagagccgagugacucagcagccaagccgagcagaguuggccgcgccuguuuaugugacaaugcggcaaagcuagugcgagccugcgccuguaaagagcagccgagcggggcuugcucaguaauaacgcggccgaaugggccaggccugcucguguaacaaugcggcaaagcuagugcgggccugcucauguuaagagaugcggggcaugcucggugacaaggagaucgaacccagugacgcaacagccgagcugugccgagccaagccgagugggccgggccugcucaugugacaaugcagcaaagccugcucgugugacgcagcagccuagucggccuugcuaacaugugacaacgcagccgagcagccgaguccagugacgcagcagcugagccaagccgagugggccgggccugcucaugugacaaugcggcaaagcuagugcgagccugcucgugugacgcagcagccuaguccgccuugcuaacaugugacaacgcagccgagcagccgaguccagugacgcagcagccgagccaugccgagcccagccaagugggccgggccugcucaugugacaaugcggcaaagcuagugcugcgacaggacagaacugggccugcuacguagugugaugcuacggccuagccgggcuugcucaugcgacaucacagccaagcugagauuagccaagcagccuggccugcucaugaggcaaaaaagcuagugcugcggcaaagcuagugcugcgacagaacugggccugcuugugugaugcugcgaauagacccagcuugcuugugugacaacgcugagugacagccuugcaggaugggaaaacgcccugaggcagccugcuugaugcaaaaaaaggccacacccacgugaagcaaacacacacacuugugcgagcgaaauuaugcaccucauccacgaacacacacccuuucgcaugcccaaacacaaacacgcacuuaugagagcaaaacuaugcagcgcauucacaaugcgugugcccaaacacacacaagacagaacgcaucuuacacaccagucagccccacacccuaucaucauauucugauaaauucuuagcggaucuuuguuuuagauucuuuuguaauuuuuaauuugggaacaguagcuuuuuuuuuuuuuugguaaccauuucaaaccacuuaagaauuuauuuuaguuuauaauuaauauuaaauggagauuaauuugaaagcccaugccuuuaauacugcacaucugagcagcaggcagagcucugaguccaaaaccagcccgaaacugugaccccaggauaaccacugauaaguagaggcacuaucucaaaaucaacaacaacaaaaaaagaaucaaaaggaaaggcggggaaaggaugaccccugcugggaccuuaccugccucuggcuguucccuacuuccucuucagccauggugcucaggaucugcgacaccagcuccaaaugcccaaauccgaaagagacgacuggcaagcagcaaaugaaugcaacugcgaugcacugaugcaccggaacugacagccaacaccacccacuuccugaauugcuuccgggucaacaacccugcgugcaggcagcggcugccagcuacaggcuuucugaaaguguugggagugacguagggggagcuugcccuggguucuguuucuugcaaagucauggggcuagggccuuuugcaggccgcacugaggcuccaaugccauuagaagccaugggagaguuuggauuaccaaauugggacucucauacucauccuucaaggcagaguuuucauuuguauaguuuguucauuuuguuuuuuaaauguuuuugagggcaucucgauagauuuggguguauaaaaugaacgagagcuggagaggauugaaaaaugugagaugacuuauguuuuucacuacaguccagugauacaauguuguguuugggcacaauuuucucacacugauuauuacaauuaguguagacugggcucauugauccguuaugcaaaaaauuugaauuagauaggaucauuccaaauuuaaugcugcuuuuuacaguauugguuaugaauucuguucuaaaguagcauucaguccagacaauuccuuuguucacaaaaauguguuugccuccuuccaugucuuauaaacauucaaagcuccauaauaccuguaucuuuucucucuuucgacaucgguaaugacgguaguuguugguucccuuuaaacuuuccuuggguaaggaagugugcacugcaaagaugccuggagcuauuaauugaacguuaucuacagaacucuuacuguaccccacacugacauguaaaacaaaaaguccagcacauccuuuaagagguggaacuguugaucuuagagcauaagcacuugguguccuguucaggaaauuuuccccuaugcccauguguucaaggcucuuccccacuuucucuucuauaaguuucagugucucugguuuuauguggagguccuugauccuauuggacuugagcuuuguacaaggagauaagagaggaucaauuugcauucuucaacuuucugaccgacaguugaaccagcaccauuuguugaaaaugcuguuuuuuuuuucuacuggaugacuuuagcuucuuugucaaacaucaagugaccauagguguguggauucauuucuggauauucaauucuauauuggucuaccugccugucucuguaccaauaccaugaaguuuuucacacuauugcucuguaguacagcuugaggucaggaauggugauaaccccagaaguucuuuuauugaugaaaauaguuuggcuauccugaguuuuugguuauuccaaauuaauuugcaaauugcucuuucuaacucuaugaagaauugaguuggaauuuugauggggauuacauugaaucugcagacugcuuugaggaagauggccauuuuuacuaauuaauccugccaauccaugagcaugggagaucuuuccaucuucugaggucuucuucgauuucuuucuuaaaagacuugaaguucuuaucauacagaucuuucacuagcuugguuagagucacacaaagauauuuuauuauuucugacuauugugaaggguguccuuucccuuauuucuuucucagucuguuuaucucuugaguagaggaagaccauugauuuguuugaguuaauuuuacauccggccacuuuucugaagcuguuuaucagcugcaggccuucucugguggaauuuuuggggucacuuaaguauacuaucauaucaucugcaaauagugauauuuugacuucuuccuuuccgauuuguaucccuuugaccuucuuuuguugucuaauugcucuggcuagaacuuccaguacuauauugaauagauagggagagaguggacagccuugucuacucccugauuuuagcgggauugcuucaaguuucucuccauuuuguuugauguuggcuacugguuugcuguauauugcuuuuacuggccuugaauuccugaucuguccaagacguuuuaacaugaauggguguugaauuuuaucaaaugcuuuuucagcaucuaaugagaugauguguuuuuuuucuuugagauuguuuauauaauggauuacguugaugguuuuccauauauugaaccaucccugcaucccugggaugaagcccacuugaucguggugaaugaucauuuugauguguucuuggauucaguuggcgagaaucuuauugcauauuuuugcauggauauucauaauggaaauuggucugaagaguauggguauuaaaucuucuuugaaggucugauagaauuuugcacuaaacccaucuggcucugggcuuuuuuguuugggagccuuuuaaugacugcuuguauuucuuuaggauuaugagacuguuuagaugguuuguaugggaguacuuagaaggaggaacaaaauaaucaugggagggagagggaaggaagaacuugggaagaagagaaaggggggaggggcaaaagggggcaggaucagguaugggaggagacaggggugauguacagagagucauaaaauuguacagaguguguaacaaugggggauagggaacuggaggguagccaccagaaagucccagaugccaagaaagcaagaggcucccaggacccaacagggaugacauuagcugaaauucccaacaaaggggagggagaaccugaagagaucauauccagauguuaggcacggccuccguuugagggauagagccacccacucaucuccaaacuuuuaacccagaauugcuccuguaaggaaauacagggacaaagaguggagcagagacugaaggaaaggguauccagagagugcccuaccuggggauccaucccauaugcagacaccaaacccagacacuauugcugaagugcuugcugacagaagccugauauagcugauuccugagaggcucugccagugccugaccaauacaggggcaaaggcuuacagccaaccaucaaacugaucauggggaccccaauggaggaguuaggggaaggacugaaggagcugaagggguuugcagccccauagaaagaacauaggaagaacaacaauaucaaccaaccagaccccccagagcucccagggacuaaaccaccaacuaaaaaguacauauggggggaccaauggcuccagcugcauauguagcagaggauggccuugucaggcauccgugggaggggaggcccuugguccugugaaggcucaaugccccaguauaugcagggcagugagaugggaguggcuggguggugaggaugcacccucauagaagcagggggagggaggauaggauggguuugcggaggggaaaucagaaaaaaggauaacauuugaaauguaaguaaggaaaauauucaauaaaaaaauaauaaagaaguugaauuguaaaugguagggacaauacauagcuuuuaucccagcucucaggaggcagagacaggaggaucucugaguaugaggccacccuggucuauacagugaauuccaggcucaacgaggcuauuauauagugaggcaaaauugagucaacuguaaaaauggaccaaaaaaaaaaaaauagaacuguuaguguacaagcauuccccuggccuccucccagggaccuagcugaggauaaaagggcccccagcuacacagacauuucucucugucucucccuccccccauucucuguuguuuccuaugugucucucugaucccucugcauucucuccugugucucucucucccuuuucugcucuaugucucccugccagucaaccucucucucucccuacucccaauaaaccucuuauaccagaucuguuauauagcauaauuucucaaagguagaccuuggcacagcccaacaaaagcaccuacccuuguuccaaauuuuuauccuaucaagagugacaggcuugacuaaaguccugucuauccagggacucuaccucacugaaauggaucuucaagugcuggaaaaccaacacacagagaacugggguguucauucaaugguagagcacuugccuugcaugcaaagggcacuugaguuaaauccucagugccauccauucacaaaaaacagucuugccggguguggugguguaugccuuuaaucccagcacucuggggcaggggcagguggauuucugaguucgaggccagccuggucuacaaagugaguuccaggacagccagggcuacacagagaaacucugucucgaaaaaagauuuaaaaaaaaaaaaaaaaacaacaaaaaaaacagucuugaccuucuaaauaaaauauagcaagucauagucucucagcagcaacccaguaucacacuccauaucaauucccacuuccuaauaguugcagucuuuaagucuuuucuugaacuuugauuguaaacagaaaugaccuuuugugcugagaacaggugaauacaaaaacauucaaacaaacccuuccucguuuuuuuagaccuguuuaacagugugaccacagaaaacccuaaauaacguaccagacugaaggacauaauacuuugggaaaaguaacuagauaauuacuaacgaguaauaaauguagcagacaaccuauacuuuggaaaguguacuagaaaaaauucaguaaauaauuaguuaaaaaaauacuucaagcaaaggccugagcagaggcuuuugagguucugaagacaauccuagacacaggcagaaucuguaggccuggggcugcucauuucuacaccugcuuacucaagggacuguagggucuccccuuaaugcauauaaagccaaucugaauagcuuuuuucaaucuuaguauucccccuaaccuuuccaacucaauaccuggccacuuugaaaaccuuaaacauugcuguaagcuugaaccuugaggaauaccuucuuccucuuucuucucaccuccauauaacaaggugacaaguccugaugacucuuauucacuagcaugacucauguugacuuauuauccaccuuucuaguguaugaugccaucuggacucauccacuguagucauucugcuuuucuuuucuuuucuuuuuaagauuuauucacuguagaauuuauucacauucugaucucaucuuucucuccuugaagcccuuuacuagccccagcuuucacauucaugcuucaacaccuuaacucaccaggaauauucauagccaccucucuaauuucaucucccaaaguuucagcuacaacaguuucauuuaguuuauuucaagaacucuauaacuucagaaaaacauaaaugcuuuuauuuuacacaauagacaccugaaggaaauugaaccaagauauggcuagagucaaggacaggugaucuauuuaaauauaaauagacagccaagugauuaaagugguagcacagaaguccuaagaugcacacugccaacuccaucaaagacaauggcugacuguaccugaaugucucaggacaaaggacuuuggagccuggcauuguuaggaguggcuuaaaucuuuuugcuuaagauugagaaacaaacaucauauacuguguuaaacaaaacaaaaaagaccagcugcaccaaaaauguuucagaaguugagccuauuauccucguggagaagaaucuacgaguucuauauccagaucugcaggacucaggaagagagagccacugggccuggcuucagauuuuaaacccucaaugugacauuuccuccaacaaggucacaacuccuaauccuugucaagagugccacuuccugauaacuaaacauucaaauauauugagccuauaaggggccauuuuuauucaaaccaccacauuccacucccuacuccccaugggcuuguugccauugcauaaugcaaaaauggauacagucuaaccucaaaaguccucagagccuauugcagucucaacacuguuuuaaaguucaaacucuuuucugagacucaaggcaaucuccuaacuguaacccccugagaaaucaaaaagcagaucacauacuucccccacacagugacacaauauauacauuaccauuccaaaaaggaggguaggaucauagugaggggauacuggaacacagcaagagcaaaaacuagcugggcaaacuccacacugaaucucccugccuaaugacaaagcaugcauuagauauccaacuccuuucagcuuuguugaccucaauaagggacaugcaaguauuggaacaaggaguucauaguugugguuauuaaaggcaaggggcugaaaaaggauuggcaugaaauagagagccugaaauugugcuaaugccacugcagcacaguuggguaacacauggauagggcauuaaagccaugaaguaugccccauggaccuauuuugaggguuuguguagauagagcgagcucuuccaacccuaugcccuuuugaaaauguuccuuuuuuauacauguguauauguauaaauguguguuaaugcauguguaccacaugccuacaggagcacaaagaguugcuguggaacuggaguuauaacuggcugugagcuaccauaaaggugcuagagacugagccuguguucucugaaagaacagcaaauguucuuaacugcugagccaucucuccagucccuccauaccccuuuuaaacaaaguaaugucuacaaaccaagaacaucaucucaucugagaaagcuuauuagaaauacugaaacuuggcccuguugauuuguauuuaagacuuucagagauguuuaugcacauuacaaucuuagaacccuguaugcugaccaaggucuuagacaaggaggguaauaggccauauacacugggcucuaagaucucacuguguuugcaccaugccuucucaagggcugcucucacacaagacauggaucuaugcagauaaguuuguuuuggggagauguaaaaccucucugauuggggacuggggauucaggccuugcugcacuucccagagacuuuacacaaacgucaucuuucuuguuuucaaauuauucacugugauauauguauccauuuguguaucugaauccuuuuaauccccacaccccuuuuuugucucugggcuacuucagagcuguuuaccauuuuaucagauacuucuuccucuaauaaaaugcucacacguucaaauuuauuuugcagucuucaucuagagcaguaauuugcagucuuccuaacccugugacccuuuaauacaguuucucauguuguggugaccuccaaccauaaaauuauuuucauugcugcuucauaaauguaacuuugcuaauguuacaaauuuacuguuguaaauaccuguguuuuccaguggucuugggggaguccuaugggagggucguucaacccccucccauaugguccugacccacagguugagaaccagucaucuagaguccacuguauaauacacacuaacaggucaauucuauuccuguaauaaagcuauuucacugggagaccacuaggcucuugucuuacccuuacuguugcugugaugcacaaugaccacagcagccuaggaaggaagccuuauuuggcucacacuccacaucacugugcuucacugaauccaaucaagacaggaacucaaacaggacaggaaccuggaggcaugagcugacccagagauaagagccacugccuguaagcaagcugcugcuuacuggcuugcuccccauggcuuacuaagcaugcuuucuaauagaacccaggaccaccagccccaaguggacacaauucacauugagcuggucccucucccuuccaucacuaagaauaugacuuauuggaaucuucauaaauucauaaaacuucagcacaacuggcccauugucaauuugacaaacacaucacuguuaacaaaccuuuccuuucucauucacccccaagaucucacauucaaaauguaaauaacuuuuuaaaaucccaacaguuuuuucuaauucaaacacauuaaaaguugaguccccuggucuacagagugaguuccaggacagccagggcuauacagagaaacccugucccgaaaaaccacaaaaacaaaaacaacaacaaaaaacaacaacaaaaacccaaacaaacaaaaaacagcaacaacaacaacaaaguugaguccgucagggcuggagaaaugacucagagguuaagagcacagacugcucuuccagagguccugaguucaauucccaacaaccacaugauggcucacaaccaucuguaauggaauccaauacccucuuccggugugucugaaggaagcuacaguguacucacauacauaaaauaaaucuuuaaaaaaaaaaguugaaccccucuaaaauggccaaaaaauucaaaaucuuucaacuguggacucuuacaaaauacaaaauaaacaauuuacuucaacacuauaaacaacucaugucaaauuaucugggauccacucacaaucuacugggauacuccaaggggcuugggucauuucuccagcucuacacucugcagcacacacaacuuguauucugggcuccggcugccuccacuccacugcucugcuguucuugguggucaucccaugguacuggcaucuccaaacugcaggggucucuugcuacaucagggcugcgcuuucaccaauggccucuccugggcucuccucaggaacuccagcccuacaauguaacguacaagccucagcugcucuucaggaucccuucaugccucaaaaccaguuccaccugggugacucuuaacuauccagcucacaugccagcacaugguacaaccuuagccaccucuggaacacagcguaugugugccgacucucaggaaacagaaaacacuucccaggagaaucugacacaaugaucugcuugcuucuuaaucacugcuaacuuuucagccccaucgaaccagcaucaaccgucccaguaacucaaaaggucucacuucaguggugccaggcucuucuuaauuauggcugacucuucagccccagcugacccgauaccacaggcuuuucacauaaauggccugguagagucuuugcuucccucggaaccuucgcaagccaggccuccaucgucuacagugaucccaacauucuugucuuccaagauccuuccuauagcucuccgagcucucaacacucaauggcucuucuagcccaaagucccaaaguccuuccauaguccucccagaaacaugaccaggucugucagagccacgucccacagccacgucccaccuugucuuaguuaggguuacuauggcuaauaugaaacuccaugaccaaagcagcuugggaaggaaaggaugcauuuggcuuacacuuccauaucacuguucaucaucggaggaagucaggacagaaacuuaaacagggcaggaucccucaagggaggagcugaugcagaggccauggaggggugcugcuuacuggcuugcuuuauguggcuuguucaaccugcuuucuuauagaacgcaggaccaucagcccagagaaggcaagaaccacaacagucugaggccuuucccuucagucacuaauuaacaaaaugucccacaggccugccuacaacccgaucuuggagggauuuuuuuuuuuaacauugaggcucccuccucucagaugacucuagguugugucacguugacauaauacuauagagcacaauucuaucgucucaugcuccuuuagaagcaacugagcccaauucaauguaaacuuaaccaaucagaaacuaccagcugagagacuaugcuaggugcugcuaacuacccaaugagggacuucccacuauaaccaaugaaguauccccucuuagcagcacacaaaccuauccgaggucaggugcuguccagugcacggagagcagaauguuuaugaaaugacuaugucauuuguguuugauuagacaguucucagcccucuaccacucuccucccaccaacaguuaagucugcuuugucaauacauuuugagauuuccauggccuuggccaugguccucauguauuaaccaaaauaaugaaaguaaacuaaaauaacuacaaaagaucuaucaaaaaguuggcauguaacgucucaaacaaugacuaugcucuaccaggaaucaauguuuaagguuaaacugacccucaucugacuaugaccauggcuuuguagaguuuuaccuuaaaacucuaauuuccacagaaauuggugccucaacacauagagaaauugagaaguguucugugaucacucaaguucaugaucacuauauuaagcacacucagaauuuuuagagugauuuauaaucuaauacauauuauaaaucuaucagagauuaauggcauauuucucuauaggccuuaacuacagaaucuucuccuaucccaaauggcuucaaacuacagaauuaguaaaauauuuuuucuaagcacuaagauguuuguuugccuguuuauuuagaggcauacuuccacauggaguaacucauugccuacguccugaaaacuaagcuacauucucuugaaauagauccugcaagcuuguugggagguucaaguagggaaacauugucagucccuuccccuuccccuuccccuuccccaaagaaugguccuccucugucuccucuuugaccaaggauggggaucagguggaguggacagagggagaaaaggcagcaccugccuagccagccagaucacaaaaucaaucccugaccaauggguaacauguccgagcgagaucauacucagacagguccugucgguguuacucuuauuauccuggagauagcacaucaaggucuauguuagagcuauuuuggguucaucauuaaggaggaccuggguuuccauauacuagaaauauucuaaucuuuuguaacuuacagggcuagagaauggcuaugugguuuaaaugcucgauguuuccaggacccaccaaacaccuggaccucuggcugcagggaugcgacacccuaugcugucccugugcgcaucugugcucauaaguacauuccuccacacaauuaaaaagucauuuuaaaacuuuuucagauuuucacaaaaccuuaauaaauguacuucuagaagaaaaauuuuguuuuuacuuaucuguugaucuguaacacagauugaguauauccaacaucuggaaugagaaugggaguggauuaaaccuuucucaacaucacucacacacacacacacacacacacacacacacacacacacacacacaggucucccaggcuggacuuucucugccucuuugcucugcuuugcuuuguuucuucuaaaagcuucuguugacuaagaaaaagaaaacaggauuaguuucccauucaaucccagaauucagagugaugcaugugaaacuaaguguugauuauaagaagaguuaucuucuuuucccucagaguggaauuucuguacccaggucugauagcugucucguuguuucaagucucaggacaaagauaugcaucaccaaggacuuuuccucauuaaggaugaugccuucaacacuacucaaagccauagcaugugugauucucuuugcauaacucagcaguuaagguaacauacaugucuuugaugcgcuugcagugugucuucccaaacacauauauucccugggaggaacuaucauaacugguaggaaggcuguggcacucuaaagcauaaauccuuacugacucugauuggccacacaaauggcucugaaagcuccaaauauccuuaggggacuacaagcaggcugcucaaguggugcucagugaaucuacugggagacacucaccaguguuaccuuuccuagcauagcaucaugaagucaagaaagacuucuccaguggccuuuucuugccuauucucaguaaugcuggaugagcuagcauggaauucaaggaaaugaguucagaagacacaggcaguaugcaguagccuuagggggaccuugacagcuacaggagcacagccaugggaacugacauaugucuuggagauggcuugguccacagaugccacagaaacugauccagacaggagaacaacuugauaacugacgaucuaugggcaccuuaggagucacagagcccuaugccacugaaauagauaguaccugggcuguccuaggacugauaccaccaaguuuccaguuucuuguguguauuccuaaacccuuggcuuucuggcacaaaguuccagcaacugcagcuuggcagccaaagaccuggcagcucacccaucuguggcuccaauaaaccaacauccgcuggugguucuguucccgccuggagaucccauucgcucuaagcauccugugccggugagaacacugccuacuccuaagcaauccugaucccugcucgguuucugagcagcacuuggguauuugacacucuccuucgcuaguccaaaagaggcagguaacccaaaauguccuaggagcagcuacuggaagcaacaggaacugccgaacagaagaaaggaaugggagcaggaaggacaggaguggagagcacagagaagaggcugugaggagccacagaacagaaccugcaggcccuggucuccagaacaguucaaagaguugaaacaucucaagaucacaggucgcagaccucagauccagugcaguaacacuggcuacucacacaagagccacagccuguucagggaauuuugcaucacaggaagccacucgcugcugcuucggugcugccacugcuugcugcugucagacacuggaggagggaaaagcagcuagaaagcaaaggagaauuagccucacacacaacagcacucaugcgugcauguagacacacaauuacagaacucuaugauaacaaccauuaugauugaaaaugugcugggcacagugcuguguacgugaagucuagcaacugggauguugaaacagggugaugacuugagcccaggagucugaaaucagccuggacaaaacagaaaauuuuucuguuuugagaaaaagaaaugacugaaaauauaucuauuaggugaauuauuggacaugggcuccaaaagaaaagguaagagaaacucacucauaaggggaguagagugguucagauuacuucaugagugucuauggcagugggcaaacaccaaugacgaaucgucauuucugaaauugagcugaugaaaccaucacagagcuuccaagaugugguauuaaaacacuacagcuucaccucaacauagcaccggauacacaaagucuaauacaaaagaaaggggggaauagccuugaaugcacugguacggaaccaccuucuuuaacugagcaccaauggcucaggcucuaagaucaacacuggauaauggcgccucacgaaacugcaaggcuucuguaaggcaaaagaugcugucaacaggaaaaucagcagccuacagauuggaaaaggaucuucaccaacgcuauauccaacagagggcuaauauccaaaguguauaaagaacucaggaaaccagacaccaacaauucaaauaacacaauugaaaaguagggcauagagcuaaacagaauucuuaacagaagccaagaagcacuuaaagaaaugaucagugucuuuagucauuagggaaaugcaaaucaaaacaacucugaggcuccaucuuacacccaccagaaugcuaagauccaaaacucaagugauagcccaugcuggcgaggcugugcaacaaggaaacgaacgauuccuccauugcuaggggagugcacacguguacaaccacuuuggaaaucaaauuggcaguuucucagaaaacuugaaauaguuuuaccucaagaaccagaaaaaaaaaaaaaaaaaucagccgggcagcgguggcgcggauuucuggguucgaggccacccuggucuacaaagugaguuccaggacagccagggcuacacagagaaacccugucucgaaaaaauaaaaacaaacaaaaagacccagcuauaccacucccagguauguacccaaaagaugucccauuaugcuacagggccccuggcucaacuaugaucauagcagcuuuauucauaauagccaggaacugggaacaaacuauaagacccucaacugaagaauggauuuuuuuaaauguugguacaucuacacaacggaauacucuucagcgauuaaaaauaaagacaucaugaauuuuggagggaaauggauggaacuugagaauauuacccugagugaggagccuagagccagaaacacguauguuauuauucaguaucccaaaguccauauuccuccaaacaaaagcauggucaggccuaucacugcucacaaucccugucacagcuacugucuuagauaggcuuucuauugcugugaagugacaccgugaccaaagcaacucuuauaaaggauaacauuucauugaggcuggcuuacaggcucagagguucagucuauuaucaucaacgggagaaagcauggcagugucaaggcagguggcacuagagcaggagcucagaguugugcaucuugaaugggaaggcagcuagaagacugucuuccaggcagcuaggacgaggauuucaaagcccacccccacagcaacacacuucuuccaacaaugccaaaucuacuccaacauugccacauccccuaauagugccacuucccaugggccaagcauauucaaaccaccacaggaauguacuuauaaauggacauuagcuauaaacugugggauaaccaugcuacaguccacagacacaaagaaacuggauaauaaggagguaccaaagguagaugugcaaaucucucucagaaagggaaacuaaauagucaauggauguggauggagaggaaacuguguaggggaggagguaaggaggggauuggagauggcaucagguguggagagagaaggggcaggagagggcugggagugagaauggaaauuggugagggggugcaucuccagugaccagcuggaggacuagggugggagaggguacagggugucuguaagguugacuuuagcuaagauuccuaccaaagggggauauagagauugaaguagccaccuccuguagccaggcaggacauccagaggaggagcggugacaucauuccacccaccacaaaaauucaccucaaaauuugucuugccuacuagauggacagagauaaagaugaaacagagagugaggaaacagccaaucaaugacugcuccaacuugagacccauucugacacuauuuauaauacucuggaauaguugcagacagaaaucuagcauaacugucuccugacaggccucauccagcaacagacggaggcgaaugcagagacccacaguaaaacaucaggcuuagccuggggaaucuuguggaagaguuggggauagaagugagcaagucagagagaucaagaacgucgccguaagacccacagagucaacaauccugggaccauggggauucacagagccugggccaccaacuagagagcauggaagaguuggaccuagccucuccacauuuguagcaaaugugcaacuuggucuucaugugguucuccuaacaaguggagcaacggagguggacuggggggcuagguacaaggacaggaaagaggagggucucagucucuguucccugccauuggauccccuccccuaucuggacuaccugguuggaucaagauuucagaagaaacccaaugacaugcucaaaggauuuaacugaggggaguuuaaggaagagagauuuuaccaaaggaugggcacggcucagggaccuuucaagagagagaaaagcagccaagaagucuugaaauuuuagaaagcuguuacgacucccagaauuaaagagauuaggguauugaguugccagccaaagcuggaacuacccaagagaagcagucauuagugaccaaauacaggaacuuuaaaugguuaacgaagguaggggggugggauugugagaaagacauuagagugugggauagagggaucagugcuauuaaccacauccucuuuccuguuggcagucuccuacuggcaugacauccucccuagcucgcuccgcggaucugacacuggcucucucuucaguaggcaugugcacacacaugugcucaccucaccuguaaccucggacccagccagcugcucaguucaagccccaaagccacccuuaaauacagcaguaauuugcuagcugguuuuccuaacuucugcuuccugcuacuaggucaguccacaagcagucuucauucaaaagaaucuccaaccucugaaaccuuaugauccgcgauggcgcuucucuaaaacaucguggacggcgcugccggggcuucaccugccucuggucgcuccucuguccccuacagccuuagggagagcuaguagaccaccucugagcgcccaggu

SEQ ID NO: 8826 - RNA, 59234 nt, Mus musculus
cagcuuccuuccagaggccccaagucagaucaaguagauccacaagugugggcagggucuaucuuuaggcaaacuccgaguccgggguucucuccacuguuaggcuagacuagacgagcgugcacuccgaggugcgcacguggagcgcagggagccauuuaaacuagcgaauccgcguucucugugcugacccgguagacgcuccggagccccgacuguccucuuucccucugggcggccgcccgggcgagccucuuccccagagggucgagggcacaguuggggcaguguggcgggcgggccccgcguuuccugugacagcgcggcccagccgcucccucccgccguggcgggaccauuuccugagcguccgggcagaggcggccggcgcggcgcuaccaucagcgcagggacgcgggggugcggccggugagcgcgugagggcagcggggcggaccgcggcgggaccgggggcucgagccgcaccggcagcagugagcgucuuacacuccuugcugggagcugcggcucagcguuaaggccaagccggccagcgagggacgcggcccgggagcauccuccccccaccgcgcgcccuaagguggaacugcccggaggcgggcgucgggcccccagcuccgcgggcccuggagcgcucgggacucgcugaucgcgggcucggcggcaacaugucuguggcguucgcagccccgaggcagcggggcaagggcgaaaucacgcccgccgccauccagaaggugagccgggagaggcgccgggacgcgggccgaggcgggguggcgugggggcgggcugacgccggcuuuccgacggagcccuuuggcgccugcucugcccgcacaaaagcgcuggcaaccgccgcccgauuuccccgcgggccggguggccucgcgccgcggggccgugaaggaagcggccccgagacuccggcgucgccccgccgggaccccacgcgcggaagcccgacccgagagugcugcgccgcaaacuccucggaguugaggcccucuucggagaacuugagaaccuuccgcaaugucucggggcaggcgagaaaggagccggggggccuccggggcuccccggggucgcucccgggaucgcaccccggaucuguuccggucugcagcagauagaugcgccugagcgcgcagggcgggcgcugggguuccggagggcgagccugcucucgcuggccuagcgcuguuggccguccacagcgacaggcgggcgguuugcaugaagucacgaucgaagcgcugggagcuggguccucagagagugccacccagucgccgcuccggggcugccaacuggagacacaaagguucuuuauuauccucuaagccagugucuaaaagcaaggcacuauuuagcucucagcaugguagacuuuugaaagucgccuccuguuaaguuuagcaguuugccuugcccugaguauuucgaucuuguucccugccccggaguaagguuaaggggagcaagucaaccuguaguaccaaucggggcacccuugaagaccuguggguuacggccaucgguuucuguuuacugucagggucuuuguaguguggcauuugacauuugcccaacuguugcuuuauuuuucuuugaagaaacccgccuggcagugucuggaaacgcaguugguuucuuuagagugccagguugagccaguagucuggugaacagcuuucuuuaagcacacacgugcagaaagaauguuucuaagaggauucuuuuugaacucuagaaaaagucuggcgcuuuccuuuuucucaguagaguuuuuuuuucuuucuuucuuucuuuuuuuuuucuuucuauuaguugcuuaucgugagugauugaucuaggugcuaacugguuauauuucauucucagaugaaaagugaaaauggauuaaaauucuuuuguuauuuuauacgucuguguaugucaugugcaugcagugcuuggggaggucagaagaaacaucaguucccugaaauggaguuaauagccuccugugggggcuggaaaccacagccagguccuuagcaagagcauuaagugcucuuguccucugaaccaucucuccagccccccaaaagcauuacaauucaaguucuguuugcagugucagauguugguuuagacaggaggcagaugguugggguuguuucaugugucguggauuccuugguugaguauugaauugauggcacugccuucaggggcaggcagauuucugugagauugaggccagccugguccacagaguuaguuccagggcagccgacgcuacacccuaucuugauaacaacaacaaaaauaguaacaacaauaaaaaacaaaagaauuuuuuuguauauagugauuauauuuaagaggcacacuuuagaaaaguguuugcucuuagcaaucgaagauaaugauaaaugugccggaaauaccaauucaugguaauuggauuuuguuuuuaauugaaaaucacguuaaaugauuuuugguuuugucaugaaauuuugaaagguggggcaugcuuaggaugccccccuaaaucuuaagcuccuacaaacuuggauagugugcuagggacuccauguagguuuucuucuguagugccauuggcauagaugaauuacuuaauccucaaaaccaagguugcuuagauuguuauaagaugcuaaaaugauaaucuuaugguuuuuggacuuucugagauaucucaguuuauuuuacaaacuucuauuaauaauuacaugcauagagaugauugcuauguguccuuuuggagaaucaugaaucugcacaguuagaaaagaagcugagccauuaccucagggcccuugggcagcacugcuccuguguuuguuuccuucuggagaagagauuuccuccuucacacuagagcaugagaaugcuccaguagcaacugcgaguccacuuucaacuagcagaaacuacuguuacagauuggagagguaaugaaauguuucuguauuuaaaacaagacaccccaaaacaauggccuagaagaugguucagcuggguucagggagagagccagugcuacagaauugcccucugaccucacaccacagcacugagugugugugugugugugugugugugugugugugugugugagugagaugauuaauacacacugaugauaaauaagucaaaagaaacacccuuuuuccauucugaguuucaaagagaauaauugagauagguauuaaacagaauugauuaaaugugauaucauuccacauacacaaaguaagauuuuuuuucuuuuuugagauaguuucucugugaaguacugacuguccuugaacucacucuuguagaucaggcuggccuugaacucacggagaucugccugccucugccucccaagugcuaggauuaaaggugugugcuaccuuucaaccagcuuguaggauuuuuuuguguguguguugcaaguuaugagcaguauuuuaacagaagaccacagaagguucacuuucuauguagauacauuucuagaaagauucaaaauaugaaaaaucaguugucucagaauuaucuaugcaagucauauauagcauauuucauaagugauuauacauuuuaacagcaaaggaaaauuuuaaccaaguuaauucaaucucauguuucuuacaaugaauuuuaaaauauuuugucagagcaaguagaaacacuaucacaaaauaauucuaagugggugguguuuuccauguucaacuagaugguuuuauaaucugaaguggcuuugaggaaacaauguuucgcuucuuugcagugucguguucauggauaccuucucuuggcuucuugguuuugaauuuuacuggauauacagguuuauaaugaacucucuggcuuaguuuugaguuuuacucgauguacagguuuauaaugaacucucugguuuuaauuucagaugcuggaugaaaacaaccaucuuauucaguguauaauggacuaucagaacaaagggaaggccucggagugcucgcaguaagacagacaagcucuuggucuugggucuugugguuguuacuuguuacuuugucuuugaguuauuuauuucaaaaugugcauuucagucuuuuaaaauguacuuguagagucaugguacugucaccucaguugguuugagaacauuuuaaucaccccagagagaagcauauguuuauuggccaucauuggaagucuuucccaccgaccucuuacccuauaaccuacuuucuagugguauagguuugacuauugaaaaccuucuggauaaguggauuccccccuguuuuugaaauagggucuccugaagccaggcuggugucaggcuugugauccugccucugccucugccucucaggggugucugcacaucacauaaagggauguaugugccagacacccagcuccaguuggcuuuuccacacagcugacuggugcugacacgugcacuacugcuuccuuagaaagccaagugcucucccuguccuccugucauuugccauucauggcacuuugcugaacaugagacugaucuugacuuuuuuuacaaaugaaaauuccuuccugaugggagcuaucauguauacccaaauaaugaccgacagacacacacacacacacacacacagagagagagagagagagagagagagagagagagagaaagguauaaucuuagucuagugguguugugaccccacacaccuuuaaucucagcucuuggaagguacagacaggcagagcucuaagucugaggcuagccaggucugggacuucacugagaaacccugucuugaaaaaaaacaggcgggggggagggggggaagaaagaaaaggaaaucuucauguauguagugacuucagaaaauacugcuauucuagaaacccaguuaccauuaggaccaaacuucugaagugaucucucugaagugagugauaaacccuaguagaaucagaugggcaugaccggaaucccagcaucuuuaaggcaggagaauuauaaauucaaggccagccugagccacaucucaagauccugucuuuuuuuuuuuuuuuuuuuuuuuuuugagacaggguuucucuguguagcccuggcuguccuggaacucacuuuguagacuaggcuggccucaaacaagacccugucuuaaacaaacuaaaaauccacagaaacagaucaccagaagaaucugacucugaggcaucuugggcagcagugucuggcagauacagguaaagacgagacacguuuucuagcagaugccauagggaagaagugacaugcuuuacaaaauacugucacgucugugugaaaccaccaucacuuugagagaguugacgccccucucgguccugagcuguguguaguguuuugguuuuacugaguccagccacugacugcugcccggagagcacugcuuuacagccucucacucagccguggugugcccuuuccuagggcuccuguuggcucucgggagagagcgccagcaaccacuuggucagcuuuccaccuuuauuggucucuugcccuccagugauucacucuacaucugaauuucaggucucucuuuuaccucuaccuaaaguaaguuuugaaauaaaaaucuauguuuaauauuauaaaaauuuuauggcuaccucuuauuuuccauuaucuuauuuccuucuguauaaauuuaugucaauacacauauagauuaugauguucuaauguuuagagaaguaauuuuuuucuuuuuuucuuguuggccaaggaucaaauuuaggacgguguuucuguuuggcaagugccguccccauugagugauugccagaccuaggcugcaguucuuaaguaaucacuagggcagagaccaugcuaaauugccgaaccacucugccaaaaguuuccuugcuuuacuucaucccugucacggcauucacccaccacggccagcccuagauacagugacacaccuaguccaacaaggccacaccuccuaauugugccacucccugggccaagcauauacaaaccaucacgauauuaucccuuacugaaauucuuuagauguuaacagaucggcccaaucacuuuauuucauagacauuugagaaugauugcagguauggguuauguuuaguaacccagguuuucccuaaaguccggggugcacucuuacguugccugaguuuagacuauugaagugaugagugcaggacuguuggcugcacagcuuucaggguuucccaguuaguguguccucuccgcaucccagugugggucauauuugcauuuggugggugugcuuuaaccauaggccgcuccucagacuuaacguuucaccguguugacguuguugcagaaugcagcaauucugugguggacgccucaguuaaguccuaauuuauguuucugcauaaugaagugcccuauggccuuaguguaacuguccccacccuaguugaacaguagcagcuuguucuaguaucugugguagcuuugaugaauuaguuaagcugcugccugcuguuuucuucaccagauuuaccggcuaauguguaauucagaugcauaucacugggaaggcaccuugaagcacaccuuccucauuaugcuucaguguauucauuuuaguagccacuagugauucccccaccaugguuauuaccauuacaguugucaaaugaugccuagguccaucgcucguaaacccauuuggaguucuguugugaggucaucucucuccucucgcuuggcauuucaugccuuugcauuugaauggaguuguacauuccuucuguguucuuaaccuuaggugugacucugucaaauaccuuggguuuuuuuuuccccccuuggguuguucuagaucuggcuacuagaagcauuucugucugacuucuugauaucucucuuaaauuuuugaauauuuuauuuuccuguaccaugaaauguuuuauuuccucuuguacaaaucuggauucaucucuuucucuuaagaccagauugauggugguuuuauuugucuaaauauaugguugaaauauagaaaccaaaacauugauauuagauuaucuuguuuucuaaucacacacuuggcauuuuguaugaccacuuccauuuauauauuuuguuucuucacuacauuuuguugauauauauuugaaauuuuauuuuuauuuuuuauuuuuuuuuuuuuuuaaagauuuauuuauuuauuauauguaaguacacuguagcugucuucagacacuccagaagagggcgucagaucuuguuacggaugguugugagccaccaugugguugcugggauuugaacuccggaccuucggaagagcagucgggugcucuuacccacugagccaucucaccagcccagaaauuuuauuuuuaaaaaguaguggucuaauucugugguuuugucacggaugucaggggugaggucacucccugaagcacacaugcaugcacugccacagugauucuuuacuguguguguggcauuuaagaaccuggaguagaauagguuucacuucugugucugacccaguguuaauggcagcgaggugcucccacuguggcggauccuguaugguuuguauuggaagcuuugucaccugugugugugucaucugcccacucugccucuacacauggccuagacgucccagacgguccuccccugugcuugcugcugccggggcauagacugaccucagguggaggcuuacgguuugccuuuucucaugaguuuuugacucuguucuacauugacucaagcaaguuuugcugugucauuuaggacugcccuuaauucuugggagcuggaguuuuauguuuuucagguucuuguauucuuucacaauuucacacuuaucuguaaugugcucugaugggauucuccuccauuauacuguuaccccuccuaccaagcccuccuuccuacccagaccaugaggcuuucaucucucucucucucucucucucucucucucucucucucucucucucucucucucucucugucucucugucccugugugugugugucccuguguguguguguguguguguccgugucccuguguuucccugugugugugugucccuguguguguguccaugucccugugugugugugugugugugugugugucagugucccugugugucccucccguccgccucagagaagccugaucagcagucugagcugcaguuccugcuuugauggguuaccuuuguuuggacuguuaguuuguuuguuuuuguuuguuuguuuguuuuuguuuuguuuuguuuuguuuuguugguauucgcuguuuuccaaguuguugcugcagcuugugaauaaagaaaaaagcacucccugcucuccacacugaccggugcucuaugcuccugcuggggcugaaggggaaggaaagugcauagaagccuuggagaaggauguuucuacuggcucuugcugcaacccuaauuaaugcaguggaucccccaccccauugugaaagaaaacaugaacuugaaaaaaaauauucaccuccccuacacgcacacaaaagacgaauuuuagcuacaugucccacaucuguaaucccgucacacagaaggcugaggcaggaggauugccaugacuuccaggugagccuagagccuaugagagccugucuuaagaauagcaaaccuaacaaguccuuacuguuuuaaaacuguugauaguauuugcauuguaaaacaguuaggaagcaaauacauugaaaacaagacagugagcacccccuucccacagggcuucccaggagugaggcuuuguucuguaagucagggguugugcauaggcaauguucuuccugguuugcauacuugagccgguuacugcuuccuucuuuguaguuuggauguuuuucuaagucaauccagauuuugcuuuaaucagaagccccccaccccuuccccuuuuggguauuuuaggauggcuacaacuauuucagaguguuuuauaaauuuuaaugccaaaagauuguauuggucauuauuuaauggauucuuaguuuaaaccacugcucaccaaacuaacuuauccuacaaacugcaguuugaccauugaauaaaugugcuguauaaaaguuauuuuuaaaauuaagcuuucagauuaauuuuuuuaauuaauaaauuuaggacuguuuauucugccuuaugguagguaauucaucuucucuuuaguggugucuuuagggacugaugucucuuuuaguagugagcauagacauuuggaaguaucuguuagaacuuguuaggaccagacagucaucaaacauaagauuuuaauggaucucguagguggcuggcuuccagcuguucccauuaucaaauauaagaugugaugugauuggucaucuccuguuaguuauacauccauauuucuuguguuaacgcaguagugagaacagguacagugauguuuaaagaaaagaaaccauaaaggcaccaucagccaguuuugucaucguguggacauugcagagcacaccacacagacugagaaggcagccggacauugugggaacacuggggauacccacuccguccuugacuaaaacguagaggaccacacaccuguaaggacugcaguaacaaguguaaugauauuuauauuagaacaugaaaauuugcgggaaaauguuuuuauuuucuugcccauagucugaguucagauucuucaaguuuuuguuguuauuguuguugauuuauaaauuauaucuuaggugacuuacauguaaacucagaagagaaugagaaaaaaauaaaaguaaccagguuuuuguuaaucauuuuugagauuuguuuugucuuagcuuuuugaugaauauuacuuauuuuucuuacugcagucguacuccaaagagcaccugcuagccuaguuuauugauaucugccuauagucucaacacucuggaguuugaggcaagaggauuacuaauccagacaaaaaucugucuaaaauaaagugagauaaaauugcugcguuaaaggccaguuucuggcuuauguaguuaguucuggggccaaccugaaguaaauuaaggugucgcuucaacaaauaaacaaaacaauagaaaacuagaaaccacaaaucagcuugcauuugugaaccuucuuauguuaggaaaagaacuuagaggacuguguucucuguguuggauggguguuaauguucucguggggugguacucaggggugggccgauguacauugggauugaaguauguuuuugacaaaccagaugggugccuagacagaauagaaggacagaugcuauaaaauacugcucagaaaucuggagaaagguguaaagguuucuccuuaucuuuuccugaaacuucugaaaauuuaaaaucacuucaaaaguuagauuugauguugagaacauuuggguaaauagcuugaaaauuuaaccgaguuauggugugaguuaaagcuucaagagacuuuugaggccugcuuuaaccccuguuaggcagucagcuagcauguaccaugcaguaauuuucuaagggcuggucagccuaaguaagagguuuuguuauauugcacauagacagagucuucagguugggcaucuucaccugccaugguaguuggucauguuguuagacguguuaaucugccaugggguaguuagucucaagcucucacuugagaaucauacuaacguaagaaaacucagagaagaaagacuugaaaauguaggcuuugaaguuaguguguguguccuacuuaaaagugacugcgugguccugccagugggcucagcagguaaaagagcuuuuaccugcuagcuuuuacaucacuagacauggcuuuaguuugauccccaggacccaccuaguggagggagagaaguugugguccccauuacugcuccuaugaccauggauacaauuguuaaacauggguguuugagggcuggacaugguggcacauccuaacucccagcacucaggaggcagaggcuagaacuuaggcaaccuggccuccagacuacaaggugaguuccaggagagccagggcuauacagagaaacccugacucaaaaaagggguugggggaggcaguuugguuauuuuugucuucagugcaagagaguguuaaguuccaagaaagacaaguauggaguugugagacagucccaacugcugcuugcugucaguagucugcagaauugcaaagacagucauaagagcuccgcuugguccuuguuuacccaagagccuuauaaaaaggucuccuuucagauuugguguaugugaggagcgggacuacaagucuaaguuucuuagugaggaaccugugaucaguaaagaaccaagcuuuucuccucuuagaaacccugcgguuaguuguuuauaauagagaauuauuucaguuuggaucugaauuugaaugcuucauuuauuugaauacaauucuuuugacauacucauuuuaaauuuauagcuaguaucuauaauuaaugagucucagcuucugagacauggucuugcuauauucccaggcuaaccguguuuccgugccagcuucucaagugcuggggccacaggccuuugccaccaugccuggccugaggaaaaugaagucuuuaaacaguggaacguuuuuguguagacuuuaaauuuguauuuauguacugaaaccaaacaguaauuagaucacugccaauuuuugguuuuauaugaguuaacuuuaaaaaauuacaaagugacuuuaauuauuaagcaauguuacuaaaagccauuguucuagcuguauuuaaccauacagcccuagucuuaagaauuccaguuauaguuuuaaagugaauuguuaaugauuuuaaucuucugccauuuuauucaugucugcuguagcaguuuuuacguugauugauucccguuguguuggcaaagaugcccuuauagaagaaggguguaacguuggcuaaaaucagcugagacaacccagagagggagugugugaucauaccuuggcuucaaguuuuugguaaaaugcaaauggcacaggaguacuugggaggcagguggaucucugaguuugagcuugccuggucuauagagugaguuccaggccagucagggcuauauaaugagaccccaacaacacaaagaaagcaggagaaagugugggggcagugagcauaucucauugaauuccuguguucuaacucuuguaaaacccacugugcugugugucugccucuggaugugggauauugaucccuugaccagcuguggagucuugugcaacucagcacuguaaaccaugauuucucagugguagguaagcggagagacucauugccucagucaggguuuccauugcuucaaugaaacaccaugaccaaaaagcaacuuggagaggaaaggguuuauucagcuuacacuucuacauugcuguucaccaucaaaggaagucaggccgggaacucaagcgggcaggaaccuggagauaggaguugaugcaguggccaugggugggguggggugaggugggggugaggggguggggggaugcuguuuacuggcuugcuucccauggcuugcucagccuucgaucuuauaaaguccaggaccaccagaccauggauagcaccagccacaagagcucacuaauugagaaaaugccuuacagcugaaucucacggaggccuuuucucaacugagguuucuuccuugcugacucuagcuugugucagguugauacaaccagccagugcacauagaacaugcgugccuagcacauggugagauugcuccgcgcuccauuaccuuaaauguguugugugucaauuggaauuauuuugcagaggaaauaagaaaaguugaagugcuauugauacacagguaacaucuuucauuaagcucuaaaaauaauuauagugcuguuugcauuuaagcagguuggaagauuuuuuuuuaauauugguauuuguuuuauuuuaauagguaucagcagauauugcauacaaaccugguauaccuugcuacaauagcagacucuaaucaaaauaugcagucucucuuaccagcaguaaguaccuaugcaaccaugugggugaaugucucugcccccgugugaugucaccggguuuuguuucuugaaugcuguguuguguuacucgucugauuugcaugaauucuccccaaaugcucccuguugguuuauuuuaaauuacugaguaaguugcuaaugugccugggauauuucauuucaguguuaaccacuuccacccgaaucucuagcuaucaggacuguugaccuuacaacaauguaaaccagauugccagggucugaacagaaguuucucaacaaacuucugugugauugccucaaggccagacaagauccuggaguggcacuggcugcuuuaucugccaguuuaugcuuuuguagcuccaucuguuuguuggacaaacugagucacuugcugugcagccucuaucacacucuggauucugucuuguagaaucuguagcuauaacauguccuuccgucucaguggcacaaacuggugcguagguggagacucagcugggcuugagguuguucuagguuuccucuguugggucaagucaggaagauguguuuucaggauccgagauaccaaacuagucagcuauuacacucaagacucggccgggagcagcggcuuucaaggcguuuucuuuccuucuuguuuguuuggggacuaagacucagggaucaguuugaaugcuuggacauuguuacuacaagauuuuuauguuuacuaggcccuuuuaguugacagaacuagauuuuuuuuuuuuuuuuaaauacugagaucuaagaugguuuuaguuaucuuauugagaugagguccuccuggccgaggcuggcccggcauuugcuguguuuacuuuccuuugguugcuaaaggcaugcaccaacacgcucacuugagaaacuauuuuaccuggcuuugauuuugugguuaguaucuccugccuucauccacaagcuugaaguggaucaugugauaaagugugcacagaacuugugagccaugagagcaggacccuugaccuugacccagucugugggauacuuuugaauaugaaauaguuuguauggguauugcuguguacuucauugcccuugaguugauuuuugcaggcagugggugcauuuggcuugcuuccuccuguguggcugauucucucucaguaugcuuggaaauggccuuuuuuucaucuaguuucucaaguauugguguauguguggaccugugucuggccuuuguucuguuggucuuuguaaggaaauuccgugacgucaucaccccugaccacgcaguucuuccuucuuccccuccucaagggugauguuucuagauuucucacucugcuucauggacuuagugcuagguacuucauucagguguguguguguguguguguguguguguguacaugcaugugcaccacagcacucauggagaucagaggacagcccaguucuuucugccuuuuuagaguucuagacuugugcugcugagcaagcgccucugagcugagccgagucucuggucugucuuuguuuuucugugccuagcaucugcaugaugugcgugcaguaggguuugaaucuucgcuuccaggacauugucuuuagcuccuggcguuuugcucucuguauucccaguugugucauuuguuuguuccccgccaguccugacuccucuguucuuagaagagguagcacaggacaucgcugucugcucugaccucagagggagagauucaucugaccaguaugugugauguugacuguaguauucuguagaaaacuauaucgaaguaaaagucugcuuugguuucuggugugcuaacuaaagcguguauuucggaugaguugcacuuaacccagugaucagugcuuucuucuucaggcugucagugugguacuuuacagugguaaacugaccaauaacuccuaccuaagaaaggacuucacuuuccugagucugucucacuuggucacggccuuugucuuuuuguuuuuguuuuuugaggugggacaucuuauuguagcugagguugguguggaacuugcuguguagcccaggcuggccuugacuuccugcuuuugcuucugaggcgcugggauuacagguggaugugugagaacgcccagcuuggucacuguacacaauaccuguuguauuuggcuuuaucaggguuuuugcaucuuuguaagugaucucucuuuuuuuaauugauuguuacagacuucauaaaaugaaauggaauuuucuugcuuugucuuaugugaaagagugcugaaaugugacuuuaaaugguuggugugccucuguagaauaguaucuuccuuuaguuuccuuagcauuuuaaauuuauuuguauaaagcugaugaaauaauuuuuuaaauaauaacaauaggacuauuuguguguuugauuguuugagacaggguuucuguguguaucccugguuguccuggaacuugcauuuuagaguacacuggccuugaacucagccaucugcugcuucugccuccugaguacugggauuccagacaucacuccccagcuggaaucuuguuuaccauaauugacuuguauauuuucuugugacuuuucugucagucgugacagauauaggugaccuauuuuuaaaauauuuuaauuagucaauauuuggcuuugauuuuuuuuuuuuucuguauugaaggauuuuuuaaaagcuuuuuggacuagaaccccaucacacaugccaccaucaucgugauguuacuauugcaaauagguucucauguagucugggcuggccucaagcucacagugcacuuggguacaaggcaugcauaugguacacuguuguaggacaaacauuuuccagaggaggcacaauacucacccagauaggagacuaugacagcaaaguuuuaaguaccaccaaaggcuggcuugguaagccagugaguuuuauugagguuucuuacaggagcagaacugacuggaagacaguugcaucaccaaagcccaccccagcaugggcgacagcucacagagcuggggaccuggagcucacugcacagcuggcaggcagcuugcguaguccauugucgagaguguuguuuccaugugacccgguagacagucauuugcuagccacaugaaagcacaugcugaucuuaaaagaaggcugcuggcagucaccugucuugcuuuucacuuuuuucaaguuuuaaauaguacaacuucaccacuuagauagaguccuuaaauuucccuuuauuaaggguagcuguugaaaugacuuguaugcaaagacugaaaggcuggucucugaguaaaauugauuucgaguacauaguccuguauuuuagacaaaacuuucacuuucuggcuucugguuuuuaggugauguuacauuuaagauccugaaaagcccuugggugauaacgaauggcuuuucuuuuuuucuaaaagcuuuaguaaaguugaguuuuaguuuguaaguucacugagugcucuaacagagcaucauuuaaggcccuucaugucagaaauuuaauauagcuauuuuuuucuuuuuuauuggauauuuucuuuauuuacauuucaaauguuauccuuuuucccgguuuccccgucuccuggaaacccccaucccuuucuucucccccugcuucugugaggguguuccuccacccacucacccacucccaccucccaccuccccgcucuugauuccccuaacaggggcagcuauugaaccuucauaggaccaagaacuuuuccucccauugaugccugacaaggccauccucuccuacauaagcagcuggagccauguguacuccuugguugguggcuuaguccugggaguucugggguucuggggggguacugguugguugauauuguuguucuuccuaugagguugcaaaccucuucaacuccuucaguccuuucucuaacuccuguauuggggaccccgugcucaguccacugguuggcugugagcauccaccucuguauuuguaaaacacuggcagagcuucucaggagaaagcuauaucaggcuccugucaucaugcacuucuuggcauccacaauagugucuggguuuggugacuguuuaugggauggauccucagguggagcagucucuggauggccuuuccuucagucucugcucuacacuuugucuccauauuugcucuugugaguauuuuguucuccuucuaagaaggacugaagcauucacacuuuugucuuccuucuucucgagcaucauguggucuaugaauuguaucuuggguauuccaagcuuuugggcucauuuccacuuaucaaugagugcauacccuguguauucuuauacgagugaguugccucacucaggaugauauuuucuagauccauccauuugccugcaaauuucaugaauucaucccuuuuaauaccugaguaguacuccauuguguaaauaccacauuuucuguauccauuccucuguugagggacaucuggauucuuuccagcuucuggcuauuauaaauaaggcugcuaugaacauaguggagcaugugcccuuauuaccgguuggaacaucuucuggguauaugcccaggagauguauuacaggauccuccaguaguacuauguccaauuuccugaggaacugcuaaacugauuuccagagugguugugccagcuugcaauuaauguagcuauuuuuauaaguacaauaaguaaaguaaaagaacgugcaguaucguagcgcauucugaacauuucaguguguguguugccaugucacaugaagauugcaguguguguguguugccaugucacaugaagauugcaguguguguguuaccguguuacaugaagauugcaguguugugugucuguuggcaugucacaugaagauugcaguguguguguugccauguuacaugaagauugcaguguugugugucuguuggcaugucacaugacgauugcagugugugaguugcuuugucacaccuauugaucuucucauucccucugcuguugugaagugaauccagggucaauacucugauguuucaccugcgcuugcuuuugugucugucuguguguguuugugugcacguguguaugugccagggugugugugagacggucaggacaaccuuggguguaaguucucuaggcugucuagccugugaguuucugggguucucccaucucugccucacagcuccccaugggauggaccgaugcuuaugcuauguauccggcucucaugugaguucucuucuagcauggcagucuuuauuuggccuugccuuuccacaccaucucuaccuuguuuaauuuggcauuuaaaugaaaggcuuaaacacauucuugucugaaguuauggaacagagcccuaaguaugaauauuaagucaugucaucugucgacaaaauacuauuuuuccugacauacuuauucuuugacuuccuaauuucucuauuuaaauuauguguguuaucgguguaugcauguguaagaacuggugcccauggaguccacagggggaguuggauugccuaacacgaguguggaagcugaacgugggcucucuucaggaacaguagccuuaaccacugagccaucucuucugcucacuccuguuaguuuuuaaucuuaccuucuucgagugcucagcucauggcaugaccguacauccguucucuuguuucuucucagugcacacaguucuucagggaggguuccuuuaugcuucuacuuaacugugcucuuuaauuucucucuagaaauagacggauuccaaauaaggaguuucuugccugagugugagacagcacucuagcuuccauuagacacgaccauuugcauauucaacaggccuuucagcaguaugacaaaaacaaacaagaaccuugugacuguugugugacagacuuccuggggagacauggcgcacacaucccuucaccccuagaaagguagcccauggcagaccaaaguauggcugugguaaacuaguguuuuauugggguuacuuaugggaauauggguggaugggguuccuugcgggagcagaaacgacucagaauaccuggaucacuaaagcccaccccagcgugggugacagcucacaaagcuggggaaccuggggcucacucucgccggcagacagccccacaggucggagagcuuccuuuccaggugcucaguuguucugaguucuugugagcagcucaccugguuuuuguuuuguuuuguucuuuaauggagcuggcuguguucugcucuguucaggccgcugcuuuauccuuccaguucugugugcugucucagucuuccguacagcuguuuugggacggacucuuccuagucuucacugcgcauaaauucuuggggagggcuguguauuagauucaguacagauuaaaacaucaguaugugccugaucuucugggcgaggguuuuuguuuuguuuguuagcauaaaaaagaaacacuagaaagauugauuuuauucuuucaaaaauguaaaacaaagaauuuuacaugccuuaaauguuuauagccaaauggcuuaaauguguauuugauauagaacaauauguacuauuuuagaaauacugcguguauuaaaaauacauuuuaagcagcagaugagauuacuagcuuugcucaauuagggacagcucugcaaggaaguuguucugugucugugggcacugaucucucuguucacgugcucgaaaugcuaaugucacaggcagcauucuaccaacaggcugcugauuugucacaucuauuuaagaucuauaugaugccgccuggacuuuuaucuauuaaauucagaagccuguacaauugaaccuagauauucuuugcauauuggcuguacauuucugugaauaguguguguguguguguguguguguugucagcauagguauaaaauauagucaaaguaccucuaauggaaccuaaagauuauccuuuugacuuuaauuggaaauacuauuucaguauuccaguaguaagaaauuaauaaccuucuguuuuguuuuuuaauugaaugcaugugugcuguguguguucacauguaugugcuuguuguguguggaggccagagguugacgucuggcauuuuccccaguugcucuaggugguacuuuuuguggcgggugucuuacauagccugguccucccugguuuccuuaggcuccucggcagccagccccagggaccuugugggucugccaccacucacuuucuccucccaagguuugcaugcgugcugagaucaggagucagguguucauguucgugugacacgcacauuacgcacugaaucggcuccagccccagccccucuuaacauuuggacaaguacacaaaagucuucguagaaagcugucuacugaagcauugcuuauauaaauaaaaccaacaaacagaagcaagggucaguauugaggaugacuucaacaaauacauacaacuguuuaguagaguuuuacucuugaauaaaguuaauuuguauaauaauaaagaauaauguguauagaauuuuuaaaacuacagaaugguucuacccugcuuucaaauauucaacaaauauuuauuuaagucuguuuuguuucaauaaauguauaugcuaagcuuuuagauuuccuaauuguauuuguauaucacgcuuauaaaugcaucacuuuuguaauauaaacaaauugauagauguaaaaauaauauaaagaaugaauauaguugugcuaguuauuuuuguugcuauggacagaauacccaaacaaacaccuuacggauuaaagauuugcucuggccacaagcuuucagaaagcggcguguaauggccaccuagccccacugcuuuccagcagucuagaaugaacaugguggaggauggcccuggaaagaagugcuucaccuccuggcaaucgggaaaccaagagaauuaacagggaggaaacugggccaagguagacccuucacaggccuggaccaagugaccagcuccuuccagcuccuucccauggucccuugcuucagugcuuccaacaguccacucaaaauguaaaccuguggacgaaucaguggauuaaaguugguaggucagaaacuccgugaugugauaguuucaggaaggaauuccagagacacccaaagggugguuugcauuuuccugggcuccccucgagcagucagguugaccuucggggcuaacugccucacaugcucucuuucauuuccuuaacgugugguauaccuguagcuugcuggugagcauuugauggucucauauuuacaaggccacgaguuagauucuagcauuugcauauaaaaccauauacauccuuaaguacuugggccuggagaggugaagcaguaguaagaaagcuugcuguguaagcauggggccuuagugacuuuucuauugcugugauaagacaccaugaccaaggcaacucauaaaagaguuuauugggcuagaguccauggucgggagcauggcggcuggcaggcaggcacuggaacaguagcugagaacucacagcagagaaaacuaguugggguggcauggacuugggaugccuaaagcucgccccagugacacaccuccuccaggaagguccuaccuaauuauucuccaacugcucaccaacuggaacaaagauucaauguauagguuugcuuucuuacuuaaaauuaagugauggugguaccuguuacuccaauacuugcgaggcucacuuaggagaagccuagguucugugacaaccuggccuacaauaguagacccaauuucaguuuaacggacugagaauggcuguucaguaaugaguauguuggaguuggauaaacucagguugucaauuuguuauguaggaaauacuugcucucaugaaugagaaagugugaguugauugagaaccugguacuaaaucuggcgaguauccagguaguggacuaagcccgaagcaccccugcccccacugagacuugagccccagggagucuggagaaugcccccuaacaaauagaagugggagcauuagcuauggauauggaaggucacccagucaggucuugugguuagcacugagguuuuuugaacuagcuuucuagcccagggguuaagaugaaucaguuuugagaauuaauuggggacaccuaacuccugcagaaauucaauacgggucaugucaugauggcaugcauccugagauuucuuuuuuuuuuuuuuaauuagguauuuuccucguuuacauuuccaaugcuaucccaaaagucccccauacccaccuccccaauccccuacccacccacucccccgcauccugagauuucugugagaaugaauuaccaggagaggagaccuuccuaagcuguuugaggucgauguguguggguauaugauauauaaugaauaugugugcgcacaugugcauauucaucacgugugugcugugugugcauuuaccuuugagagacugaauuagggcuggaagguaaggugagcaaacaugcccccguaaggcugcgggccccggugaggcugcgggccccggugaggcugcgggccccggugaggcugcgggcccccguaaggcugcgggccccggugaggcugcgggccuccgugcaugaccagcuaaggcucuuguuuguguagcuuuuaccagcuuuaggcauguuaaguguacaugucuccuuuuuuugguuuugauucuuagguuucucugucauuuuagugccuccuugugggagcuuuauuaaugccaguuauacuacaacugaggaagcuaaggauuuuguuuguaguucuguguuuguagucuaaaagagauauugaaaguaauuugauauaaugauguauagcuuuauggaaaacuaugaaauuuuugagcucauuaguuaauugaaaauauauuguuuauaauaugucuggcuguagcaaguagugcuuuugaagugucagugaacaaaacagccagaaauucccacucucuagggucugucuuccaucaggcaaggcaggcgcaguaaaagauccuugcggguguugaaaaguggugggcuguggcaaggaaaggcagagagcaggagagguguacuuggguacuggggguugcaggaugguauaugcauagucaaagagcugcacaucuuugagaaggggaccugggaacagaguaaggaggcacgucuacagaggauugcuucgaggacuauucuuaggaccuggguuucucuucugaaaguugagaaguuguucuaacgggacccugugcagacucaggaggcagcuguuaaaccagagauguggcaguagccauacccggauagaaguccaggagguguagacguggguacaucccagguuagaauagaggccagcggggaugagagaggcguugggguggccucgccauuuucaggguagaacuggcuucaugagacuugagcaugggaguugaugaggccuuugcaucuguggcauuuccaggagaggugaagggacggugcagguaggaggagggcugguguaagugugcugugagcaugcucagagcccuagcagggcucugcucagugaaaggccuagaaucuaggcuucauaaucauuucucaaauauuuaucaaguugauacuggaugacuggaagccccgacaguuagcgaguaauacagugguggcucucaccccuauuuaagcuacugccgaguagaauugacagacagugagcacugacaugggaauuagaagggagcuaagcaguggaacggagagguuccugggaguagacaguguggccaguuauucucaugccgggaaagggagcagguaaaguguccuuuuacaugucauucauacacaguaacgccaucccuugaaggguauaggugacuuuacuacucgucagaacaaugcucucauccccagaguuucuagugucccauucuuggcuaguuucuaauucuuugaccuuuuuguaauugacuguaggaguuuuaaaaauaagaacugaaccaaugcugggcuucaaacccaggacccuauaagucuuuguuaucuguguuucucuuacaugcacuuauuacacuuugaaauuugccauggucugcuugaaacaucauugcaugaauaguucugauguaaauguuucucuuccuguaucaagguuaugaagguaugccugcauuuccuucauuuauucaacaggugggggauguggcuuaguggcagcugaccagcacgcaugagguccuaggucgaguuucugguagggacaaaaaggaagguuuauccacagaucacauccaucagcaccacuuacuggaaaguguuaacugcccacugacugucaccugcgggucucuuccuguacgcgugaguucuccauuacagccaacaucuaggcucuuguucugguuugcuugucugucuuugcaccaagcacaugcuuuuauuauuguaguuagccuuccuguuugcuaguaauuguucuuaagauugcccuggauacuccaaaucuuucacguguccauauagauguuagacuuucugggacaaguguuucaugucaccuguagguugaaacccauuauccuuaagcauugagcgaagguggcacauccuuccgugacaggcuucuuucccaacaguguucccuucagauagcgcacaucucuucucgagauaagugccgccgucagguggcagauuagccggugacggauucacgcacucuguaugugugcucugucugcauccaugaggaagcagugaugcgcgucccuuccccaguuuguuguuguuuuuuuuuuucuauuuugcuucugacauuaauuugcuaguugguuuauuuuacuaucaguguuagguaaauauuuuugucuaucucuuaaacugugggggcaagagugcuuucaccaauaugauaguguuguaaaguuuuguuaaguuuuauuugguugugaaugguuauuuuauauguaagugggagcuguggggccguggugugcugugggaucggaggacacuggggguggcucucuccuucuaacuuaaauggcuucuuggggucacucucuggucgucagacuuguauuuuggggcucaagcccccuuagcugccgagccaccuggccaggucaacuccuguucuuaauugcuguuauguagacguauuaaguuuaucagagccuucucuucaugagagcucuguagacuucacucugauucgcugcacugugucauuuucacaggucaugcccugacccucaucccuggagugacauugcuuauguuacucuggacuugauuugccucuguuuuugugcagugguuuuagugucugaaaacauguccuguagccuuucuuccugaaguaucuuugucaaggaguaaugggcucauaaagaauugguaccugcucuccuuauuuucgauuucugaaagguuacauaugaauuucuauuuuuuucuuuuuauuuauuccuaagugacuuagacauaaaacuacaauaaaagcucaugaggagauuucuucaggaaagguuuaaaucguggauggugguuuuugcuuugcuuugguuugcuuuguuuuguuuugguuuugguuuugguuuugguuuuucaagacagaguuucacugugcagcccuggcuaugcuacagcuagcucuguagaccaggcgggcugaacucagagaucuggaucaagagugccuggaaaaaaagaaaaaaguucuuuucuuuuuuuaacagagaaauuuuuacauuugccucccuccuuucuuccuuucuuggugcugggacagcccagggcuugccuuguguuaguugcccuagugcacacguguaaaacuggagccaugucauggccucuucugugcagccuuucuccuuugcugaccuucaggcaucccuaugacuguguuucuguguggccaaauaguaccccacuuuaugaucguccauuguuuguuuaucacuuggggguucuucugagggacucccugagugagugcuuuaucuacacauugugccaagacuguguguguucagcccuggaauauguacaggaguuggaguuaccagauuuaguguuaccuccguguuaagcuuguugaguggugacgacauuugccauggcgccuguauccucagcaggacguguggguuucuguccgucuaguuuuuacugugauaguguuacagccauccugcugcuguuggacauuacuuccuguuuuuccuagugcccugugguuuuaaccgaacgucagacguuguggcuaagcaaaagcaguacacaucgguguuguuuucuuccaaagggagccauuugccuuugguguugaaauacccagagauuaccuuaaguugagugaggcucagguuagacuugcuaaggcugaucuauuaaguaugacgcuagucucagaggagauugugaccucuccagcgagcucgagcuucaugagaaccccugugacuuugggccugccccagcagucagucaccuuccagccaucugcgucacugucaccuccuggcuacuguuucccugcuucacguggaucuucugaacuuuuauucuuaaauuuucuuuuuuucugguugucagagauuccaaagaacucuagcuuucuacugggcucaaccucugagcucaacacagucaaagaaaaguccaaggucuagcguauggucuugcauuuauuugaccccucuuucugaaaggguagcuuucaauucauucucccaaacuugcuuuguagagccuucagauugugucuuguuuuguuugcucauuuguguuucccagcacuuauuagcucucauuagcaggagaguuuguuuguuauaccuuguaaugaugauagugauucgagaugaauuggagauugaauuacaaucagauuggaauugagguauguaauuaaaagugagauguaugauuuggugguuuuuuucuuuuuaaaucagaacuaaauuguugucuauaaagguagacaaagaccugaagaugagauuuaaaaauucuaaagguuagugauuuacuggauuugcuaauaaagagguuaaagguuguaauuuuuuuucuacgugcuguuggcugaagaacagugugucugucuucugugugcugcuguauucacaucuggaaagcuacauaguaacuauaggugguaaaugugaggaacugcuggacuggacauuaccauaaggucuggaaggaaagggcagggcagauagauguguggauuauaacugaguacauacgugugugcgcgcguguguguauuuauuuauauauaugcauauaugugccuucaggcugaaaugaggauuuagagagaaacuaaccagcuauuuuccuuuucccccauaagaagggagacagguguugaagguguguuugugugcaggcacaugcaugcgcauguguguauguguauguaugugugugcgugcacucucaugugcauguccuuucacucuuuugugaacucucagguuucgugaguauuuucauuaggauugucaaaguuuagaggccccuguuuagaggcuaccuguaacauucccacccuguaguagugacuagcacagagcuauugagccaagcugccagcuccuauuuaaagcauucucccagucccggaacuuacccucuugacagaguucucugagacuucuuguuccuuugauguauuuugcugcuuuuaucuccuuugcagguaaaaaucuacuauuaguaaacaucuagauaucuucauaaggaaaggacacuuuguuuuuuaaauguaacuuaaauaacaacaauagacacauuagagaucauaaauaaaguuuguauagccuguuagaaaauuucuuucccugugagauuuuauaaguuaaaacacacuuuaacuguagucugcuuuccaaggcacugaaguuaugagggauauuaaauaugauauuaauaaaugcaucauugaaaugcaucggaagacacugaaauggauuuauuguuuuguuuauauccaguuuaguaauauagacagcagugauucuauaugaaucuuucauacauuauucugccguuccucuuguuugacuaagcugucuucuuucagccgcccacacagacuaugccaauggguccuggagggaugagucagaguggcccuccacccccuccccgcucucacaacaugccuucagauggaauggugggugggggcccuccugcaccacacaugcagaaccagaugaacggccagaugccugguaaguuuuucuccucuaagacauuaacaccagaguugcuuagcaacuggaacgacaugggggcuccggggauacuagauuguugaugacaaaacugcuuugaaugcccccgaguacaggcucgcuucgaguuuguuagcuacagagcgacgugaccuguauucaguguuuaucaggcugcccuugggcuuugauguagcugacacacggcauuccucugaugaacagaacuggcuaaauuuagucugucugaaacuaugcaauacagucggcuuuagaagcuuuuggggggaaagggauugugccauugcuuaagaauuaaaaccuguucaugaaaaguaccauaauguuuauuuaccugaaaauacauugaucucagaaguagggacacugcaaaaccacauggggacaggaacagaauugccccugaagugccuaggguauuuaguauuuccuugcagauauuccugaagccaaaucaagauuguuauuaguacauauguuuauagguuauggcuaaucugaaguugaauuagaagcaguauuaaaagcagaaggcuaauguaagcuuucuuaacaccgaguccuucccuuuaccugccuggcgguaacagcagaacacugaccugcucaggccauuggguguuuaucugguuaccuuuaaaacuauuguuuuuuauaauagauaguccauagcauagguuuugauaaaguguacucuuccuuuaauaugaucauauuuuuacguucuggggccaaagauuauuuucauuagccagaaagcaaagagcacuguucaauuaccaauagaguaaauuaacauagcagaaccauuuuauuauuagccugauaauugaaauguccagcauagucucuuacuuggcuggcugugccuuugguugcauugguguccaaggaggacggacauacuaaaagaauccaagggagagcacugagccacgagauaagguaggcugcuuuagaagaucggugugcagcugcuaaugcuggcgguaaaugguguuucugucacucaucuguuuccugcuaagguucgcacaggauggagggaugagucagaguggccccacacagcauggagagagggguauacacagacuacguuuuagguuccgguuaggcuguaguagagggaaaguugcuugccaaguucaugucuggcucuuaggacagcagcuuuagaacugggacacugugagguugugugguuuagaacauuagccugcucuccagauuacagugaggccuaagaccaacgagaccucugagaaucaaauaaguacuuuuaacuugacauacugguucaccuauaaagcauuauguaauagagauauguucuuuuuauuaaaaguguuaaaugcugcuucuuauguauguggcuguguccggaagucagggagguuucggggucucuguccgucuuguuccuacuguagcugugugcucaggccugcuggaaaacugcuuuuuccugcuaagccaccucucacacccuaagauuaaagagcgaagauuaucaacuaaugaggagauugucugcacuacugcagagcuucuaaagcaaucucuaaauacccauuacugucuuaaaaguacagaguuuacucuuugguguaagagaauuuggaaggccaauagcauauauuuccuuccaugaguuuaauuuccuagcauaguuuuuguaguucauuuauaucaccuugauuuuagugucacuuacaucauuugaucuuggcuaaaaaaaucaaucacagcuuuuuuuucccuuugaauuaaauuuaucaaaaagaaauuuaucauuacugguuuguuuuuuguuaagccuagaagguaaaucuccgugcccguggaaccaaaaucaaagacauagaaguccgucccucaaccccuugccucuccaaaugcuugggucugggucuggggagaaagaaaaggggcucguguagauuuugguuuccucccucccucccucccucccucccucccucccucccucccucccuccuucccucccuccgucccucccuccuucccucccuccgucccuccuucccucccuccgucccuccuucccucccucccucccucugucccuuuuuuccuuccucccuaaaggaaacacccuuuacauaagcucuuccuucagugucuggagaacugucucauucucuugguggccaugcugcauccuuuuuuuuuuuaaauaaaaauguuuucccuguguuugucugucugucugucuggacuguguguguguggugcccggggaagccaggaaaggguguaggaucccuugggacuuuaguuaccaacagucaugagucgugguggguucugggaaucaaacccaguguuccgggaggagccgccucuccagucucacauccuucuugguggaugucucuagucuauaugccauuuccuggugacagaaaugaagcuuaaagucuuuugguaugccuaugcacaugcauauauuuuugcauccauacaucuguguaccccaaaacuuuguaccuguauguuccuagaaguuaaaguguuggauccuaacuacauuuuaagcuagguguaguggugcgugccuguacucccaacaccugagguggaggcucaggaguccauacucacccuuuacugcauugugacuuugaggccagucugcuacagaauauuugugucaucaaaccaaaccaaaaccaggacauuuuaaaauuugccugucauugcaaauuguuucauaugaaacaguacuugcuuagauuugcauuccuucagcuguguaugaaagugauucuucauaaugugcugggucagagguuugaggcagggucccccugaaccuaggccucacugacugggcuagacuagcugaccagcaagcccagggacuacaggagugugcugucucccccugcauuuuacauacaucccagugagccaaacccagccccucaugccucaugguuagcacuuuaccaauugagccagguccucaacuucuacuuuagguuuuucuguuauguucaaacuugcuuuuauggaguuaagugcauccaucuaacauggcucugagcuuccaagcguacucaaggccuucccuuuccagcauuguuuccaaaguccucaugcuugaaguuaguuuuuaugcuuuguuuuucuuuuaauauuuaauucuucacuaauuaauuaguuaauuaauuuguucacuuuaucccaauauccaguccccuucuucucccagucucccccucucuccuucccuucucuggggaggggaguuuuuuauacauaugaaauuaguuguagggaaggaaugagguagggaccuuacuggaugcuuuuuccagcuguccccgcccucuccgagaacucucugucuguggcccauagauauaaaugcuaccguuauuguuuacuucuaacuauuuuauguauuuggcauauuuuuacacucugugcuucagugaccuguugauucaguugcuugugucugcuacuacuucacaguacugcucugugagucuucgcuguccuagcaagcuugggucccuuccuguuccaccaucaguuuccucaucacuaaccugggaaacugacaacauguaccugaucagaguuaguucccauuuaagcuguuugcuuauuuccuguugauuaauuacucaguuuguugcuuagacuguuaguuccguaaugaaaaacagacuuguaccaugcaccuccguaacucuguccauucugaccauuucucuuugaagggccuaaccauaugccaaugcagggaccuggacccagucagcucagcaugacaaacagcuccaugaauaugccuucaaguagccauggcuccaugggagguuacaaccauucugugccgucaucccagagcaugcccgugcagaaccagaugacaaugagucaggggcagccaaugggaaacuauggucccagaccaaacaugaauaugcaaccaaaucaagguaacuguccacagcacuccugucccucucuuccccagcuccagcuccuucacaccccugcucccgacucaggaucgcuuucuucuuauuauugggggguagcccacggguagcucaucacucagguguagggauuccuugugggaucuucucugugcauauugccauuucaccuggcauugucaugcugcuccuguuuaggcaacuguuuuuuguuucuguuuuuguuuuaaagauuuauuuauuguuauauguaaguacacuguagcugucuucagacgcacccaaagagggccucggaucucauugcggaugguugugagccaccaugugguugcugggauuugaacaggcucuuaccggcugagccaucucaccagccccuuaggcaacuguuuuacugagguuucauagguacguuuucccugugugucuaguagacacuguccgucaccagcuacccuaggugucuggcucuuacagccaagcugguaugaagggggggcuucuuaagacacguuucuacucuguagcugaggcuggcccacacuuggggaaguucugccucagcgucuccauugcugcgauagcaaggggaagcccagaacugaacguuuauguuuuccuugagucgaaugucuauuuguuuuggucauuugaggcagccucugucuuaagugucaacugagucacagcugugcacaugagagacaacguugaguugaagcugccccgagucuuuuuguguuuguaaauuaaauugcacuugguuugccuuuugcaccuuuuauuugggguucuguguuggauuguuucuuaaugcuggccacuggguaaguuaccuaagcaagcgggcacaccaucugcccucacaagcaagcucgccagccuuguucucuuucacuugcuggggaacuucugguaacuccagauggcuuuucugguguuugaggcagggaaggguuugccuuccaguguuuagugggggugccucugcaccccuagcuagcuacuuagcauggagugcacuacaguuuauuaguagcauagugaaguuguuaccaugguucucuuuuaaguaaauaauaucuaaaagccgguaaguggcgcucuguucugcuaauugcuuuguuuaagcauuuggcacguuaccaccguaaaacuaucucacuauaaaauguagugagccucaaauuugauugauacaaaaaaaaaaaaucagaucacucagaggaaguuggcuuguguuaaaauuauuuaugaucaaauauuauaauuucaaaauacaaguacaguuauguaauuuggauuagaggugcucaccuuaccugggacccauugaaucagaagcugauuugacaaaugaaagucacauuaaaaaauuguuuuguuuguucaucauaaaaccuuuuuuagauaguuuuuauaacaguaagccauauuuaaauauuuucccuguguagacggcagagaucauagcacacggcauugcagguggccccuuuuuaggaagcuuaaaaaguucuaaagaugaaagggaacuguuuuugcauuuucaccucuuaaaaauuucuuucaggaccaaaaguucaguccuugguacugccccgccccaagucucagauuuaauaaagguuucuuuaaugcuuuuguuugcauuguaaauggcaaaaauccuuggacgggccucauauuuuaacauuuaucucuguauuaagaaacacugaaaaaaauacuuaaaaguaguuguauuguuuucuacugggggcuguuuuuuguuguuguuguuaauguuuuccugcauggaugccugugcacauguguaugucugcuaccuuuggaggucagaagggggcauccccaggaauagaguuaguggacgauugugggucaccauguugaugcugggagccaaacccaguuccucuguaagaacaagugcucguaaccacugagccaccuuuccagccccuaguuguucauuucgagauacaguuugguuguguaaccuaguuggccuuccucagccugguuaauucugggaugacagucaugugccaccauuuuuuuuauuaacagggcuuuugagucauggaaacuaaauauucuaggaaugugaaauucuaagaugcagcuuaugguuaguagucaggagcguagcucacugguaggaugagcucucagugcguucaacaccguggguuugagaaaagggacgaaggaaggguuugucaagugacccaucacaauugaaaaaaauaacagcuucgaguucuguggcaauuaacuagugcauuguaucauuugcuaauguguuuguauuccugcauaaugguacuuuuauaaacugacuguuuauguuauaguuuucucuucuugcuggggauguacccacaaguacacaccuaccacacaagugcacaccuaccacacaaguauucuaccagcgagcuacaccucucaccuacccgcaaccccagaacggcaguagguuccuaacaggaacacugcagggagagucuaaaugcauucauucugguaguguuuaaacucauuucccuccacucacuuguaaauugaaagaauucugccgccccuucucaucuuucuacuuugaaugugauauuaaagggaaaaaauacucuccaauuucuuuuauuguaauuuuacuuauucauaugaaauaaaucuaacguguagaaauuuuacucacuuuuaucuuuuagguuguuuaagaaguagagagugaguuuguuagcuuacaccacuggggcugauguagucaggccaugcaguagagugaggcagaguggucggauguggaauccuuggacuuuaaggugcuggguuccauuacgcuauuuccauguauguguuuccuuacgccuuuucuagcuuguccaccugccugccugugcccagaucgccccuuuagcuccugcucaacacguacucuaguccucucccuuacagcagcuccagcucccucgcaugcuccccuugcuagugggccucaccaguaaaaacuggcuuuagcuuuugaguaguuugugagaaaguuugaaaguuagaaagauaguaacacauuguugauacuuaccuggcaggggagauaccaugaucacgaaggugguuuucccagggcgaggcuuauccauugcacuccggaugugcugaccccugcgauuuccccaaaugcgggaaacucgacugcauaauuugugguagugggggacugcguucgugcucuccccuguuaaaaaaaaaaaaaaagaaagaaagaaaagaaaagaaacuuguuaaaauacaccacagcaucugccucaguguuagcugcagaggcugagcagcucacuacagccugggaguaugaaccagccugagcaagacucuguaaaacaaauugaccccguuauauuuacuaguuauacuuuuguauauuuguguuauugaaaugcauauuagcagcaguuggcuuuuaaacagguuauaugugguaguauccauauauaugugauaguaucuaagugccucuauauaugugauaguauccauccauggacaugggauaguauccauuggauaugugauggcacugugauugguaucuacucucaguuuguugaguauugcucaucuagaaguugagaaaguagauuuuuuuucaacucaguuauuaaacuauaauuuuagcaaaauacucuccucugugcugucuucgagcaaauuuuaguauugaacuuguggcacaccacagucuaaguauaagacaucucaguaucugccuccccgucuuaauucagucuuguccaggugagggucuuccgucgucccuuggagccuuuacgguuagagccgugugcccguguauacaccugcauggagcgaggugcgguagaacugaaagccaaagaggccggaagaggggcuucucuguucacagccugaucccugaugcacagcagacugcuuggggucaugcacgucuguuuccuuaaugacuaggaauuggaacuaaaugucaugucauaaucuggaaagauguuuaaucaagcaaaaacccacaaaugagaacagaaaagccucuggaaauggcccacaguuguauuugcuagaagcaguguauuauucauucacaaacauuaaguguagcucgcuuuacuuaacagaaaugaaacgucagcuguaaagaguuccacaauuguuuugcguuaagaaugugcuucaagagcucuaugaacguaagucuuaggacuuagauuuaagcuucgagcuuggggcuuuugauaaauugauucaaauucuuaaagauuaagugaaguaggccagugugacugcgugguggcuacacaccccggagagccugagcuugacucuaaugugcuugugguaaaaggggaaaacuaacuccuggaagucguccuuugaaggcuggagagaugguccaguggguaaggcuggagagaugguccaguggguaagaggaccuggguucaauucccagcacccacgugauggcuuacaaccauccagaauucuaguuccaaggagacugaugcauacauacuuaggugcagacaaaacacaaauauguaauuauguuacaauuuuaaaaaguaacagcugacagauuacaauaccacagagaaggacacugguuuccuaauguguuacagcagaaggaucuucugacccgcccaccccacacuauuacucccaucgcuaacgguggugauaaccaagcuuuuucuuuuuacauagacauaaacauugacguugauuuuuuuucaauugucauagcgcagcagcaucgucuuaacuuauuucuauucucgagggcuugccucacuugugaguggagagcaagugugagugguuuccaacugccuuuagguuuugugacuuuugggagaacucguagagcacagcugagugccauucuacauguaauguguuagguuauugucccagggcacagaccacaugaggaagcggaagaggugcggaggcagcauccagaaagggcagugggaugaugcuucuguucucuccuccagcaccaggggacaucgcucaccuagcgcgguuaugggaagacgcacacauaguuuaccugugcuggggacucuauuggguggguagauuugaucaguagauuagccccaugauaagucuacauguaguuauuaguccaaacuccaccuaaguuuaggaacuguaggacauccaauauagaaacuauagacaacuauaguauaugggacuauaggggaguguuucccguacuggccucacuacuaugaaauuaagggagcaaucgcaagucaugauucacucacuaaauuucaagaauagaaaguuagaaaacaaaagaguuacuugaaguauuccaugggaaugucuuguucggugaccaguguuuuagacgacuggaucguguuaucuuuguucuuccuuaccaucaagacugacaagaauauugccgaucccacgauugcugugaauccaggguuugagguguauugcagccuuucuguuguucuguucuguagaccagauauuuuguuuuaauacgccaguuucuacuuagaaaaguuaaccucugauuaaugugaaaacucuagaagauguaagaagccuagaacauggacuaggagacacugccagacuugauauguuuuaaaugauuccauacacauagucuauaggcacaguaacauacaguuagccuguucauagaaaucucuguacuuuucauuauguaauuguuuauuuuucuuuccucuauacucuuuguucaugacagucagaugcucuguuugcuucggucacucugcaucaugagugauaauugacuggcuagguguauguccuucugcuguaacacauuaggaaaccagugagugcccuucccugugguauuguaauuugucagcuguuacuuuuuaaaauuguaacauaauuacauauuuccccuucccuccaucccuccaagcccccccaccccccaccccuugcuuugcaguccagguggagcuccagcuugguagguugcugaaggugaccuucaauuccugagccuugugccuacacugccugagugcuggggcuauaggcgugcgcgcaucaucaagccaggugccuguaaugcugggauccacacuggugcguugugaauacuaggcaaacaguguagcagcugcgcuggacuccugaccccaagcgaggcauucugaugucgcccauccccaagacugucuacuuagacaggguucuucacaacauauugucacuguaccacccaauccagagguuuuggaauucaguucagucaccaacagauguuuaccaacaaauuucuuuaugagucacuuuggagucuaguucaaacuguaaguaauuuucugagggucugcuaacuaaaauaugcccuagcuuugucuguugcuacauuuauuaauccauaacauacucaguugguuuuuuuaaaauuuuuuaaucacuacgaagcagaauccauaauguaguucucagacuaguuugugaaaaugccugcgaugaccauaagaaaaccagaguagagugucuuaccucacugcuagugauggucuugagguuguagccgauuccucguuguggggacucugcgucuguccucuacucucagguggcaacacccucuuggggaccaccagaaaugcggugaaugucaguaggacugagaaucacagccauuaaaacaguuacuguaaauaaaugucugggaaggucguuugugugugaagauagaaguggaugugccuauguaugugcguguaugaaaaauggucuuaaaauaacaccauuuaagauucuucucaaauuaaugaacuguuaacauuuguaaguucuuuuggucuuaguguaagccccugagaugguuacaauacugucacaucugucugucacccuggcuccuugccuugggccuaguaagaagcacucaaauuugcuucuugacaaaauuuucuuggagcucaugauaucaguaacauaaaguauaccaauuuugcgcuauuuuuuguguuuaauauagaauuguuauuguagacuguguaauacauuguaaaauucaaaauggauuaguguggaaaugguaaauauuugguuuauguccuuugcaaaauacaugaaaaauuuuaucuuagauuaaugagguauuauacaccuuuguauguauuaucuacuucguaguguaucugauaucaacauuauauagaaacaagggauaucugugaagugacaccguaugcugcuguuauuugaagcaaugauuauguaauauucauuuugaaaugcuucuuuauucuaggguacacauuuguagaguugguagccuuuguccuuuaacuuguuuccguuaguguguuaaggaaaaccaugugugcccuagauaaucagaauugagguuuuaaacucuuuucacggauacaccuucaaggggguggugcagaaugcgugcucuacggugccauccugccccauugucucuggauuuacauugauccugagugaugugaggguccccuggggaagugacagagaauacaggagggugguaacuggauuggagccacuggcagucccaagagauccggcuuggguggcaugguccugcccggcugggccuugugcugggauuuccuuuccuggaaggacuuucaagugagaccaaauuuuguugugauagauuuuugauauucccucauccccucgcuaugacuuucauuuuggcuccaguauacagauauggucuaacugcaccguuacuucuaagucaggaguucuuugggcauuuuuuugauaauaaaaauaaggcaaaccuuucauuucuugaaaaugaaauuuaaaaaggugcagucagguugacacaacaaauuaugaguaauagcauuaaaacuuuuaucauauuaugucaaacgaucaugaauagagcaauaacccagcgguuaggaacacaguucuuucggaggacccgcguucgacucccaguuacccacaaagcauuucaugacugccuguaacuccaggucuaggggaucuaaagggcuccucggacuccagccaugugcauggcucacaccauccuugcaggcacagaggugcauuuagaacucgggccugaugcgugcaguguugccggguacuguuagcgggucuuguucuguggguuccucgcuuguguggguacugcagugagccauguccaugcauaacggcuccaguaagcuuugaagaacuucuguuuacaauaauaaaaauuggagagaagagaaaagaauucggaaaaaagcagaaagcacaaagguaguuaggaaggcaggcgcucuggaaaagcauuucuuuccaggaaacagauggucacaugccauggagguaaagcuuuguacccgcacggucccuggagacuuucagagugggcugcuucguuuuuagauauuuguuaaaauuaauaaugagccuaugacucaccugugucauuguggucugcagaacuuucccuuuuguaguuggauacuauuuaagcgggauacugcaagaugacacacacacucuugagacagccgggugagagugguaggcaggccgagggacucuguucucuaaugacccagcaggucucuaggagcaccuuccccugccauguggcagcaugggaugagauggccucugcuugucacgugacagucuucgcugugugugcugcagcaaugggacuggauucucacucgguagacuggguagcccaugccuuauuacaggccuuuuccugguaguuuuaggauagggagacggggguuggggcaggugagagcaugggcaaggugagaggauuuuaguuaguuauuaaggaacaccgagguccuggaggcaggagagaugguacaguguucuuggaaaggaccuuggucaguucucaguacgcaugugacagcucucgggucuguaacuccacuucuaggggaucccucugggcauacauacaaaugguacacagauacacacaugcuggcaaaacacccauacacacacaauuaaaaaaaaucuuuaaaaagcaaaaacaaaaacuagaccauugauuucaaguuuauaaagcuuguaaaaaaauugggaaagggaaauuuuuuuuuuugaaauuuugcaugaaauugaaguuuauaaaauucaguugaucuguuuaugaagcgcuucuauagguuuccguuuaccacuauagaauaaaugucuacuaaaaggaaugaaaguguagggccagagagauggcucagugguuagaagugcuugcuguucuuccagaggaccuguguucagucccaagccuucacagcgggcagcucacagcaccugugacucuguucucuggaugccuucccuugucugggcuccugcaugcaugcggugugcauacaucaugcaggcucacaugcauacagagaagucaucuuucuccuccccucuacuuagagaaggaaguagaagccuggaaguugguuucuucuguugguuuugucuccagccuuuuccucuugcugcaggaggaugcuuugucagagagauggugagaugaugcagauaggaaauguauaugccagaaagagcuugucuccauuuuuguuuuuuaaagauaacgggagcacucugguggaccugagggccaccaccaggucuugguuguuuuccuuauuugcagauaaauucuggccugugagcuuugugcagagacucauuuauauuugaagucaguguuccuuguuugaucacacacucgcguauuauguuguaagaaguucuuguaucuaucaugaaauggugaacuguugugccgggauacuguaugaugauguuuugcguguccuuagggccgaugaugcaccagcagccuccuucucagcaguacaauaugccaccuggaggggcacagcauuaccaaggacagcaggcgcccauggggcugaugggccaaguuaaccaaggcagucacaugaugggccagcgacagaugccucccuacagaccuccgcaacagggugagacgccauuugggaaauuccgugcuuaauguaaauaacaguaauugaagggcuugaaguuuuaaugaacuuuugaucuagguaaauccagggcuuuugcuggacuccccugacacccacgaagggagcaggguuuaggguacagaggguccuaggcacauaggagcgucccagcacccagcuuccuguugccugguguucuccagggaaagaugacaucaggaaauauaaauaucagaaaaugcccccucccuuuuuuagaagcuacuaaauauaugacagaacaaagccaauuuuacuucaaagugcuuuagcguuaaugucaaaguaaaaagaagucagguucccaccagcuucagccccuguuucagagguuguuuuuccgaguugauauuguuugauauuauguguaucuuauauuaauuuuauaaaugacguguggaccugcuuguguguguaccugggaauagugccaaagcaugguggggucuccagcucagaaguagucucucguaacagcagauuagaacgaucgccuuugaugccauagagaacaaaugauuuaugucuugacugguugugguuuuucaggcccaccacagcaguacucaggccaggaagacuauuauggggaccaauacagucaugguggacaagguccuccagaaggcaugaaccagcaauauuacccugaugguaaucucuccuaauguuacccuucccguuucuauccuugcccaguaucaaugcagacagcauuucacaacucuuuaaugaagggcgaagaaacuaccaacuuguuucuucauuuagaagaaagcauuuggguauuguauaguaccaccaggaaggacauugguuuguaauuaauucaaaguauauuugugcggucacuguugguccauccggagcuacauucuaucucuauauugucucucgugugaaagaggagcuuuuuauauuuaggauuguucauuugaacccaagacaaauuucuucuucuacuucuuuuuuuuuuuuuuguauuuuuauagauuuaauucaugugcuauaaaguucacucauuguuuugcucuuaugcauucuauauaaggaauauagcucuauaagacuguagagaauauucuuggguaauuuucauuuuauuuauguuccauucuugggaaagaauuaugccuuauaugcuugcucuugagaaaagaugugucugcaaucuagccguagauaaggugcacugaauagacugaguguacgcaaggcauuuggguuuauaauuuagcgacuucccccugccuccuuuaaaaggggacgugacuuguaagaaguugacuccgcuaagaaagugcaggcacugauaauccagguguacaagggcauuucuacugggcaguuuaaaacucuuuuuguuugaaaauuuuguauccuaauuugaagaaacauucaacauagaaucgguaaaauaauagauaauguuaauagguaaaaaguaauauuacauaguaauucauaguguuuugccaaaauauuucauccauaaaguaaauucuuuuguuauuuuuuuuaacgcaauuauauggcaaagaaacuucagacuaacguuuaggaccccuuggcuagaaccuaacgcaaaccaccaagaagauggaguuugcauucaaauggcauuucaucugcugcuuuucgucagcauacaaggcauaaaggcaugucugugcuaagcacugucaccagggcuacacacagaagcguuggucagugauggugcauaacuccgcuuagagcugugugcuuuuaaucucaggucuucuugccauugguauucagaguauuggggcuuuuuccucuccuuaauucuuuguggauagaugaagcuuuuuuuuuucugaaauuuagacuuuauuaauaguacauuuauagaagauuucaaagguggcaucuaucugguaaauagaaguaaucucagaauaaaugaucuuuuaaaucaacuuuaaaguacaucuuaagcaauuguguugaacuuaaugguuuuggguccugaacauuuccugaaauacgaacuuugucuuauuuuaaaccuuucuauugaaaauaggcaccuuauuuuuguaacuauugaaacuuaacauuuauuacuugugcuagcuuguucuuagucuaaguaguaccaugguuucacagauguauguauaguaggcccugacaaguacagaguguuagccacaauuacauuuccuuaggcaaaagugaguaucuucucucagguccagauagucuugcccauaaauacaugggugaguguuugccugaguuuuucugcaaagggccaggcagugaagguuuugguccuugugggccauguggucuugcugucacauugcagaccuuuaaagauagcaagagagcugcugugggcagcacuuaaagugagcagacaugauugggucacaauagaacuuugaucucagccggccacggccacaguaagcugguugaucauacauugccagcucuuagagacuuucauccuaacacagugagugugacauguguuugugacuacaguccuaaguaggccuuucuggagcauuaguacccauuuagcaacugaagacauuaguuccuacauuucguuuuuaagugaaacauuaaagaauuaaaaaaaaaaauagucuacugguggaaguuacugagucauaaaacuuaagguguucuccaacucaggaaauaugaauuuuaugaacuuuuaugugcagaauacucuagaaauauuucuaaagaagcuuuaaaugacagcauuauaagauacauuuuuacuugggugccagucaggugggucccugugagucugaggccagccuggucuacagagcgagcucuaggaacccagggugagagaccauaucuuuaaaaaaaaaugacuuuuuuuggcaucuggaaauacugugaaacacuuguacuugaugcaauaaaauauuagagguguuagaaacucacuucacuucuuuucggaguacaaacucaaggaccucauauuuuguauuguuuuuagugugugcuggaaauggcguccaguagaacagggguuugauuaaacuaugauaacuuccauccuuuguucauucugauuggucucgaauuucuuacaugugagaggccuaaauguucucacuuucuuuuuuaaaauaggauguaaggguuuuuuguccucagugaggauuaucacaguuuggaggaugaguguaacauuucuaagauuacuguucuuugccuugaaauaguaugcuuauaaucucacagugaaagcuuucacguugguaaauacuugcuaaugcaauuaagauuauuuuuuuauguauuuccauuucuuuuucuuuuuuuuuuucuucaguuuuaucuuaaaguuuaauuguaggguuuucacucaguggccauuaacguuucuuccugucucuugucgaauugauguaggucauaaugauuacgguuaucagcaaccgucguauccugaacaaggcuacgauaggccuuaugaggauuccucacaacauuacuacgaaggagguaucuauauaccuucacacauacacaugcacaucccuucuccaggaaugguaguucuugcauaggacagcgucucccaugcaaagcucucguacaguacuaguggcuggcuggcuggaaaguuacagggccccccaaacaaccuuacaaagauuuagaauguguaacuaugaugugucauuucuaacagcaguaaaaagacuaaaacauuuaaaaaugcuuuuuugcuccguggaaauuuacucuuuggacauaaauccaucaaccccaucccccaacccuuugugugugugugugugugugugugugugugugugugugugugcucacacgagaguacgaguguguacgugugugcguguaugcguauguauuauuuacaucucagcauagagccuguagggaacagcuugcugaccuuguguagcuagugugugcucuuguagcugucuuuaauuuugucuuuuuuauuuuauuuagcauagucaugaucuuaggccugugaugcuccaguaacuguaaugcucguaauggcagaggcgcugaaagagcugcaguucaaccuugcacaauuggcuuaaacugcaguuuguuuggccgaaauccuucuguuugguuugaguuuuuucuuuguuuuguuaaguuuuuuaaaaaauauggcauuucauuuuguucuuguauuguuggcugugcaucuuagagggaaaagccaaaaucguuaauuaggcagacuucucaggacuuugcgcuccucuucuccguuucuucuguaggaaacucccaguauggccaacagcaagacgcuuaccagggaccaccuccacagcaaggauacccaccccagcagcagcaguacccgggacagcagggauacccagggcagcagcagagcuauggugagcuucuucagucugcuugucuaccagaagacguggcaagaggucuucugaaauacauacauagcauuuaacuuuuauucuaaauguuaaccaucuguuuauguuuagcgaaaguggugugugugucuguguacacauguacacgugcccacauggagcacagugcacacauagaagucagaggauagccugugugagucacuucuuuccaccauguguguccuggaaauugaccucagguuaccagguuugguggcaagugccuuacccauggcaucaucugccucuccagcugguaccauuuuauaagcauaauuuuagcccagucugccauuauaguguugauuucaagugcuccuuuuaaaggcaugggaaaauaaccgaguuaguaaaaguguuuauuacacaugcaugaggaccugagucagagccccagcacccaccugaaaacuacaccucuuuagccagagcacugcagaggcagaggggcagaggggcagaggggcagaggggcagaggcgaggguccuuggggccuuuggccaguuacuuuuacccaaagacucagcuaccaggagugugucucaaaaaauaaggcagaggcuuagcaugagcguacacaugcaugugagcacacaccauaaucaaggacauuacaugcagguguuacccuuaaauaaacuaaucauaucuguuuccgaagaacuacaggcuaaagaugguugguucauuguucagugguaaggugacaauuuaaaaaugagaagaauggauuuuugcgucuguuacgagcuuagauaagugauaauuagguacauaaguaacucacuauaaaaaguacuguuuuuuagugcagagcaaaagauuauucagauaaauaaagacaauguuuguuguucuagcuaaaagcacugcuaagggugucuuuacugaauucguguauccuacagcguuucggagaauguacagcgguauuuccuguaaaauuuucauagugcugucugcuuccucugcuuggugugcacauggcccuggauuuaaaaaucuauuacaaugucugacuuuaaauauuuuucuuugguucuuuaucugucuguccacccacccaccuauccagucuuacaucuaggcaacgucuaccacuuuauguguagagagugaggcgugggucgucugcagcaacaguuugucaguaugggugugccuuucugcuaacuguucucuuucuugugaguaagugcuuugggccguugguguaagccugucugcuuucuggcacugucuuugucugcuuaugaagaagcugagauucuugugucccguagcaugugcauuaccacuaacugauggggcaucgaaucucuucgcagugaagagaagucuagguguguaugacggcuaguacuuauccaugggcuuucuugccuuuucugaauggcauuuccuuuucaugacuuuuguaugucagauaaauuuuauugcaaguacaugaaaacaaauuugaugucacuaaaugagcuaaauauacuaaccugagaaaaacaguuuucacuuggaaaagacaaaagaauuuucuuuaaauacuuaaauacuuacugauuuguugaauggcaggaauccuaaaggaggccuccccauugugcucauuuagaggccuuacuggucaaacugucuucuagguugguguuuuaauaauuugauauucaauaauugaauaaccugguagaauuuauuugaaguugaaaguugauuauucucuucugaguuucucuacagucauuguuuuuguuuugcuuuguuuuguuuuguuuuguuuuuugagacaggguuucucuguguagcccuggcuguccuggaacucacuuuguagaccaggcuggccuugaacucagaaauccaccugccuuugccucccaagugcugggauuaaaggcgugcgccaccacugccuggugcaguccuuguuuuuaugguaggucuuaaguggcuguuggggaagacacugaaguguccaagccaugagcuuccgcuggagaaauggcucucggcugucguuaguugaguuucuaaagcggacaagcuugcuuaacacaggcggucucucccauagggacaauuacacuauuaacaauacuugauucucaguguguuaacucucuucuaaaauuuaauuguauuucacggggguggguguuuugcccgcuuguauguauguguaccacgugugugcucaguguuucagaaggucagaagugggcauggaucccuggaacuggaguuacagagccauaccugcagccuucaaaguguaacuuuucacucagcuuuuuuucacauuacagcuuguggcuuuuugagucauucauuuuuuauuuaaaauucuguugauauaaguuuauugauggugguacagcccuaccauuuugaugacuucaaauguaaauuuaaucacacaauuaguaugucauuguuuuuacaacuuuagucagaaauuaugucauuugggccugcuucuagguuauagaaccaggaccugauccuggcuaacuuauggaucuuaacuuaguuauuauugagggguuacugugggccauugcuuccugggccugcuuuaucauagucccagucauuucacugaagcagcagccccuauuuugcuuuuacuauagucauuagcuuugaucucacugugcaaaagugacugacugcccuuucaguuuagauauaagaauuuuguaacaucuguuugaaauucuugcugaaauuguggagacucuuucuagcuuuaccuuugggcuuguugcuguugucuugcagguccuucgcagggcgguccagguccucaguauccuaauuauccucagggucaaggucagcaguaugggggcuauagaccaacacagccaggaccaccccagccaccccagcagaggccuuauggguacgaccagguaaguugccuaccagccguggaguuaccacgcuguccuucauuucuguggacuucugagucaagauuucacuauguuguuguuuugaaccugugaucugucagcuuccaugaacuggaauuucaaccaugaugaaucacauguagcccccuucucaugacugcuagccacuacuacacucuaauuaguacuuuaagauauuugagaagaccagcacaguugaauaacaaucacucuugauuguaacagcuugaaguacaacagcagcucauuguccccggacacacugucaucgguacuucuccagugucccucauuagugaacgcggcccgugcuuuccucuguuccccagugcagcucacccggcauacuuggacuugcugucagagcucuuuguguuccaaguucccugcucacacuuucacacguguuucuaucgccaaguguuuuuucucuacccucgauuucagauguugaaaugugucuuacuuauccuaagauaagauucccuagaaccugguaguauccaucuggguuuuucucuuuuuaaucagaccccgcagacuuggacugugcgccuaggcacuuagggaugccgccgugguuguucugacuugcucugggaaugacuauagaccacggaauguuucagguuugugcagugaauuugcagugaggacaucuuaauacauucacugcuuguaagguacuaaagugggggaguuaggaacauggaacuguguguagucuauaagucagggaucugaggcuaauguagaagaugucacaauuugagaaugcuguaacuagcacuagagcugcaagcaguguuuccugcucugucugucugucugucuaucugucaggccugcagcccuuuguacuggcacuuggucucuaaguaaggacaagaggacaagagacagacacgggaagggugaggugcaugagcgugccugcuucugugcagagcagagugggggagagggcagaaauuguacucuguguacagugccugggaagguccgaaggucacacuagguucccugaaacugcaguuacagacacuugugagcugccgugugggugcugggaauugaguccagguccucuggaucagcagccagugcucuuaacuacugagccaucucuccagcccagaaauaaagucugucuaagaaguaaaauuauuauugaauaguuaaguuaccuuuaaaagaccugaugaggguccuagggagauggcucagcuguuaagagcacuuguucuccuggcagagacccaaggucaguuuccagcaguaugucaggugacucacagccaccuuugcuuccugcuuccaaggggaucugacuauaucacgugugugcaugguacccguacacagacacacggauaugcauaaucuaagaaaaaugcuuuaaaaauuaaaaccagauuagauaacuugauauauuuuaaaaggugagacucguuguucuugcaagcguggugugcagcuaagacagacagaugaaugcuuccggcuucuagagcggaugucuccaucuuccugcuucugucauucggcacuucucugccucugccuccuccuccuccuccuccuccuccuccuccuucuucuucuuuuauuuuuuuuccaauuuuuuuauuagguauuuucuucauuuauauuucaaaugcuauccugaaaguccccuauacccucccccacacccugcuccccaaccuacccacuucugcuuccuggcccuggcauuccccuguacgggggcauauaaucuuugcaagaccaagggccucuccucccaaugauggccgacuaggccauccucugcuacauaugcagcuagagacacgaguucuggggguacugguuaguucauauuguuguuccuccuauaggguuccauccaauagaugccugugagcauccacuucuguauuugccaggcacuggcauagccucacaggagacagcuauaucaggguucuuucagcaaaaacugaaaaaacaaacaaacaaacaaacaaacaaacaaacaaaaaacugguguauucaauagugucuguguuuggugacugauuaugggauggauccccgggugccgcagucucuagaugguccauccuuuugucucagcuccaaacuuugucucuguaacuccuuccauggguguuuuguucccaauucuaagaaggggugaaguguccacaauuuggucuuccuucuucuuaacuuucauguguuuuacaaauuguaucuuggguauucuaaguuucugggcuaauauccacuuaucagugaguacauaucaugugaauucaaggcccauaccuaaacauaauaagagcaaucuacagcaaaccaguagccaacaucaaaguaaauggagagaagcuggaagcaaucccacuaaaaucagggaauagacaaggcugcccacuuccucccuauucaauauaguacuugaaguccuagccagagcaauuagacaacaaaaggaggucaaggggauacaaauuggaaaagaagaagucaaaauaucacuauuugcagaugauaugauaguauauauaaauaacccuaaaaauuccaccagagaacuccuaaaccugauaaacaguuucagugaaguagcuggauauaaaauuaacucaaacaaaucaauggccuuucuguacacaaaggauaaacaggcugagaaagaaauuagggaaccaacaccccucacaguagucugccuccucuuuuauaccauaguccaccugaacugcaagguagagcacuuagguaguuagccaaguuccugaacaauccugcuucacacuuuagccuacacaagacacuggcugacuuguuguauuuagaauguguguggugugucuucaucugucuguaugcugacuggggcagggucucugaguugaacucagagcaccccaguuccuuuggucuagccaacuggcuugcuguaggauccuucuuuugucugugccucuggagcuggggguugcaacccaugccugccuagcuucugaucuauguguuuuugagauuggaugagggaaugaaaaccaacgcagauugcuuagcacaauagugauaaaguugucguggcaguuuauauaguuacagugagaaauggagagugagcgccuaccucuaccucuucaagguacauuugugcucucugucucuggaaacaguuccuuugucugacagucguguuagccucagcaaacacaccucccccucccauccacccccccaugaguaaacauugaaucaagcaacaaauuucauuaccuuuccuuaaaacugugucuacuagcuuuuuuucaaaaccuuuuucaaaacugcaacugucauuugcccuuccuggcuuagcugauuccauccugcccuaucuagagucugucuguucuccacacaggaccuggaguggccuuuuaauaacagucaaguucugccaccuucccgucagugguggcuacaguguugagaaguguuagcuuuguauguugggccugggaagagagagcgcacucuuuccagucuccugccauacagcccagcuguggcugcagcaugagcggccgcagcaugagcggaugcagcaugagcggaugcagcaugagcggaugcagcaugagcggaugcagcaugagcggcugcccuccuuauuccucuugccucaugccagccuccugcucucucugaugugcgucaggcucucucagaaccaguuugguuuuuugguuuuuuuuguuuuuuuuggcagcuccugguaccuggaacuccccccucuaucugcagucccucccuggccuugucagauggcuacaguagugaacacccaccuuggauuacuuggucuuccugucucuauuguagaauagccagggguaguggcugaugccuggggagauugagagggacacaguggauccugaguucaaggucauccuccaggacgguagugaguuggaggcuagacuugucuauaugagacugucucaaaaaccacaaacagaauaacucucuuaagguuuaauuuacauguaacaaucugcacaucaaaguuauacaguuuaaaccaggcgugguggcgcacgccuuuaaucccagcacucgggaggcagaggcaggcagauuuuugaguuccaggccagccugcucuacaaagugaguuccaggacagccagggcuauacagagaaacccugucucgaagacccaaaaaaaaaaaaaaaaaaaaaaagucauaccguuuagugccuuuuaacuguaugccugugaugucauuaucaaaaucaaaauaaugaaucaucgugccccacgguuucugugccccugaccccuuuaaaaccaccacugcauccacugagacucucccuacaugucugcugauaggcuuucugucacuauaaauuuauaguguguguguguguguguguguguaugcaugcaugcaauaaaauuugugaaggucaaaagacaacuugugauagucaguucucccaucaguggguccuggaaauugaacucaggucauuagacuugguagcagaugcccccugcacagcccuuuugcaagcucagucagacuucuuuuauuggccaugauuguuuugauauuugcucuuacuauugugaccaugaacaauucuuuauagcugacuaguacucuuugauaaggcuuucuacccaguuucaguuaaaguaccugaacaaucagguucaauucuuuuuggacacauuaauuuuuuucaucuaaauaccuagguguggaugucacaugguagcuguguguuuagcuugagucagugcuggccugcugccucccuucacuccuugcagccuguguguuacugccuucuaggugacagcaacucaauguugacaaagcuagacacacuggugccuuugcagagcugucaccgcagcauagagagcaucgggacagacacuguccagaaggauugccuccuaaccuguagcaaccacagcugcagcacaagaaguaguuguguucaucacuacauaggacagugaucucacauggaaaacaaaguagaggagcccgagaaacuauuagugacucuaguggagggaaaugacucaggcccuuucccggagggagggaaagggaccucccucaaacuuagugugaccugaagccauucgagcuuuuuuaagugaaggccuuguucguacauugacuugaguguacauacucacgugagcaccguggugcccccauggagaucagaagauggugcuggacucaguccuuccaggacuggguccugagcucaggucuucaggccugagccaagccuuccccaggccccuucccagugaguuguggacaaugcacuuucuuuauuagcaucucacuucacauugccaggggagaauuacccaccaguauugagacuugguguguuaacuaaucaguucuuuaguuaacuuauuuugggacaggcuuucguuaccuucuuggucucaaaccuuuaguuugaagcaguucucuuugaccuccaugguggcuugcacugcagccauaagccauggcaucucucugggaaaacgcuuuuuccuauccucucugagaugccaggaucauaauagcuaugagguaggauuuaauaucaucagucugugguggaagggaaacuggugcagagcuguagcuuacccucucaguucauggguaaggaaacuggccuuaaagaguguuuucacaggcguaaagauaccaacaggguuagugugugugugugugugugugugugugugugugugugugugcgugcgugugugcguguguguguguguguguguguuugcgcgcgcgcgcuugagcaggcgugcauuuaccacagagucuguagcacuucauuuugagugcacugaccauuaauuacgcuuuugagauguaccuacucucccugccagcccagcccaauccaagacuuucacgugugugcuaccggguccagcuuuaaaguacuaaucgucuggugaugugggcuguacaaaccauuugcauuugaguauaaugucaggaaaauuagagugaucgugcauaaacacuuguauuuuuuggauggauagucacuuuucugagaugaugauaugcaaauuauauuuguaauuuucuguguuaaacuaacuuagguuaagcuguuagcuaauucuguuuuucgaauuuaucuuucagggacaguauggaaauuaccagcagugaaaauguccuuacauuccaauagccaguaccuauuagcaggcacguugucacagcacugcaccauggacaccccccugggaagacuccuuccauuccagcuagguuuuugggaaaaccuuuggcuaaguggcugcuucgucagcaaguagcuguuaugguuuaguuuguaaaggcuucguagcuaccgaugcaccugauuucacguuucuacucuagauggcaacauuggacagaaaaugcauugacgugaggaguuugcagcgguuucagaacugugcugcaaauggacugucacagccugaaaggugugagcagcuggguguguguucgcggagcuucaggggguuucauacuuuuccaccgauuauuuuguaaggggaagggggaaauguacacuuuuuacagcagcaauauuuugucuauuauguuuauuucaugugauaaauaugcaaagcgguacacuacacacugggcagaaucagaaccccuguuaauguggagugugguagaugcucggugcuguggugcucugaagacaggcgaggggaggcagaagcccaccacaggcccgcuguuaguucuuagaggaaacuccucucucucuuaucuaccagauuagcaagggcgcugugauacaguuuuuugaguacaaagacauuuuuuaaaaagccuuccaguuuugugcauuaaaaccuuuuuguaaauaugguuuauaauacuguuuucaaacgcaaggcaauaauuauguugcaucugugaacuuuggcagguuuguguaaaaggagggaagccucucuuaaaacagcaauaacagaaaaggaggaagcgggauguuuuuaccuugucuuguaaucagggagcucucaccacgucagagaggaggcagcauuggucucaccuuacuguuuuuuacauuaccaugauugguucauggagcagggaggaguccacgagacuucacacgcuugugcuuuaacuuucuuaacugggcacaagcaaagggcgccuucguguuccucucuucaucuuaguuaaugcgcgaggaaaaugcuuugauggccauuucucauucgcacugaaagccgagaggugacauuuuacgguuucuuguuuuuaagcacgacauacuuaaucauuauuugagacugauuauuuuagcuaaauuuggggauaugccauggggcaagaaaacauguacugagagauuucuaaacacaucuauuuaagcauacuuuaaaaauaucuagcccaaagguaaguugcuguauccucacaguugucugcauccagggaauaugacugaauauaacauaucuuuguaauugaauuaguuuuugccacuucuaacugaaaacagaacagaaggagugccauaaaugcaaagaagcaaaguguacuguugucaacauacuguaaucagaggagggguuucaaugugucuggaugagaguguguguguuuaaggucagaguauaggguguucuucaacuuggacaguagaaaauaggcaucaagugugaaccggugaggcguggacagccuucuugugacugagaugcuuguaaguucugugccagguucuccaccacuguguacuuuauugcuauuuaaaacuguaucaacucuaacgaaagaauaaauuauuugugauuuuaauuuucucauuuguuucuuuaaauuagaucucuuugacucuuacuguuuugucuggagacugcacucuggguuucuaguccgguacgaguagacgguauuugcauucuaggacuugaucaauauucucuugccaugcccacguuaauuagaauuaacuguucaguaaucagcguguuguguaggauguuuguugcagaauucuuucucugaaaaugaaguccgugaagcuauaaucaagaugacugaauuagauaaaugaguugaagagacaaaauugugcugaucccaaccugguggagauacguuaucucauuugaaaugagcucaacugacauuaagaaauaauuugucuugccaacccaucuucuguugucuuauucuccuuuaauggaaacuaaaauugcaauuuuaauaagcagaauuuccuccaggacugucuuccuggagacuggugcauuugcaagguuuaauuguuuuauaacgguccuguuucguaaaaguuuuuaauugguggugacaaagauuaccguaauccuuuggugccuaguaagaacaauaacuucaccggcagccuuucuaccgaagcugacauuuucauauaaaaaaaaaguagaaauuuuauuuuaucgaaugaauuauaaauaaguuuuguaguaucccaugaaauagcauggcuguuuccgaauugccaagugugcuggugccauugugugugacuauuagcgucauucugcagcuuugccugguggcacagugaccugcagagaguggggacaugugccccacgugcagcuacacaccccacucacucagcacacgggccgaucuucuguuguuuguccuccuucccauaagcagaggcgagcacuguuacuuugcucuuaaauauuucaggaaggaccugaaggauuccuuuuuaagaauucuuuugcucugagauucuguauuuucaguaauaauauucaguucagcaucaucuuacaggcuuuacauucagacugcugccuuuucucucacguuaaacaaaagauuaacaaguaaauuacauaaaagugauaaacauuuuauauaacugucauauaaaaggugaugauuauugaagaucuguaaaagugacugucccaugcauaauggcauauacugagaauauauauucucguuucccuucugaugagagacuuaugcuucccuguuuugugacuucuuuuccgagucgccacucuauucuugcacuguuaaagaaacaguuuucuuaaauuauccagcagacuucuuugugugugcucuuggcuguuuaugugcauuucauuucucaggugcuuuggucuuuuaaugucuuaaagaucuuucugucacuuuagaaacugugauuaugguaucuucuacuguauuaaauaaaugucugcagccuuccucacugcagauucacagacucgac

SEQ ID NO: 8827 - RNA, 1280 nt, Mus musculus
acauuaaaaaugaaagauuuauuuuauuuuuaagagggagagagagagagagagagagagagagagagagagagagagaagagcacacgcaugugaguacaagcacagcuguacccagaugagucugguucucuagaguuggaguuacgggcuguugugagucacuugauaucaaugcugagaacugaacuuuggucuuccgaaaaagcaguacacacuaacugcugauccaucuucuucagccacaggaauagucuuuuagaugguacuuaaucaaauacuuaauggugacauacgacuguauauaucccauuucuguguuggcuucauguuuaggcccagugauuagcacugucaguucauagguugguccugagagcaaaugauauuuagcagaagaaagcucugaucuucccucccucccucccugcuccccuccuucccuuccuuuguuucccaccuuccuucuuguugcaaaggacucagauauucuucucuuccuggcacagucaucugagcucaucagcucuccuggguuucagguccacuauuguugggagaaaugucccuugauugacauccccaccagaacuguguggaaugggaaagugguagaucuuugaggaaaucaaacaguagcagaugcccaacccauucuguaaaugucuucacacuuaucuacgcaauugaaauuuguuagaaaugaugaugaaguguuucuaggagagaggcuuggcucuagagaaggggccucugacugcgacaagagggcacuaaugggucauggcagugcccggaauucugagaggcugaaaugaaagguguugcuaacagcgggcauccaacuuuuccuauucuggguguccauguucgacacugacgggcacacgacuauuuguagaaccaaaugacucuauaaaaaacagcacauguuccaacauuuccuuuuuguugggggagugacaggccacauuuucugguuuugaugaaccaucaacagacagcaggaggagguuuucuugcuacaucaguuucacagccucaaacuguguauuauaauuaacagugcagacgucuagcgugcaaucucuuggucuggaggaaauacuguauagacccaguaaaggacucucauauacuugguuguuuccccaugugcuguguuuuggugucugagcuggguagggguuguucuuuggaaggcugagucuguguugggggucucuuuguuaauaaguuuaggucagaggguagauggauuaccuuucaggcuuagugau

SEQ ID NO: 8828 - RNA, 630 nt, Mus musculus
uuggauagcauuuuuccuucuuuuuuuuugcauuucugagaaaauuuuauuggcuuuuuggaucaaguuuauuuuccaggaaggaugauuccaucauacuucugcuggaaccagcgcauggccuccuccuugcugauucuguguuuggccccaaugcagccuguucugcgcuucuugucugcgaugcugaacccuggccuacccagcaccacauagaaguccaggccguagaucccaaugcuugggucguauuugaugcccgggucaauguguucuugaauuccaaaaccaaaguuuccaguauccgagaaguuauuuuuccgcaacucauacucccgcaccuucaggccuuucuccagaauuuccucugccuuggcuccucggacugugcagugaacagcaaucuucucauuucuccagaugccaaaggaccugacaguguaucuagcuuuggagaacaccggggucuggccugugagcugcuccaacaccuuggcugcccgggucagucugucuccgcucuccccgacgcagauauugaggcagagcuugcggaugcgcaguucccgcaugggguucuccuuuuccccuugaucuugcgccaugguggagaacaggaagagagcucau

SEQ ID NO: 8829 - RNA, 1183 nt, Mus musculus
aucaaagaggaaacaaacaacucuguuauacacuaacggucuucaaaguacaucauuuguacaagagaaggacgaagaaccaaacuguuuacagagauccaagcacaagggagagagggagagcacaccccucacauggcuuuccgaugguacucaggaggagccacuucauaaucacuggcacugaacaaaguugcagaauucuucgccagguacuugagaaaaucauguagauaguucaguaauaaagcaaggcuuuucucaucuagagguguguaggccaacaucgcuccaauucgcacaaauaaucucagcaaauguggcgcuccauacaccugggacaugggugcauccggguggucggcgaggauuucagcguacuguggucucucaaacuuguagaggagcugagugcccaacaugacauugaaguauuccuuuaugccugccaccaccucauuaacagcauacucuuuauuaucuguauuuccucgagacuucuuauaauuugcauaauccuccaaaauggaauccacauucuucuuggcaggaagauaaaaaagcugcuuuugucuggugaucaagucccagucauccacaagccaggguuucagcucuucaggaaucuucacucuaacuucaacucuguucaugaagguuucuucauuuucaaugauaggaucuacccgggcucucuucuuccgaggaggcugaggugucucacugguacugccaccaucuccguuuccagguguuuucugcuuguucuuuuuuguuuucacuucaacauuuuucuguugcagaccggaugucuucuuccccggagcagccccucucaucuugcccucugcauauuguuccugauuggccuuuugaauuucucgcuguuucugcaaauugguguccacguauuugaguacucugcuuucuggcacccauucaucccaauuuuuauuccugccacuguaauggaugaaguauuucacuuguuuguccuuuauggcaaccuuuacacacuuugcuucauagagaagaggcccaugaaagcacagcacucgcucgcccuccuggaauuuuggcuuaggguccugcuugggcgccauuuauaagugauucgcugccuccuccuucucccaccaacccagacuaccgcccccuacucucuaccccacccaacuccauu

SEQ ID NO: 8830 - RNA, 524 nt, Mus musculus
auuaauuucuuuuuuuuuuuuacauuuaaaaaaaauggcauuguuuuauuuucgccagcaggcgugggauacauguugugguaggugugcugggcucagugcagguguggauggggucgggggaggugaugacuuggugguuggaugggaacugagaggauuagauucgcuucugggaaguuuggaugaaagaaucauggcaugcuauagcuaagccgccaaugagguugagaaacucuuggaaaucuagcugcccaucacaguugagguccagcuucuucaucaugcggucaaggacaucaggauccuucugguucuuugugaaggcagccagcucuguguucaugaaggaaaggaauucaguuuuggagaguugaguguuguuuccauccuucccgcuguacuuuuggaaaacagcaaucagggacucaaugcaucucucagucucuguaggcauuuuugcuucaaguugaggagcgagguccggcugcgacuguggcugacgguggcugggacaggaguca

SEQ ID NO: 8831 - RNA, 524 nt, Mus musculus
ugacuccugucccagccaccgucagccacagucgcagccggaccucgcuccucaacuugaagcaaaaaugccuacagagacugagagaugcauugagucccugauugcuguuuuccaaaaguacagcgggaaggauggaaacaacacucaacucuccaaaacugaauuccuuuccuucaugaacacagagcuggcugccuucacaaagaaccagaaggauccugauguccuugaccgcaugaugaagaagcuggaccucaacugugaugggcagcuagauuuccaagaguuucucaaccucauuggcggcuuagcuauagcaugccaugauucuuucauccaaacuucccagaagcgaaucuaauccucucaguucccauccaaccaccaagucaucaccucccccgaccccauccacaccugcacugagcccagcacaccuaccacaacauguaucccacgccugcuggcgaaaauaaaacaaugccauuuuuuuuaaauguaaaaaaaaaaaagaaauuaau

SEQ ID NO: 8832 - RNA, 448 nt, Mus musculus
aaggaaaauagaucaaaaugaggaaacuuugugcugaugaugcaguuccuaagaagcgcaaacagaaaaauauuuuaaauauagaaaaggauuuaggagaauuagaacuaucagggccaacuggagccacuacagaugggaaacuggaaccagcaagugaaucaagugacacggaugaagaaaugacuccagugccugucagcccucauugaaauaccugagaccuucauguucuacucagugaccauggcacauagucauuuauaugugggcuggugacauggcuuagcaggagggggcuugcagccaagccugacuacugaagcuugagucagagaauccauggguuaaagagaaaggaugcuacaaauucaccugcacacaaugggaaguguguguaugcaugcacacaaauaaaauuuauuuuaguaaaaaaaaaaaaaaaaag

SEQ ID NO: 8833 - RNA, 42744 nt, Mus musculus
aaaccggcagccuuuggcucagagaccccucugcccugcugcagaggacugagauuuaaggugguggccaacauggccaccuuuuacucuuccccucacugucaaaugccucuguccacuccuucguccauaauggagauggugagucacauaaggcuucugaguuuugcaugucacagcuaacgcaagagaaauguuuucugcuuucucugucuuuugcaaucucucuaccuaaauuucgaaauucccgcagaauaaacugagccuagauggagucaggcagcuaccuugagcugguaaacaguagcuaguagggucaggggagguccaggucgaggccacugcuugaguaguggcuccaggggaucugaaaaagacagauugggugugagaacaguaucaggaaaagaaguuuccagcaacaaucggguugacaacaaggaccagaagcagagacgcucaaagcguuuagcaaaguccugggaacucggaugaaauuauucuccuuaaauuuuguauuguaaaacagaaaguauagcacagaaguuaacaaauagaaacuguuauuccacagacccgaggcuguauuuggguugugaggcuuaucagcgucuguguuugugcuaguuauuugagcucaagugggguugguaucacugucagaugguuagaggugagccaguuaccuguacgauauauguauaugauuauauauuauauguuauauauuauguaauauaaucuauaguaagcaauauacaauauacucagcacuuaguggcacacaguaaaaauuccauaaaaauaacugagggguggcaauaaagauacuugccgcuaagucugaugacagaauucaaugcccuggaaggagagaaccaauuccugcaaauuguccccugaccuccacagugugcuauguuccuuccccaugcaauaacuaaaaaaguacauuaaaaguagcugauaauauuuguaaauuuuucuuaaacaguugaaguauauguuaaaaaauuauagacagggcucgggaugcagcucaaggcccuggauuuaaucccauucagugcuauauaaaccaggguaugguggcaguggccucuaacucagggaggguagagguguggcuacaaggacuagaaaaugaaggacuguuucagcaacagcgaauuucccaagcuaaguacugcuaccugagacacacccccucacccuaccccaagucaaaacaaaacaaacugaaaaacugagcgggaguggggguagggguggggugaggacaugguaacacagacuugccauuccaacauccuggaagcugagucaggaugauugccacaguuggccuacauaggaaauuccgugucagucaggaguagagcacgagaccuuaccucaaacaaauaaguaaaaguguauagguugagggagguagcccuagguucaacccccaaaaccaaaauaaaauuaaaauacagcuugcuuguuuggguggauacaugccucacgcagcccaguuuggccucaagcucaguauaugguccagggugaccuugauuuucagccuccaccuuagugcugggguuacagacacaugccacucuuuuaguuuccgugguaguggggaugaaacccagggcuucaggcagagcaggcaggcaucauaccaaauaccauuuuuaacaaugggcuaaauaaacacgaaaagggcugggcauuuugucugcuuugucugaaccaaguuaucaguccuggguaccaaaggaagccacccugacugagcccugaggacauccgcugcuuucuuugauggaugucugugguuccugcuuugcaguuagcuuugccgcaaaaagcaagacgcugguauugauugccugcagaggaguaugcucacagaucugacuaccgcagaaccauuaacaacgccacccccaccccgccccgcccuuguuggcauugauuucccacugucuuucuuaagagaggggccuugagccuugaaguaaaggaaaugcugagccugccgcuaagaagcaccugcuuuuucucuauucacugugacagcaccgcagaagcaggaaaugggcacugccaugucauauaaaacgccauucuguaggacggaggcaauauaaaaaacauuaaauaugacagaagcccaggugggagagcagcaacugucugagcccagugggagcaacucaguaagggccuaucuauaaaauaaaauuaagaaauucuuuuuugaaggguagugguggcacacaccuuuaaucccagcacuugggaggcagagacaggcagauuucugaguucgaggccagccuggucuacagacugaguuucaggacagccagagcuauacagagaaacccugccucggaaaaccaaaaaaaaaaaaaaagaaaaaccaaaacgaaaaagagauuguuuuucauauuauuucucagaucuuguauguuucagcagccuagugauucaguuuuuguugacugccuguuauguaugugcaagguucuggugugugguuuuuuuuguuuuuuuguuuuuguuuuguuuuugcuuuuguuuuuugguuguuuuggauuugauugcuuacauugggguuggcuaauuggauuuugguuacggggaucuuaaagauuacauuuauuugcguauuugguggcagugaggguggggagagagccacagcaugcauuuggaagccagagggcagcuugcaagagucaguucuuuaucaugugaguucuaggacccaacugaggucagcaggcuugguagcaagugcuggcuguauuuuguuuuguuccauuugauguuuuucuuuuuccucccucccucccucccucccucccucccucccucccucccucccucccucccucccuucuuucuuucuuucuuucuuucuuucuuucuuucuuucuuucuuucuuucuuucuuucucagcagggguuacccuauguaacacuguagcacugacuagucuggaccugaauguguagacagaguuggcucugaacuccuaaagacucucccuccgccccucaaacaccgggacugacagcagaugccaccauacuuggccugaugaucuuaacugucaguagaauccaaaggauccuccgaaaugcacguaguaaaauagugugccaucuggucauuuccuuguuaacuccuguguaacuauauagcuccuuccuccuuucuaaguuaguccagguuguccuugaacucgauauguacucgagaguugaggaugccggaggacagcacuccugcugccaccucccgagcagggacgcuauggguuuggcgauuuacuucaccuaagcacucucccgaccgaauuacaucucuagucucagacuuugaauucuacauuuuucuucuacuuaugaguucugagacuauauagucauaugcuaguguucccagauuuuuuuucuuggaucacacccaggacuuugccugucaaacuuauacccauauacccucagcccaaauuaauuaucaauugacauauaaguucgcacauuucugagauuuuauuuuauugugucauguuaaaauauuauguauauauucuguacagggaaaacacuuuucuuuuuuuuuuuuuuguaugcugccuaucacugaaauauuuucuuuuuuuuuuuguucuuuuuuuauuacauauuuucuuuauauacauuucaaaugcuaucccgaaaguucccuauacccuccccuacccacccacucccacuucuuggcccuggcaauccccuguacuggggcauauaaaguuugcaauaccaaggggccucucuucccagugauggccaacuaggccaucuucugcuacaaaugcagcuagagauaugagcucugaggguacugguuaguucauauuuuguuucaccuauaggguugcagaccccuucagcuccuugggugauuucucuagcuucuccauugggggcccuguguuccaccuuauagaugacugugagcauccacuucuguauuugccaggcacuagcauagccucauaugagacagcuuuaacagggucccuucagcaaaaucuuucuggguuugguggcugauuaugagauggaucuccaggugggguagucucuggauaguccauucuuucauuuagcuuccaaugaaagaguaguaaacucagugcuccaagguaugcuaaucauuaaacagauaucgacauuccuccaccuacccgcuuccuggguucaaggaguguucauucaaagaaagucacccugacccacccuggccauugcugaaaccugcuacgcaaaggugcuauuguuaggggcucuuagaaacugucuugagaaauaacccucacaauuaccagguauuccuugugacaccugugacuuuguacuuccuugugauucuuaacugguauuuuugguaucuuccaacaacgcccuccccacuuccuugaguugugguuucuuccuuuaaauacccccuuauccagcuacucggggcaccacaguccucuaccccugcgugguguaugaccaugggccccgagagcgcucuuaaauauaaauccucuugcaguuugcagcaagaccauuucucguuggugauuuuggggugucgccucuccugagucagaacgugggggaguucucacguugugggucuuucaccagcuuugucucuguaacuccuuucuuggguauuuuguucccuauucuaaggaggaaugaaguauccacccauuggucuucccucuucuugauuuucuuguguuuugcaaaaaaacacuuuucuuuguucuuguguuuuuuuuuggucuuucaagacaaacuauuuagugcaacucuccaagcaggcuagccucaaacucaaagauuauuaugucccacucgacuggcaagaaagacgcaacaagcuggaaucuucugugacaaaagcuuuauuccuuacuucuucaggagcaagagagagaauggcaaaaccccgucccuuuuaaggagaauuauccuccgccuaggacgugucacucccugauuggcugcagcccauuggccgaguugucgucacagggaaggcagagcacauggaguggagaacuacucuggcacaugcgcagauuauuuguuuaccacuuagaacacaggaugucagcgccaucuuguaacggcgaaugugagggcggcuccccacaaaagauucccguuucugcauuccuguuucaugccaaggaugggccucagcguggagagggguucugagagaaggggugucuggcagcagugaaacgauccaaguuaaaucauggguccaagcugacggccuguguucugcuugauacagcuuuuccagucuacuucacucuauguucugcuuucucucuggagaguucucuauauucugcuugcucgauauucuaagagaacucucuguucauguccugcugucuaccucugugugugugugugugugugugaguucucuaggcauuucucucuuuuuacccuaaaauuugcaucaagaggucccagcccuuugauuucuaggaugacaagccuacuuuuuuuuuuuuuucccuuaauguugcaaaagaauucagagcugugcuuuuguuaagcaguuaaaccaguuggguggcaccugcccuaaaauuaccauuucuacaacaccugggccaaauccugcucuguccuaaaaugaccuugaacucaguaaucugccuucuuuuguaucucccugccuuugcaucuuucuaaccagcuggcucuuaguguagcugucuugcucuuuuagauucauuaagcacccccccauucauauugcauccuuauacuuuuugcauaguagagaaaucauauuugcaaacccauguauuaagaccucuuucccgccgggcgugguaguacacgucuuuaaucccagcacucaagaggcagaggcaggcggguuucugaguuugaggccagccuagucuacaaagugaguuccaggacagccagggcuauacagagaaaccccguuucggggggggggggggacgacgacaaaccaaaccucuuucccaucgccuuaagggcuguccugauggucccaguguuuaucauuuugcugagaucagucacauccuugacuccuauuucuuuucuuuucuuuuuucuuuuuuuuuuuuaauuuaggugaguacacuguaggagucuucagacacaccaggagaggccaucagaucuccuuacaggugguugugaaccaccaugugguugcugggaauugaacucaggaccucuggaagaacagucagugcucuuaaccauugagacauuucuccagcccuugacuccuauuucuaacuaucauggcgucauuaauguuaacagggaggacauuccuuggaaagaguccugcguugcuaguuggucaagaaaauauacacauuauuacacaaacaaaccuuaugcccacugcagccauccacacuccuggaggcucacaccagguuccuaucucaggagcaggacccaugucacuuugcccccacaagggccaugcuggguaugacacacuggaacuaagguauucuggauuuauuuuugucccuuugaaggaaaaggucucaaugcauagcucaggcuugacucagauuuauuacguagcacggaccaaccucaaacuucugaucccccugccucagccuccgaagcuuuggccuuuuggcauguguccuuuucagacauuugcuauuacuuuguguaguggcccuuaauuuacuuuagcaggauggucuuugaugaagcucagauauaaagauaugccuugaagaauuauggauaaaaauguuaaauauaucaaauuuucauaugaucuuuuauauuuaagacucuggggagccuuagcuuaccagggaccccccugagugaaccacguggccagaauugaugcaaaaagcaagagaaauuuauugucccagugcacugggguugucccagguugucuaaguguuuugugaccuucccaaaguuccuaagcugaccuuuucaguauacgcacacuauuguuuucauaaacuuuuauugccagcgaugauguguuaucuugguauuuugcauugaagaggggguagcacauuucacaagccaugacugcccuggagcucacuggguagccaaagaugaccuccaacuucugaucuuccagccucuaccucguaccaguuugacuuaaugcuuuccuuuuaauguccucaaaauaagaaaguagggccgggcaugguggcccacgccuuuaaucccagcacuugggaggcagaggcaggcggauuucugaguucucgaggccagccuggucuacagagcgaguuccaggacauccaggacuacacagagaaacccugucucgaaaaacaaaaacaaaaaaaccccaaacaaacaaauaaagaaaaagaaaguaagucuggugcccacugacaugauguaucuuccuucagagucugcuagcaguuguaacaggguaggggaugcuccuccucagcuaacaagaugcugaggcuggcaaguuuaggugugaaccuagcauagugucuauggaccauaauuacuaaguggaccacaccuacucacugccuccacgcuguccugcuuucguauuuauguagaaccaaaugaccaaaagcucacaggauaggggaggagccaaaccuaacacuguuuugacauaucuuuauuuuucuguucuugggaaggucugggaggagggggaagagcugcagucaggauaugacgaugauggugaugacgaugauaauaauggugguggugggugauggggguggugguggugguaguaaugaugaugaugaugagaaaucuucuuuuucugguuuccuuccacauuugagaauaauacaaacuggguuucauaugguucgagcaguuugaaauuugaggugauuuuaaaaaugacaaggugacugcagugccacacaccaguaauccuagcaaucagauagaagcaggaggaucaggaguucaagccacccucagcauaugaagucaguucucaauuccucugcccgcuccauccuugguacugaguggcuugcugucucaaagagaacuaggaagaagcuauauuuuaaaaaaaguuuuuagcucugcucuucccagaguuucauaaaauccacauuucauuugcucuugacagcuuuagaucuuuaacaucuaacugcuaccacaguuuccauguauccauuucucaacugcucuguguuucuaauuaugggggcacagacuauaaauaaacagugucccacgucuauuuauguacuccaguuuuccauuugugaaauggaauaguagaauucauacauucuuuuuuuuuuuuuuuuuuuuuuuuuuuuuuuugagacaggguuucucuguguagcccuggcugucuuggaacucacucuguagaccaggcuggccucaaacucagaaauccaccugccucugaaagacccacaacgugaggacucccccacauucugacucaggagaggcgacaccccaaaaucacccacaaaaaacagucuugcugcaaacugcaagaggauuuuuuuauucaagagcgcucucgggcccacggucauacaccacgcagggguagaggaccauggcgccccaguagcuggauaaggggguauuaaaggaagaaacucaaggaaguggggagggcguuguuggaagauaccaaagauaccaguuaagagucacaaggaagugcaaagucacaagugucagguuaucucucaagacaguuucuaagagccccuaacaaucuaagagccccuaacaauagcacauuugcauugcagguuccaguaaugguuagggugccauucuuugaauugaacccaggaagcggguggguggaggaaugucgauaucuguuuuaugaccggcacaccuaggagcacugggccacagaggccacauucccaagccugggccuaaagguuuuaaauuuuauuuuuacguuuuacugcuuucaccucugccuccggagugucgggacuaaaggcgugcgccaccacacccugcuaaauucauacauucuuuauucuggagaugcucucauuacauugacuuuuugugguacaggagacugacugauccauacuuugcggaugagaucuuuagacugugcuuuaaagacaucauguuucccuguucuaacugugcuuugucuuauuccagggauuuaugcguuucagacuuuaaacugaaauacguuaagggaaacacagcauggaaacagagcacacgccaugcauucuauauaucaugacauugugagaaagcagaagcacagauucaguguucucacacaugcugagaucucuacacgcgcgugugcacacacacacacacacacugcgaucucugcacauacugacauacagcacacaaugggaucucugcauacacagacacaacacaaacacaacacacacacugugaucucugcauacacagacacagcacacacacacacacaaacacacacacacacacacacacacacacacacacacacacacacacacgcugcucuagucuaggcauaucauagguccagagugcuuguuuaacuacuucccuuuccuuuccucaugagagcugggcauguccuauucugucaaaucuuucucugauucaucacuuugucugccacucaauaaacaucacuuuccaacauggugcuuccuucuacaaacuaacuuuaccuugauuguuugguauuaaagguauguacuaaggccugagccacaccauaacuagaaauguuugguuuuuuuuccggguuaacacuaugaucaaauaucuuucaacauuuccuccuuuuugucuaagcuaaaaauuguacacaauuuaauuauuauaucagaaacaauuaucaaccccauaaacuuaacauuccgaauguccuuaugaagaucuguugaugcaaagauucuuuauaacugcagucugcagucuugaucaucucucuucagcaaacgcccauuucaacaucaagguuuuccaaucuaccagucugauggacagucagcuagcuuguuuguugagcugcuuccaugugugggagaucugcuuucuguguugccugcuuuucugucuuucugugucucuucuuugagucgagccuuucauguggaagcuucucuuagcucagaucugaucuuuacuaacuuugauggaaacaauagucuuucauaggcaaaaaucucuuccccaguguaacacauuccuugagcucuauucugauguuaaaacaucuuuaaaguaauucuaacucagcaagguuuuuuucuauuaucuagaguccuucagcuaaucuuauucccuuucuguuuaucaaggugcaguuagaacuuuaugaauucacauaugagcuagacauguagcuugcaguccuugcccaguuccacaccagggaggcagacuucguacccauugucaauggcugucaaucuugauccuaaauuucauuagguaccacagauccacaauugagcauuuucuguucuauuaauuccuuugucucuugucucucaagcuuuuggauuaucacagcuaauuuuuccugcuuuauagcaauuuuuuucaaccuuuuuuuuuugagaggaaaaauauaaagauugaagauugaauugaaaagccuagggagggcuuuacuuuguggccaaauagucacaaggauugugauggcuuuuucaaguaacauuuauauccccucaaguccucucuuugcucuuaagggaucugaaauggaguuucccauuuuuaauguaggaaaagucugucuauguaauuaaaauuguguuuugggauggcuuacugugacucacugccucagaggauccuacaucguuccuugcucugagcucaaaacuccuacugcuuuggaguguccugaauuucuuugggcauucagccaaacuuagagaacugaccaggcuggauuugaauucacagaaguauguuugccucugccucucaagugcuggaauuaaagguauguaccaccaugcccagcugugccuuauuauuuccaagcauuggcccaugugcaagagagacauaacacugucucugaacaguacuggaucagcuacuuuucucaacauugcgauaaaauaccugguagaagccacuuaauagagaaaggauuuaccugggcucaggaagucccucaugguggagcagcauggaacaguggcucuaugucaauaagaacaugguggcaaaccagguaugaugguuuguauaugcuuggccagggaauggcacuauuaggagguguggccuuguuggaauagccgugucacuguggguaggcuuuaagacccucagccuggcugucuggaaaugagucuuccacuauaaaccuuuagaugaagauguugaacucucagcucugacugcaccgugccugcccuggaugcugccaugcucuugccuugaugauaauggacugaaccucugaaccuguaagcuagccccaauuaaauguuuucuuuuauaaguguugccuuccuuggucauggugucuguucacagcaguaaaacccuaacuaagacacuaggaaacagagaacaagacaacaagcagagccaguauagaccccuuaaacaccuccccaggguagccaggacgcaugucuaaaagguuccucuacccucaaaacuguacuaccagcuaagcauucaaacacaugaguccacaggagauauuuuauauucaaaucauaagauacguuuuugugcaugugccuauggugcugugaguugaacccagggccuugcucaggcuaggcaaguuuuaccucuucauuauacucgcagccccaaagacuauguauuucaaacgugucccucugaaacguugaaagaagcagaguaaaugcuuuuaccacacugggaaaugggagaauuggaucagaagaucccucggaccuuucccauucuacccguguugcaauuucaugcuuauuaaaauagaacacgucaaauaugaaagugguucaggcccgggaauuucccaggaagucucccacuggcaccugcgugaucuuuccugagucauuacugaagcaaagcagcuugcucugaggguaugcaccaggacuacuuacaguggaugaaaauuucuuuggucagaaugucauggagguagcugccuaacacacauaaucugaaaccuagcaacuaaaggcaacaagauuggcuagcagacccugcacaccaccugggcuucgcaguagagcuagcccugguugugggugggacacugguaagccagcccugagggugugcgagcggugggcgggagagcugccccugccccuccuuugcuguauaguggugugggugaggaagaugccuccgacucccuggagagcuggcccugccuuuccuuguuggcugaaucacuugggagagcaauaggcccugagccuugccugugcagcgauguagaacuggcccuggugaugagggugacaggucagcuguugccagaguaauguacaaagccugcugcauuagaagccagugaacugcuuugaaagauuagaucuucaagcccugcaggugcaccagccgggggcaguuuaaaacggaagguuucguaguguggcugguugucuugugugguuuuaguuuugacuugauauuguuugcuucaccugucugacaaaaggccuuucuuucaccccgagcuggccuuaucauacucucagcaauccuccuguguuagcucccugacugcaccaccauacccagcuacacaguaguuuucguaacucaccacagacccugaaguuugguaccuuggcaucaagcugucucagcaggcuucucaggugagucggaugcaagaugacacagugacuugacagaaaauggcugugucacagacuugcccaaggucagaucuauagucacagaagcugauugaaaauaccuaaccaaggccacuuuuguauccacaccuccugagcuccaguuuccucuuucuguuucuauugagugccuugugcugaaaauuauagcuacagggaacugaaugcugcuuucugcccuggagcuuggggcuuccugacccccuugucugugagaaucaugcccucucauccucgucugucuggauucaauaugaauuuggaccguccucccucuucagagucucacuacauugacaggcuguccuauguagacaggccucaacacacagagaaucucuugccccugccccugccccugagugcucuaaaggcaugcuccaccaugccuagcuugagaauacugauuuguuuaguuuuguuuuguuuccuuucuuccuuuuauuuucuauuuucaucuuugaggcagagucucucuauguagcccuggcuguucuggaacucaauauguagacaaggcuggccugaaauucacagagaucuaccugucucugcugggauuaaaggccuucaccauaaugcugguauuuuuaauuuuuuuaaauaaggucuuguguagcccagacugaccucaaaauugcuccacagauaauggagaccuugaacuucgaagccucuggucuccaccuccccagagcugagauuacauucuugcuuuacuacacucaguuucugcucugcuggagaugaaacccagaguuucaugcauucugggaaaguacucugcuaaccgaguuccagaauguucuuucuuacucucuucuucacacucuggauuaaguuagcucucucauucuuuuucauagauucugaucacugaugguauacugugguauaaagguauuauuuucuuaaacugcuucucagacaugaaagccuugaggacaggaaggaaauauaaagugggugcagaccaccacaggucuaacuggauagaugcuguaaggaaaaggaaguguugguaagaugcaggagaugaggugagggcaagugcgucagcuaugagggaggugcagggaaguugugguuccauccauaaaaagggagggagggagggccaugagguuaaaaaguggacagugaguggcagccuccaaagccacugucuguccuagaaacauacauagacacacacugcacugccucuagcaucaugguccacagcaaucaaucaaaauaaucucucaaauucagaggugaagaaugaaccaacccaaagacaacugcaggugaagcugcucagcggacagaaccaggagcuguccacccccucccccagagacuuugaacugguuuccuuccuguugcugucauaaaacauucuaacucaaagcaguuugagggggaaacccauuugguuuaucuucaggccauaguccauuguugaggaaagucaggggaaaaccuccagguaggaaccuaaagcagaaaccuuggagaauuucuguuuucuagcuuuacucccaggcucaugcuuagguggcuuccucccuuccuuccuuccuuccuuccuuccucccucccucccucccucccucccucccuuucuuccuuccuuccuuucuuuuuuccuucuuuccucucucucuuugucucucauguguacaguguucugccugaaggccagaagaggguacuagaucucauuauagaugugguugcugggaauugaaccuaguaucucuagaagaacagacagcccuuuuaaccucugagccgucucuccagccccuuaggaaguguucuuauauagcucaggaccaccugcauggagaaagguauuggcaguagugggcuuugcucuccuccaucaaaugagcaaucaagacaauuucucauucacaagcccagagaccaaccugauaaugacaauugcucuguuacuuccuuucagugauuugagccugggucaagcuuacaguuaauacuaacuagaacauugcuuauucugccccuaaugucuacugauguacuugacacaaaguaggcucccucauuaaaugcgugcagaaugaaugagucagagauagaacauguguucaccaccaccugaugguaggccaggaacaagagcuucacuauucauuacccccuuuuacuuuuaacaaaaauuauguaucacugguguaauagcggcauggcgguucugggguaaucaauugauuucugauuggaugugaggccuggucaaaagaagagaagauacuuaacacuguaaaccuguucccuagccuauggcuaggcugggcauaguggugcuugccucuaaucccuguauucaggggggagagcaaggcagaucucuaggaauucauggccaguuugguccauauaaggagcuccaggacagccgagacuacaccaugagaucuguuuucaaaaacaguaacaagaagcaaaaauaaaaacuaaacaaaacaggagcugaguuacagcuuagugauagaguauuugccuaacaaauaaagcccagcaucauaaaauuaaacaaugcaagauuaaguuaaaagugucagcuggacaugguggcaccugcuuuuaaucccagcagaggcagaugcaagcagaucucugaguuugaggucagucuggucuacaaagcaaguuucaggauacaggaagaugcugucauaaaaagaggaaaaaaauuaaaagugucaaaacacaaaaacgguaaagacuggagaaaauaagugggguucaggggauuguuuguuuuuguuuuuuuguuuuuucgagacaggguuucucuguguagcccuggcuguccuggaacucacucuguagaccaggcuggcaucgaacucagaaauccgccugccuuugccucccaagugcugggauuaaaggugggcgccaccacugcccugcugauuguuugguuuuugagacaggguuucuccguguacuccuggugguuguccuagaacucgaucuguagaccaggcuggccuugagcucaaagauccaccuacaucugccuccuaagggcugggauuaaaggcgugugccaccacugcccaauuguugcauuacauauuuugcaguauuuuauauauaauucaguguacugugcauuugcccauacaacuacauuauaucuauaaccuucucagccuguuuuccccuccuaucuacuuccuaaguguagugacuaaagaaugccccacaacaugccauaggaauuuuauuuuauucuuuacuuuuucauuacuaaggcacuagagaacaaacccagggcucauacaggcuaggcaagcacaccaccacugaacuacguguaaaaucguguuguuuucuugagaugguuccauucccuaguccugaaggcccuggaacucacuguguggcccagacugccuugaaacuuuaggcaauccuccuucuccaaccucguaaaugcugagacauaaggcauaaaccacaaugccgggcuuauuuauuuuugaagcacagucuuguucaaaugcagcccagcuggccucgaacucugcauuccucgucugaccgcugucguuguauuugaacgccaccaagugggccucuggauuaagcuucacaucacgaucagaaaacgucuguuguccugggcuaucccucgcaauugaaauauugagucagucaccuaaauggucauaggucggcucugaggcuuauuaagauuccaacuuggaggccggauagagucauccugucuccaguggguguucuuaaacugcacuuaucggaacucuugcggaacucugagugcggacuccgaguggaggguucagguuucacccuccggggaccucgagccucugcagugccuugucucucgcggaagagcguuuguaagcggcggccgcgcgcuccgccugcgcuccaccgagaggccccgcggcgcggcuggccgagccaggaggcggcgauccggccugggccgggacuuccuuccucccgggcgggacaacagaaccacccgcagccagcagggagcuccuggcagcucgcugagcuagagcgcagcgaugggcucccugcugagcagcgacagcuccaaguccgcgcccgccuccgccaccccgcggacucuggagcgcagcggggacucggagcugcccaucaccuccuucgacugcucagugugucuggaggugcuacaccagccgguccggacccgcuguggccacgugugagugucggguggcgcgcccacccagcggggagggaugcuggggaagccgagggcacagggugggugggaguagaagcaggaguacuggggaaacuaaugcagaacuacgaccaccuggacagguccgggaagacacccaggguauguguuuguauguaguuggaggcacuuacacgagauugugagagccggggaaucguggugugguaggacagggaccuccgacacauugcacauuuguccgacugauugggugugccuuccacucuccugagaacuuggguggguuuuguuuuuuguuuuuggggcugugcacauguuccaaaaccuccagaggcugaucucuuuugcuguagagaaacugugcaaacucuuucaauucucacacggguuccuuuccuaacaaauacagaccucgaccccucgaaaaucgucaaggccaucuagagcaugccaaaggcuuucugaggucguuagcuugaccaaugaauaggguggagcuuggagcucggauguuuguuucacaccacuaaauucacugguuuaaaacccugcugcaaagugacuggagguuguaaacuaccugccacaggcacggccccuccccaaaccgaaaguauagacaguuuucuucaaaaucucgugcauguagugaaaauuuauugccguugcaaagcaagcaguaguuguuucuaagaagacuuuaaaaaagaagccucagguguaugcuauuaggguauguucuuagggguguuugaauaaucagagggcuguuauuaugcuauuaggguauguucuuagggguguuugaauaaacagagggcuguuuauucaggcaguuuuuucguguuuuuuuuuuuuuuuuuuuuuuuuuuuuuuguggucacuugggugugaguugugugcuugcaugcaugcauagaucggaagcaaagccgacuccuccaccgucaucucugacgaaacuaacgacaauccgauaaagcacaagaacaaaaacacaucugccggugucgacucuuggccaaccaacaaaacaaacaaaacaaaacccccguauauuaaaaacgcauaugcgcgacccuguuuuaacagcacuugaggaaggcuugacaaacucgggcaaccgaaccgggaggcccugguacccacagggagccagggaggagaaugugcggcccacacaguauuuaaaucaagagugcucugggcgcuacuuuguggauauucucaggacuuguuuucuucagcuuuguacuucagggcauauauauauauauauauauauauauauauauauauauauauuuuuuuuuuuuuuuaacgccuuuuccaguuagugaugguguuuccuagcugucucuacauagcucuuugacauaccauccaaaggccaggguaacagggugagagccaaaguucuguuguguaauguuaugaaauauaucaauuaggucagaacaacagccuaaagauaauuacacuuuuaaaaaacuguuuucuuuugggugguuuggggugaguuugggucucauguaaaguaaguagucuagccucaaauucacuacauagcuuuacaguccaaucaacgaugaacaacagcaaguuuugaaaaucccuuccacugcucugaaggagcaacuuggcuagguaguccucugauuccacauuguuugcaggggcuggauuuugaacacuuuaauuuauuuguuucuacuaaaggagaauauaaacuugcaaaauguuacauuucuuucuguuuaaucuuuuuccuuuguuaaagugaauaggaaacuggccacuggaaaaaagagucauaaaauauccuaacagggacuggacaaauugccuucccucccuuaaccguucuuuguuuugacaaaucuauguccauuguucaggcugugggcagaauuuccauguucuugcauuuagccaacuugggcgccuuccacuuuauaaauguuaaccagaguccuuuugcacuggagacuguuguuaacagcaauuguacauucuaaaugaaugacucuuuccugccaagcuuaaguuggaaaaugagaaaauugccagugaagcccuguuuuuaucaucccauagcaagguuagauugcaaacugggcuguuuuuguugauuuuaguuuauaaacaaauaaaugacaacaguucuggaugaauguauagggaaaccuuuacacacagugugacauagugugcaaagacgugacugcaagcuggguuugggauucagccuucuucuuuuuuuuuuuuuuuuuuuuuuuuuugguuuuucgagacaggguuucucuguguagcccuggcuguccuggaacugacuuuguagaccaggcuggccucgaacucagaaaucugccugccucugccucccaagugcugggauuaaaggugugcgccaccacgcccggcugggauucagccuucuugugaccuagugguugacucucacauucucaaucucugccuuuaaaagguggcuagccgugagcuguuaugagcaugugagauccacagaagccuguaagggaggccgagagcuagaaauguagggcacagugguagagcacuggcuuagcacaagcccagcccuagacuggaucuccaaugccaccugcauacagguauagucaucaucuuuauuuugacagagucccacauauuccagcugacccugaacucacuaugcagucaaggaugacuguccacuuuuagucauuacauuucuuucauuuuucuuuuuccuucuuuugagaaaugggucugacuuuguagagcaagcuggccuugaacuucccgaucuuccugcugcugccuccuaaaugcuaggauuaaaggugcgugccauccuuaccgacgagcacucucuucugccucccuagucuagaugagaggccugagugugagccucaggucuuuugcuaggcgggcugagcaggcucuuuaccaaaugaacuagacuccccgcccacaccuguuuguuuguuuucgagacaggguuucucuguguaguccuggcuguccuggaacucacuuuguagaccaggcuggccucgaacucagaaauccaccugccucugccucuugaguacugggauuaaaaauuuaaugacaccuguuuuuuuguuuguuuguuuguuuuuaauugaacuucuggauuuuaaauuaauucauuuauuuaagaugauuuucuaaggguucuacugcugugaacagacacuaugaccaaagcauaucuaaugaagacaacauuuaauuggggcuggcuuacagguucagaaguuuaguucauuaucgagguggaagcauggcaguguccagguaggccuggugcaggaggagcuggcaguucuacaucuucaucugaaagcugcuaggagaagacugacuuccaggcagcuaggaugagggucuuaaagcccauacccacagugacacacuuccucuaacaaggcuauaccuccuaauagugccacucucugggccaagcauauacaaaccaucacaaugauacaugcuucccaggauacaggaguggaggcaagaggauagcuuuuaggaauuggcucuucuaccuuguguguuuuggagguuuugcucuaguagucgggcagguguggugguagaugccuuaaaaugucuugagaccggguuucguguaccucaagcugguauuaaacucacaucaugaacaagagugaccuugaacuacugauauucaggccucuauccuaccuuguagguucucucucucucucucucucucucucucucucucuguggaggggugagagagagagggagagagggagagucauuccaggcuggucuggaacucacuguguagacauacagacaagacucugugagugaacucacauagauccaccuggcucccaagugcuuggaugugcacugccacgccugauauccagcguuuuauauauugauuugauuauucauaugacaaaaauaguuguaaaauuagauuagaagaaaaagacuuccuacauuugcuuuaauauugucagagaacgggggaaagaaaagaguuauugaauggaaacugugaacugaacuaaaaaggaaccuaauuuauuguugacgagaacagucaggucuggggauguuguucauugguaaagcacuugccuaaugugugcaaagcucaguguccagugccagaaaaauaaacucuucugugaguguuauaggcacagccgcuaaagggagcugggcauaaauauuagcugcuuuacaugaccaaggccacuuauaaagaauguguuugggcauauuauuuccaugauggcagagagaggcuaagguagcugaaaucugaggaccaugagcucuuggaacaugagcaggacauggagagcgggagcccaaaauggccagagucuucaaaucucagucugccggauccaucccauaaucagcuuccaagugcugacaccauugcauacacuagcaagauuucgcugaaaggacccaguuauagcucucucuuaugagacuaugccggggccuagcaaacacagaaguggaugaucacagucagcuauuggaugggucacaaggccccuaauggaggagcuagagaaauuacccaaggagcuauagggaacugcaacccuauagguggaacaacaauaugaacuaaccaguacccgggagcucuugucuuuagcugcauauguaucaaaagauggccucgucggccaucacugcaaagagaggcccauuggacuugcaaacuuuauaugccccaguacaggggaacgccagggccaaaaagggggaguggguggguaggggauuggggggguggguaugggggaccuuugggauagcauugaaaauguaaaugaggaaaauaccuaauuaaaaaaaaaaaucucagucugccucaggagauauaccuccuccaccaaggccagaccuccuaagccuucugaaacccugcagccagcuggggaaccaaacauucaaaugcccagaacuaugggggacaucuucaaacugccacaguucugaugcaguggcagaguucuuacuagugugcacuaggcuuugguguagaaguuaggguccaguuuuuccucccagccccaugcucccagaaauaagacucagacucauaauauauuuacaaauaccuuggccauauagcuaggcucuucucagacuagaaucauaacauaaaaauaacucauuuauuuuacucuacauucugucuuguggcugguuaccugugcucugguaccacguuucugucuccuuauaucuuccugcuuuguucuaucccagaauuuuuucugccccccagaugucccaccuucuauucuacccuuuccuauaggucguagauuuuuuuuaauugacaggugauucaucgaauacauaagauauucuuucuacaccuugaauuuauucccuuaguauuacacacucaaauagacaagagcaaauaauuagcuuucuaaauagauauaguagacaaaggagaaauaugauggagacaauaucuaggauuuaauuaguucaagaaaggguguguguguauacacucacacacacauacacacacacacacacauauauauggaauuuauuggguugauuuacagcugcaguccugcuaauuuaacaauggcugccugugaacagaaaguccaugaaucuaguaguugcucagugcacaaggcuggauaucucaagugaucuuuaguauauccugaaaucccaaagaagaacucuaaugccaaugaaagaaugcagaugcuagcaaggcaagggcaagcaggaagagagaaaagcuucggucuuccauguccucauauagacuugcaucagaagguauggcucagauuaaaggccuguccuacuucauaggucuggacuagaaguggaucuacuucaaaucaaguaaaaaaaaaaaaaauccuucacagguguguccuuacauuuuuggauuuuaguuaguucuacauguaaucaaauugacaaccaagaauagccaucacaggccuggugaacauucagcaaucugguaaaaagaaucuaaaauguaauugcugaaagcugauucuagugaggcauaccuguaagcauuugacauuuagaguccuagaagauugccacaaguuuaaagccagccugaauaucaaguguuaacuugcuaugauggacuaaagggacacugacuccaaaacaacacaauaccauaaagaaacaagcaaacacaaauaucucaaagauccuggagaauaaauuuagggggaaguagaugaaaacuaagaguuaccaaaaagaucuagagcaagguuucucaaccugugggucccaaccccuuuggggaucaaaugacucuuucacagggguguuaccuaagaccaucagaaaaugcaaauauuuacaucaugauaaauaauuguagcaaaauuacaguuaugaaguagcaacgaaaauaauuuuaugguugagggggucaccacagcaugaggaacuguauuaaaggauugcagcauuaguaagguugagagccccugcucuagaguuucaguuugggccuaagaggggcaggggcgauaggaagaucuguaucucccuugaacucaguggagacaagugcuuauuaacaucauccgugugcacacuuuuccuagaaggcauugcugcugaggcgauuucuaagucacuuuaaggaaaauggaugaaaaucccauuagagaucaagcaggagcuauaaaacuucuccaaaguguggcucucaagagcagaucuuuucaugugccaccacugcccagcuaaggaacggaacucaggucuugcagaagagcaggaaguguucuuaaccacggagagagggaggggagagggagaggacacacgagaugguacuggagauugaacccagggcuuugugcacccuaugaaagugcuuuaccaacugagcuguauccccggcuccaauggucuaugguuucucuauaaugacuuuaagauagagcugauggccgggcgugguggugcaugccuuuaaucccagcacuugggaggcagaggcagguggguuucugaguuccaggucagccuggucuacagagugaguuccaggacagccagggcugcagagaaacccugucucgaaaaacaaaaaacaaaaaaacaaaaacaaaaaaaaaaacaagcuagagcugaugauuggccacagaccuuccaugcccuggaagaacaccccagugugcucggugaguguguuagaauguggugugugaagccuuuuaugcuacaauugggaaauucuugagugccauuguucuagugggugagcacauguuuuaaaaagcaccaugugaccaccccuugaagauuuggcaguuaaguguuggcuagcgguugaagugauuccaaaacaaaccaaaguuuguacaauuugguaacugaccuuuuguguguuugugugagugugugugaguguguguguguccgucccauacuagauaugacagggcuauuguuuuucuugcugugcugggggcugaacuaggcaagcacuauagcacaacaauauacacuguaccguuaagcuguacuuugggccagaccggucugguccauuguugaaggggauugguuugugugcguguguuuuauuaucguggacuguucaccgugacuuuugucuuuggauaacgguucccuuaacuuuguuuccauugaugcuaacuuugcuggcucauaucuuuuuuuuuuuuuuaaaacucuaucuagacagguucucacucuaacccaggcugaccuggaacacacuauauagcccugaccagccuucaaccuaaagcaauccuccugccucagccucccaacuggugagauuacagaugugagcuauuaagccuagccagcacauccauaaugaagcuuuguguugaauaccucaauuaaaagguuaggccugccaccuggugccaacagcgucuuccagaucccuguccgccagaccgcucuccuccaaaacccucucccucaaccuuagaguccccagggcuucccuuuccuguuggaauucauuuagaguuuaguuuugcucugagacuagggacauacgucucuccaguguucuuagcuguguuuuccuguuuccuuccaguacccugccagccucuucauuacaggggauuuuggcuaauuacuuuagaggaauagaauggguucaugaaauaacaaauaggagugauguaauuaaguuuccagcugguuuccagccgguugagucauuauggauuuccuuauugguuuucuccugcugugcuacaagggggauggggucaugcuggagggaagggccacacaccucagagaggcccuuucaccccaagcauucugggagauggcacuggagugauaccaggcuagaaagauaagucacaccagcaaagucagagguucgguuugugugacaucugauuccaaagcccuggugcuguguucagaagcuuuuugucuuugauguuggagguggugguuguuuuuuucauuuaaaaguuacauuuauuuguuuuauguuguguguauguggaagggugcaugugcuguggugugcccugagggggucagagaccaauccaugauaggugcuugguaacuugguauuucccugaccacauucagagguuuggaaacaagaagccagauaguugcuguuugacacaggaucucacucuguagucuugacucaccuguagaccagucuggucuuuaguuuacagagauccuccagccucuaccucuugagugcugggauuaaaggaguaugccaccacucugggguggagugaaaucuucaagaugguauuccauuuacauccaucaugacaucaguuuuuuuuuuuccuuaacuauauucucuuuguguugaucccucuuuuuguuauuuuccacuucacagcccccuacggcagguagucaggguagacaauugaauaccuccuuuccuuaguguugguucccauauuccccucucuaggggucuugaggucuucauggcagaaaaacaucacacuuuugaaaggaucuaauguagaauuuaggcuggucaacuguuuauaucauugggguuaaucuugaacuauggacccuccugucuucacuuuccaaaugcugggauuauaggcauguacuacaguacccaggucuuuguguauauuaucuaugagcauacaaauacucuuaaucaacugagccucaagacaccauagccaggacaccacaguauggcuuacucaugggaauuuuggcaauuccuagaaaagucucuauugggcaauuucuccuaacugauuguuaugucaacuuucugaccauguucugagcagcuacuauugugccuggguuguguaggagggaccuuguguucuaagugacccaggaucuuucucacaguguuacuguaacuucccugucaucaugggaauguuuuuguuuugcuucucagcuuuagugaggugauacacucugacucacgcaguguggaugggcugaugaauugcugcaauuguucacagccguaacaacaccacaacccagaucuaggacaguuaguuccuauacacugacaaaucgccuccuguccuuuguggucaauuucugucccuauggcuagcccugucagccccaucugcuucuggaaucaacuuugggaacaugcagccaguagcccuuugacuuucagaaggggcauggauuuuauuuugcccaucuugucucugacaccaucaggaaucauuugcugguguagggccuuuugagccagggucucauauagcaaacucacuaacauagcuaagcugacccagaacuccuucuccuucaaucucuggacuucugagauuacugguauguaccaccuugucuaguuuauccagugguggggcugaggcccagggcugaaugcagugcaggacaacugaaauagacuccuaaccuaauguuagauuuuagagacaagaucucauaugccucuagcuagucuugaacuuguucaggcucauuuugggcuucugauccuccuuaaacuuccuaaguguuaggguuacaauuuugugcucccacacccagcuuaaggcaccaaaguuuauugaauagauguauuauaaacuuaaagguacuuagccuugguccugguuuauguuugagagagaucucaagggcugagaguguauauucuugaagaguacauauugcaagugguucaaacauucaacuaaaaauaaugucuuuuuucgugguacucuggaucaggagccaggcuggcccugagcuugugugauuuucuuggguuaaggcugauccucugccugcucgucucucucagcacagcuccgacuaugcccuaagauuccuggcugccuuucugaaugucagccaagagcaagcaguuccuagaacguuguauuuuuuugguuuuguuuccauucggaguguucuucucuagguucccuuauaugcuuaccauuguuuuuucuguuugacucuuggaaagggguuguauuguagcccaggcuauccuaaaacuuucauauguagcccagguggacugaaaucccaaguacugggauuagacugguucauuacuaugcugauuuaauuuuuccccucuaauuugacaaagaaucuacucuuuuuuuuuuaaaucucauucuucuacuucuuauuccccauugguguuuguuuguuuuuuaaggcuaaacucuacucacuauaacuacuuaccugaggauuaccuugauuucuguucucccaccucccaagggcuaagauuauauaguccugccaccaugcccagcuuaaaaucccaggucuugccugguuagccgggcaugguggcacaugccuuuaaucccagcacuugggaggcagaagcaggcagauuucugaguucgaggccagccuggucuacagagugaguuccaggacagccagggauacgcagagaaacccugucucgaaaaacaaacaaacaaaaccagguuuuacuagacugcauacuucugcagucucauguccagcuucuuauagagugagacgucaucuaccccuacauaagacauguaagcagagaauucagguuggagucauugauguuguauuuggaauguuaauuuuuuucuuuuaguugaacguuugagccauuuguaaaaaaguacucuuaaacgaauauacuuucaagguuuuacaugucuuaggguuucuauugcuguaaagagacaccaugaccaaggcaauucuuauaaaggcuagcauuuaauuagggcuggcuuauugguucugaaguucaguccauugucuuuauggcgagaagcauggcaggguccaggcagacuuggcacuggagaagcugagaguucuacaccuuguuccaaaggcaaacaugagaagacugacccuucuucauuaauuggagcuucaaagcccaccccacagugacgcacuuccuccaacaaggccacaccuccuaauggugcuacuuccugugggccaugcauacucaaaccagaacuugauggcucauacuuuugauucuagcauuugggaggcaaauucagguagauucugugagauugaagccauccucaucuauauaguguguuuuaggcaaaccaagaguacacaaugaaacccuuucuaaaaagcaaacaaacaaaauaagaaaauacuuuaagccagguuuagugauguguucuuguaaucccagguagauuacauuacaggcgggagagauguuagugggaaaacugagauucucuuuucagauuuauuuccuuccuuccuucuuccuuucuuucccuuuuuuuuuuucuugguuuuuugaaacaggguuucucuuuguagcccuggcuguccuggaccucacuuuguagaccaggcugcccucgaacuuacagauauccaccggccucucccucccgugugcucagauuaaaggccaccacugcccagcuagauaaauauacuuauuuuuauuguaugagaucuguuugccaucugcuugcccagucccuguggaaguccuaagaaggcaucagauuccugggaaauggaguuagagguggcuaugagcuaccauguaggugcugggaauugaaccuguguccuguguaagaacaaucagugcucuugaccacugagccaucucucuagacacccucccaugcaugcuuagucucauucauaaaagauuuuagccuggugugguggcgcacaccuuuaaucccagcacucgggaggcagagguaggcagauuucugaguucgaggccagccugguuuacuaauugaguuccaggacagccagggcuauacagagaaacccugucucgaaaaacaaacaaacaaacaaacaaacaagaacaguaugaacucaagugcugagcccuaucuccugaugcgugcauucucuguuucuuuugaguagguucugccgaucuugcauugcgaccaguauaaagaacaauaauaaauggacauguccauacugccgggcauaccuuccuucagagggagugcccgcaacugacauagccaagaggaugaagucagaauaccagaacugugcugaguguggaacucuggugaguaacaacagccauauucaugguuacaagaaaagguuuccagggaaaccuuucuuuccacccucuccaucucucuagcuccuccagugcuuuggggacaguuucucauucuguagcccaggguggacauaaacuugcugucuccugccucugcuuuggaagagucgggauugcauacaccuaccaccacaucaacgccuuuaguauuuguguguaugcagcacuagagauugaacccgcacacugaaugaguguuguaccagcaaaccagagucccagcccucauuuuucagagucauuaaguucccugugcuagcuaugaacguagucuguagccccaccaaccuuuuaaauauccuuuuugaaacuuggaagucuuacuucauuuaucuauuuuccuaccaccacccagagcugggaagauaacauuuuuaauauggaauuuuuaaaaaggaaagcuauauaaguuagcucacuccuuuuuuuguuuuguuuuguuuuguuuuguuuuguuuuguuuuguuuuuugagacaggguuucucuguauagcucuggcuguccuggaacucacucuguagaccaagcuggccuugaacucagaaauccgccugccucagccucccaagugcugggauuaaaggcgugugccaccacaucuguggggcuagcucacuccuuuaaucucagcucacugcauguucaaggcuggcucagucuccaaggcaaguuccagaccagccuggacuguauaacaauacucugucucagaacaacaaaugccccaaacaaaaagucaacccucacaugguuacucuuuuucccuuugccucagagccuggaaaccaacuagauacuguugcccuuaacccuggcccuuaaggaauuaugggagcaagacgaugcuuaaauggcuuucaucuucccaguuccccaucccugcccagugaccgauuugguuugguuaccuggaccuccucuugccagggucuuuuucuccuguuaggcuccuucccguuacugucuuucucccccuccccccugagcugaauggacagccccuccagggcuuugaggcaaggacacacagggagcaugucaucucuguaaucuugugcccaacaguucuccaauaaggccuggauagaauuacaaauauuuauauuuauagauguaagaauaauuuaucauggacuucugaccagaauuuguacauaaccuucggggauaagcauccugauauccaacacuaauucugucucuuccuguuucugauuuggcgcaaguuauuauuauuuuuuauuuuuuaauauuuauuuauuauuuuauguaaguacacuguagcugucuucagacacaccagagggcaucagauguuauuacggaugguuguaagccaccaugugguugcugggauuugaacucaggaccuucagaagagcagucagugcucuuaaccacugagccaucucuccagccccaaguuauuuauuuuuaaugauuuauucuguguguggugaggcacauggacaaccuuacuauggcugucuauccaaaacagcauccucucaaacgcuggaugaaguagcccaucagacucucuucucugcugucugaucagucacaggauuuugcuuguuuggggaacucugcgccaguguuuugcuuucuaggcuacccuucuguacaggaaaggugcugaaacaaguugcagccugucguauuucgcuguccaggcuggcugcucuccuccuugcagccuggcuuuacuucugaguuucucucagaggaacuucuuagcuaccuguccucaugucuugguuccucuguugaauuaucugcagcauuagaauaggcaagaggcucguuguccaccaucucugcaacaguaccuuacauaauguauguguaucuagacuauaaguuugacaauuugucaauguacaauccucagguuggugacuuuucuaagaaaagcuuauuuuucuuaaacaaaaugucuuagccuagucuagccuggauacuugucauccuccugcuucagcaucccagguacugaggauuauguguguaccaccacaccuacuuagagcuaagucuuucuuuucacauacaccacccccacauuuuuuuuuuauuuguuuuuauuuuuuugagauagauggucucaccuuguaggccuaugugaccuggaacucacuauguagaucaaguuggcagagauagauugucucucucugccauucaaguguugggauuaaagguguauguacaccauauguucauggcuauuuccaucacuugguaguuuuugaagcugaacuuccaauggagguuuggcagaaugaggcaguguaggcuggcguaggcuggcugugggcugccaccuagcugcagcugugagaaguuuucuccagcagaucuuaccagcaucucugagcccaguguauauauacugugcuaucagcagagcccuuggggugugugcagacaagcaagggcuccuuauccugcccugaugaagauggacaagagcaguggcuuauguuagccaagaaggcccuaugaaguaugccuugaguugugaagucauacaacacugcuggucaugccacacaucaauggcauuuacuacuucacuuaaugugugagaagguuccuuuaguuuaugauggacacaugcaaaaugaguauucaauuuucaucuccauuucuuuucaucucuuguaaugcuuuucuucuuuuuuuauucuuacuuuuucucuucaccuagauuugucucuugcccacaaaaccuauuugcauagcaguaugcaaaacagccuuuuuuagaaaacagcaugcuuuucagaaggaacaaauuuaaaagcucaacauucaguuucugaaguguuaggagauuguguguguauguguguuaggagauuuuaagcacaguauugaucauuauguuuauuguuguuguuauuacuauauuauuacuuuuugauuuuucaaggcaggauuucuccaggugucucucuggcuguuuacucgaucuguagcccuggcugaccucaaucuuagagaucugucugauucugccucgaaugcugggccaccaccaaaguauaggcauuauucuugauaaggccuguacuuugugacuauuuugugaaaaaaauaauccaauuuauuaacuuucccaguguaaucugauuugaaaguugugaagcuggguuacauaaagguccuugccaacaggaguuuuaucuugaaucugcuuuguguagguuugccucagugacaugagggcgcacauaaggaccugugagaaguacaucgauaaauauggcccgcugcuagaacuuggcgacaccacagcaagguuuguuucgaugcaguagaaugccaugcuaaauucagugcaucagugaagaauuuaagcacuugggaggcugaggcaggaguugugacucugaggccauccugggcaacagagugagguacuccuaugugaaaccacucaaaaucagacauuucuuuuugaauagugggugauuucaguaccuaacucuugucuuuauuuuuuuuuuuuaauauuuguguguaucuguacccgaguguaugucugcaccauguggggacaagauccuguagaggucugagacuguuaagugcccuggaacuggaguuacaagcagcugugagcccccaugugggugcugggaacugaaccugggugcucugcaagagcaacagguacuuuuaagcacugagccaccucuccagccuugaauguauacuucuuaaccuagagauccaaaggaucacucuggucuucuuacuuuacuugaaauugcccugcuaagauacaugcuguugcagaauuugcuuuacaaguggugccauaaauuuuaaauugaguauuuuugcuguaaaccgagaauagagagucugcuagguugaccaguagggaggaaggaaggcuaaaaaauagguugagaaaauauggcuuugacugcaaauugauggaguuuaugaaaaauuuaaaauacauagaaacugacuuaaauucuaauuucuuuugcuaguuaaaauuauaacaaagaauuuuaaagcuaagcuuaguagcacaugacuauaauuucaguaugcaggaaaccaagguagaaggauugcugauacaaggguaguuuaugcuucugcuacguaguaauuuugaggauaguuugaauaacacaaggagauuaaaacaaacaaaaccccagcccaguaccaagacauauuccuauagucacaacauuccaggaggcugaagcagauggauugcagagagcuuagggaaagccugagcuacagagcaggauucuugucuuaaaacagaaaagcaagccagaggugguggugcauagccauaauucuggcacuuaggagcagaagcaggaggaccaagcaaggcaagccugggcuauguagugagaaccugcucucucacaaaaaaggaacuaacuuagcuauggucuaugcaacuguuuucuuuuugaaauuucuaauuaggaggucauucuagcugacaacuauuaaagugauuguaauucugugcuauuuccagauguguauguccauuuugucagcgggaacuggaugaagacugcuugcuggaucauugcauuauccaccacagaucagaaaggaggcccgugguaaugauucuugggguuuuuuguuuuuuuguuuuuuguuuuuguuguuguuguuguuuuucgagacaggguuucuucuguauaguccuggcuguccuggaacucacuuuguagaccaggcugaccucaaacucagagauccgccugucccaagugcugggauuaaaggugugcuuuaccaccgcccggcaaugauucuuaucuacuacuugucugucugucuguguacagcgucugaauuugagauacauuauaaaccgcauuguggcucaaugccuguuaaucucagcauuugagacgugaugaaggauagacagagcucuaugcuagcuuggguuauagaauuagaacuguaucugcuccucccccaaagaaauuagaaaucauacuuacuuauuuucuaguuuuuaagguuacuacauuuauuuaucauacacaguucacauguagggaugagggaacuuucggcacaacuggugccccucugaacuuuucaccagcuccaagaaacucucuuugauaauguguggcugggcauggugguucaugccuuuggaagggaaaagcaugugaacccuugugaguuuaagacuagccuggacuacaguagugauauucagaccagguccgucuacaacagugagaccccauacauuguuuauauuaauuaauuaauuaauuuuaauucuuaagaauaagauagacaggcaguggugacacaugcacuugggaggcagaggcauagguggaucuccgagcuggaggcuagccugaucuacagagaacauuccaggauauugagggguacccagagaaacccugucuugaaaaacuagagucagggcggugagauacucagauggagagagaaauguauaggaucuaacugugcagcccuagaugaccuugaacaacuuuguuuguagaccagacuggccuugaacucagagagaucuuccauauuaagauuugaagccaagcagaguaguagauggcuuuagccacagaggauucaaagcuagccugagcuacaugagaaacaaaacaaaacagugcuggggaaaugucuuagucacuagaaugcuugcacaaacaggaagaccugaguucugaucccuagugcucccuuaaaaccuguaugugauucaucuguggccccaggacuaggagaacagagaugguagauuccuagaacuugcuggccagacagcuagccuagacuaaaugcuuagcuucagguucagugagaagcucuggcucaaaaaacaaaucagaaggagagcugaugaacuggucaguguuuaagaacacuugcugcucuacagaggaccagaguuccggggcccagcaccuaugugguagccugcagcaaucucuaguuucaggauaucugauguucuccacuagggucaaugggacccaggcauggaugugacacacauaucauacaugcaggcaaacacucauacacauaaaaauaagucaguaaaucauuuuauuuuauuuuauuuuauuuaguaaaucauuuuaaauaaaauaaaauccucuuaaaacaaaguaugacaacuuaaguacaugaaguggaaaugaaaaauaaaaauaauuuaaaacacaggguggagaacaguugaggagagcaccugacauuggccucuggccuucacaggaacaugcacaggcaugacccuguacaccuacacacaaacacaugaacacaugcacacaucacacacaccaugaaacuaaaccaacaauguugauguguguccaacagauucauaguuaagauucacguucuauggugacuuccuuuuuaaaaaucuggcauuagccgugcggugguggcggugguggccuuuaaucccagcacuugggaggcagaggcaggcggauuucugaaugugaggccagccugguuaaccgagugaguuccaggacagccagggcuacauaaaagaaaccccgucuguauuaauauaauaucuauuaucuggcauuaauaucuugaauuauuugucuuucuuuccaguucuguccacuuugccauucacgaccugaugaaagcccaaguaccuucaauggcaguuuaauuagacauuugcaagucagucacacuuuguuuuaugaugauuucauaguaaguauauuucuaccuuuuacauuauauuuuugugaugucuguauuaagccuacuuuuuauaauccucauaaguaaauugagcauguagguagcauuaaguauuagcauuaaggagaaagucaggacaaucaaagugcuuuguagaguugacuacuaaugugcuggagagauggcucagugguuaagagcacugacugcucuuucagagguccccacuucaguucccagcaaccacaagguggcucacaaccaucuguaaugggaucugguauaugucugaagacagcuacaguguacucauauaaauggaaauaaauaaauaauagguuuuuuuaaaaaaaugacuacugauauugaaguagucuucuuuaaucagcuucaguggcacacaccuuugaucccagcgcuugagagacagaggcagacagaacucugugagugcaaggccagccugcucuacauagugagcuccaggccagccagggccucaugauaagacacugucucaucaggauggacauccaauagagaucucaccuucuguuuucguggaagcaaggggggcugcuuuguguuuuacguauagaagggcugauaugaagccuauauuucacuuugaaaaauaaaguugaagcauugcuuacauuuucucuccauaaaucaaaaauaaaguuguuagcauucuuuuugugaguacauuguugcuaucuucugacacaccagaagagggcaccugaucccaugacagaugauugugagcuaccaugugguugcugggaauugaacuuaggaacuuuggaaguccagccagugcucuuaaccacugcaccaucucuccaucccacuguuagcauucugaaucguagagguggccuuauuuuucccccacugcuagagaaaaugcucguuauuuagcucuguccccgagaaaacuagcaggaauauguaaacuuuauuccagauaugugugaaauacagauaaucauccugaccagaauuuauuucuuugacuuucuaaaucuuaggguuuuaauguaguuuuugcuuauauguauauguguaugguguuuguguguguguguguggggggggggugcccaaggcagucagaggcaggcauuggauucacuggugguuauuguagaguucaugaccacugggaaaagaccccagacucaauucagauuauaauuaauuaaauguagguaggcuacaagcaaggccuagagucucuaaccugacugaagcagaugcagaaagggcuuuuaaagguguaaaccacaagagcuguucugucugcgcaagcagacuacaaaagccagaaucagcaguuagucauagcagaacaagcagauggcugugcguuucugaguggggaggggggucaaggagucaggguugccaagaacuuaucuuccaggaacuugaguaagagacaaauagcuauuagguaccaacauggaugccuauccccaaguggaguuuuuuagccaucccagugggugcuaggaaauaagcuaggguccccuggaagaguuguacauggucuuaaccacugagccauauuuccaaucuggguguccaauuuacuauaaacuacucauuaaaaccuaauagcaauaguugaaaggccagggaagucaaacaggaaagaguaaccucaaaguaaguucugggucuaugacgagcuuccagaaaagacagacaggccauguaacugagagaauuuauuuccucaaauaugaacauugcauugugcuguuccucccaguucugaaacacuacugaccauuucuaaucauuuuucuguauuguaggauuuugauauaauugaggaagccauuauucgcagagugcuagaccgcucacuucuugaauaugugaaucagucaaacaccacauaauuuuaugacuaggaaggggaccauucacucguaccauuuaagaugcugcuugaaggacuggagggggauugucgacguuugauggagaaacauguacuacaguauuaccugcuugucuuuguuauguugcauucaaaaaccguguucauucuggcuuagaucugcccuuacauucuugagucuauuagacauuuaaccacgagacacagccucucagccauuaacagauggaagagacacgacacaggcuggcuaugugauggagcagcuuccuguguccauuagugauguguguauaacgcuacauauucccaacugucaucaugguuaggcgagaaagccaaucucuguuccaugcuaaaagacggagaaaggaacaaaauauggacauuaaaggaaaucugaaauguauucaaauucucaugcucuaaucuccaauaaggaacgugaauaaucuuaugaaaaggaggaaagggaagaauuugaagucaccaaaauccaauuuagccaaauuauaguacauaauauaauacugcaacaacuucugcguuugaaguguauucuuagccaggcauggaggagcaugccuguaauucaggaggugaguauagaaggggcaggaguacgaggccagccguggcuaaugagguggcuaauaagaccauaaaaaaaaaaaauuaagcugggugugguggcgcacgccuuuaauaccagcacucgggaggcagaggcagguggauuucugaguuugaggccagccuggucuacaaagugaguuccaggacagccagggcuauacagagaaacccugucucaaaaaaccaaaaaaaaaaaaaaaauuuuuuuuuugauagaagauguuucaaauauucuuagcuuauugcuuggaaguauuuuauaauguaggugauuucuaggaccccucuguggauauuuaugguaguuuucacauugggaaaucccgagcuuuguuuuuucauuuuaacaucuuaaaaaaguauaaaaugaaguacauguacuaaaagccagauacaaaaugcauagcuuaacauguuauaagaaacauuguuaauggaugguuaugccuguaugccuaggaggcugagcaggauucuaguucaaagccagccuggacuacauaguuaguugcaggccugccugggcuauaggguaagacccuguuucaaagcugaacaaaagcauuaugaacucauguauucagucauguaugaacagacuuccauccauuacaagugucacuuuauugagguucaacuucaauucucuuuccauuccuugaagguuggcugaguucuuaacacucuguuacucuccuugcugucucuuacagcaagcuuccauguugaauuuauuuccugcuaugaaccagagaucagcaacucucuaagaguuaugccugcaaagaggaucuguuguucaaggucucccucagcuacaaugcaaggucaaagacaaccuaggcuacacaggacucugucucaaccugcccccauuuucauuccagaaaaaaacuucuaaggucagugucugcuauugaggcugccauuguuugaaggagagagccaggaaacagcucuaugcuuguuguaaagauaaaaauggccaggcaggguagccaugguaguccaggaugacuggugacuagagacccucuugcuucagccuccuguguguaagggcacagguauguguugccaugccugcaauucccuauuuucaaaaacaguuggauggugccaacguuuuuaugcucuacccucucccuuuuauccuccaguucuucaaguaaugugcauuuauuauugcugucacuuuucacaugugauucuuuaauguuacauucaggucacuuacuaggauuuccaucuuggaauuaagaaaaaguaacaaagacuagagacaucaacuccugaggguaaaguguuauuugacuuaaaaauaccuuuuggaaagggcuggcaauauggcucaguagguaaaggcacuuccugccaagccugagagucagaguuugaucccugugaccacauucgugaaggagaacuaacucccacaagugcaagcauaauguguacucccuccucacacacacacauaagcacaauacagcuuauauuguaauuguuuauaagcaucaucuguugcacaucaacauugucauaaucauggugccaugauuucuucccucuuuuugagacagguucucauauguaugccuggcuggucuagaacucaguguguaaagcagacuggccuggaacuucaagugaucucccugcuucuaccuccucgcccugggacuuagaugugggcacuggcuucuaaaguuuuccuagugaauuauccguaacugcuuugauauugcuacuguuuucuccucaggacaagguuacuauauauaacaccggggagggacagggcuuccgggcagcccuugcauucccuggauuaacuuagguguuuggucagacccaggaacuguggucgcuaaggccagugcuggaccacauccuugcuuucccuucugacuucaaagucgcucuucauggcugcuaacaagugacagacuuuugcaaccucucugccuccagucuggguggaugauacaauauaugaaauaaguuguauuaagaagugaucaucagcccauaaaauacaguauaguucugauuauugguaacuacugcccugucagucaaucuagguuaacuuagggcaauaugaaagucaugaguaaguuuagaaaccuacugggggcuggagcaauggcucaacaccuaagaguacuggcugcucuuacagaggacccagguucacaccugccaguagcuccaguuccagggaaucugacaccccccacacaagacacacgcaggcaaaacaccaguacacagaaaauaaacacugacaagaccaaaaaaccaaaaccaaaaaaacaacaaaaaacaaacaaacauauucuggauaaauggaauggcucaguagauaaaaauacccuuugaguaaggcuggcaccuaagucugucugaaccccccucccccccccccgaacugaaccauaaaguuuguccuuucagaucugcacaugcacuguggcaugcucuugucugaauucacacaaaaagaauugggggggugggguggagagacaugauaagucagcaguuaggguccuugcuacucacuaggauugaggucucagucccauguaggacagcuugcugcagcagcccucaucuggcucccacugguacuuggaacacaggcacaugcucacaaauauuuaaaaaucauaaaaauaauuaagaaacccaacaacugcguaaauggggcaaggugacuaaagccucuaauaccagcaauugggagguagagacacaaugaucaggagcagcuuaaggccagccucagcuacauagcaaguuuggggcuggccugggguugguuacaugugauucuguguucugaguaguagguucaagugaaugaacagacugggaauccgacccacagcuuuuuucuuugucuguuuuaauuuugccaccuagaggauaaguuaggugcuggccaccugaguuauuuuguauucugaauugcuuuguuuugaaaaugagacgaagauauaauuucacugugcguuuaucuucuuuuuuuaaaaaaaaaaaaagaauuuaauucauugcuuuaaaaaguaaaaaccaguacucaaaguuguugaucaucaguaagaaacuuucaugugcuuuuuguaaauacugccuaaugaaacaacuggaccaggggggaagaugaugcuguuauuuuaaaacuuaaguucuccuauacuguugguagaaaacggguugauuguggaucagugguaaagaguuggagcuccuaagaaccccugacucugguaaugucaguuccugcugucacuggggacuaggcgugcuccauuucgaagugagccuacucuaguuuuugaauguuucucaugauaauuuguaugcuuacacauugaagguauuuuuuugaaguacuaacauucauucuuugguucaaauguaaaaagaacuugugaucagaauuuaaaguguauaauucuucuucuuuugaaaacuguauuaugagaaauaaagaguggcaggaccauugcuuucauuaaaauguuc

SEQ ID NO: 8834 - RNA, 4545 nt, Mus musculus
auuagagugaaucauauucuauauuuauugacaaacaaaacucaauuuaauucaugucuagcauuguuuuauaaucauuuuauucaaggacauauuuuucuguuucugucccuccccccacagugugggaugugugugagggggauucuugaaugccuccaacucccauugacagccucaaugaggguaccauacaucaugagauaaguaugaagaacauguccucuaccaaaaugcacaugccuuucugguccuagaaacacacaugucuuucuuuaagguccuagaauuaggcugagguccauucugaaugcuaagcagggucaacagugugaguccuaugggagggcccuuauuuaucaagugaacuccccaaguugaaagguuacauuugugaaauugcagcuggguccccuaacaguuaauccuagcuccugcaaaccaaagacucuuaauugaaacacaaaucugacaauaugauaauguuuuaauaaaaacgugcuuucuguacucuuaugugucaaagacugacaagagaacuucaaaagagguuguuuaaccagacaaaaauaauaagagaaaaaauauguuuuucaacaaaaccauaaagcuugaauaguacagagaggaaaaaaacagggaacuguccucuguuuuaaccaacuguguuucccccaccucuggcauguccucagcccuccuagacagggacugguaucuuccaagucagccccacacccuagauaccaaaacaggcuaaaguggcuccuagcuuacuuugagaucagacagcuucugcauuugagaguaugaggggguuggggggugggagggaaaacccagcauaccgauguuguggaagcugcaaacaacagcauauacacagacacaaaaaaguuugcauauugcacagagcgcuugaagaucauaaaucuaugcaugagaaagauguaguggaaauuuugggggggauuagaguuuauuuuugucaucucugugagacagcuacucauucauccagaucacagcuaagaaaaaagcuggucacagaaauuagcaguuucagcucagcagcgaagucgccagccugugaaggcagagagaaauugacuaauuagcaaugcgcacuaaaacuugacgguucuuuauagagagaagagaagagagagggagagagagggagagggagggaggggggcucgcuuuuuccccuucuuucuuccaaagauguuugaaaucgcagucauuuacgcucgacaauuuuuacaauagccuugagccauaauuuugcgagucucuccagcauccaucccccuguauggucucucucuacuggccaagcacgaccauuucucuccccaaccguggauuuccuauuacucucguuacgacucacugagccccaggcccaaggauaaugauguguuguuucuugguagcauaauuugucacacguacauuuuuucuucuucuucucuugcagaaagcucugcucccucucucucucucccucucucucccucucucuccucucucuuucucucuuuucucccucuccuauauuuucuugcuguugcuaauucauggugaucaaaugauguacgacaaaauaaauuguacagagugacugccuggaguugggagccagaagguguguuccccucccaaggagagagcaaaccuuuaaaaaggaaggacaauugauuuuggggggagcuuaagugagcccugacuuugcagcuggcugacagcagguaaguuucuggccuuggguuugccuugccuguauuuuccuugucuuuugggguucuugugggugcggggggggauacuuaagggggggucguguggcaaacgcuuauaaagaauaaaacucucauugcaagaaauaagcagaugggagguggaagcaaggggggagaacaagaaggaaagacuaggaaaagauuggggggggggcggcuagacaacgaagcugggagagcaagagagagguaugaccagggccacuuccagugaggacucaaauguuuccccgcaagcccgagcuuugggggagggugguuguggcugggggagggagguuaggguccaccuggaacaggaugggaaagugaguggagaggagcccagucugguaggaaugaagccggcgauccagaagccgcgccgggcaaggcagagugagccgcagcggaaggggcagguccggcgggucccucggagccgggcggcggcggcgguggucccggcgggcgcgcgggcgggacacgggcaagagggucccuuccuguucagcccugaaaggugcaauuacagauuaaggacucgguuuguggauuucaccuagccucccccuccccggccuccuaccaccuagaagcgggaggcucagacuuuuuacagaaguacuucagggcugggggaguuggggggggggugcccgagugggggaccucuggaagcugaaccccggggaucgaagggaugcuugucccaagauccaucugggugcguagcagagaccccuccacacuggaccgcgcccccacccccaccucauucccgggccgccaccccucccccaacaccugccuucuaacuugaacuucucauaguuccucuuguuaaagcgacugcuccuggugcuugagagcgagggagaccaauccauaccagugccuccuggccucuagucuccugcucuaaauccagccuagcaccccaacuugcccccagucauccucggggccgccccgcacuggaaggggaacuaggugacugaacuuccgugcucugauauagcaaaggugcagggagaagggggcccgagguggggugaguaguauggguggaaggagucucuggccagguuuaaaggcgccucuggaaaauuagcaaaucgggguggcagcgaggaaagccaacaguuugcgaagcggggaagcgggcagggccggggugagggaaaugagcuagaauugauaaggacagcucccgccucugccgaguccacugagcggguccccaucgcgcuccgcugcacuuccccgggagaagaaagggcuuuaucucuucucucagacugugagccuaggacuuuuucggggcagcgcggauaaucgaagguguccccagcuuuuagaaagcuaagaaucgcccacccgcacgccugcccccccuuuucccaccccacccccaaacugggccaacuaagaaaaagcaaagcuuccagcaccaguugaccuggaaccgccgccgucggucgccucugagcucuugaggcacccccugacuccccacucccggccuuuccguucauccagccgggcauggacucgagcccacgaggugucacggccucagccuccacuuuugccgccgcugcuaucaccgcuguugcugccaagagagaagccugggugcuuuuaggaaagugaggggcgaaguguauaagagauagcaaggagcagaaccgaagucccgaccccagacgaggacccuucuggaggcgcucaggacccggcgccuucacaccucccucuuagguucggauccuaagagcgcagggagggaaccaagcggggccuugauuguuguuccucucuccccuccacacccuuccccaccccgaccacaccacaccccacccccuacaccucccugcuaccccucccaucccccacccgucugccagguuggaggaggguuuaaagccaggugcgcagagucagcucgccauguccagauccggggacaggaccuccaccuucgaccccagccacagugacaaccugcugcacggucucaaccugcuguggaggaagcagcuauuuugcgacguaacccugacagcccaaggccaacaguuccacugccacaaggccgugcuggccuccugcucgcaguacuuccgaucacucuucuccagccaccccccucucgggggaggggucggcggccaggacggccugggggcccccaaggaccagcagcagcagcagcagccucagcagcagccuccacagcagcagcagccgccgccacaggaggagcccgggacuccuuccuccucccccgacgacaagcugcugaccagccccagagccaucaacaaccuagugcugcagggcugcucguccaucgggcugcgccuagugcuugaauaccucuacacagccaacgugacccucucccuggacaccguggaggaagugcugucggucagcaaaauccugcacauuccucaggucaccaagcucugcguucaguuccucaacgaccagaucucggugcagaacuacaagcaggugugcaagaucgccgcacugcacggccuggaggagaccaagaagcuggccaacaaguaccugguggaagaugugcuguugcuuaacuucgaggagaugcgugcccugcuggacucgcugccgccccccguggagucggagcuggcacuuuuccagauguccgugcuguggcuggagcacgaccgugagacccgcaugcaguacgcgcccgaccucaugaagcgccuccgcuuug

SEQ ID NO: 8835 - RNA, 1878 nt, Mus musculus
ugacucgcugucugccaccgucagaguccacucgggagagcccccuuggcgccgccucuuccccggguggagggugcagguagagaccccagcuggggaggggacccauagguacgagguggaggugguucgcugaggaacuccgggucagacccgcuaaacuagugaccgagagaaaagugccugaggagaaagggagauggcuguuggcuguauucagccaggagcaggaaggagggcgaggcuugcagaaagcauucaaaggucaugaugccccacccugaaguacccgcgccuggggucugcacugcuccccgaaacuauuugcacucauuccuaggaccugguggauaaugaguggcaaacuaguuuuuuguuuguuuguuuuuuuccacgaauacuaauuaaaagaagcgccucuuagucguauagcgcgauuaaugacuuaguaucuacauauuccaaaucuaccuuuugauucuguucauguucgguucuagcuggaaaauagguuccggacuggggacgcucauuguggaagcugauuggugcgggcacuuguccaucuggaacugcagcagcuguuuuuaaugaaacgaacuaagaaaaugcucuggacucaauaccaggcucaguaucugcagcucuuggacguugucccgacccuugcuguucacaauacucuccagugucugacauggaaacaaauugugggacuccuuccuuuaguucccagagagcagggucagucuuauccugcggcccccacccuucccugcauuaggggaagaaugcgucucccccaguguucuucaaauggagucuuuauagggguugauuuagcacagcacucaucuaacuucuugcucagaaggauucucuggggaucuaguuaggaaccaauucuguuuucaguggauccagcguugagcugauauucugagcaucuacugaacuccuguuugauguaaacgcuuguuuaaggaucacacuuuaaguacaagguuuauagcacacucucugacacuggcuaacccuuguugcaucuucacugccuaauuuucaagcuauaagacgggacugguauuaauuauucuccauguugcuuggagaaaaugccagcaaaugcaacucaagggaggagggguuuauuuuccauagugacaaggaaagaucucugcaggagugugaaacugcuggugaggaggcagagagcaaugaaugcuguccagcucgcugcucacuccuuuuccuccuggaaucacagccaugggauggagcuacccacauguaggguggaucuuccuaccuggguuaauucaguuucacagauguucucagagauuugucuccuaggugacucuaggaucuugucaaguugacaauauucaccaccacagcaugcauacccagcuagcucauugcagguccaggaucuauccuaguguccagcauaccaaaguuuagaaaguaugagcuaauuaacugcugggguccucauagcagaugugaggcccaguaugcuugcaggaggaguguaguaucaaaagggguguaacaauaagguagcugccccacaaacaaugaccauucccauagcacaucagacuuguagaugaguagauguuggugaaaugaaaaaaaaaaaaauggccacagggcagaggaaaucacacuuguuccaaaaguucauuuucugcuuuaaaucgugauauauugguucucagacauugaauuaaaaaaucauuuugcuuuucauuacagauaaugcccagcugccuguuggaugggucaucuauuuuaauauuggagcaaguaaauggauuguuaaaaagaugaacauuuuucccuccucauuaaaaaucuugaaauuuaaau

SEQ ID NO: 8836 - RNA, 1343 nt, Mus musculus
ugcacuuccucuccucuuucccuuuuagcauuuaaaggaaccauuagguggcgggcacuaaaggagcaaacaaaccggagaauggcgagaaagggaggauggugaggagcgcgcuugcgcuuaaccuggggagcaugcaggaaaagauggaauccucuagaugaagcugcagugugugauguuaaaccaccagauugauggagcuuuguaagaauucugagcgcugauuggugcaaggauugacagcagaggucacagugucagacauucaccaaaauucucuccauagaagucuaggcugauuagaaagagacuggacuguuucggaucuaggagaaaacaaaaaaacaaaaaaacaaaaaccggcgccgcuacgcauuuucugaagaguuuuauggucucugcaugggugggggagcccuucuuucuuauuuacaguagaaggugaugccugauguuuugcugaggucugauuugaggaugggaaugcauuguauuguauugugagcuuuuugauuaaugaguugccugugcuguuggcaucuauuuugcauuaacauaucuggcaauauguucccauagauaagcucauuaaaauuguuugcauuguuugauaaggauaacaaugugaugccgagaacgugggucuuaggcagcucaaggccagacuuacagggagacagauagcuuuuuccucugaaguucuuuuguacuaaggugguuauuuuuaaacguaaccuuuauaaccaucaacgaugcuuuugcuuuaaaguagagcacacauaccuguaagaugcauccucucagccagugagcaacaggaaauaacucuuuuuuaaaaaaauaaaccuuccaucugaauuuccaaauuauauuauggguggaguauucuguguucaaauucuauaugcauaucauaaaguagauuuccuuuccuuuaaguagagacuccauuuguugacucaaaaagggaggggaguguuaaaagcaacccuuugcccugucaucucuggcaguuauauaaauacuuaaaguuaauuuuggcuguacccauuaggucaccaaggcucacgucuuaugguuccaauaaauagagccugcacagcauccuuaaagauuacagcuuguuuuucuccuaauguaagccacggcucauccucaacuucugagacucucccucuuggggaucuugcaguuugaaauucugucuccuccuuaccguucuccacugggaacauccaccucaaaaccuaaaaagagaauuuagaaaugaacagaacagguugcugugcuuucacgaaccguucuuagaggcgacacacuugaaguccuguuuccuaagu

SEQ ID NO: 8837 - RNA, 1343 nt, Mus musculus
acuuaggaaacaggacuucaagugugucgccucuaagaacgguucgugaaagcacagcaaccuguucuguucauuucuaaauucucuuuuuagguuuugagguggauguucccaguggagaacgguaaggaggagacagaauuucaaacugcaagauccccaagagggagagucucagaaguugaggaugagccguggcuuacauuaggagaaaaacaagcuguaaucuuuaaggaugcugugcaggcucuauuuauuggaaccauaagacgugagccuuggugaccuaauggguacagccaaaauuaacuuuaaguauuuauauaacugccagagaugacagggcaaaggguugcuuuuaacacuccccucccuuuuugagucaacaaauggagucucuacuuaaaggaaaggaaaucuacuuuaugauaugcauauagaauuugaacacagaauacuccacccauaauauaauuuggaaauucagauggaagguuuauuuuuuuaaaaaagaguuauuuccuguugcucacuggcugagaggaugcaucuuacagguaugugugcucuacuuuaaagcaaaagcaucguugaugguuauaaagguuacguuuaaaaauaaccaccuuaguacaaaagaacuucagaggaaaaagcuaucugucucccuguaagucuggccuugagcugccuaagacccacguucucggcaucacauuguuauccuuaucaaacaaugcaaacaauuuuaaugagcuuaucuaugggaacauauugccagauauguuaaugcaaaauagaugccaacagcacaggcaacucauuaaucaaaaagcucacaauacaauacaaugcauucccauccucaaaucagaccucagcaaaacaucaggcaucaccuucuacuguaaauaagaaagaagggcucccccacccaugcagagaccauaaaacucuucagaaaaugcguagcggcgccgguuuuuguuuuuuuguuuuuuuguuuucuccuagauccgaaacaguccagucucuuucuaaucagccuagacuucuauggagagaauuuuggugaaugucugacacugugaccucugcugucaauccuugcaccaaucagcgcucagaauucuuacaaagcuccaucaaucuggugguuuaacaucacacacugcagcuucaucuagaggauuccaucuuuuccugcaugcuccccagguuaagcgcaagcgcgcuccucaccauccucccuuucucgccauucuccgguuuguuugcuccuuuagugcccgccaccuaaugguuccuuuaaaugcuaaaagggaaagaggagaggaagugca

SEQ ID NO: 8838 - RNA, 11111 nt, Mus musculus
accggaagccgugcgcgccgggggcuugugggaagcggcuggaagcggcggcgcugcgucugcccgggacgacgaggcugcggcgggucccgagccagaggucagcggcgcgcggggguagggcucgaggaggagggcgcggguaggggccgggaggccggcgucgcucggcaucccgggcgugcgcacagaaggccgcggcggaagggccgcggcggccugcugcacuucggggguccgcagagcccccggcgcccgcauccucgccgcccugcuuuccccucccccacgggccgguuuuguucuauuucgaggcucuggcggcucgcguaggauucugggagacgcucaagcugaagugggauccggcgguucucgcgcaccaccuacugggauuuguaguccugcuggucccgggcggaagugccuguccaguguggcggggccucugcggcccuccuggugaaugcugggaagaggacggccgaguugcuggggcaggcugggcacggcgcugugaggcgggaggucgcugaagaccuggauccugccgagugccggauugcacauuccacgagcuuggugcaguacaaaguaaaagaaaaagcaguuucuguuauguagaaauacgugagcuguugauaagagucggcuccaggaauaagaacaaauaacuuggauuuuguucucaggccaucccacucuuaucuauaugaccugucaguuugauacagcauuuucucauccuuugucuucaccuugaccgguuucaguaagguuuuguuaaguuucugguuuuuugguucuuggcucugauugauuaaacaguagcuguagaguuaagagugucuaugugcuguuauccguggcacgguuaugauuuugcaaauaccaaaaggaccagaaaguaguucaaauuuccccgaaggaaaaguuagggaagcugacugaggaaaaaagacuccuguccacugagaacuguaagugcuuuuuccuaauagaauuugcugcagcugauacuuguuacuguaaguuuaaauguauauauggugugguggaugccugaguaacauuugcauguuaugugaaauagcuucuuccgcaguguuaugcgaucgguuacugaacuguguaaagcagaguuugugacagaucuacuagcccagguuggguuugccauguagacgaggauaaccuugcuucugccuccguguugagguuacagauuuaggacacauagcuagcuacuagugaacauuucucacauauauuuuaaguuuagggaguuccuaaacaaacaacauaguauuuaugcacaauuccgagaguuagcucagcaguagaggaggguguguaaggucccuggauaagucucuaauccgggggguucgggcuggggcugugguugaucuguuuccuacuccagguuugcaaaaaaugaaaagaaaagugggaugggcuagguggcucaucggguaggggccuugcuccuaagaucccagauugcacauagcaggagggaggaacuaacuccugccuguuguccucugaccuccacgccugugcugaugcauuccagcacaaaauaaaugggggaaaaaaaguuauacaugucccaccgcucugaauguuuaguuuguuaucuuauguauauuuguaccacguguuugccuggugccuaaggagguuagaagagagaggcuuguggugcuggaaacaaaccaggguccacugcaagggaacaccuucuuaauugcuggaccagcuuuccagucccaagcuucagagcauuuggagaccacugagauagauggcuucuuaccuggauuccuuagguuauuaaauuaccuuugguugaccauaugucacagauuggcaaucuuuuuuuuuccaagaauggacaagauaguaaauauuacguuguuuuagaucuuagcugaaaucauugaaugcugucaacucuuaccauuauagccugaaccacaauuaaauuuaaugacuuauauacacaaaauuuaaacauauuaauggggcuggagagaugguuuagugguuaagagcacuggcuguucuuccagagguccugaguucaauucccagcacccacauggcaguucacaacuguguguaacuccaguuccaaggggucugacaccuucacacagacauacaugcaagaaaaaccaccaaugcccauaaaucauuuuaaaaaaacauuuuuacaucuuauuugugugugugugugugggggggguguacacgucguguccggcuugugcagaaguaagcuuucgcuuauguacuuguuggucaucggacucgggucagcaggcucggcagcaggccuuggccaaccaagugacccugcugauccuggacagauacaucauauuuucucaacaagaaacgcuucugugcuuuuuagucauuaaaauuuuuacacuacuuuacuauggaugcuguaauaggcagcaggcuagauuggcuauaauuuagcagcuauguuagaauuucaaucgguauagguuauagguuauuaauuggaauuuuuaauccaguaaaacagcauaucuuuuuugcugcugcuuuugaauaucaugggauacuuggugauuuaugugucuucuguuucuuauaccuuaggaguacuuuugaggaaaacaggguauuucucugagguguauaccuugccuccauugccuuuucuugaaguacuguaacagaaugucugcacagucaguggaagaagauucaauacuuaucaucccaaauccagaugaagaagaaaaaauucugagagugaaacuagaggaggauccugauggugaagagggaucgagcauuuccuggaaccaucucccugacccggagguuuuccggcagcgcuucaggcaauuuggauaccaggauucaccaggaccucgagaggcggugagccagcuccgagaacuuugccgccuguggcucagaccagagacacacacaaaggagcagauacuggagcugguaguuuuggagcaguuuguugccauccuacccaaggagcuacagacuuggguucgagagcaucacccagagaauggagaggaggcaguggcuguucuagaggacuuggagagugagcuugaugacccuggucagccggugagcaugcuugccuuauuuucccagguggaaauacucauacagcaguaggcacacugcugaguuaacuucacuuggcuaaguuagaagcauguuuauaccuccuuccaguucccuugcaacuuugcaauaccuggcugcucugcuagcuaggauucucgugucucuguauaguuucuguuaugugugcuuagugucagaaugucuucucaaccaaacugaacucuuguuuucagguuucucuccgucggcagaaacgggaagugcuuguagaagagauaacaucucaagaagaugcucagggauuaccgaguucugagcuggaugcuguagagaaccagcucaagugggcauccugggaacuccacucucugaggcacuguggugaggaccagggcaccgugugguguggccuuuccccagagugcuuugcuuguucuuguggcaaaauccuuuuaaucagaaauuccuaugcauuaagagcuugacuuuuucugaugauugauucauuggccuuagguauuuuuugcucccagacauuaccaucguuagcuuuuuugcagucuucuucaugaagaccugccuaucuugggcucacaucugcauuucucagccaguaccuggagaccaagucuguuuuggugaugggauugcuuagcugcugucugcuaaugcccuuugcuuucaguuuccugccuaacuguauugacauggugaauuuaucugaaaccuccuucagccuuuuuguuuauuguaucaccaaaguuuuccuaaaauuccaggaaauuuuaauucuaauuaaauuuuaaaauuuaauuuaaauuuaaauuuuauuuuuguuuuuuuccuucaauauucuaucuagagccuuuuaagaaacuuucuuuuucuccuuuuuauuuuauguguauggguauuugccuucaugugugucuauguagcaugugcuuauugggugcccuuggaagucagaagaugcugucuaaucuccuggagcuggaguuacagaugguugugagcuuccuugugggugcuggaaauuaaaccuggguccucuggaagaguagccagugcucaaccacugaacaucucuccagcccccuuaagaaacuuaaaaaacauuaucugucuuuuaaaacuuacauguaacuugaguacaagugugugcauguaagugcaggcacugucaggucaggagagagccuugcaguacugguacuaaugccaugcacuugucuauaagaccaaguauacuaaacuuacugugcugcaguugguuucugugacauuuuguuugagauuguuucaggagucaguccuugagguagguggaaauuaauacuagcaugccauaaauuaagauaugagcaguguucuuccccguaggaguggggcuacaagucagaacugggguacagguguaaucugccacacugguuuuaccuaucaugggagcgcguucuguugccuaguuuaggaacuguacuuguccuuucaagauaugcuuucauggguagaaaacauguccucuuccuaaaugucagaauugucuguuggccucauuuuagcaaacaaguagcuuucccauccacaacauuccguuuauuccaggucauauguccaucuacccuucauacuugacuuuucaaguauguaggccucauggccccucaggcccuuggaucucccucucuucugcuuucucgauugacuaaccuugcuaucacuuaucccgggcugcuuuugagugcuccugcucacugugugacaacugucuacucuguacugcuuaaaguuccagaaacauguugguucuuaucccugccugcggguagacagugcugccacuuaaaauauugaggcuuuuucuuucuggacacaucucucuaagacuugaacaguuuuucuagcugucaugacaaauuccaaguuggagcaaguuuccuuaguagggaagcuuauuuauuguguauugaaguuuaagugucauggcuuuaguuaacauaggcuguacucggauuagacuuagcuuuuugucuuguuauuugagacuuggucucacuuuguggcccugacuggaacuugcuuuguucuuggaauuggcauugaguucacagacaucuucuucccuucccuucccugagugcugaguuaaagguauaucucacacacccaagucuuggcuuuuuuuuucagucaggacuccuguauucugcuguaaguucaguauugggugugacagacugacugauuucagcaguagcuacuguuugacagauuuuuugauguaauuucuuuaaaaaaauuuuuuuuucuaacagucauuguuuuuuucccaaaguuuuuuucagaccuagccauaucaguuggauuuuucucccuuuaucugauaaucugucaccuacucuauuuuuuuaauguguguauuauaugcauguaaguguauaucacuuguucaggugcccaaagcggucagaaaaggaaguugggucccuaagagcuggcguuguaaugguugugagcuuccuggcagugcugggaacugaacuuggguccucuggaggaucaagugccuuaauggcugagccaucucuaaccccuguguuaaauuuagaugaaaccuuuugugccauuuugcuaucuugccauuagcucauuaacuugauagucuucuuucuuuuucuuuuuugagaguagucaaccuuauauauucauagaugugcauaaucuguuuauuuuuaguucaugaaaaagguuuuuuugccagguaugguagcggcacacuuuuaaucccagcauuugggaggcagaggcaggcagaugugugaauuggaggccagccuggucugcauagcauguuugaggcggcagcagcugcauagugagaccuugucucaacaucaacaacaaaacccccuuucccuucaaguucuuuccucuccagcuagguauugagugauguuuacauuuucucuguuucagaugaugaugccacgacagaaaauggagcacuggcucccaagcaggagauggcuucagcuggagagucucaugaaggccccggcacucucaacauagguguuccccagcuuuuuaaauauggagaaaccuguuuucccaaggguagguuugaaagaaagagaaauccuucuagaaagaaacaacacauaugugaugaaugugggaaacacuucagucagggcuccgcccucauucuucaucagagaauccacaguggcgagaaaccguauggauguguugaauguggaaaagccuucagcagaagcuccauccuugugcaacaccagagaguccacacuggagaaaaacccuacaaaugccuugaaugugggaaagcuuuuagccagaauucugggcucauuaaccaucagcguauccacacuggggagaaaccuuacgagugugugcagugugggaaauccuacagucagagcucaaaccucuucagacaucagagacgacacaaugcagaaaaacuuuugaauguugugaagguuuaagaaauuaggaggaaacaaucagcacucaggucuuuuucuucagaaaugaagacaaaauuaaaaacaugaagagauauggaaacuuauuuuucccuguugacugggaaaaucuacugggaaauagaaaaaaaaaacuucauucaccauuauuaucuugaaagaaaugguguuauaccugccuagaaacugaaauuuuaaauaauucagguguuaauaccuaaauuuuucuugugaaguuuauauucucuuuuuuuucuccccaaguaaugagcuaccugguucuuugucucuuuccuuuuucagacagcuacuuuauuucuguguuggucauuggaguguucuguaagggugcauacguuuuuauuuuaaaaggcaacauaggaauuguaaaaucuaaaagcccauccucaagacucagaaacauccuuuaaagcuuaguuuccuuuuguucaggaugaguguauuugagaaaauagaagauaaaggccaaagccucagacucagaugagccuuaagaucucagaugagagaugguagcaaaacuucagagaguagaggggacacacugggcacuuacccagugaagcaugucacuuagguacagucauccuguaggaaaacucgaaaagaaaagugauuuuaccuaacuugugggaaucuuacuaauuaaaaugguuuuccuguguaaaaacagacaguuguaaaagugaugguaaggcagacacuaaggaagaauguagugauguugaaaggcaaauguaaaguuagguaauuacaugacauggcuuuuagaaaaccucaaacaucuaauucauuugccucaugcuaguuaaggacaggacauuccuugaugggguggguaacaauaucagguuugcuauuuuuauuccuuugguacacaaggguuuaacaccaggcuaaaacagccauacauuuauuauuaaacauuucuaccgacaaugcacugugccagguacuguacuccuaucgucagucgguaggaaucuguuccacuguaagucacaagggauugauuuccccucagcauuccccgcucaccucugagagccccagaguuguaguucucuugccagugugcuguguuuggagggagaugucggcucagagucagcuagucagcucuuagcauucuucagaggugaguucaaaucacacucuuuuaguuugaaaguuaaugaaucuuaaaaauccaaacaucauuucuaguagcauugugguuguaacuacacguugaaugaacuguacuuuaaacaacuaagcuauuaauaacuaguuuauuaguugucagaauugauuuuuuuuuaaauuuacagucuuaacacauuuuuaaaaaaaauuuauuaagaguaauacauuuuaguaguaggauucuguaugccuguauacuuggcuaagaauccaaguucugugguucuacuauuuaauggaaaacucuggaaguuaaagcauuggauaagagaagaggcuuuuuauauaagacaggcacuguuacauggaaaacuauccaugcaaguacagauauuucauaguuccagugauuugggucauaucuggugcuuugucaaauuuuaacgugaaaaaugagauuuuugccugagccuguugaaaagcaguaauaaaugccacacagcuagugaagugaggccgaaugaagcuuguucaugauuuucugauaacaauuauaagaaaugugcuuuauagauuuaagauuuauugaaguauaaauauguaguaaugcuauaauguauuuuuaaguuauacaagaaaauguagggacuucuguuuggguuuuucucuguggcugagaggaaacaaguucauguccaauaaagcugcaaacuccucugcucuagauaaaguagcuuggaauugccuuacuuauuuauuaacaacuggcuucucucccaguaggacuuugaguuggcacauuuauauaaagcccgcagggaugacagaacucuuaggguagguaaccucuggguggaaugucaggcuuaacaguuuaggauagauuugucuccgaggccaaagcugcaugugacgugaaagcacagaaguagcauuagaguuggugaacguaugaggucugucagcccugacgccguguuccuuuugagaaggaagcucagacaaggcucuguggggaggggacuggacuaaaacccuggugguuuacaggaaaaggacgccgugggcuuuguauuuaaccgacugcuuaaccaguuaauuuacaguuagugauugcugacuucacacgaucaccacacauauuuugggagguacacaguaaugaaguaggcugguaacaagugccaagcaguggccuagcuagcaccuuucagguuagcaauucuguuagugcaugcauacuaacugacccuacagucuguguaguggcuuuuagugauuuaaauaaucacaacuaguugauguuugaccauugcagcccgugugaguuuaggggauguuuucuauacugaaacaguuugcuugcuaagcauuggauuggaaugaauaccgaaucucaccuagaacuguggacuagcaaaaggacccaaagaucaugugacuuggacuuggcagggcuacaacucccaaggucagguuuuuugauuggucuguugagagugauggcauaagugaaguccugcuuacuaagcacuacauuuuuuuuccuaguuaacaagcuugaaaagcuauuauauaugcccauuugaauuuuucacagugcaaaaacaaaagccgaaaaagacaucagauuuagccagaaauagugauaauuggguuuauuauccuuccaaauuuagcucuguacauguuuaagcaaacaucuuuuaaaauaauagcugaccuuugggguugaguacaggcucccacuacagugcuuuaauccuccacaaaccugagauaguaacauaucuccauugcacaucuguagugagacuugcuuucacucccuacacugauguggacauuuucauagcugcauagcauuccauugcaugaaaacacucaacaguccaucuaagcaaccccauagugauggguuaguagguucuuuauacauaauagauauggaugacaucuauagacauacauuuacuaccuauguaguugggucuguaauacaaaugacuagaaauggauuuauuggcucacaaaauauauauuugacauuuuggggggaacuacagcuuacacuaauacuccauugguaguaauacccguuugcuccugucagugcugcucauccuagaggccaguucauuuucuuguugcgccuuuauuaguaaaauggaacauuuuuguucauuggcuauuuuuauguccucaucuggucuugcucauuucuuuucuuucuuuguuuuaauuaugaaaguauaaauaacuacaguuuacaccaaaaaaaaaaaaaaguauaagagcagagaccauuuucuucagggcuucugguugguuccacuuugcaguguacuguacauccaaguacaguuuccacacauuuccauaugaauaugcagaaauguggacaccuuuuaaauaaacuggauuauaugaggaauuuuaagauaucuuuguguuaaacauucugguauuuaaauuccuguaaggugcauggucagcuacuagacacucuacuuacucaucaauguaaucuuuaccaacuaugagaagugcucauuuccccacauagccuuaucuacacuugauaguccuuaucuguuugggauggguauagagaaaaaaagaaacuguccuuacauuucucugaagaauagugaaguuggcuauuuacaauucccugcggguugguuggucauucauagcuucuacugcuuuuguaugggguuacgugugggugucuguucuguauuucucccuguauguaugguaacaguaugguauuguggauaacccaucccauaugacuauggugagcacacgagcaggcuuggcauaagccauacagcauccuagccacagugguuagagaugaggcauacaguuuaaaggcuagggagagugcucaacagaagugcaaacacuggcaagaagguuuuggagauacuggagacccgaggaugaugugagccugcauucuuacuauauggaggacauauuggaggagacauucaggccagcagggauggugagaaaacuuaaguucuaauauuuuauuugggggcccuagauccagaugugccuaaagccugcccuaccucuggacuuuaaaguuuuuugagccaauaaagucccuuucuuguuuaagauaguuguauuuggcuucuguccugauuaauauauaggguauuuguauuuucuuacugauuuguaguaaaccucuguaguuuuaaauuauagacuucaugcauuauauaaguuaauaaaauuagcauggcuuucugugauuugggcucuguuaac

SEQ ID NO: 8839 - RNA, 859 nt, Mus musculus
uuuuuuauugauucuuugugaauuucacaccgugcacccgaaucccacucaucuaccugcccucugccuuugcaaccucucccacacaagaaaaaaaagcaagcaagcaagcaagcaagcaaacaaaagucucaccuugaaagcuacagugugucacagagucucauacaguacacucuucuacccaaacagcuuuucuugaaaauguucauugaaaugagucauuggucugguucgaggccucugguuucugcuacacgaucaauacuggauccucacuaggacuccccuugcauagccucuuguggagaucuuacagcuuugguucuggaggaccaaccccuucacguguuccuguaguucacagaucggguagauuuuggagugggcaaauucaaagcccuggaucugggccugugugcuagucagccugacagcucucuagugcucacaccaccagugccaacucuccaggacugcucaggugaggagcagggccaacucucccacucucauacccuugggcccacaccaccagggucagcuguacuaugcugcccaggugaggugcagggacugcuuucccuagugcuacagcuggcaagggacggaaccagcucaccugcucucacgcccuuggcaccagcuguuccaugcugcugggcagaaccaggucucccgaucucacccccuuggggcucucaaggccagcucuccugagugcugcagacaguuucuguuuggucuagcucucucgguuucacaccauaagaacauacuucauuuaagcugugagaucuguuaacauugucuuccucaguguguaguaugacuuauaaguucuaaagauguguguuca

SEQ ID NO: 8840 - RNA, 81698 nt, Mus musculus
agucgccagcgccgggcuuggcggaaccacucaucccgccacagguggcuccgcaucaggcguggccuugugcggcgccccgggccugagcgcugcgacggcgccuucguuuucagccgcccgcgaccgacucgccgaggcuuuacucgcuugccgccgucuuuguccgcacacaggugggcaccgucuccugcccgaggcccuggccgggacaaccggaccccgcgcauccggggcgggugggacaggaagcgacugcaccgcggaaccaagcgcggcgggaagacucgggcgcagccggcggccgacgaggggcgcccgccgcgggggaggggucgggcauccggugagcgcggccccggccucccccgcgcagccgcaccggccgccgcggccgagcucgucccgcgaggacugcgcccgggcggccuugcgcgcgggugugcgcgccucgcugacggggggacgccgggcgagcgccgacugcggcugcaugaggcgcggcgggaacuagcgcgccgagcccgcgaggcccggcacggaggcugggggggaggcgggcgcggcggaggcggagcucgugccgggcccgccugcccacgggggcgccgcuggcagaggccgaggaggcggcgcggcggacugcggcccgagaggagcgcccgcgcugcggcccgcgggagcgcgccgccaccgcccgcgccggccugaggagcgccugccgccgcgcgggccgaggugagugcaccgcaggccggcgggcuggugacgccggagcggagcggagcggagcggggcgaggcgcaggcccgggcgcgcccgccuccucggcccuuuguggccgcgcggccggggcgcgggguccggcggcggggacucccggcccgcccggcgcgcggcgucucccucugccgggcagccgcgcagagcugcgaguuggcguccuaguuugacauugaguuagaaaccguuuuucuucagaagacggaaguuuguuuuauugacagagguacaugcagcuaaacauggcuccugguuucggccgggugggacuugcugccgcgguaccgggcugacccuagcuggucuggagcgacgggggagggcgcccgggccggggccgagcccuguaccugggaaguagcgggcugcaggcggugggaaugaaugaaggagcccagagcacaaugcucagagagacugaccaggagucgggaugacuugcaccgucacugccucguacuuagccuugcagaggggacccccuuuagccccccaccacauuuaugaccuuggccuucuuucagagccacugaaccagacucgcuuggcauuucugguaccugugggcaaaaggcagaacagucauugugcucuugaauuguuucuggaggacagauuaugucaccuacaccccacuuuguguuuaauagcaaguaguucuuucugaucguaucaagaacucuagaaaguaggagagcuuguccuaauuuucauagaugacgaugaagccccaaagaaguuaacaaaguuuucaggucacaccuaagcugccgaguugagauucagagcuagacuuugguugucuaagugcucuuugcuccaaauuugugucuagaccugucauuguccagcgugguagccauuaaccauaugugauuuauuuaaaauuaaauuuuaaaaaguucagcucuucucucaguagccacauaucaaaaauucaagagccaaauguguuagaguugaauaguguucaucuugaccauuuauuuaucugguaaauguuuacugagugcuauguguucaguguuacguuuugggaguacuguggugaauacaagagauaaaguguacuugccuuuagggagcuuucguuugacaagauagcuugaagaucuuucugugguaugcuagagccuuguuauuucuuucaaauguaguucauggacuagaaacaucuucaugaucuggggaguuucgaagaaauaguucagccacccauccacaucgacugaacuagugugcuugauuccagguugugugugguuugaaaucugagaagccuuuauucuuauuuuauuauuauuauuuaaaugugcauggguauuuugccugcacauuugucucucuguccuguuggugccaggagagggcuucagcccucuuggaguuacagauaguugugagcugccaugugggugcugggacuagaacuuggguccuaggaagagcugucaguguuccucaccaccaaaucaucucuccagcucuauuuguuuuaagcagcagacuguacaaccuuggaacuguucuuuauuugugcaaagacuuaagugucugacuuccucgauagaacuuaaacuuaaugagagcagagauugucauagcuuucuuuccuaguuagguguucucauagacuuuacaguccuugauaaguacuagauuuucaguagauggguuuugagcaaaugcaugagcauaacgaauauauuuguaguuuaucuucuggaaauucuagcuaccugguagaguuuugcuucuggcaugacuuacugaccuucccuucuuacucucuguuuuuguuuuugugucgaggcagcguuucucacucuggcgaaggcuggccucagcucacagaaaccuucagaccucacccuuccaaaggcugggauuauaacaugagccaacaagccuggcuucauuaugggguggggcacuggcuugauacaaggucucacuauguagccccucugcaguguagcucauugaccuccaacuuggugaugauacuauugcuucagcccaccaagugcagagaucauacagccagaaugucugccuagcacuugagaaacaggaagcccuauuaauacauuuaaauuguaauccuguuagcaccguguguguguguguguguguguguguguguguguguguguguguguguguguuuaaagauuuguuuguguuuauguguguggauguuuggucuguaugucuguccccuuagugcauacagugccuuuggagaucagaaggugucagaaccccuggaacuaaaugaacuccuggaucguucaacaguuccaaagggguugcaacccacagguugagaaucacuggacuagcaccacagaccacuguaccagguuuuugcuguuguuuguucauggauaacuuccacagaccagguagaaucaucuaaucuuuggaguagacuuccauucuauggaaaacaacagacauaauaucauuguuuuuacacucauuuauguacuacauauacuucucauacuuggguaaaauagaagaaaggaaugcagcagcuguauagaauaggacuaagaguagauacuuacugcaugcucauuuauucuguucauguuuacugggugguuaauguaugacaguccccaaaguagagaacagaguagcauacaguuaugaugaguccagaugaguacaguacaguacagaugaguccagacuuaaugaccauccguagcuuacagcgagugcuguagagagaggaugguggagagauugggugguauagggauaaguagcuggaggggaaucauugcuuuuggucccuagguuaguagggaaggcuucuggguauccuccccaauuacuucuaggcuggcuuauccuaucuuuguuaucucacaaccacauggaccugucucuaaagguauccugcuuauuucuggcuuuauauaugauuucuuuccaagauuacccucuuuaaagugcucugcuuguucagagguuggaucucaugccugaccuguaugaagcccucaguguugaucuaugcugugccugucuguacuuaaguguuuggugcuugaggguagcauagcauuugauauuuguguacuuuauguccaggagaaaggauuggucaaaggcuuaguaaagcacccccccccucuaaauuaaacuuucuuuuacauuuuaguuuauuauuuuauguguauggguguuuugccuucauguaagucuuuacucuacuuaggugccuagugcccacagagaccagaaggcauggauucccugggccuggaguuacaaauagucaugagaugucauuuggaugcuaagaaacaaacguagguccucuggaggagcagccaguacuuuuaauagcaauggcaucucuccagccccuuaaauuaaacuuuuuuguuguuguuguuauuccuuuguuuuucaagauagguuuucccuuuguagcccuggcugucuuagaacuaagucugaccucacagaagucuugccucgucuuccugaaugcuggguuuaaaggcauguuccaccaccaccuagcuaaauuuaacuuuuagugugugauuacuguagguccacauguaaacuaagaagcaauucaggaaggucccuuguauccuuuaucuaguuacucccauugguauuaucuuguaaacuauagcacaguguuaaacuacgauacacugugauacagagacauuucagagaauuucuaccucagaagauuuccuuauguugcuguuuuuuaaaaaagauuuauuuuauaugugcuacugcauguguauucauugcuugcagagaccagaagaggguaucagauucccucuaauaggaguaauagauggcuugagccuucuugugagugcagggaacuaaaccagguucccuacuagggcagcaauucccuuaaaagcugagucaccuucaguccuuuauuuugcuuuuaaaucauccuuuuuucuugcccccacucuuccaaagcucuggaauccuaaucuguucucuguuuccauuauuuugucaucucaagaaaauguuauaaauggaauugcuuucuauaguaaguaccuaccugugaguugacuguuuccacuaagcauaauaguuaccuaaguuguugacuguaucaauaguaguuucauuuuguuauugaauggcauuucauaguaugaaagaauuucaaguccaguguugaggauugauaaggaacuaacagugagaucugaaguguucacauuuggaacucuagaaaaguguaccaaauguggugucuuuuuaugauucuuuuaaucauuuaaaaguuuugggcagggcuggugagauggcucaguggguaagagcacccgacugcucuuccaaaggucuggaguucaaaucccagcaaccacaugguggcucacaaccauccauaccgagaucugaugcccucuucuggugugucugaagacagcuacaguguacuuacauauaauaaauaaauaaauaaaucuuuuuuaaaaaaaaaaguuuugggcaucugguuacuuccaguuuuugaaauuacaaaugaaagcuaauaaacuuucauguucagguucuuguguucuguacucuuuuguuuuucugaaacaaggucuuagguagauuaggcugguguguuggggggugcuauuuagcucugccuggccuggaccuucacacauuauguuauuguuuuuugcacuacccauuccgauaggcaugcaauagcuuacuguuguuuuaauguacuuuuuccuaauggcuaaugguguugagcauuuaguuuguuuuuagauggucauugggauaaaacccagcaccucacuugugauagguaagaaauauaccacugagaaaugauuuuugcuuguuuucaaacuggguuguauuuuuuaacgacuguguuuugagaguauauauuccagauacuaaaccuugucagaagguuugauuuauuuguagguuguauuuucauuccauuuaucagauuuuuguggguggagcaaaaguuuuuaauuuuguugaaaucuggcuucacucuuuguggaccauauuuuugguguuaagcccaagaacucuuugcaaagaucuagauccugaagaauuccuccuguguguaucuuucuggaaagugacaugcuuuauaugugauucauuuugaguuaacuuuuuggguaaagcaugagacuuaggucauagcuuauuuacuaccugucgauauucaauugcuucaauacuguuuguugaaaagauugccuuucuucuauugaauugcuuuuuuguguguguauguguguguguguguguguguguguguguguguguguguguguguguauuucugaagaaguauuccauuaauuuguguuugguuacugaaacuggaguauauucauuuucaaaacaauaguuucucgcauuucuuugcuuuuucauauaaauuguagaaugauuuuuauuuacaaaaacauguugcugaaauuuugauggauuuugauagacuccaguccguuuggaacaaacuguuacacuuacugcagucacuguaugucuguuuagugagaucuuuguuucaucagcauugugagguuugccaaauaccguucuugcaucuaugucuuaaauuuuguuagguguuuuuguuagauuuauguaaauauauguguacuuuagcaaugguaagugcuggauuuuuaaaugucccuuucuugaauugacuuguuuuuguugcuauggugaagaugaaugaugagaaaagacaucuuuacaagugcugcuaccucuccucuccucuccucuccucuccucuccucuccucuccucuccucuccucuccucuccucuccucuccucuccucuccucuccucuccccuccccuccccuccccuccccuccccuccccuccccuccccucuuggaaacuuuuggaauucuuacacauccuaguuaugcccagucacggcgcuacaucucaaagccuuuuuuuuuuuaaaucuuuauuuauuuauuuauugaacauauguaauugucgcuaucuucagacacaccagaagagggcaucagaucucauuacagaugguugugaaccaccauguaguugcugggaaucgaacucaggaccucuagaagaguaguuagugcucuuagccgcugagccaucucuccagcccuccaugggauggagacuauugauugauaguuuuuuuuuuuuuuaaauaauauugaucagcuuucaucccugaauaaacuuuccuuggucaugguauguaauuuuuuuaaacuuuauuuuuauugaaaauaauuucuuuucagcuggaugguguuggcucacgccuuuaaucccagcgcuugggaggcagaggcagguggaucucugaguuugaggccagccugcucuacaaagugaguucuaggacaacuagagcuacacagagaaucccugucuugaaaaaaaaccaaaaaacaaacaaaaauucugguaaaaguuucuccucccagauauucccaccuguucgcucuuuuaaaacaaauggcuaaaaaacaaaaaaaaccaaacaacaacacacacaaauuaauaaauaaaaggaagaaaaaacauguaagagacacacacaaaaccauaaaaccacaaaauuagaaaacauaauauauaaccaaaugaccaguaagauaaaaaaaugcccaaacaaagcaaucugagacaaaaagucuacaagaaucccauugaguucuuuuuuguguuggccagcuacugguaggcuuggguuuuacugguguguaguucuuuuuuucuguggagguggggaguagguggugguuugagacaggaucuuaggaaguucagccugguuucugguaaugaaagacagccuuaauuucucauccuuuauccuuagucuuuggauuauaggcauguaucaccaugcucaacuugucugucuuuguuuguuuuuauuuuuuaacauugauuuauuuuaugucuaugaguacacuguagcuauuuucagacacaccagaagaggcaucggaucucacuacagaugcuuaugaggugguugcugggcauuggacucagggccucuggaagagcagucagugcuguuaacugcugagccaucucuccagccccugucuucuuauuguuuuuaauagguuggucuuaauuacuguucuguugcugggaagggauaccaugaccaaggggacuuuauugagaaaaauaauuuaauugggagcuugcuuuauucuuucagaggcuuaguuuauuaucaucauggcaggcagcauggaagcugacuguagacagacacuggagcuguagcagagaacugcauccuaaucuauaagcagagaauucgacuuuagacuuggcgugggcuuuugaaaccucaaagccugccccgcagugaugcacuuccuccaacaaggccacaccuccuaauccuuuuaauccuuuaaaauagugccacuccuuguuggcuaagcauucaaauauaugaaucuguggaauccauuuuagucaaaccaccaguguuguaucuuauguucuuucaauucaguguauauuuuuauuccuuuugagagacuuucacuuugacucaugaguuauuuuaaaguguacuuuguuaaguaguuagaggguuuuuuuuuuuaaauccugguuuggaauuuuuaguuuaauucuacuguuguuggagcacuuauucugugauuucaguucucuuauauuuguugaaguucguuuuaugauccagugauccagaguauaaacuauuuugaaauuccauggguucuacuauaguugagucaaguaugauuaguuccuacuuagauccuguuaaucgaaggaauuguugaauuaauuuccuuccucucuucuuuuuucuugaaaguugaacccagguuuuacacuugcuaagcaagcauucuaccacugaguuacacaccgcaguuccuugaguagaaucgaguuuguugaauauacacacacaugcacacacacaaacaaauuuagcuguugugacuucuugauagaucugcuuuucuguguuuuuuuuuuuugcauauuguuuguuacauauuaucauaacuccuuuacuucauuuauaggauauaucuuucugauuaaauauuucaaguagguuuccuauaaauaguguauaguuuaucauguuuuaaaauuuauucagccagguuccauuuucauugauguauuuaggccauuuauauauaauuauuacuauauuagggcauauacuuagcacuugacuuuugcuucuuaauuuuucuuuuucagauuuauggauuauuugaacauuuaaacuuuuuucucaccuugaucuauacuguuuugggguauaauucuuucuuuucuuuuuuuuuuuuuaaacaaaacaaaaacaaaacuggggacaggguaggauagaauaggagcaaggagacugagucugacucuguagcucaggguggccuaggauucacuaugaagaccaagcugaucuugaccauccucuugccucgugcuuggcuaagaguuuuugucauuguuuuaacucaggucugaaaaauucauuuucuuuuucucuuucagcuuucuauagguagagguuuuuuuauacuaauaacuuuuucuucuagucuuugaaaaacacuuguuuccuuuugguucuuguuugugguuucagguaagaaauuugcuuucauuaaagucacuuuuccuuuuuaguuauggccucuuuucucauuguuuuuagaacuguuucuuuugcuuuuacacucugaagcuugugguacuuuugguauggauuucuuuggguuuauccuguucacucagcguucugaaucuguagguuuaugucuuuugccaaauuuaggaaguuuucaccauuaauuuuugaguacuuuuuuagcuuuauguuuuucuguuccccuuacuuguaagacagacaacuugagcaauagcucuuuuguuacaguugaauccuuguccuuggucuuucuguucugguuggauauuuuuugcuacuaaggcuuuuuguguacuuccucuguccuuuuauuuugcuguugagucugcccaccaagcuuuuuaaguuuuagcuuuuuaauuuccuuuugggucuuuaucugcuacuuacuuaggcuuuuucauuuuaaacuuguuuagaguucuuguauuuguugagcuguuuuugucaaggcuauuguaaaaucgauaauuuuaacaucuucuggugcuauuucaguugaaaucucccauuuuuuuuugggggggcgggcuugugcacgccguacguaggugugugugugugugugugugugugugugugugugugagauuaaaaccuggauauuuccauguuucucuaauauauuaggguuuuuuuuguuuguuuuuuguuuuuucuuguuguuguugguuuuguuuuuuuguuuuuuuaagcuuucuuguaaccuccccucugccugaagcaggcugagccagaccuugacuuugcugccacuaaggagauuaucaaggguggagccauccucccuagaucacucuauuguucagccacugucccguuccucuucaagauacugcuaccugccgaagcaauuccggagacuacacccuguccuacacguggucaccugcagcugggcuccaagaaugaauuggcgagaaugggccucccccuccuuuauaagcgcauuugccauuaaacauuugagccuugaucugaacauugucuuagauccauuucucucucguucgccuaguuccccucucuuuucagccccaguuugccucccagauguaacccaguucauguuagccucugcccgguuuccaacacuuucuguuuucacuggaguuuggagggggaucacuuuagcaguggacaugaagggaguacaucauuagaccucuugacccaggagagcuuauuauacuugggugggugaggugguauagaaggcaugaugccuuguuucaagcugauguggaugaaagcuuuggcuccuguugugguuagaaugugaaauguaccccauagguucauauguuugagcuuuuggucaggagcuagugauccuuggaaaguauuggaacuuguaggaggugggagucucaguggaugaagugggucacugggagaguugagacuuuauagcuuagcucuacuucuuguucauauucugcaucuugaguuggguacaguaaccagccagccuaucugcuucuugccaccgugccuucccugccuguugccauguguuccccaccacacuagaggguaucccucuggaacuacagggcaaaacccuuucucuuuuaaguuguuuuugucaggaugguuuuuucacagcugccuagguugacuucuugaaugcugcccugguguggaggaugcacggucuuguuacagcuugugaauguguagccuucucaccucaguugcuuagaaguguuucauguaauuucuacauaaaaucacuguguugcugcgaugucucuuucuagucuucuggauaacccaagcaagcagauuucuguuggggcuuuauuuaugcuuguuugcauuucuaguuuuuggugucaucuacuucagaucuggguacaugaagcaaaaaugaaucauagaaaucucaguuguguugcugcugcuuucuuacugaaguugauggcuuaucugccuccuccuuuccuaagcacuaccagaugagcaaaucacaacaaaacccagucuucucaggugucuguguaauguccccauuuuauauaucuacuucacugacagaagcaaauaucccucaagagccaguauuugacauuuccacuucccauagaguaauauuuuuuaguacauguaaaauaugaauugcaaguaaaagagagcugccauauauaauccuugucuuaagcauuguuugcuuuuugaaucuguuuuugauuguuuacucuugagucuccuaauggacuagauaccagguuguugucuagggacuauugccugauguuagauacuucuuuugaaaacaaaauuuaauuaaaaaaauuaaaauguuuguuuuguguauguguguuuacauacaugcuacagugcacauguggaggucagaggacaccuuucaggaucugguucuccuucuaccacauagagacaucacauugaacucaguucaucagguuaggagggaggugccuauaacuacugagcugucucucuuacuggcccacuucuuuuuuuuuuuuuuuuaaagauuuauuuauuauauguuaaguacacuguagugucuucagacacuccagaaaagggcaucagaucucauuauggaugguuaugagccacuguaugguugcugggaccugaacucaugaccuuuggaagagcagucaguguucuuacucacugagccaucucaccagcccacuucuuuuuaaaacauuaagucagugauuaaccauucaguuuaacuuuucuucugauguuuuccuuauauuuuugugccuauaaaauuuuuaauauuuuaagauagaacgauaguaaugaauguugagaggacagcucugcuuuaaagugaccuguuuuuucuuugguuucuggaauucccauaaguuguuagaaauuacaaaacaauuggcuuagggagaaggcuuaaaggguuaaggcccuugccugcaaucuugaugaucugaguuugaucccugagaagacccccauggugcaaggagagacugacuaccacaguuugucaucuggccuguauacauauaccauggcacauacccuuccgcaaacaaacagacaaaacaaauacaauaacuuaaaaauaugaugauuauguuuuuuauaagaaucuuuuauaaucacuaauuuuugcccccuugaggacacgacuguucuggggucuguaaaggucucuaggcauagcuauggcuagagucugaagugucuuccacaggcuuaugcuuugagagcugggcucucaguaugugcaguuuugaaggcuguagagaaagcuuucuuuuaaagcugguggaagcagaucaguagaggagggccuuuggaaauuauaucuuugugcuucugggaggccugcugugcuggaagagccuccgccacaugcuaccucuaucaucggcuagcauaccuacuccauggugcuagguggaaaccuucugaaaugacaucugaaacagaccuucccuuaagucuguccuggaguccaaacacuaucagacacuggaaaaaaccuuucuggggauccaagaaaugauuuaaagacuguccuuuaggguagauggcccaggucuugcuagguuuuuguguuucuagaaguuaccauuucucucccucccucuacuucauuuauaaaaaggaaugguuugcacugauuggagauguauucacacuugaguuacuagauugguuuuggaauuauauguuuuacuguuuuggaauuauacacacacacacacacacacacacuugauaauuuauuuauuuuuaaagguuuauuuauuuauuauguguaaguacacuguaggugucuuuagacaccccagaagagggcaucagaucucauuacggaugguugugagccaucaugugguugcuagggauuugaacucaugaccacucaugaccuuuggaagagcagucgacgcucuuaaccacuaagccaucucuccagccccacuugauaauuuauuguccagguuaaauaguaaacauuugggaauuuuguuuauuuuuuucaagauagggaauuuuauuuguuuuuucaagagugucucacuauguagcucuagcugucuuagaacucacuauguagaccaggcuggccuugaacucugagaucugccugccucugccucacaaguggccagauuaaagauuucugccacuacaccuagggcaguuuuuggaaauaauaaaaagcucuuguuuuaccauuccuaggaauucguguguagguguugugucuggccagcagaccacaaccuggguuuuagccuggaaaggcauuuuggaaaccuggaagagaagaggggcuagguggcgagagaaagaaauguagccaagacaguuacucugaucaaggcucaaauuuuauuguugcgacacuaguuaugaaggaagggggaggggacccgauuuccgccgaauaaucucugguccaguagaaaggugcacgguguggcuccgcagguucuagcagugggcguggcagaacgaaugagcaggaagcuccaccccugagcaagcagguuucaggcugggggaggggagacuacauguaggcagugguuacuaguauuaccuauuccuguuuguagcagauucccugagaagguagaaaggcaguguucagaauagugaggccugacuacuugggagauuaaagucuauaaucuguuccuaguagaggaggaggacuaauuuuaauuauuuuaaauguuuucaggcaaaaagaauacgguuugaaauuagucaguuguagggagaguagucauuuguacucagaagcauaagacacuaaaacugcguugccauuggggauggagauaguggcaagauauucuuuaaucugcaacuuaggagugagaaagggugggggaaaguccaucaguuguagagggagcgucuuugaccagagcuaggaguucuuugagaaguacacuuugggacauuucagcgaaugagguguauaaacaccacugggaagaaaagcuucugacugagagugcaaaggguugcagagcuggcagcuugucagcugguuuucacacuggugaacggaccucaggaggggcaggcugaagaagaaucagugcaacagucgauuaguuucaacagauuggauggaauucagguuauugaucauugaaaauguggcaggaaccacuguagauaguaugggccaugcauuguucuaagugaucgauuuacauuaacuugucuggucuuuauaagauuaaaggauguggauagguuaagugguagaacuguggucucauccuuuuguccuuuuuuuuuuuuuuuuuaaagcuuuguguuuggguguuuuguuugcacauauaucuguauaucauugcacaucacugauaagacuggaagagguuguuggagcccauggaacuggaguuaccaugagccaccaugugggugcuggcaauugaacucuuggccucuagaguagccagugcucuugaucacuaagccagaucuccauccccuuuucaucuuuuaacaugugagucuugcucuagaguuuauagauuugacuaucaaacuagauugcuuugcuaagguaguuuaggcaagauugagagggacuugaagggagggcugggaagagguuugagacagggacucaugaagcccaggcuggccaaucuugguauuaacuuguaugaccuugaacuccuggucuccaccuccugagugaugggcugacaggugugugcugcuacauugggcuugagaggaccuugaaauaccaaguagaagaguauggguauaugaagaguauggguauaugaagaguauggguauaugaagaguauggguuuaugaagaguauggguauaugaagaguauggguauaugaagaguauggguauaugaagaguauggguauaugaagaguauggguuuaugaagaguauggguauaugaagaguauggguauaugaagaguauggguauaugaagaguauggguauaugaaggaaccacugaagagagugaugaagacauugaaugauacgguuggaauucauuuugaaaauacauagagauaaauauguaaucauuauuucaaaagacuauauguaagaagugaggugcugugugcaggaacauucaggagcauuuuuagagaagggaucagacauuauuggugggucaaagaacauuuuaucaccugaccucugaagggauaauauccucaacaugcgaacaaaauaagagcauuacaacuagagcaauuaguguguucagauguucuucuuuccuucagugaugagaaucaaacccagaaagugccagguaaacaguguaacugacuuaccaccucaucacucagggaauagcaugacauauccaauugugagugacagaggagggcuccaguggacccaauugcagcugucaugggaaggauugaaccuuauuagcagaggccaaaucuggaguuuuaaguuagaauuuuuaaccucaagauaaaaauagggagagguugagaggguaaugcauaaauccaguuggggcccacgagaaugaaaagauugaauaaauuuuuauuuucuucugugggccaagugcuaugaauacagagugaaugaaacauguuuucugucuuuguuggucauauaauucaacgaagcauacaaaauuagaaacaacuaaguaauagagaaauggcaucucaguggagauccagaagucaaaacauuguagagaguaguaaguaggaagaggauugucaguaaaaggaguaguaugugucaaggcuguagagcaggacagggcaugcaugcuguguaagaggaguaagcagcagagugucauggccagcgguguucaggauuguguucaggguuguucagugccugugagcacaaagacugggcuggaguguacauacucagaauacuagagaguuuguuuugcuagagaagccagaaggggaaaaaaaaugaguaagggucuugcuuuguagaauagacugaccgugaacuugagaucuuccuauccccaccuccaaguucagggauuacaggcuugugccaccauggcucagaagucauguuuuguuuuguuuugucuugacuuuuaaauauuuauaauuuaaucacaaaucuuuuggggugagagggagggaagguauauuuuugcacagauugacagucugaaaguugucuagucaguugguuagugugagagggaaaguaauuuguggaucuaugaagggaaagaauguaauuguauucuugaaagccauuauucugaaacuaauggaaaucagaucacuuuaauuucgugguuuuuuuuuuuuuucaauugccauugugccuggaacuuuguagguauacaguuuuguaaucguaguauuugaaugccaauaaauaggacuagcuguauaauuugugaguucagaaugacaugaaaaaugagucccuuuguaaaaaaaaaugcuucaagacacacauacauaaaaagcuucaagauaauaacaacaaauuguuaaaccaaaagcaaaacuccuucuaaaguggagcccugugugagucuauauuuuaugaguccauaaagucuguccugaaagauuauagaauucauuuaguacagaaaccucccuuuauaggagaggauguguaguauuauauacaauuagaucuuaauaauuauuacauuauuuuuaauguaauuaacauuaaacauuaaaauacauuuuugaguguuugccgccuuuaagucuguagaugcuaagaggauagugguuugcguauguguggugcgcuugcucuugagugugaccauuugcaugcaagugcauuauguucuugagaauauggacucuugacaucucuggugaggugguagcucuuaguugaacccaggauugccagccagguugcugggggucgcugcuuacuauuaguuccccacaguguguguaaaaguaaugacaaauaggugaaauaagucauuccaaagacauuuauacugagauuccucaacaaguuuuugauguuguuugcuuuuugucauugaggucacuaguagagaaagacuuugaugagcaguauuuaagauguaaauaaacagacaaaauuucccauaguuacugucugucccacugaugaaugugcugguuuguuucuuauuuccuuguaaguucugagaguucagaauuuauugggcucuguguacuuauuugagagcugucuguuuaguucacucagauucacagaaugaagacgagcaauaggccuuuguagcaguagugauggacucucugauuugacagcugaguaugguauuuguguauguggaagaguagccugcuagcauauaugcuguugaacaccuguuguauauuugucccuguuaauacaggguuuccuauuuucugaauuaacuuaauuuuagcagcaauuaguuuuuucuucugcuaaauaacuuuaaacuuaggugaaacugguuguuacuauugauauagaaauaaauugaaacagcuaaaugauacucaguuuuguuuuauugguuguacuaauuuguagguaguauauuguacauuagaccuugucuuucagcguuauaggcucaggugaacacauuggauaaacaauugaagagaaaagaaaauaugagguauuugggcagcaggaguggauauuugagcugagagcuggguuaucaucugucucaaaggccuucacagaaccuuccugugccuggcuccuuccuuccuucaucuccucauacacugcuucagagaagccuuuccugaacgcaguaaaauaaccaacuccguggucaguugcugacguggcagccagaagauucuuuauggcauguuccuuaucugucacuuuucuacuucucaacuuuguaauauaguuucaugagauugaaacgaaacuggucuuuaaggaaacugcccuguauuuuugcaaauguacuagggagugaggagaagucagcccuuucucuuuacuccuugacuaaauuagaguuggcaacucucagguuaggaauauaauauaagggucagagaagcauuugagcauacuguugggauuuuauucccuuuacuaugcuuuaauuuacaguguuugcuuuaguggguuuuuaguauaccauagcauugaaauauggggugcugcaaauccaaccuaaguucucaggaaaagcagucugcacuaaacggcugagcuuuccagcacucagacuacccccccccuuccuucucucagucccuccuucccucucuuucucucucuuuaaagucuaauuuaauaccuucgugcucuaaugcuauacagggagaaaagaagugugguucuuaaagaguuaauaagcaauccucauaaaaaguaaugagaaaauuggacaaguugccuugcacaaugaggguaacccuucaaaggaacugacuaauagugaccuaauuaaauucuaauuaccuuuagaaguaugaaagguauucuauucauuuaaccagcauuucaauaaauacuaaguacuuugauccuauuauauauuuuaucauuuauuuuuaaauuuuaguuacuuuaaauuuuugaauauggaaugucucaacuuuuugaguggcaucuccaaguguucgcauuuagaugugcccugguuucuugaaguggguggagucauguaguauuagcaucucugugagccacccucccuucuuccucauaccaagaagaaauuacuauaguucuuacaaucuuauauuuaauuaaaaaauaguauguugggggaaaguguuucaguaguagcugcuuaguuuaggaucauagucccuacacugucaguuaugugugugcaugcgcuccuagagauugaacccagagacucacacauaauguucaaacuuucugccauugagacuacaggcucaauacaaauacgagagaugguuuucuuguuugagcauuuacuuucuuccuguuguucuuagcuuucuauaguauaguucagucuuauuguuaucaauugguguucugcuuuuauccagaaauggaugaauuuuuguuuaguuuacugauguuugcuaagugucuagaaguuuguuuggcacauacuuguuaaaugaaccaguuuccuuugacuuuuaaguaguguugauacauuucuuuugggauaaauacuuagugaucuaacuuguuuagagaucauagaugcuucuuuuuuuuuuggcgguguggcaaauguaagacuuaaauuuuuauugaagauuaaaaauguuggaucagagagauggcugggggauaaaaacauugacugcucuucuuccacaggaccuggauucaauauccagcacccacacauaugucagcucacagcuuucuguaauucuagucccaacagauuucagaggcucuuauagccuccuuagaggauacacaaugauauuuugacauacuugcaggcaaaacaccugugcacauacgugguggcgcccgccuuuaaucccagcauuugggaggcagaggcaggcaaauuucugaauugaggccagccuggucuacagaguaaguuccaggacaggcagggauacacagagaaacccugucucaggaaaaauaaauaaauaaauaaauacaaauuuaaaaaauauugggcuauuauauauauaauaauauauauacauauauauguauauauauguauguguguauguauguguguguguguguguguguguguauauauauguauaaauauauaaagcccacccccaacacacuuccuccaacaaugccacacacacuccaacaaggucacauguccuaauauugccacuucuuguggccaagcauugaaacacauaaaucuaugggggccaaaucuauucaaaccacuacauucuauucccugguccccauagauuuguagcuauaacauaauguaaaaugcauuuaguccaacuuccaaagucuaucacagucucaacagucuuuaaaaguucaaagucucuucugagauucauguaaucacuuaauugcuauaauuacuacaaucugcuauaagaucaaaauccaaaagcagaucacuuacuuccagcaucacaggauauacauuauuguauuagucaggguucucuagagucacagaacuuauggaaugucuuuuuauauuuagugaauuuguugugaugacuuaaguucaaccaacccaacaaugggcagcuguaaaugggaaguccaagaaucuaguaguugcucagucccacuagacuaguuguuucaguugaucuucuguagaacuagauuccaacagaugugcuggcaaguauaugcaagcaggcaaaaagagugaaucuuccuucuucuaguguccuuauguaggucuccagcaaaagguguggccuagauuaaagguguguaccaccaugccuggaucugggacuuguuuugucccagacugacuuugaacucagagaucuucuuguguuagucuucugggauuaaagguguguacuaacuugccucagccuaagcuuuucauagccacuauguaugccucaagaucuccaugccaagauccaggucagaaacuugugucuuccagcuuuaagaucugaaucacaggugagcccuccaauucuggauuguaguucaugccagauauagucaaguugacagccaggaauagcaaguacaauuauuauuccaaaacaucauagugagguaauacuguaccaaagcaagaccaaaaaaaaucagcugggcgaacuccaaacucugcauuuccaugucugauguccaacuccuuucagcuuuguugacugcaacacacuucuuucucaugggcugguuccacuuccuguuagcagcuuuccucagcagguauccuaugacucuggcaucucuaacauguuagggucucuaggacgacuucaacuucacaacucuuguuucauugucugggauccacacaugaucuucuggacuccuccaaagggcuagcaucacuucuucaccucugcccucuguagcacucuaggcucugacugauuccaguccauuuguugcugcuauuuuugguggccguccuaugguacuggcaucuccaaaacuggggucuuccacugcaauuaggcugcacuuccacuaauagccuuuguggucauuagaauagguauggcccccauuagaugcauguguuuggaugcuuggcccauaaggaguggcacuauuaggagguauggccuuguuggaguaggugugaccuuguuagaggaaaugcuucacugugcaggugggcuuugaggucucauauacaugcucuagcuacacuccgugcagaagacuaucuccuccuugcugccugcagaagagagucuccuuuggaucaagaugcagaacuaccaacuccuucuccagcccuuuaucugccuucacacugcuuugcuucccaccaugaugguaauggacugaaccucugaaacuguaagccagucacaauuaaauauuguccuuuauaagaguugccuuggucauggugucucuucauaguaaugaaacccuaacuaagacagccaaucauagguucucuucaugguaccaagucaucuuugcauaacucagucaguucuggaccuucaacugccucugaggcugaaccuucacuaauggcuucuaacagugccaagccucagcagcucuccaugaccccuuccccuucauaccuucaaaaccaggccaccugggugacucuuauacaugaacaaguccaagugcuagcucacgguaaacuuuggucaccucacacaauggccuuucuguccuucaugcagggacauccuaggcauauacaucuggcccccgugacuuuccuuagucuuuuagagaaauuucaauccuugauucuaaaaccagaaccaccugacugaagcugccgacuacugcuucuugcuggggcuagaacauggccccuaauucaguuacaucuucaucagcuuccuguuuucagugauuuccuuuauugccuaagcuugucuguccuggaacuugcucuguagagugaguuugaauucagagauuugcauuccugucuauugagugcugggauuaaacguauguaccaccauaucugaacuuaagcuuuuuuuuuuuaccugaaacuuacucuguagaaggcugacuuggaacucaucugcuugugucugucuccugggauuacagggguguaccaccaugcuugaaccuaagcuuuucuuuaauucccuuuuacaagaucuuucuuuauaagcaugaccacuauuccucagaaucuggaucagaagccugugucuuccagccucaagaucuggaagaucuguguguccuccauuucuggauuguaguucauucuagauauauaguuaaguugacaaccaagaauagccaucacaauccaucccuugucaauuugacacacaaucauauuuucucauguccaaaugaaagcaguaaccaggucauaauuacaccuaacaugauauaacuauccuuguucaacugcaaacacauaaacaauaagcuuaguugggugggaucuugcccugaggucaccacuuccuuaauucuauuuaauauccuugaacacaggauuucgcgccauuucacuuccuggugccccuuuaaucuuugagccauacauuuuguauuuuuccuuucuaaguuugcuacgucuguucaaaaggcuuuucagaagagugaaccacaggacagagccuaugcuaggcuauuuuaagauguccuuuguuaauacaauuaaucuaaaucgcuucacuuuagccucagguagacuuuucagacaagggcaaaaagcagccacuuucuucacuaauauaucacaaguacagucuuuaggccacguacuaaaauucucugaaaccucuugagccaggccguacaguucuaaucaccuucagcaccgcugucuuccaugcuuuuacuaguaugguccauuaagcccuacuuaaagcauuccacugcuuuacaaaguccccaaaugcacauuccuccaaacaaaagcauggucaggccuaucacagcaauaugcucuucccugguaucaacuucuguauaagcuggaauucagaaguaggcuccaauagauguacuggcaaaguaagugcaguuaggugaagaagaaaagcaaacccuuccuucuuccguugucuucauauaguccuccuguggaagguuuggccuagauuaacggucugccucaagaucugggguaaagguauguuuugauccagguuaagaacaugcaucuugaggccauccuagucuacagagugaguuccaggacagccagagcuauacagagaaacccugucucaaaaaacaaauaaacagcaacaaaaaagaacaugcaucauucccguuuucuacugcuguggcaaagcaucaagagcaaugaaacucaaugaagaaagaguuuauuuggagcuugaagcuucacagggagaauccaugaccaucauugcaggcgauaauggucucgggcagacuugguacuggugcugcagcugagaauuuacauccauaguaaugaaacccuaacuaagacagccaaucauagguucucuucauggugacaagccucagcaucuuugcaugacucagucaguucuggaccuucaacugccucugaggcugcaccuucacccauggccacugacagugccaagccucagcagcucuccaugaccccuuccccuucauaccuucaaaaccaggccaccuggguaacucuuauacaugaacaagaccacuuaguuguuuuaacaaucucuuuuuaccuguuuucagugugauauuugaacagaaagcccaacauuaguuaaauaucuguccuacauauaaacauggagaccuugcagucuguuugcuacauuucuucucaaguguguugucuaguauuuuauucuuguaguaauuauugagcugcguccucugucuugugccaagaacugccagauucuauaaugauauuagacagaauacaggccuuggauuuuugcaguucauaugacaacaagcugaauaacuauauugacuagaaaguauuguggcccuuuggucuggggaaguuccugugggguccuucacuucccagagcugcuccccaggaugaugguugaaguuguuuccuaguaucuuagguuuugguuagaggaaaccuaacagaaagucuuauuuuuauuuuuuuuugguuuuauuuuuauuuauuuaucuaucuaucuauuuauuuauuugagacaggguuuuauuuauuuauuuauuuguuuguuuguuugagacaggguuucucuguguagcccuggcuguucuggaacucacucuguagaccaggcuggccuugaacucagaaauccaccugccucugccucccaagugcugggauuaaaggagugugccaccaugcccggccaaaguuuuauuuuuaacauuuaggcaucuguguugaagagauaaaagugacagaagaaauuaauagcuuacccugaguuuuguuuuucagucuccuuagaauguagccaagcauuccugcucauuauguacuguugaauugugagcucccaauucuguaguuuccugcuucuguguuuuagcucaguuuguguaaauauaucuuuugccuuucuacuaauauaaaacaaauuggucuuuuuccucacuaguuuuuuuuccuuguaaucuccaucuuauacccuugaaaccuuuugcaaagauaugaaaucgucuuguaaauuaugguguauuccaucaucuuaucacaucuagagauuagauuuguuaaggcaggaucugauaguccauuuuguguuccuaccaaagaauucuugaaaaugaaccauaaauaaaagccauguauuguccuaguuuuggaggcuaagaaguccaguaucaaguagucagcaugugaugcggacuuacugcuguguuacaacaagguggaggaauaucacauggugagagucaguaugcaaagcaggcaugguggcgcaugccuuuaaguuuagugcuagggagugauaggcacgugaucucuaugaauuugagaccagccugaucuacauagugaauucuaggccaaucaaggcuacauaaugaaacccugucuccaaaaaaaaaaaaaaauguauuucagccaaggucucucuucuuucuuuaaagacacuaaucucaucaugggagucccuguucuuuauggccucagauaauauuaacauucaaauuuuggauuuaaguuucuaacauacagucuuugagaggaacacauccaugcuauccagagccuaauuuuuucauguuuuaguuuucucuguuaguguacuguuuuguauguaauuaacagaguuugaacauacuauggauauaugaucuucaguugauuagcuauagucauguacauaacaggauuucagacaaagguagacaaugauaaauacuguagaaccuagauuuguaguaggcuuugcugcuagguuuauauaaguaacacuuuuauguucauauaguaaugagcuuaccucaugacauguuucucagaacacacacuugcuaaaugcacaagacuauaauaccauugcuaagauggguaugucacagcagguucuaguuuguagucauuaaauuuauauugaaauucuacugcuagauggguucucuacuguuuacacuuuuacuuuuuuccuucagaggauacauucugaucugaaucaauaauuguagcuugcaagaugcuuggggugggguguugaauuuaggagcacaauaccucaucacugaaagguuaucuucacauagaaagauucauauacauggagggaagugucaagguuggucggacuucaugcugcauccagaccccauugcuuuccacaguuucacuuugccauccucaguaugauaaaagcuuuccuuaaagcuuuaagauagcuucaagacuugaaguauauguugauucaaagaguagcuagagaaaggaagaugcuauuucuuuuuuuuuuuaagauuuauuuauuuauuuauuuguuuauuuauuuauuauauguaaaguacacuguagcugucuucagacgcaccagaagagggcauuggaucucauuacgggugguugugagccaccaugugguugcugggauuugaacuuccaaccuuuggaagagcagucgggugcucuuaccuacugagccaucucaccagccccaagaugccauuucuucuuuaucaucuuuuuucccuaaagaaagaacuuuccccaaaugcuuucuaaagaacagauuucccuccagguucccuugaucaugauuuaguuuuauacuuuuguaagauaaaugcagugguuauggcuggccuaggccagucaggaauggguggccuaguagagaauuaucacaggaguuucacugccggcugcuaaggaguagaacguugugugugagauaaggaguaaacagcacugcagaugcagucaaccugucucugucucuggccuucucuucggaaaaguggauuuuauuaauuaacccacuuguucuuaaaauagcaauuaacuggagugccuauguaugucccuuacauuacacuuagcuuuggggaaguagcugaauaaucaaugggcagcuagccugcagucuggguccuggcuguggagcuaaggggggaggaaagaguuaacucugaaauacacugacuuuaggacauuuauuuuucaacagaugauuugagacauguggauuugugauaugaauucauuuggaaagccacuuugggguaaguugauaauaauugggaauuaaugacuucaggauuauacuucucuauggauuuugaaacuuauauccuuuggauuuuaugccuuauauucauguacuagaagggcuuguuguuuuagguuuuguuuuuuaaauuuuuuuuuaggcagaauuacacuauauaguccuggcuaaccuccaacucaaccaaaauccacugcuaccucacucccaaacugggauuaaaggcauaugucaccaugcucagcaccagaaugguuuuguacuaaguuauuauuuuaauaaaauuugagaaauauagggauaaaauauagucucaguacuuuauuagugcauuuauauuuauuucuuauuagcaagucaauuugaagacuaaaugaaggaagagcagguucaggaaagaaccuuuagcuagaacuaaacuuacagucuucuuaugugacugggaagucauuuccaguguagugucgaugauacuggaguaaaguuugucuuuagcuucucuauugcagaggucauuuucauugcaucagugcauaugugaaagaauccugauuguuucaucuaagaaagcaccuuuagcaaugucacuuacuauugacugagugugcauuguugcaguugagcuguaagaugaguguacuuuucuuuuaaagaaauaaugaggccacaugggguuugguuguugguugcaaauugaccuuuugaaggccacauaacuaauaaguguuagaacugaaauuugaacuuaaacauuuggcuaaguaaugaacuuaaauauuuccuuguuuuaauauguaaguuguauugggguuccuaaggccacccccagaucuucugguuggcuuggagaacucaauaggcugcagcacaguaguacuaacuacagaaauucauugcagcaaaaggacacagaaucuggaggagaacaggagugagcuugcaaguuuccucuccccgagagauagcggggugugaguaguuucugcagcaaccgugacaacacacgaaagauugccugacagggaaagucagaaacucauguccagauuuuuacuggugcugguuauguagagguaucuuguaucuugcacauaccaaaauuagagucacagaagaaaaagauguuuaacuaacaaaauugcguaugccguuaaggcacaguggggcacacuuguuauuuagaaaaagucuuguaucacuauggagaacuguuuauuauucaagcucucugauuugagcuaagggccaacuuuauauaccacaccuuuucaaggagagcaguuucaggccugcuauauuaacuucaccucuauacauugauuuauucauuugaagaaguuauaaucauuuauguucugacaaagaaaauaaaauaggugcaguggcaaacuaauuuuuauuuuguuuuuuguuugguuuguuugguuucucuguguagccagcccugguuaucauggaacucacucuguagaccaggcuggcauucaaaucagagauccaccugccucugccuccugagugcugagauuauaagcaugugccaccacugcuugguuuagucaaaccaaaauuuuaauaucauauuuugaauggucuaaguugcuacugauaagaaagcucacaugaccuccuggcuaagauccaucacagcaaaggauaaagcugcagauagcaggaaggcauccugagugcuaaaauuauagcgaaaggcaccacacucagaguuauuuuaccauuuuaauagugagauuauuuaggaaaacauuuuagauuuuuuuuuaaagcuuaacuccuuguuuccaucaacuuuuagaaauaggucuuuaugauuucuuuuauucauuuucuuagaauaguagaguuguucuaucauacuaaaugucuuuugcaagaaauggaauaucauauaaaauaacuaaguaguaaaucauagugacuauauuuuuuuuuuggucuuaaaaaaaaaaaucuacgggcuggugagauggcucaggggguaagagcacccgacugcucuuccaaagguccgaaguucaaaucccagcaaccacaugguggcucacaaccaccuguaacagagaucugaugcccucuucuggugcgucugaagacagcuacaguguacuuacauauaauaaauaaauaaaucuuuuuaaaaaaaaucuaccacuuaugcucaguaauaaaacaagauguuguagguaccccaccuguuuacauuguacuggacaucauaguaaaguagcugaauuaaaaaucaaccaucaagaaucaagcacauuucucaguuaggccugguagaacacgccuuuuauuuauucccagcacuugggaggcagaagcagauggcucucuugaguggaaggcccccuggucuacagagugagucccaggacagucagggcuacacagagaaaccuugcuuugaaaaaccaaauaagaaaaaacaaaagaaagaaggaagaggaagaaaaagaagaaucaagugcauuucuauaaacuaguaacaaaguuacaguacucaagaagaagaaaauauuuaaaaauaucugguugacuugaaacacaacugugagauuuauugaacucauuacuagagaggccucacuaaguggagagaugagaguuuguggauuugaaaaaucacaaggacagcaguucugauugcucauagauuucauuugaauuacaguggcuuuuggaauagagcuuuuaaaaguuaaucuaaaauuuuaaagggaaaccaaugacacacauauacaaggcacuccugaaaaaguaaggaaagggcuaggaguggcagaggcaggugggucucugaguuugcggccagccuggucuguagagcaaguccuaugauaacugggacuacauauacccugucucaaaaaaaucaagaacaaagaaauaaugaaagguauauguacaucaagguggcuuaguagguuaagauacuggcucuuaagucugaugaccugaguucaauccccauuguuugcccagguccuuaaagacaacuuauuuuauuuucugaacuuagaaucuuucuacccgguugaaagaaaggacggacuccagaaaguuguccucugacggugacucauccuuccacauaaaaauguuauauuucucggaguggggguugagacaggcuuucuauguguagguagcccuggcuguacaggaacuccaucuguagaccaggcuggccucgaacucagaaaucccccugccucugccucccaagugcuaggaguaaagacguacgccaccaccgcccagcuugaaguauuuccuaagauaugagaaaugauacuuuuuugaaccauaaaugauauuccuuauuaaagguaaacugugaacuagaaaaaaauuacagguagagcauauaacugacacaacacuagauaaagaauuuuacagaaagaagaugauaaaaccaauuaccuaauagagcauugggccagauuucaguauguauaugagaaaagaaauggaaugaucaucaguaacagcagagacgauagaacaccaaauauaaagcuggguguggugcugcauagauggggaccugaaagaugggagaugaggcagaagggucugcaguuggaggcuagcuuggauuaaaugguauaauaucuccugucagcaaacagacaauauauguagcuacaaaagguagugauuacacaugaaaauuaucaaaaauacaaacuccucuccacagugcugcuaauguaaauacaccauacuuaugaaguauguguuucuucugccugugucggagaucugggauuccugugaugacgacucaggagcaagggagaguucucacuguuuaaagcauuuuaugugaaggaugcucaaagauacuuuuuaaaaaauugcauacagguuguuagguagacauguuuucuccuuagaugucuccaugugaaaagacauguuuuuuagauacaaaugaaccgacaauaauauauauuaguguaauggucauuaggucuuaaagaaugggucuggugaaauacuuaguugauaaggucuugccuaggaugcaugagagccuguguuugaguccuagcuccacauaaaccuauugugcccacuuauaaucccaguacuggaguguuagaggcaggaauaguagaaguuuaaggucauucuggcccucuaggagcuuuaggucuuauuggucuauugagacccuguuuuguuagugucuuggguuuugauucuccuccccccacccccaacuacauuagcagucaagauucuuugccagacaguuuucggugugaaauggcuuaaauauaaauuugcauacccagcuuccguggagagagccaucguuucauguucuguaauccuuucaugcuuuucuauagucacuacucacugcaugugacacuagcaaaugaauagacaugaugcagaggcagagaaagucgguagcacccuuguuuucucucaccuugacaucaaaaaaugcuguucugaugaaagaccauaaguaggagaucaaagucuccagagaugugagcagaaguaauuuauguuacaaguaucauuuagcaccucuuugcgugacucucuggcucuucuagcaacuuugugaagaauuacuguagguauuuuauagauaaacucaccugcccuggauuguucagaaucuucaucuuguaagacuccccuuguaggaagcugcacagcaccugucagccugcuucuucaggcagugcuuacaugacucagcauggggcccauggacaagguauucccucaguguucuugauugaauaaacuugauuuguuucuguccuagucagcagcgacacuagcuuuguguuauucagugacaugauacucaggcugcuccagggcucuccaaggcaaauauugauugacuuguuagaaacaguuuuacucagaguguuucugucacuuucugaugacaauauaagagugucugucguagaguguagaagagugggaguaaaagcuaaaaacucaggacaucagaguuuaggaggaagucuuggaaccccuucccuuuccugcaguguuuguuuucuaagugaguagugacuugauguuuguacacaggauuuggugggaaaaagaggacaggaauuagcgugaaagacugugcaguacuggcugggggagaacuggauauucagacuaggaucacuguuugcugaagaucuuggcuugauugacucuuacagcuuuugucuuagaguucaguaaaaacaguugcagagaaaggaaguuaagacccauguuuugaugagacuggaauaguagcuuacugcuguuuuaauuuauauauccaguuacaagaaaauagcacauuuuuacacauuuuauuggcuauuuagauuucucuuuuuuaaaggccuguuuauaccuguuuacccuuuuucuauugaauauugcucuauaagaguuauuuauauaauaauggacuuucuuguuaaugaaauuaauucauaucuuaauauuuauaauguuaaauuaaucauaugauccauuucucacguauugaauuuaagagucauuuucccccuuuuuucuucauaggcuaugacugugauuucugaugaaaccaaauuggaauaauuuucaugauauuuguauauuuauaucuauauauauuuuaaaauuuuacauuugacuuaaagugccaugagaaaauuugcauauugcaaggugguucuagccaccuccuugguuuggguacucuuggauauguuccugcugcuuuacuucagugaaugcaacaaaugugaagagaagcaggagagaggacuuccugcuggugacggugaguggcuuuguacagcugucuucuuaaggagauuggucauuucuacuguaguucaaauuuagauuuauagcuguauauuucacauuuuacauuauuuuauauaaaauuuaaauuuauauguagauuuaaauuuuaagauaaauaguaaucccuaaguuccuauauggugauuauauuucuaacaguguugugauugguucuucugacaguugaauguuaagugugacugacuugcucaguuuacuuuuuaccagaugacagggaaucucauaauuggaacuaccaagauugcacugaagauuggucuaaugccauaaugcagagugggacauuaaagcuuuguuagcagguguccagucucgugcuugacucucauucucuagauacagcaauggcucugaauccucuagugcugcagccuuuuaauaguuucuccugcuuuggugacccuaacuguaaaauuaccuucauugcuacuucauaacuguaauuuuaguacuguuuuuuuuuuauuacguauuuucuucaauuacauuuccaaugcuaucccaaaaguccccccccccccccaacuccccuacccacccauucccauuuuuuggcccuggcguuccccucuacuggggcauauaaaguuugccugaccaaugggccucucuuuccagugauggccgacuaggucaucuuuugauacauaugcagcuagagacacaagcucugggauacugguuaguucauaauguuguuccaccgauaggguugcagaucucuuuagcuccuuggauacuuucucuagcuccuccauugggggcccugcgauccauccaauaguugacugugagcauccacuucuguguuugcuaggccccggccuagucucacaagggacagcuauaucaccguccuugcaacaaaggcuugcuaguguaugcaauagugucaucguuuggaggcuaauuaugggauggaucccuggauauggcagucucuagauggaccauccuuuugucucagcuccaaacuuugucucuguaacuccucccaugggugauuguuuccaauuuuaagaaggggcaaaguguccacacuuuggucuucguucuucuucaguuucauauguuuugcauauuguaccuuauaucucgcuauacuaaguuucuggguuaauauccacuuaucagugaguacauuucauuugaguucuuuuguuaguacuguuuugaaucauaaauaucucuguuuuccgguggucuuagaugacuccugugaaaggguuuuucaguacucucauuuuuuuguuuguuugcuguuguuuuguuuguuuuuugagauaagaguuucucuguccuggaacucuguccaggcuguccucaaauucagagacccaccugcuucuaucucccaagugcugggacuaaaguuguacaccaccauuccuggcuuggcauuuuacucuuugaagaaaugauauguaguuauucuuccaguacuaauuuucuuugacucuaauuguuauaaggaggaagauacuugguucuccaaaauuugugaucugaaagcuauuuauuuguguuaggaacugugccuguuuaauuauaauuuauuuauauaaccagcucugcuuaguugcuggaacagcauguuagcaauaccuagguuagccccaucagucuacuuaaaaguucacaaaauacuacuuuuacaguucuucuacuacucaacauuacugauuaacaaaacacugccuucuuaacugguaguagagcuauacacccuauucccuuaagacccgagggcaaguuaccucucacugguaagaaacugcugugcuuuuuuuuuuuuaaagauguauuuauuuauuuuaugcgaguacauuauauucagacagcagaagagggcauuggcucccauuacagauuguugugagccacuguuugguuguugggaauugaacucaggaccucuggaagagcagucagaugcugagccaucucuccagcccgaaacugguggguguucuuuucccagaguggcuuuccucuccuucaccccacuuuaauguauugucaguuagaguuggagcuuaugguuucuguccugaauguagaggcuuaaaagcaagagaaaaauagagacucuguagcacauagaaacucaguuagagaauguguuuaaagcucuaauagguguugaacaagaacagaaaaguuuugagcuggagagauggcuuagcaguuaggaguauacugguugcuccguuaguucucugcauccacauaguggcucacaaccaucuguaacuccaguuucagcagauuugacgcauaauauaugugaaaagcacucauacauauaaaauaaauacaucuaaaaagaauuucuaccuuuaaaaaacuugucaaagauaagcauggugcuuacacaguaggccaaaaagggaucucguggcuugccacagauuuuggcucaucugcaggcaggggcacacccucaauggauuucagacaagauguuaagccaucuaacaagacugggacuuuugaaugaauugaugguugugugcuggaagagaccugacuagaagagacauggauacacaaacuaguggcagccugucaugaaaguuugaaagagauaaaaguugaaguugacccucaugucuccuugguuaaacagauugcugaggcagacuccccaucggaggagcagccuggaugagacucugggucuuagaaggcuaggaauaaguuuugagaugcaguuuguuuuccuccccuuccccucucacacacccacacacacaacacuuggggguucccccccccccauuuucuucuuuggucuuuuaaaugcuggauagcagguguguaccaccaugguuggcgagauaaguuguuuaugcuauguuugguaauaagguuucugauggccuuguaagugccauuucagagaaugcaaacauggagggcagggaugggugggcuauugagaaacagacacacaaccucuuagcacacuugagcauggaagaagcagguaacacauguuaaagaaaugucuguacacaucuguguguauguacauugagagagaaggagaugguaaaaagggggaagaggaaauuaccagcaaguaguacaguauaguauugaaaucauaagaaaaggguuauucuugaagauccuaagguuaauaugguuuugaaacacuagugacauagacuucaaagaaaaggagcaacuuuuguaugaaaauacaaaguaauggagaaauguguugaaaacagcaugaaacaaggugauaaugcuuugcuuauggaauaaaacugaacacagaaucucagaaaaggugaugagguucaugggcucugaaggagagcuggauuugagucagaucuuaauggggagauggaggaaguaguguuuugauggcgagggcgucugguguugaacugagaaggaugucagcagugggagagcauuacuccugagaaacacuaguuuucugcuacuguggcagcaugaaaaguaacucacuguuuuuuuagccaaugcauuauggccggggcagagugaaggguagaggaagcugcucaccuaugauggccaggaaacagugaagggguagggugggacaggaugugaauaucucuucauggauacauacuugcuagucccaccucuuuaaagguuucuuugcuuggcaaguaggcaagauuuauuuauuuuuuuaacuauauuauuugagucuccuaugauuucaaauauuuuaaucucuaucuuaaaaucacagcaacaaugagaaaauuacuauauuuuuuucuuagugaaucuguggauucauuuuacauucuugagagaguuguuagaaacacacugaauaacuuccuauuugcagcucuggugucccuucugcuccucugcucuuaagaucgcugcugaaagaauucugacagaacaagcagacuagcauaaacagucuguuacaaagugaacagagaugagaaugggcaguagccaaagggaccacugcagaguaggacacugagagggaccagugagaccauugugcucaccuacaggcuuucaugggccuuguacuguuucugaagucucuauauuacaaaguucuucaggugacugaaggacccaucuuucagacagguuagaauguuacauuucuacccagaaccagagguauaacucauaauccauuuuuaugaaugguagucacuuaauagaacagauuauuuuuaaaaagugaauuuauaaaaacaacuuuuauaaacgggguugcgguagggggagcaccuucccuucaugggucucagcaaagcccuacuaccucucuuccuguucuuuuuuucuuuuaugugugugugcauguaagugccaagguugugugacaaagucagaggacacauuuugggaguuguuuuuuccugucccuuguuugaggcugaguuuuucuuguuucugcugcugugcuccaugcuagcuggcccuuuaaauuucugggugauuguccuguuauuuucuucccacucucuauaggagagcuaguauugagaaugugagcuacaucuaagauugaggguuucagggaucgaauuguguaauccagcuuguguggcaggcaguuuaaccaccgggccauccgccugggcuuauacugucuucauugauauuuuaaaguuuaacaaggagagcuguggucaugcuuucuuucuuccacaugagauuuuaguuguggggagucuguggauacauaugucuguguguggcacacagaagccaaaguugaugucagcugucuuccuuuaucacugugcaucuuuuuguuuguuuguuuguuuguuuguuuugacuuuuugagacauggcuucucuguguagcccuggcuagccuagaacucacucuguagaccaggcuggccucaaacucaagagaucugccugccucugccuccugagugcugacauuaugccaccacuggcccggguaauguuuuauuuuuugagauauggacucuuggccugaaguucacuuauugggcaaaaugaucuggccagccaugcucaagcaacccuccugucuaccuccccagcacuaagagugcagccacaugcugcuccucagccagcugccgggcacuuuaccaaccucuuuccaguugucaggagagucaccugugauaguuuuuucuuucuuuuaguuaucacuguuuuucacucacugguguggagagagagggagaggggggagaggggaggggggggagagaaagagaagcuuauuugcaaggaaaagaugaacaaggcucugcccuauagaucugcuggucauagaacauguccaagaacaaauacaaacaaacaaacaaacaaacccauuaagcacaaggucuuuuacccauuguucacaguaucccuaagaccagacaugaguauaacuuacuaguaggaucuccuggaaccaaugacaguuuuaaguuuagucuguguuuugcaccugcauacaguguugugugugcuaugugugccguguguauguaggaggugagaggaugaccugcaggacuggauuacucccuuaucaugguucagguucgucacacucaagauuguugagcucaguggucagcaccuuuacccugagcuguuccagcagcccaugauaacaacuaggagcccgagacuucaguucuugguuuuauaagcugcuuauuaaaagaaaggcucucuucuuagugaucugcuggccugcugauaauaucuggcuagcugcuuuacaauauuugugccuuuguaccacaccucagacaguccuugcugacuaguacuugggcagaugcuaucaauccaagaagguuuuuuguucccuuaaagucaccauuuuuguguagagacacauucagaaaacuuaaaaacuuaacugcuggauaauaaaacuuucaguucuaaaauaagcaaaugggcuggagagauggcucaguaguuaagagcauuuguuuuuguagaagacgggguuugagucucagaauacacguaauggcucacaacugucuguaacuuuaguccaagaagucagaugccuucuucugauugccugggcaccacacaugcugguagugcacauaugugccuacaggcaaaacacucauacccauaaaauaaaaacaauaaacacauuguacccuuaacaauuuuuaugccauuuuuggucauacugcauucucuuauuaucccauguagaugagaaauugaauacaauaacuucaaaguuuaguguaugugacaacccaaaauuucuuggaauguuuuuuuaucuuaaaagcauggaagauggagccgagugugaaaacugcuccugaccuggcagugcuccuguucacagcacuuucaccgccauuuuugcuuuacuuaugauugguuauucaugugccuaugauaccuguuauaaaguccagcauuuucaguugggccuauguauuauuugagcauaaagccuguaaaauacuacuaaacuuuuguagaguuuucaugucugagccauggucuacugggcugcaccugcacaaaguuuaguauucauaagagauaauggcuuaugagagacacauggaaguccuggaaggacaaauguguggcaguggagagaugguaauuuauucugagucaaauguaaauaaccauacccaagaacauggauccauguuaccccaguugacauguuucacugugaaaguggugacaugaguuucuuagucacaaaaccauuggaggcuaaggucagcacacuuaucagagucauuggcaggcagauuucaacaaaguagggaguguucuaaaguggguaucccaggagucuuagugguuagugguuugcuaagauuacaucucaaagauaccagauagucaaaaggugaccaaaaaauagccaaagauaauuuggcucuggaccugcaacauuccaacuccccauagucugaucagucagacagcauuguaaucuucaacauagguuuggcuuuuggagacuuaacgcuauaagaauaaugaaugaguuuuuuagaaaggaaagggaaauuguuuuacuugccuuuaaaaggcguacuaguaguuuccuaugguaaagauagaaccaggaagggggauaucagaggaggcagccugcaugaacaacagcaugagagcaagagaggccaagcaaagcacaaguggagggaaguggcagccaucaggcaguagggagugcugaggaguugguagcaggcuuggaaaguuagguuaaacuccaggaaaggcagugaguagcagugaggaccgcuuuagucuaggaaggcuggaggaguguucucagacagcuauuuagcacuaagugaacagaauaaggcugagaggucagucacugucucagcaugggcagccaaacaggcugggacggcccagaugaggcugcuuugccugcugagggcaguuuuaacuugaauguuguuacucagaaucauguguuaguuguuuugaaauugguuuucaguuacccuucuucuuucuucuuaguucuagagcuagugcagaaaccucaugaagguccuggagaaauggggaaaccagucgucauuccgaaagaggaucaagaaaagaugaaagagauguuuaaaaucaaucaguucaacuuaauggcaagugagaugauugcacucaacagauccuuaccagaugugagguuagagggguaaguacgcaguuggugugagcggaggcgugucuguguuccccacaaguacuucgccuuaaugcuggcagcccugacaagguugcuguuuaauucuacgcgaagccuaagcugcgugcugaugauguaauaccccagacaguacuguucugcugacucaggaauaggaaagugauuacuucucugagugaauuaguaguggauucuaaacacuuucaaaaauguucauauguucaacuguuuacagaaagacuucggguguauguaacuugaggcagugaaguguguacacuuaacugaaauuuuaugugucugcacacagcuguguaacaucaucuaaccaaauaaauaaaguucuauuuacuuuuccaguuacuacucccacuucuagagacaaccacuguuuuaaccccuauaaauugagaugauauacuuucuccauuauggaagagggucuagaccucugcuggaagacacugugccuguagacagcaguaccaaauugcaugcauaaaaaauucuuuaaaaggagagcugaagagauguggcucagggguuaagagcauguauugcucuuguggaggacccaaguuucacucuaagcaccuauaaugggcagcuuacagcuauuuacauuuccagcuuuaacaggaucuaacucccuuuucuagcuucugagagcucuugaacucaugugcacauuucacacacacacacauacacacacaaucucaaaaacaaauaguaaaagaaaaaucuguaauaauguagauguugugugcuuuuauaaguagauauuauaggcauauuuaaaauuuuaggucaaagcuuucgaugucuuuaaucccaacacuuggcaggaauaucucugaguuuagggccagauggguauacacagugaguucuaugagacucuguuucaaaagcauaaaaacaaaaaacaaccaaacaaaaccuggaaaauuuaaauuaucaguuccuacaaaaucuaacuuguuggcuuuuugagucuauuuuauuugaguucuuaccaacaccagguagaagagagaaguuuagaggggaaagggggcauaggucucuuuaaacgacuuccugcugguuaggggcauugaguuccuugaggcaaguccaucuucaucuacucagcuucuucuccaacuucuucucgucucuuuucucucaacucucaguggugguagcagcaggagcaggaacagccgcaccuccuucuucagagcauccucuaucccucucuggguccugacauucuuuccuucucccgaguucucagaauuaagcuggcugcagcuggcagaauuacgacccugucagaccaugcacaaggcagcuggucugcugcuuuggagaaucugaagcagccccauaucccacacaugggauuaaaacaaaacuuguuuacaaaucauagcuggguuuuuaaggaaaccaaaacucucacuacaauaacugauacgagagcagaaacuacaaaguagaaucacuauuaaauccauaaauuacuuaaggccuuuauacagagacaucuacaaacuguaacaaacuugcagucaugcacagucuugucacugaauuacauuuuauacauaucuaacgaagaaacaaagccaagcuuuuacuaggaaaaagaaggaacauaccaguguacaucaugaaaucagagugaucaguaaaauuagaugacauaauaaacaaggaguguuaguuagccuuacaaguaaaaagucaguugaaucuaacaguauguaaauuucauacacucaagccaaacugccauacauagaaccaugauuaagucauuuuaaagucaucaaauucacaacagugacagagaagcauauucuugcgccggacuggccagcaguaacgacgcugcaacaggauccuucugcacagaacuggugcugcuuauauaggccuaggagaggcgugucucacacccggauugguuaugcacuacgccucauuugcauguuccucaucugauugguuauacucucaaagccucauuaucaugcccgggccaggcagugucuuugcaaaagaacuuuacugcauauguacacauugguuguuuguccaaacuuaugcgugguggccagcaguagucagugccacucugcaacggcgcauguggcuucccacagcauauguugaugugacuauuuuaauacaagaauuuguugcuguccugauauccuuaggaacuucaaagggcacuuccuuaaucuuaucugaacagagcagcaccacagguaaccccccacaacacauaucagcguugaauuaugacuggaagaucagggacauguagaguacuuaugucauuacuuccauucagugucacacuggaggucugccagcugugcucuaugcucaguccucaggagauugaggaaagccuggagauauguaggcucuaccucaaccuuacucuccagccuuuuacccucaaauggauuacagguugaggauuauaauccauacguguucaguaagguaggugguuggggggggggucuauauuucuaaggaagagauaguaauauguguuuuuaggcaaaaucuagaaaauauuuuuaggauagcuuuuuagauauuauuagaacucaacaaauaugugugugugcgggcgggggugggggggaggaucuacuucuugaaggaaauucuaaaguaauauugagagaaauaaaauaaaugaagaaaauacccaaggaguuacagagacaaaauuuggagcugugacgaaaggauggaccaucuagugauugccauauccagggauccaucccauaaucagcuuccaaacacugacaccauugcauacacuagcaagauuuugcugaaaggacccagauauagcucucucuugugagacuaugccagggccaagcaaacacagaaguggaugcucacagucagcuauuggauggaucacagggcccccaauggaggagcuagagaaauuacccaaggagcuaaaggggucugcaacccuauagguggaacaacauuaugaacuaaccaguaccccagagcucuugucucuagcugcauauguaucaaaagauggccuaguuggccaucacuggaaagagaggcccauuggacuugcaaacuuuauaugcaguacaggggaacgccagggccaaaaagggggguggguggguaggggagugaugggggaguuuaugggggacuuuugggauagcauuggaaauguaaaugaggaaaauaccuaauaaaaaauuaaaaaaaaaagaaaauacccuauguucaagaucaaugcuauaaagauuugauuugcauuuguuaauuuagugugguuauagucauaauuaugugaauauauguaguguguguguguguguguguguguguguguguguguguguguguguaauuugauuagcugauugugucacuggaaauacaaagaacuggaagagccaggcauuguuguagaauuaaucaagauuucgauaaaagcuauaguaaugaagcuauuuugaaguucuuauaacauaggucagagggacaaaauucggaguuuaucucacaucucauucauacaugaacacuuaauuuaugacuaagaggucccuguguagcccugagaggauaaucuucuaagcaacaaaugccauugaguaaaucuccuguaauuaaggacaaaaaagaaauuguacuuuugcaaacaguuuguauucuguguaucauaaauguaaauacaaaggcagagccauaaaugauugcauaugauaucucuuuaaacuuggaaaagauuuuuuaaaagguuuauuuauucauuuuauguauaugaguucacugucacuguuuuaagacguaucagaagaggacaucagaucccauuacaggugguugugagccaccaugugguuguugggaauugaacucaggacuucuggaagagcagcuaagccauuuuccagcccuuguuuuuuuuuuuuuuuuuuuuuuuuuuaagauuuauuuuauuuauuauguauacaguguucugccuucauauaugacugcagaccagaagagggcaccagaucucucagaugguuaucagccaccaugugguugcugggaacugaauucagguccccuggaagaacaaccagugcucuuaaucucugaaccauuucuccagcccuggaaaagauuucuuaagcaggucauaagauucacauacgaaaaggggaggaggaauugauagauuagauagaucuaacccaagaacaugaucaugcuaggccaagugcuucuaccacugauagacaaccagcccccuuaaagacuuucugcuucuuaaauaagagggguaaaguauauucaaucaaguuauugcuaaaaagacuauuugugacauuuacaacaacuaaagugcuuaaauccagaaguaaagcuccuauauaguaaaaggaaaaauaacccaguuuuuuaaaaaaaaaaaugagauuugaguuggauggaggcaggcagaucuuugaauucaaggccagcuuggucuccaaaaugaguuccaagccagggaaggcuaccuagagaaaccuugucuuaggguagcagaggugagagauuugguuaucauuuuacaggagggauuauucaaauaacugaggaugugacaaauuacuccaacuuguuaauaauuuuagaaaucaacucaguaucaaaucaugugauacucuuauauacuguuuguguagccauauugaaaaugugucugugcaugcuaaaaucagcauuuauguccuucauggccuaaaaguuucauacauacacacacacacacacacacacacacacauauacauauacaugcacauacauguauauauguguguguauguauuaugcaugcaugcauguaacaggagacaaaagcaaaauauuuauaguaguaagucuguauugguuccaaaauuuaaaaucuugaucuucuauuaguaaaauaggaggucugucaugacaacauucagaaagcagaagcagaacaaucucugaguucagcgccagcuuggucuacauagugaguuccaagccagucagggcuaaucagacaacaacaaguuguaaauagaauaggauacuuuauaguaguagaaaugaacaaaagucacguuauuccuuuuauaauauaaaccuuaccaacauaauaaauagcuaaauaucauauaauauauagagaauaauauuauuugugaacaagucaaaauaaaccaaauaaaacuccuuuagaaccaccauaguuuuuccuuuagggacagaugagaugguaacaggcagucugugagaugaugucuguagucuucucacuuagugguaguuaugugcucacuugcuuucuaccagcucuuuccacucacauauauuggguguguuuguuuuguuuuugcaguucugggaauugagcccaacaaauguguuuuguguacucuauguuugccauauuccauaauauaaugaacuuggggaugagugagaugugaagcacgguauagcagugcaucugagauaaggcagcucugaugaggcgaggcauuuggggaggagagagaagauaacaguguguguugauggaaaagacccaauugagagggagaagaguuuuaaaaagggcccccaauggaggaacuagagaaagcacccuaggaacuaaagggaucugcaacccuauagguggaacaacauuaugaacuaaccaguaccccggagcucuugacucuagcugcauauguaucaaaagauggccuaggcggccaucacugcaaagagaggcccauuggacuugcaaacuuuauaugccccaguacaggggaacgccagggccaaaaagggggaguggguggguaggggagugggggggguauggggacuuuugguauagcauuggaaauguaaaugagcuaaauaccuaauaaaaaauggaaaaaaaaaguguuaaaagcaaaggcuuuggacauccguaggugagaagguguauagacaagaauacaccauucaagcccccaauagaggaaaaagcaugaugucagcuaaaugcuaacaggaugguguguggauguugguggcgucagcuaaauacuaacaggaugguguguggauguugguggcgguauggagauucucuccuggaagcuuuugcauuugucuugugauauuggaaacaaaguuguaaaugaggagggcaaaagugauuuagaaaucugagaugugaggguuugaaggaguugucuaggaaagcuguacagggauagagugugaggaggcccgcgugaggguuguaguuaauuuaaagugagaccaucuagcccagguggauuuuugugagcuacaugaacuaacccaagggcagaugcacaacuaggacaaagauggacagagcuaaguuuucaugaaaucugacuuacucuagcuuucuguuuaauacuguuuuuauguucccuccuuuucuguggcacaguuugagcugauacaaauuucggcuuccagcugaugcuuuggagcuguacauuuugauuuuauucauuuagcauaguaucuggauaugcugcaauggucaaggugcggauuuaguuauacuuacuuauguguauauucauaucuguauaauacaguuuugaucugagcauucauauuuuacuuaaguguugggcaugucucagacacaacugguuccccauuaacuccaguuuggucuuuggacaacuuguauaugauaccuugguagugacauagucccagccuaccacuggggugucauaacggaauaggaugcuucacugggacagaguaguagaaugcugcucaguuacaaauguggcuuuuuugcucacccuuaauucuuuguucacuucuucuuguacacauugcagaugugcacaguagacacauaccaccaaggcuaguuaagagauuuaucuacuuuaguguuuuugaaggugcaaagucuacagcauggcaaagauuucucaucacagugucuaccauggcuggaguacaugugagagagauaaaucacgugcuaagauaggaaaguagaggaauugaggguugucucuccuuuuuauaauaaccucgagagaccuuacucaccugugacaaguggcuccaagugucugcuuuacagaaugacuaccaagauaagaacaugauacaugauagguacuuaguaaaugcaucuauuauuuuauuuuauuuuuucauuuugugaugguuacacuuuuguuaagguugauuuuuuuuuuuuuuuuuuugguuuuucaagacaggguuucucuguguagcccuggcuguccuggaacucacucuguagaccaugcuguccucgaacucagaaaucugccugccucugccucccaagugcugggauuaaaggcgugcaccaaaagugcaauuugagauugauaauauagcauuauuuuauucuucaucaaaaugaauuaaccuagccauguguggugcacaacuuuaaaucucaguauuugggaggcagaagcaggaaggucucugcgaguuccaggagaucuuugucugcguauugggucucaggcuagcuaaagcugcauagugagaaccuguuucaaaaagcaaacaaacaugaaaaaaaaaauaaaaugaaucaaaccaaaagucugcaugaggagaaauuaguuuaagaauauagguaauaucuuuaaagucauuuuuauuccucuauaucaguauuacuuauuaugcaugcaacauuaaucacaacuucaauggaaaaccucuuacagucugaccuuuagcacaaacuuuuuguuguucugucagcuuuucuuuuuuuuuucuuucuuuuuuuauuagguauuuuccucguuuacauuuucaaugcuaucccaaaggucccccauaccuccccaacccccuacccacccacugccccuuuuuggcccuggcguuccccuguacuggggcauauaaaguuugcaaguccaaugggccucucuuugcagugaugaccgacuaggccaucuuuuaauacauaugcagcuaaagacaagagcucccggguacugguuaguucauauuguuguuccaccuauaggguugcaguucccuuuagcuccuuggguaauuucucuagcuccuccauuaggggccgugugacccauccaauagcugacugugaucauccacuucuguguuugcuucugucagcuuuucaaguacagauugauuuaucuguagugucuuaaggucucuuuuauaaaggcguuugcuuugucucuagguguaaaacaaagguguauccagauaaccuuccuacaacaaguguggugauuguuuuccacaaugaggcauggagcacacuucugcgaacaguccauagugucauuaaucgcucgccaagacauaugauagaagagauuguucuuguagaugaugccagugaaagagguaaauuauacauuuuagugccagugauaucagaccuuugaucacuaacagcuugcaaacuauugcuauaacuuuagccuaauaauuguauguaaacuuccaauuuaucuaaaaauucuugccauuuaagcucauucacauaaguauaacacuguugaucauaaaaguauuauuuaguguuuaauugugcugcaucuuaaucuuaaugggaaauagaaauaaugcuuuaaaaugugauauuaauguugaacagggaaaacccacaugauuuuguuagaauuuucuccguggaaagcugauauucugaucaugaggggagaaauuuaguucugaguggcaggaagaacuuuugaccacaaaauggaguucagacuagaguucucuggauucuucugaggcuuccuguuuccuuccuuucuaaauuucaggcaugaucuguaguuaggugcauaaaauaauuaagcaggauuaacaugagguguauaaucugucuguguacucccauccaucugucacaucucuugcuuagauauccuucugagaauaucaggauuuuucauagaucuagaauauccuaaucuguuucaugagacacucuuaggaaaagauacacuagugaaaaguaacuugaaccaccacuguugacucugaacccucggagauuucaugcugcagaaaagauagaacuuguuaaaaucagaaacccaguauuucccaauugcuuuauuuuuccccacaacccaucuauuuagcacucagugucacgugcugugcuaguauuucucuguugacaugggaaagauuugggaagaacuacaggagauagauucuuaucgcucuuaauuccuuucuaugugauuuuguuuuauuauuuauuuuaauuaugugucuguguauugacuugcauaugagugcagguguccacaacaggucaucagauccccaggagcuagaggcaguucugagccucccaauguggguuuuagaaaaugaacuuggguccuuuagaagaguagcaaguguucuuaaucccugaacugucucuccagccccgcauagcuuuccuaaugaacgucaaacuucguagcccaucauuuucaccucuuuagauauuauacccuuuccuaacgguguccauauuauauauauuuaaaaguaguuauauuuaaacaugucauacauuaguuauugggaauacuuaguuuuaauaauaguuuaaaucuuauuauuuugccagcuuguacaaaugcaagugaaaaauuaugaguuuucaaguaucaucaucuuaccuccuuaaucuaacaaaaaauaauuuauaagcacagauauuuaagugugcaguauauaauuaaaugucaaacugaguaagaucuauuauuaauuaaguagaccacacuguaggcaucauuuuuuugcaaccugcuuuuaauaaggguucaaccuuuccucuaaccuaccacucagcagagguaguggaagagaagaguuauuaggacauggggcaauggaucuguucagcaauaguucuuugggggugaguuugaucuucuugggcagcagguucaguagcaaacaccaaauaugacuuggcagcugcuuaccaguccucuaggcagaccaguccucuaggcagacagacaccaggcacgaaccagcagcuacaguccaguccuuucagcaagcagacaccagacagcuguaguucaguccugaagaaaccucuugacuugcuaacagaccugaggagaggcaguugaaguggcaagcugcugcaggaaccucaugagcaguucuugggcaaguuuuucucaaaggcauaaguugagcucaacaaugcuauauguaaugcaaacuaauacauguaugucuuuagcaaagagugaggugaaacaaaccaaaccaaggcucacugaucauccuauaugucugugaggucauauuuaugcuccuucaacaagggucuuuucaugcgucugcuauauccaaacauccuuccaccugugucugcuucagaaaaacagccuuucacguguuaagauauccuuagcaagauauccuuucagcugugugccccagcaaaacaucauuugacauaacuaacuuuccaaagaacuagaaguuuccaccucaucacacuuaaagaauaacuguugacaggccaggugagguggcgcaggagguaaagguaaggugcuugaguucagucucaggaacucacaguagaggaagaggacugacucccuggaguuagaacacagagccuugugcaugcuccacagauacucugccacugaaccacauccccagaugacaaccgacucuuaagaguuguaccucagccugcagugguggcgcacgccuuuaaucccagcacucgggaggcagaggcaggcggauuuuugaguucgaggucagccuggucuacagagugaguuccaggacagccagggcuauacagagaagcccugucucgaaagaaaaaaaagaaaaaagaaaaaagaguuguaccuuggcaguuuccguuagcugcgucaccggccaccuccccacgugaagcaguugugcaagcaucaccaugcugggcagcugucuacccucguccgagcgcuccagaaguggcaggggaguggaggcugcagagcgaguccaggaaaccucugugaggcgacuggcagcagcgcuacgacggcaccauguccccgaucugcucgaucuccaaugaagugccagagcaccugugcguguccccugucucuaaucauguguaugagcggcaacucauugagaaguccauugcagagaauggcacagauccuaucaacaaccagccucucucagaggagcagcucaucaacaucaaacuugcucacccaauccgacccaagccucccuccaccaccagcaucccagccauucugaaagccuugcaggaugagugggaugcagucaugcugcacagcgucacucuucgccagcaacugcagacaaccugccaggagcugucccaugcucuguaccagcaccaugcugccugucgcaucauugcccagcucacccaggaggucacugcugcucgagaaccucuggcuacucugaaaccacaggcugggcuuauuguacuucaggcugugccaagcucauacacacgaguguugugggugcaggagagcccauggauuugggugagcuggugggaaugaccccugagauuaucuagaagcuucaagacaaggcuacugugcuaaccacggagcguaagaagagaagaaagauugucccugaggagcuggugagaccugaagagcucagcaaguaccaacagguggcacccauguggggcuacacagugcuagcauuguugggauucucacucuggaccugugccccucagacaccaacaagauucucacugguggggcagauaaaaauguugucuuuugauaagaguacugagcaaauccuggccacucucaaaggccauaccaaggucacgagugugguuuuucauccuucucaggaacuguuuucuguauccccugaugcuacuaaucaggauuuggucggucccgaacacuuccugcguacagguuguucaggcccaugagagugaggugacaggccucagccuccacgcuacuggagacuaucuccugagagccucugaugaucaguacugggccuucucugacgugacagaugagaccuccggcugcucucuuaccugugcacaguuccacccugaugggcuuaucuuuggaacaggaaccauggacuccuagauuaagaucugggacuugaagaagcauagcaauguggccaacuuccuuggccacucuggccccauuaccggcaucgccuucucugagaauggguacuaccuggccacagcagcugaugauuccucagucaagcucuaggacuuaugcaaguugaagaacuucaagacauugcagcuggacaacaacuuugaggugaaaucacuaaucuuugaccagagcaguaacuaccuggcgcuuggggauacagauguccagaucuacaucagcaaacagugggcagagauucuucacuuuacagagcacaguggccugaccacuggaguggccuguggacaccaugccaaguucaucgcuucaaccagcauggacaggagccucaaauucuacagucuguaggcccuaugccuucucacaguucugggccucaucucagcaguggguuaguuaggggguggggguggggguggggcuuuaggaggagagggaggucuggugggagggacauucacaucauuucauuuuggucuggaugauggucugagccagggcacauagaauacugcuauccaugcagccuuugggccccagggaacagucacccuguaaagugcucagagucggaguccagcaccucccccaggguagcagcuguuccaugccugcucuguuucagcucuucugagacagggaggagagccaagggagcugugaaggggaggggcagggggaggagccaagggagcugugaaggggaggggcaggaggaggagccaagggaacugugaaggggaggggcaggaggaggagccaagggagcugugaaggggaggggcaggaggaggagccaagggaacugugaaggggaggggcaggaggaggagccaagggaacugugaaggggaggggcaggaggacucuugcaggguuuuguaagcagcgaucuaguuucauuaaaaaaaaaaaagcuacacaauaaaaagaguuguaccucagccucacaugccugcuguggcaucugugugucugcacuuacagccacauccuguauauaauaauacaacaauaauaauaauaauaauaaaagugauaaaaugaaacuuuuuugaaaugucaaaagaaccguugacuauauguugauaauuuucagcuaggagccaguucuuugaaaaaauuaauuuaaggacuaguauauauaguauaccuuguguaaugauagugauaguucugagaaauuaaucauuagagaauuuuuaucauuguacaaaucacaguauaguuaacacaaauagucuuugucacuaagcaguaccauacauacucuugaucauggacugauauggacuucuacagcaugucucuguacagacauuaaucuuuccaguaacuugugcucaguuuuauuuauuuguggggagauauuguucccaggcaaauuuucuuuuccuguccucacucuugaagguuuucuaauucugagagcccaagaaggcuauguagaauaggauguuuuuguaggauguggucucauuagaaauguggaugugcccacaacucugaagugacauaaauucgcacacagcaguucucuguccucuuuccuaaugugggccuuacuuagcacucugauguguauggaaacuccuguggacaaauaccuacucugaugcugaacugagacucuuuguucuagguggggucucuugagugcuaccccagguucucugauuagggucugggucuccuuuaucuuccugccuagaaagucuugagaauccuuuuuccuguuucuggcaucuggaagccaccaguuacugcauucugcaguuaagauugcaugcagguuaccauccaguuacugauuguaguuuuauuuggcaucacuguuuagaugauaauuuugggucucaguaagcagaguaaucuuuuuacuuuuauguaacucugugugucugcuuuuucuuauuccagagacacaauauuucucaccuggacucugcuauagaccacccaauccugucugucuguauuacuuuuccugucuguuuuccaccccacauguagaguaaguuuguagaggaaacaugcagggcucagcaguuaagagcaguagcuguucucccagagguucuauccccuacauacacaugguagcucacaaccaucuauaauucuggccccaggggauccaauacccucuucugaucuccuuggauaccaggaacacaugugaagagauuuaaaugcaggcaaaauacucauauacauaaaauaaaaauaaauaaaaguuaaaaguuaaaaaugugauggguguaguucuccaggauauguaugaccuagccccagcucuagucauauugugagccauguacugcuaccuauucccauacugcugcuuuguccucagccuccgcugaguuuauucagcgugucacccucugcugccuagguucuucccuguguucccaugcccagagcacugcucucuagcaaauguacuuccccgucuucccaaccugcuuacaucuaaucucuaucagugcucgauaacuuauuucuaggagcuuuucuugaccuuccaagaccuguauugccacagacccccuccuaaacacaccugggaacaauucuuaucagaauuucaaaacauaaugucuauggucucucuacagauagucuucuguucuggcugcugcacaccauuaucugacccaaagcuugcuuggccuggcuguacugauuuuuuaaaguguucuaacugauauuucucagauguuauagggaauaguauacuuuuuuuguuugucugucuguuuuuguaacuuguagauuuguuuaaaaucugcuugguguguuaugaauauugguuuugcaguuuuuagugaacugagauagaaauuuucaaauaguauauaagcacuuugccuguguuaauacacuuaagguaaagugguaggccucuuaucuguaugaacagauagauggaaaugaaagcuuucugaguacauuucugugaaaugaaaaacuacaaaccuuaguggcuccauaggauucuuugcuaaaugaagaagggaaggaaccagaaaaggaucuaagagcuguguaggggcucuucaguaccaaaaagacuuucaguacccaaagcucacacguuacguuuucccccaaauugccuauguaugaugucauuaguaagggaaggaauguuagccagcacagugacaaugacuacauuguggcuauuuuuuuuuaaauuuaguauguguaauuauuuguuuugggggacagacaggcacacgcacgcacacccauacacgcuaaggcauacagguaggugugaguuuauucucuccacccugugaaucccagcaaucaaacucagguuaucaucuuggagacaagcacacuuacccaguuuugccaucucagcagccucagaacuaauuuuuaccuuguaagaaaugaaaaugugcauucccaguugaaucuuagggcacuuuuugugagugcuuagaauauugccaauggaaacacaaaaaugugagguaaaucuaccuuuucucagaaacuuuugaagucagaaauuacaaacaauuaaaguacuguaaaauaguguguguacuaauguacaagacaaguuucagcaguaccagcaagugacacgacugacaucuuugugauguguggcagggaugcuuagggguccauuuucaggacagcagaaggcaggauaucugaggagucggggcuucuacucaccaguuaccuuccaagaacuccauucuuacaaauuauguauggacugaagacacacauuucuuuguguccauuguauaaaggucacaaagaugucagaaaugcccagggaauuuguuagagugcuacagaaucaugcauuaaaaacuuguugucguuguucauagacaggacaguauuaauagcuuucugaaauguaggacuuuaagauuggauugcuuugguuuuuaaggcuuauuuuuaaaacuauuuuaaaaaaaaacuauugggagacauuguuuaucauacaacuaacuucgaucgauuuaagauauuagaccaugccuaaugagcaugccuagaaucaccacaggugauucuguucaguucuagacaugcagacuaaaugcuaauccauauuuguacugauuaaguauuccacauuuucugaauguaaucccuuccauuaaauuguuuguuuguuggguucguuguuaguuuuguuugcuccuugcuacuacaaagcccaggccagucuggccuuaaauguaagauccuuauuccuccaccccaucccccaacuuccaggaguacaggaauccccacuauuccugcuaguacucauauggugcugucucguguuaaaugauggguuugaagauaggcaagccugggcuuaacaaacgucaccuugaucaaauucauuuaauauucugaacuagauauuaauuucuaaaguauguguauuaacacaaucuuacagaucauuguaacaugcagaaaagucacaaacccacucauuaccaacacaaaaauguuuuucgcagauuggcauuauucacaccuuuucacucagaaucugguuauauucgucucacuuuauuuaucacuuaauuuaugaacucauagugcuauuugacacaguauuuuuagcacaaauauuaggaaauaaguuaaccauaaaaaagauuaguaaucugucuuuuuggaggguuuuggauuucuguugauuuuacuagugucuuaccaaacugaaucaucuucuagggaacacuuuggaucucuguguuuaguauuguaguagccucuuaaucgcacacugugauuucugugaauugagugcugagcuuuacaaccugaaugguacuuccaucauggagucaguugugcuaacaucugggggcuacuaaggucuggggcauuguuauaccuagauagaugauacauaucuauuaacucacauuaguuagaaagacaugguccaaucaccaucaauaguuuguaauucaugcuugucugccaaagaucuuucuguaccuuucaguuccugucuagcauuucccuuaugagauuuuuacuuucugccucccaccuucugacuuuagacuuacauagucagaaacuauggugaucagugagacacauuguuucugucuuggaauaaaucccaccauuuuaaaaacuaauaguugugacauauaguauuucuuuuuucuguucucuagauuggauauucuuuuuuuccuuuuucaugcacauucucucucucucucucucugucucucucuuucucucucucugugugugugugugugugugugugugugugagagagagagagagagagugugugugagagugaguguuggagauauuagcauuuuaauuuuugagauaggaucuuaaaacucccuguguagccuacacuggccucaaacucaaaacccuguagcuccugccuuccagauacugggauugcaaguaugcuccaucaugccuggauuaccaguguucacugccaugccuggcucagccucuuugcuucuguugcagauucuuuagcauuguuaggaagagaguugugaagccugguagaugauguaugaugugccuguccugggugauaauugagccauagauacugccuuaguguucagguggcaagauagaagcagcuaguucauaccuuuaugaaauuagcuuccuuuaggaaacgguguugaugggacaaggagccucacuuagugcucugucaguauguauauguuaaagggaugcugcaaaucaaaguugcuuuacauuugaguaaugccaguucauguaauucauuuguuguguuauauuuucagacuuuuugaaaagaccucuagagaguuaugugaaaaaacugaaagugccgguucauguaauucgaauggagcagcgcucuggguugaucagagcuagauugaaaggagcugcuguguccagaggccaagugaucaccuucuuagaugcucacugugaaugcaccgcaggguggcuggagccucuguuggcccggaucaaacaugacagguaauuuucuggaguuggugaauuuguucuuaguacuuuuaucuuaaacuguguggaacauugcaaauuucuuuuuuuaaguaagcauaaaaauaccauccuuuuaaaucgccuuuaaaaugccuccaugaguauuccaaacaaaaugcagauaagacuucuuucuuaaagucuggcaguuaacacauuugcaaacuauccuaauggggaugaauuagguagcauguuguagaauaauuacuccaugcucuguugaccaaaugggucuggaacagguagacagccaacucagggaaaguuugcucgucccugcuuucaaaggauaccauuggggcaggcagauuaucucaucuuuguugacauguucacagcucucaucuuguagcacaaaguugaagagaagacauuguauccuguaauccucgguccuauauggaaugauucuguaacuuuauuaauauagaguaagcaucacuguagugugucugugguggucagcuuucauguuacacacuucaaaaagaauugucuguuucugucuugguuccuaagcaccaggaaagaaguaacaucagucugcuugaccuguauucaauuucuauuugcuguggcaauuugaccuugaagcugucuacaucaacuuuuaagguuuagaguuuauaguguagacuuuuuuuuuaaagauuuauuuauuuauuauauguaaguacacuguagcugucuucagacacuccagaagagggagucagaucucauuacgggugguugugagccaccaugugguugcugggaauugaacucaggaccuucagaagagcagucagugcuccuaaccucugagccaucucuccagcccccuagaguagacuuuuacuagcccaguggagaauggaggcagguaaggccauuucuuagcaaaugguggcauaaagcuaucuauucucagaaacacaaaaccaaccagcauuggaucauaauacaccaacagaaagagacccuugccgugaagaaucaaaagaauagaauuucccucuaaauauuuuuuuguaaguaaaaggugauugguuuaaggaaauacuugcauaaagauaacaaauuuuagaaauaugauccuagacauauacagagaaagcaaugugugauguauagaaaaaaguugaguaaagcaagaaaauaauuuacaguugggcugugugguagauuauauauccuaaauaguuuccaacauauacagugcuagauaaauacaaaaacaaauuuuuuaaugcacuacugaguuauuauaaaggggaaaaaauauacaucacaaagugagagcaaacaagcuguccauucacucaaggcagcugguauuugugguuucugaaaugagcucuggguacuguuuguuucuugauaaauguauaaguuggggguaacaggagcaaagccgaggcccagcuuauggugaggcaugcuaugaaucuuaacagcaaguacccaaguaaaggugagguacugaaauuuguacaccagugagaaugaggacuggaccacucaugucagaggaaacacuugcuguguuuaccuuugguguggaagaggcggacagcgcccaccacgauguucaagcaggauauagaagaaguaggaaaauggaacuauuuuuaugaggcuacaauaauuuuaauuaaaaaaaugaagaccuaugcuuuaauuuuuaaauaacggguguguuugugugugugugugugugugugugugugugugugugugugugucugucugucugucugucugucugucugugugucuguggguguaaggccagaggacaacuugcaggcuuucguuuucuccuuccacugugaguacaguaaugagccucagauugauguguuuagaagcaggcacguuuagcuauugggcugucuugcugccucagagacauacagagaaagaggcauggugcucagggagaggucaagcgacaacacucugaaguugguuuucucugucuacguguagaucuaggauugaacuccagugaucaaaucuguuuacccucugagccauuucacaagcucauggaaaagauuucuguaaacagcaauaaaaugugauuugauaucacauucuauaaacuacaucuacuaaaggcuguacuugggauguuuuuccuucaaaagaacuguugucauuuguguucuuaguuuuuaaaaaagcuaaccggaugaauauaugaucacacagucuguauagagaaguauaaaccagaaagaaaaaaguucccucuaguaauuaaaauuuucaccugguaguaaugcacaccuuuagucucagaacucagcagacagaggcaagagaaucucugaguuugaguucagccuagucugcauaguaaguuccuggacaaccaggacuacguagagauaccuugucucaaaaaacaaaccaaacaagcaaacgaaauuuuauauauauauauauauauauauauauauuauacauacauacauauacauacauacauauauauaauauauuauuuuuuaaauauaagaaaucaacuucaaaguuauagcauuaugguaaagcuauuaaccauacggagaaauauguauauaaguguauaacaugaugcugccauuaauuaugcaacaucagugcuggacauuuuccuugagagcagauuauaugcuuacuuccccacuaauaaaauacugaagaauagaaaugauaagacuuguuuacaaagaaaaauuuugccuaaaaaggauuguguaccacuaaaaauuaauuuuugaacucuuuauaauauuuuccaaguuucagauaguaaagaguguguguaaaagaagaaaugcaaaaagacagaagguucucagccaacaaaugauuuugauacugacuugguauagauuauggcauaaagaaaccuuagcauuguuuaguuguauaguugcuacgguaaguagguacaguugaagauuuuaauuugcuuuuaugaccucaggaggacagugguguguccuaucaucgacgugaucagugaugacacuuucgaguacauggcgggcucugacaugaccuaugguggcuucaacuggaagcucaauuuucguugguauccuguuccccagcgagaaauggacagaaggaaaggugacaggacucuuccugucagguaauuugucagacguuuucuuuauaguauauugcagaguugugacacuuuuucaugggguuaaagguguccuuugagaaacaaaguaauuguauacuuuguacauauuucacauauuuuuuuaaagaggauuuuucccccucuagcuaacaaaguuauauuuuguuuucauucuguaaacuccuaguauacaugauaagugaugauaacauacauacauucuuuauuuucuauaugaaaacauuucagauuucuaaguuuagucuguguuuaaaucaagcuacuccucaaucaguuguguccuuauguuaaauacuagcucagaguugugucuugugcuguaacauuuuacgagcauguaccaucugggugguacuuacuaacuuuuaagcuuagaaaagcuugguccucacaaugcuaaauagagauugugagaaauacauucaauuuaaggagucuaagauagaaaguucaucaguacuaagaaucaagaaagaugcuaaaaauaacuagaauuaacaggguauaauggaauuuccauuaauguguauuuuuuuauuacuauacuugaucacauguggcuuuauucaggaaggcauaaagagcaugcugguaaggacaugaccugagacuuagcuacauagacagaaacccuaguauuuacuccagguguguccaccugcagcgucuguaguaauggaauaccacuuuuuccgauucggguuucucuggucuguucuccuuuaaauucaaauccaauucuggagaagugaacaaaauuuauuuuuucccacucauucuuuuccagccugaguucuuaccaguacaaggaagcucuuaguacauauagaucagugucaaaucaaggacucuuagacauuugaaaacuuuguaaauuacagcuuucacuugagagacaaugcugcugcccuaguggggccuggaauagugcaggccaaugacuucugaacuuaggaaccuuagcucuggagccaagaacuuguauuuucuucugcuggagucuguuuuuccccuuucacauucauccuucauggaaaucagugguuaacugaaaccacggauacccauuuauuuaaacccucuuucauuaucauuccucugcuuacuuaauucuccgugcuguuaccuccacaccacccugugcacagcuggacuugucuuuugcaguagacaugccauggguggucagcauggcggucccuucagaaggagaaugugaugucacucugcacugcauccucuccucuccuuuaagaguguuguaaaucuaggaaagguucuuuguuuucauccuguuuuaaccuaccauuuuugcaguauuugccacccauuggaacuuggcauuuuaacccuaacccaagucuaguugaauaaaauagucaacuaccuuuuuacuugcuaagauuuuggagucaaguaccuggucaaauggagauuaugagaaauacauucaguuuaagaacugugagauaaaaaguccaucaguacuaaagaucaaggaagaugcuaaggacaagaagcauacuuagggcuuacacagagcguggacagguacagauccugucugacacagaaaaccccguggagauaaacauugcugaagaggguaagaguaagcauuguucuguaguuauaaacaacuguagacgugcaguacuuuuaucaaaacacugaugauaaauuuuagaugacuaaaauuaauggcauaguuuuaugauugaauuucagaacaccuacaauggcuggaggccuuuuuucaauagacagagauuacuuucaggaaauuggaacauacgaugcuggaauggauauuuggggaggagaaaaccuagaaauuucauuuaggguaaguucccuuuaacaaaaaauaaauuuuuuuacuuaaccacaaauauguguucauuauuuuuguuguuuauauaagaaauaaaauucagugauuuuaaucugacucuagaaccuucaaguuugaugacauuauggaagacuuaaaaaaaaaaaaacaauuucaguaaagaauccaguuauuuuuaauagucuggcuguuaaaccuaugcauaguccuucaguucucaauuucuguuauuuuaacaaguuauucaggcaucagcaacuaaauagacacaauuuguaauuuaaacaggcugcuuugauguguaaccaugaaaacaauuucauuguauuguauacuucuuagcuacuugaaaauugcucuaauuaaaucugguuaccuuauugguuuuauauuuuucaauaaaaggcgacaacaguuauggagaugguucagucaguaaagugcuugccauauacacaaggagaucugaguuugauccuagguuccaccuuaaaaagaagcuggaccuagaucugcugcgguggcucagugggugaagucuuccugcagucugagucaacaugauagaaggagagaacugacuccuacaaguuguacucugacauacacauaccaaguaaauuaauugcuuacuuauuuuuuuaaugguuaggcaugacaaucaaugcaagcuguaaucccagugcuggagacaucgagacaguagaauccauagcuaagccagugaacucugguuucaguguaaaauccuguccccaaaaaauaagguagagagugauauauagacacccaacauuaaccccugacccacacacacaugcauacacauccaccacagaaaagaagagaagaguacaacauucuggaauuacucuucaguuaauccaacccacguggcacuacuaucagcacguuagaugguaacguaugcugcuaauagcugcuaacacauagcaucuuacaguagagacaaaacccgagugugcuguagguggaagcaggaagugcucgcuucacuaccaaugacugcccaccuguaaaggagaggagcggcaugacagcuucagggaaaucccauccagcucugauccaacacaguguaauccugggaaaaccugagguagacagacugaauauuuaacaaaggcagauuucuuucaaaauguggauauuaauuguaaauauaguuuccuuaugguacaaaaauauauuuugaaacaauugcauugaaucaagaauguaagucuguucuugauucucuguuuguuccaugagugcaugauugaacaaauagaguaggacaugugcugccuuuguguguugaagcaaucaugguggugucuguucuauguuauuaguggcacaagcuuggagaggcagaaauagaaaagauuuggguacuccacaaucaugggcguguguguguguuaaaucauaagccacaucagacauguuugagcauuucugacaucguguguccuugcugacaucgucaucugcauuuagagaacugcaagacaccccacucuucuaugaucucuucuuuaucuuuaucugauuuugaccaagauuuugcaaaacacuugauccuagggcaauauugguuauauaccagagcagaaucucugagcccuaaacuuuguuguuuguuuuugagaugguuucacugugucauauuagcuggccuggaacucucuaaauggacaggauggcuuuaacuccugcagauccauugucucuacuuccugagaguugauauuaaaugcagcauagaccaccauagccaggcguaugcucugaacuuuaaacuacauguccaacacagugugcuuugcucuuuaauucagauuugguaauuuggagacauuuuagggaaaauuuaccaguaacuauagcuuuuuuccauucaugguuuuaaauaaaagccaaagcccuuuccauugaaaacuaugcaugaauccuacaggagccuuuguuagguagucacuaagccguguucugcucuuuucagauuuggcaguguggaggaacuuuggaaauagugacaugcucccauguuggucauguguuucggaaagcuacaccuuacacauuuccaggagggacagggcagauuaucaauaagaauaacaggcggcuugcagaaguauggauggaugaauucaagaauuucuucuauauaauuucuccagguuaguguauauugaaugauuuauacaagaguauacuuuucuuuuuguaugucuauaauuuuuuuuuuaaucugagcagggugcacuugcgccacaguucacgugugaacuccaaauuuaacuugugggaguugauucucucuuucuaccauauggacaccagggauugaacucagcugagucuucaaguuuuguuagcaagaaucuuuuccacuaagccaucucaggaggugcucccaacugagccacauccccugucccauaaaacagugcuaccucagaagugugcuaugagcagccuccauaagcaggcccuccaugcugcuuguauagggcuuuuacgaaaucaucucaugucauaaagccagugcggagcccauaguauuccucaagaggguucucuacaagaauaaucgggcuuuuguguuuaucuguuuucuccuucucagcaguaagccugucugaaaguauucuugaugcuuucuauucugcuuugaauguucaguuagaauucuucaagacucgggugggugugaacauaguucagugaguuauaggagagaaagcugacuggaaauaguuguacuguuuaauguuuacaacaaagaucuuaauugaauuuuuuuuaccuuaauguacauuaaaguuuuuugaucccuauguagcuuauuguuguuuaauauuaguauguguugcauucucacauguuuuuuuucuuugaaaaaaauuaaaauacauguuuuaucauugcuuucuaucugggaggugaguccauagcauacccuuagagcucauauaucaccugauaacugcugcuuugugagaaugagcauauaggcagacaugugcuaccaaucagaacgcuaauaaaucaggcaauucuuucuuucaacagguguuacaaagguagauuauggagauauaucaucaagacuuggccuaagacguaaacuacaaugcaaaccuuucucuugguaccuagaaaauauuuacccugauucucaaauuccucgucacuauuucucauugggagagguaaaaacaaguacauguguauacauauauacauaauauguauucuguauaguuauuaugucuuuaagaaguugaaacgucuaaccucuaagguucuuaaaguaccuucguuauuaaaguguauuuaaccccaaguauggguaaggaaagaguuuuccucauaaggugaaaucuuuuaacuccauuucagggaauccaguguucuuuucuggccccugagaguacuaggcauauccaugguacacauauauacaugcugguuaaaugcacagaaauuaaaaugaaucauuuuuuuaauuaaauguagcagugucaucaguguacauauuuuuaacaagcuaagccauuuacuugaaaccugcaccuucuaaagcuucuaauacccuuggguuacuccagaucaaagccugagaaaucucagugacaauaauuugaugaggaggguuggcacacuucuguacauacauuugggguacauguuuauuuuccuuugagaauucuaaguuucacaguuuuaacauggaaauuaggaaauacauguuugugucuugugaugcucuauguugcuucucuuagaauucagcauuauuuuucuugaaauaauuggcuuauuaaugcuuauaaauaagacaaauuugcagauuaguuguacuuuuuaaucccacuacaugccuauacuaaaagaucuaguaugaaaaaagauguugcugucaguuauagugaccuugacaguaaacaguuucuuguaucuuguuuauaauaugucaguuauguauguauguauguauguauguauguauguauguauguguguauguaugucuagccaggccucuguucuaugucugagaacucaaauuggagcgagguguagugacacaugcauugaaucugagcagugggaggcagaggcagguggaucucugaauuugaguuauacuagagauacccuccccccacccaaaacaaaucaguuugaucuuucuuagacuaaacuugggucuuuuaaaaacauuguuuaaaaguuuagucucuuaagucagaauucuccugcaagucugaguuauuucuucucuuggaagaaaaccaaccaucuuccauauaucuuuaguaacuuuuccucccuucauuccaagaacuuuuuuuuuuuuguauucuuaucuguugacuuccuguuagagguagucauuucuuuguuuccauggucaccuuagagauucuugugugcaucacugaauuaccacuaaaugaguacuuuaccacuuguaaguugacuacucccgcuccaaauuuuugaagcaaaaauaauuggacuacuccuucauuagaguacucuagccuauuaaaccauaaagaccugaacugucuuuuucuaguaaucuaaguuccuaagauccuauuuguuaguucaaggugauaauuuucaacagccuacuacagauuuagcaucaguuuaggugcucauagcaaucccauaggaucagauguaugaaaguguguuaaaggaauuuguuuuuacugaucugugggguaaaggucauuuuuuauaguuguuauaacuuuaaacguugcugucuucaugaguccuuugauagcauuauguguauaguacuaaccgacugucuucugguuauuggcccuucuuuauugucuacaugucugucuuuuccaggggauacaggacuucugccuugucacauuauagucagucauuccuucccuuucuccuuccucuaauaaacuucugugguuggaauuuggcauaauuuucuucugagacacucuuagaaguuaaaaucucugaaggauuucagagagggcaaagggaagguccuuugaggagcauaggcauauauugacugucucuguuggggaugggacacuugugucuaggguaaguccagccuguuuccgugcccgugcuuuaucacugccuugggccacuuuuauacuauugcaccaggguugagcaguuguccuagagaccagauugcucacaaacugaacgucuguauccuccagccccugggguaugcaguuaggggcagucauugcggugcuccuuagccucaccaguugcugcagcuggucuuggaaguguuuccuccaguuggugaaacuggcuuugugguacucacuugcuccuuuuuaccugcuacuguagauacugugcuuuuccccuuccugccccucggaaaacauacaguuucuauugggugauagaucaggaaauaggccugugcugccugucggagcaguugaacacaggccaucuguaauuugcugcagaucuuuaugcacuugaaugacaaaacucacauagaaaaaaauuacccaaguagaggggaaauccaucuauuuuguaauagaagucaauaggacagauuuccuuuuguaagcauaauugcacaugaauacaagaaggccacagccauaccuucgauuuuagucuccuugacacucagaguauguaaccccaucucuguaaguagggauuucuucacugauuuuuauucauuuaacaacuauuugagugccugcauggcauaaaauaaagugaaaaucccacucucguugaucuucauuggguaucucagauagugguuaauguggaugagacagagcaugaaaucauuaucaguuauguaggguuguugaggaaggcacccccuaagguaauuugugagcagaaaccugaagaaaguuacuaacuaagccauauacauugcugagguaaaaguuucagagcaagggaggaaggaaugcaaagguuccuaagauaaguauguacuugauauuacagaaacaguagggagcucacuugucuacaagaaagcaaguaggcagguaauaaaaccaucacaaggggaagcuagggagguggcucagugagcauggcauuugagccacaaacaugaggaccugaguucagaucccaugagcucauguaagacugaacacagguguaugucucuauaaucccagugcuucuguggugagauaggaggcagagacaggagacguuccugggucaguuagccagguuuaugcaguggcaaauagcaaagagaaaggggaagauuccauuucaaagugaagacugacaaccaagguagucaucauuguagauauaaacccucucauacauauccauauacugaauagaggacccagccauaggcaacuggaacaguuugguagccauagacauuacugauccuaguacuugggaggacagaggcaggauugcauguuugaggucagccuagucuacauagugaguuccaaagcuacauaaggagacccugucuggaaaaucaaaacaaaaaaaguagacgguaaaguuaaaagagcaggagagugauaucucaaagacuagagugaacagaagugcucaacuaauguugaaugccaauaacaugagcaucgagaauuggucagagaugguauuagugucuucugccccagcauugguagaguggccacgagaguauuagggacucuggugcuucaagagaguaggggaaacauaaauccugaauguuuacuaaucuugcaaagcaaggcauuuugcuauaaaguaauguagagaaagcggauaauagguagagaauaugagaaaggggagaaaauuuauuaauuuuuauaaaaauaaaacugugugcugaguuuuucccagguacuuuucagggucugguacagcuugaagccuugguuauagcaggauucuuaaacauuuuauuaagaauguauuagucuccuuggagcuaugcuauaccuagauacaaggcaauuuaugugagaauggggcugaugaccauuauuuauaaaaauugggaguaaugguaaaagaaguaaaacuuuugguggagaaugggcuuuguaguuacacgcacuugaugcccuugcagaggaccuggguuugauuucuagcaccuacguaguaguuuacaaccaucuagaacucuaguccuaggggcucugaugcccucuucugacaugggcagcagguacauacauagugcacagaaauauaagacaaaucuuaaaaauguaauugcaacuuugagaggcucgagucuuguaucugcuuguggccgccauuagcuggcuuccugaguccagucaggaugacuuaucugccagccuguaaacuauguaaggcugugcaaggugugcaaggcugcgguauacuugucuaaggacucuuacuuugagaugcaccuguggguacuacuuuaauacaacggguccuuuuucauacgacaguaucugucagaaccuuacugagaugcuggccuucaagccugaacagugauaagcacuuguuguugccuaaggguugguggccaugauuagauucagacuuaaauuccaguauugaauaagugucuaagcggguuagcuacuuuaaaaagaaggaaagaaaccugugcuuaugagaaugaccuaaaagagaaaauuugaccaagccagccucccucgccuuaagauaauuucugucaaaaauagcagcaaguauaggcagagaugugggagagucagguccucuauauguuguuggagggacucuaaaaugauacaagugcucuggaaaacaacggaguuccucagaaaguuaacacugcauuacugggaucuaguagugauagugauagugcucuugaucagcacucaaguaaaauacagccaucgugugauguggugaccugacuuccaggugugagagaucuuagggccagacauguuccauggcagcacuguugacaaaccuacuggcccaggcaauucaaauuuccagauacaugaaugguaaagaaaaaggccuguacauacaaggcauacagugggaaauuacccagccuucuaaaggacagacaucccgguguauacugccucauaaguggaccuugaagauguuuugcuuaagugaaguaggcugguggcaaaaauuauguguaauugcacuucuguaaaguacuuauaauagcugugugcauggaaauagaaaguagaggcuaccagaaacagguagaaguagagaagaugcuuuguuuaguggcuaaagugguucagauuuguaagcugccgagugcugaagaucuguuugacaacagugugaaugcacuuaacccuucugggcugucugcuaggaacuggcuguggugaugcuuacacugggucuuucacacauuuauauugauaggagagggauucagagaggagaguuuuaauguaaagaauggaacauaggcaguucaucucuuggaacagaauagaaagcagagaugggaucaaguacaggucagaugagagugguggaauuuuguguugacgcuugagaaguccccuuguguucagguuaauacagaguauugguugagaguaagacagggguugucuuggggaaagagggcaaagagaaacucaggcuguaggugagcacauggggagcugaugcuggugaguaaaaccaugagccccccucucucacccccccuuuccugcacauucuccccuuucagugagaaaaaucuagguuuagugacaugccucucaaggauuuagagcaaccaugccuuuagacuggugaaugaaagguuuuucuuugaacugacccaguguuggacaaugccaaggcauuauuagaugggcugggguuugugcaaauuaaaaggugauaccuguccaacucauggcagaugguugucaagguaaguuggcaucuuaacuuuuucuagccugcuagcuuccuaagugacauaggcuuuaccaucuggucuucuuuacauggucucagaaaugcagccuguggucuuuuuguaucaagucacauccagaugaaaagucuuauuucuggggcaauauuauuaggaugucuucaaccaagucugccuucuagaacuuguaguguaggauuuagaaccaaaauaaacguuucaucauaauagcuaauaguugggguuuuuuuuuuuguuugguuugguuugguuuuugguuuuucuguguaguccuggcuguccuggaacucacuuuguagaccaggcuggccucgaacucagaaaucugccugacucugccucccaagugcugggauuaaaggcaugcaccaccacgcccagcuagcuaauaguuguuaauccaugaguauuguaagaaaccacuaagaaaugcaaccugacccuucccuuuuuagcuaguggggcagaacauucgaugauuugggccguucuaaugguucuaacauuuaauuagcaucuacugucuguuaaacagcaguccaagggccuugccagucuugagauguuccucuucugaugacucaguaaaauggcuguuguggaauggauacccaugccauggcuguuuccacaagccagucuccaaagcuccuuuggccaggaaaugauuacagaguccugagacauuaucagagggauggucaaaagcagcaucuuguguccuugaguugcuuuauuacucaaagagugaaaguggagaaaacugauucccauucucuaaacagccauuuauaguucuuuaacuagaaguaggaccuugugagauuucccccaucuucauugggaugucagcugguguuaugcaggucauguuuaggcagccacauuguugagauuucauugguacaacguaacuucccugugauauauagaagacacuaucuugaagcagaaacccugguucucugacuaguacagucuuucugcucauuucuugauguucccggagccuuugcagggguuauaucacuuggggcugaacaucccagucuuuucuugguauuuagaccaguuguggcuuucugugguggucuucaucugcuuaaugaggacugagagcuacccaguuagaaacuauacugguuuaggaaaguggcaguuguagggucucccuuagggucugugacuuugccaguuacaugggaaugacuaggccuuuacuguaccaauuaugaaucccuuccuauugagugggcccuaaguccacuuagauagcuguuauuuauacucaagauaaaaaugucacugaagaaauaauaaugauugacuuuuaguauaucuguaugucuccucuaguuaagcuccagcauucuaacuccugaugucuucauugccccacagauacgaaauguggaaacaaaucagugucuagauaacauggcuagaaaagagaaugaaaagguuggaaucuuuaauugucaugguaugggagguaaucaggugaguauguuaguaaacuuucaaaacaacuuuuaguuuuuuuuuuuuuuuugcuuuuuaguuuuauuuugcucuuuuaaucccauaacauuauucaggaaacauuuucauaucuuuaaagaaaauaaaaaugaguauuaggugaaggguacuuucuugcggggcugugggugcugggggaauaaaaggagugggagaaaacccgcgucccaccagaguuccagagcucugggcgggcggaugcugaacugccgcaugcuuuccacggggccccugguagguguuuggcugugggaagccacggaaccccagcucagugggugguggacaaaggggcagucuuaggcaccagguucucagccucaggcaucccagacaccaaugggcacugcagaagagcugagaacagaaugggagucccaggggccgcucgcucagccccggggcugaagggagaagagggcaggggauggggggugcugggugguucucacgcagggcagaguccuuggucugucuguggcuugauugcaggaaggccuucagguuggagguuaaacacagcucauuaggggaaagccuaucccauuguccaagcacagcgggccuugaugaacagagacagucuaugguuuuagagcuuuauuguagaaaggcagggggaaagagaagguagaaagagggagagaagccggcuguggccaccuggagauggagaaggagugaagggagagagagaaggagggcuagagaugagaguaagaaaagugagagcuuagagagcaaggaggggccaaacagucccuuuucuagugggcuggcugggcuaucagguaacuguggcuauagucagguaacugugggguggagucuagccaggaugccaggagcuuggaacauugugugacagguggcacggggugggggguggggggugugugucggggguggcacugugggaggcuguaguuacaugacaggagccaggugcccaggagcuguggccgaacuccugcugucccuugcugguggaaaucucugcccacuggggcucugggguucaagaccuaugcuuggcuggagaccaggcugucugugggcagcccacugccccaugcuuucguuuuuuuucuuuuucuuuuuuuaaagauuuauuuauuucauauaugugaguacacuguagcugucuucagacauaccagaagagggcaucagaucccauugcagaugguugugagccaccaugugguugcugggaauugaacucaggaccucuaggaagagcagccagugcucuuaaccacugaaccaucucuccagccccagaaggguacuuucaauguaaugauugauauauauauauuauuuuauuuuuuagauagaucucacuguguagcuuuggcuagcuuacaacauuuaauauagacuaggauggccuugaacuugagaucuaugugcccuuuguaaugaauucuucucacaaccuaagccuacccucagacaggguuucuucaugucuuggagcucauucuuuagaccauguuggccuugaacucauggagauccaucugccucugccucccagacuauugggacuagaggugugaacagccacgcccagcuucuaaugauuuuuuuaauaagaccucuaugacaaccgaauuaacauugcugaacacaaaauuuauuuuguucuuauuagaaaaaagacaaaacaaaacaaaugacugccuuuaauaauauagucagccuacagagaccuaaggugguuuucacuuuacucuguguaaaauugguauagcuuuucugaaacuuuccauuacuuuaacaauguacaaaaaaucgugucuugaaauaguuccagguuauuucaguauagcccagggaaaauuugaguuuuggcauguaucucugcucauaugcuccucugugucuguugaaguuaauucugauauuuucauugucucauggcuacaaaauguagaaauguuggcaucuaaacugcugaauacuuucuuuuuacuauuaaagcucacauagguucauguucgcuuuucagguuuucuccuacacugccaacaaagaaauuagaacagacgaccuuuguuuggacguuuccaaacuuaauggcccagucaccaugcucaaaugccaccaccuaaaaggcaaccagcucugggaguaugacccaguggugaguacccagcugccuguaggaguggaugcugcagcaugucaccaggcacauuuacacucuguagcuguguguuaauaguaacuagcauuguuaauaacggcugcuacacguggccccaaugugauguucucuuuguuucuugcugugugcucuugccacuauggguguaacugccccacuccuguggcucagcuuuuuuuuuuuuaauccaaccaaacuuuuauuuggguuuuauugcaaucuacuuuuggcaauaagggagaagugaccauaagaacucaucagauuugauuccacagagcaguuuuccugaacgcugaaggucagugugugucagcucagcuucaguaucaccauguacccaucguggguauuuacgcccggaugcugacaggaaggccucgcgagaugcuacagucuaagauggaaccacauuuuacacauucuaauuuuaggauaggaaaguauacuaauacaauaaguaagagaauuuuaaaaguguugcuuagcccuuguugaacaaaauuccauuauuagcuuauucuuuaaguacuccaguuaauaaaggcuugauuguacuucaaggacucugacuuuuccaaagauuaacaacuaguuauuacuguuacaucaaaagcaaagcuuccaagcuucccacgcuuguccuuaaagcauguuuacaucauagauaacuccuuaugccugacagcacgucuguggcuaggccucguauaguaagccuugacucagaaaaggaaagaaccuaaguaaaggaaaugugugcuuuuagaaauuggauggaaaacaacugcgcaaucacagguuuguugugcuugguuuucuucugcuuuaguacugcagaccucaagccugaggaaggauaccaccuuuuuagggauuuggaaaguugaauaggcccuugauugugcacugguuuuugucuccacugaaccugaagacugaaguguggccucguguagaaucuggccucccaguugcuagacugugucacacaguaaagcccauccucagucaggaagccacacccaccugcuuuagaaaaggaagcacaguccccgcccacccagcucuagugucguaggugcaguucccaugcaucugugagaguuaaaguaggugacauggaaccucgggucagucacuugccaagucucacuuggacacagcacagggugaugcagaacuagaaguaaagaaguggaugccaucauuaguuuuuguuaucuuuuaacuuaacaaaacuguuaaaaggugugucaugaaaaugaugguucaggggcuggauagauggcucagugguuaagagcacuggcuguucuuacagaggaccuagguucaauucuuaucaccuacauggugguucaguucuaagagaucuuaugcccucuucugaccuccaaaggcaccaggcauacacauagcauacagguauacauacaagcaaaacacccauacacauaaaguaaaauagaauauaaaauuuuaaguaagaucuuacagagaaaagaauuacauuaaaaugaagaugaagguuaaaaaaucagauaaacauguguucguuaugguuacaguuacuugacaugucagguaccacucaguggugcccccuguaccaggccaucuugucggucuuuggucuagaucacauuaucagauucauuguggaucguaaucacuaugaauuuacucuuaaaaucagccugagaguaucaaaucuaaaguguaaacauugagguagauagcuaucucccucccugguuuacagccucuuuugugagugaggcaccacauaauucugcucuguuguuacugccucacagagccucuuaaagugugggccggguuguaauauuuauuuuacaagugagaaagccuaaguugccuaggcuagcaaccuagucuagauccugugcuuuugugugcuacagcaccuccccucaccaugaggauagcuauggucuggauuugguaucuaggcuuaugguugauuguacugugucucagcuacuccagcauucuuguguauugagucuguauaaggaccuguguuucuaaaagcuuaaggguuagaaucauagaauuaaauagccuuaucacagagaaaugaaaagucauggaaauaguuguugggaauauguuggaggauccuagguuaguagucacuaaccuggccuggaguuuucuuuuuacuuuaagggaacuauaaaaugugguggggggagggguggcaguggcagccacagugguguacaguuuuaaucccagcacuugggaagcagaggcaggugaauuucugggaguucaaggcuagccuggucuguauagcagguucuaggccauccagggauaaguggugcagugcugucuccaagagaaagagggggcggugcuggggguuugcuuuuuccacguucuaguuacgcugugugcuucccucugccacucucagaaauuaacccugcagcaugugaacagcaaucagugccuggauaaagccacagaggaggacagccaggugcccagcauuagagacugcacuggaagccggucccagcaguggcuucuucgaaacgucacccuuccagaaauauucugagaccaaauuuacaacaacaaagaaagaaggaaggauugacugggcuaccucagcauacauucugccacauucuucaguagcaaaaaaggaaagugcuucccucuucugugggauguuaagguuucucagccauuaaaacucagacuccuagcuuuucacuugcugugaaccggccuuccugucccaggacgugcgacugcaaaguagcgagacugugcacacugauguuuacaaggcuggaagagucuucaucaagagcagcggcaaagccuucagaucccaaacaggcgcacgagcgcucucgggauagaugcacuuucuacagcgugggugcacgucagccguuucugcugaaugugccuugugaagaagaguuuuccugauuagaaucaguagcuggaauauuaaauauugauagaaaaguaaguggaaaagagcuggaaccagguucagaaucaugaaaacauuuuuacaacaauaaaaauuaugucaaacaggguuuaaaggaaauuaaaaagaauuaugagaaguacaauuuguuauaguauaguaugagauuucuauauagauuuuauaccucaguggggaaaaacugauuccagugauguugauguuguuuucaucugugauagucauggaugcuucuauuuuccucggggugcucagagugagauaguggguggggugagcucucugaacauaguuugaauuucuuuuuacaauauucuuauuugguuugugggcuguuggaauuguaaguuuaauugccauucuuuaaaaaaaaaaaaauggagauuuacucugccuggucucaguuggaaaguuuucgaucucucucuguuguucuugggucaacuggcguacagacucugccucgcccugccucccucccuccacacaguuucuuaacaugcuguccacuuaacucugcugagcugauugugcuucaugcccaagacucacgcuacugcacugcagguuugucuccacagcaauaaccucugaccccugcgagucacuucacagagugcuguuuaucuggagauugggagaucagacauuuaauggguuuuuugaaacccuugccacuccacuuagccgugugcuucccugucggacgcacacucagguuccuccucaguuguaauguugauuugcugcuuuuucacaaaauaaaaauggacugaaaguguuuaauuggcauuuuuuaaugaguuagccaaagaagugcaacugugauuccacaucacaguccugcguuuccucccuaaauucuauuuuguuauuugguuuucuuuacucugguuuuuaguaacaggaucacguauuaaaauuugcuguuaauuaaaguuuaccuuuugauuuuacagaaaucucauugugacauuuuuuuccauagcagcccauuggccaaaaugcauaauucugcuuccugucugucaggugauacuugaugguauuccucuuuuuuugauuaucaaagacuugcuucaggaagugcuguuucuugugcguaagaauguuccugaagucacacucgucagugacaccaucugucaucauucauccagucgucagcaucgaauauauggaugcuuaggguaaggcuguccuccaggaugcagagacuccccaugcaaucugaaugaaaccgguguuggcuggaauacuuuuucucuucugugagcuauguuaauucugucuccaaugggcccaauguuugaaaagucagaugucuaauaaauuauuuucaugcucagaauuucagauuuuuguacccuaacaacaugguuuuauuccuuauuguaaaaguuuaacagcguugugauuuaaaaaugugucucacuuuuuuaaguggggggaugugagugacuuaauucauggguacuuuuagaaccuauuagauaaucuuauugccuuuauuuuucuaauuaaaauauuccuaaauacuuugaaaauauaugauacucugaguaguugugccuuacguugguuuuacugaggguaaacuggauccuuucaucauagcaguuaguggguuaagcagauguugucucuauuggacuccaacugagaggagaaggagugaggaggaagacaggaucuuacucuacagcccagacuaacaucagacucacagcaguccuccugccucagccuuuauccaaguacugagauuaaagg

SEQ ID NO: 8841 - RNA, 23947 nt, Mus musculus
cugccacugaguugacacuuuaauuuuuuaagaaagaaacauccagacagugcuacagacagccccaauguaucuacagugucauacaucaaaggacaguuguucacaaugacauuuuaaagcacugagagagaaagagagcuaagugcuuuuugaauccaagaagucaaaauauuuucagaacaggucuuaacauccucucaugggcuaaaguuuuaauacuugccacuuggaagccuagacaacuagaauguucacauaacuucaggcauaagagaccauggugaaaaccaagucuucuggugacacacuaguuacucauuuggcccaucuccacacacagauuuaaaugccucauuucucagccaagugacacauugcuuggauuaacauauuuacauuucucuaucauacagauguacaagcagaugaaguguaucagaguguucacuuguuucacaggaacauaacaauuugacagauguccacgcacguacucggaacuaaacaugccccuuuaaaacacaucuagaauuucccccucucaacguuacaaccaaccuugugauuuuucaaagcaauauauaccuccucaauccucccgaguucucuuuuccuccuauuuccugacuaugcucagugugaacuguuggugucuuggguuuugugcccauucuuucucagcacgagcaagggcccaacuccagcagggaaguaaugcuaaagcuacacagaagagcacuaaagacauuuucucuagaauagacaagacacggcaugccgaaacauacagcuggguaauacugguggaucacacacagaauuuacauuuccaaaacagaauaacuuaaauauuaaaacguaccuuuauguuacccaauggaacugacuuuauaagcauaacaaauggcaaaauuugauagaaaaauugcaaaacucacuaguuuuaaaugcuguguaucacagcauaugaacguauuucuaccaucuacuggaacuacaaacaacaguacuucuuuaagcugcucuaggguuuagaaccuaauuagaaauuuauacgaaacacaauuuuaugcucaaauauggaaaugaguaacauaauuccaaaaccgagaaguaucccagcauucugcaggaagaaauauccccaacggcugcauccgugaucacuagcaucauugugcaacaucucaggcaccugaaagaggcagaagcaacaguuuagcuuucagaacagagaaaccagagagucugaaggacaguguggcuuggggcuggguaaaguauuggucuuugucccaggacuugacugacuacaugcacacugacccugguagggcccuggcacugagcaugucuagcagcugacuaggacaaugacgacuaugguuccaagcagguaaacauucacccacuguacagugagaggugaugcuggcuucccugcugcagguacgucugauguucacuucugaugcagaggcagcucucacacugcauagaauggaaguguagcaagaagccugcuuuaagccgggcgugguggcgcacgccuuuaaucccagcacucgggaggcagaggcaggcggauuucugaguucgaggccagccuggucuacaaagugaguuccagaacagccagggcuauaaagagaaacccugucucgaaaaaccaaaaaaaaaaaaaaaaaaaaaaaaaaaagaagccugcuuuaggaguguuaaauggacaagggaguuuuacuuugucaaaagggccuuuuaaguauggccugcugacaacacguggccugggcugggcuuacugugaguuuauagacaauccagggccugauucuacaaacggaggaguuuucauguguuuccugguaacucuuggguaggagaaagcuguauaaacagaaaccaacaaaagacaacgagcucagagggcaccuacagucuuaacuaccauccuucuggacccacaauccugucucaccacuggaauuaacaccauuuuugcaaugauuuuuuuuaauuaaaaaaaaaaaaaaagauuagagccgggcgugguggcacaugccuuuaaucccagcacuggggaggcagaggcagguggauuucugaguuagaguccagccuggucuacaaagugaguuccaggacagccagggcuacacagagaaacccugucucaaaaagaaaaaaaaaugaugaauuguauuuaugugaauguggguuugugcuugugcauugccuacagagggggucagauccuggugauggagcugcauggggcugaaucacaggaugugggugcuaagaaccaaauccugguccucugcaagaggaggaugugcucuuaacagccaagccuuuccccagacccugcaauggcuuuuuaccauacaagucuguuuauuuagucaaugcccucgacuucuuggaaacuuaccaugucaaccagagcgacauacaugaacaagccggcagugagugcgaauauccacauagaaacauuuucugcauaaugcccgaugaauaucccuguugccauuccaagguaggccaacauggcugacagagcauuauagagcacagccugcuugacagucaugccagccuuuagcaaaacagcaaagucaccuuuaucagaaaacaaacaaacaaaaaaaaugagggcagggucauugaagauaauuuugacacacaucuaauagauuuuucagauauagaaaaaaaguuugauccuuuuccaggggaauaaaaagaaagaaacuauccagggcuagagcagcguucgcaggcuccagcaguuucacagacuugguaauuccaugcagcagugucuguaggcuuccugggugucagugauggugagggagggagggcacacgcccugcugcacuccugcacugucuagaagggguugacacugcagcugcaggcaggggcaacaguucaguuguccuaacuacacagugagcuuaaggcuugccugggcuacaugagacccaaucucagaaacacuaaagcagaaacaauaauaaaccaccuggcgauggagggagggcgguguggacuugaaggaauggccgcaagugacaaaggcaacaccuaagagcccugagucauggagauggaaauguuaagagccucacggggcaggaaggacugagaauggggagcaagggaaacacgggcuuacagagcaugcgccagguagacgggaggccuucugaauggcaggaugcaugccaaggaccaaaagugaagcuguccgaguguuugugaaugaacgugugcccaugagaagaaacaggaacugggauccaaacgauggaggaagguuucacauuguagugaagugagaagugccacucaccaaccccuuuccuucagcuccaagacuuccugcugucauucccacucuacccuccgaggcagucccuucccgaacucugagcuagccuggcagucaguaagcccacugacccuccagucuccauccuccaaagcgcuggggcuccgggaacacagaaugcugggauuugaacucagguccucgggcuggcacagccagugcucuuaccuacugaguguugacccacuccugucuuuuagguggugcuggggcuaaaucgagguugccaugcagucugggcaagugcacacccauggagcuacuacuauacaagcuacagccuccuuccuaacuuccuguguaauuuaagacgcauucccaugcaugcuguaguucuggugucuuuggguuugggaauugggaguugggaguugggaagcagggucucacuuagcccaggcuagccucaaacuauguggaugaggaugacugucaacuccugauccuucugcuuugccacccaaguggugggaugacggucaugcacgugcacuuguaggagcccagccacucauguccccagugugccaacacagaaaggacgacuacagaagggacccagcuguagcuggacacagguauaauacacagguauuaugcauucuuguccagcgagaaagaagggcaguuuggugagcagaggcugggaaggcaggccuuggcuaugaagcagccaccagcgacagcagcaugguucagucccacagcagaagcugcccacaugcuucucuuaccuaguucaugaggcaguucaugacagaacacagcgacagaggugcuuagcccacuggacaaacccucggugaaggcagcaccuguguaaacaaagucagcaagggugagucugaggccccgaaagcacaguacacgcuacacagaaacgacgggaaaacaaggacauuacauugugcauaaacaccaucuuccuagcucagccuucaccuucuuacuuaaaaaaaaacaagcugggcaugguuguacauuuaguuauaguacccaggaagaagaggcagggguaucuuugugaauucuaggucagccuggucucagagcccaucucacugggccuagaugcccauaggaagcaaaggcauacgcaacaggagggaaagguucaguugacuagcaaugagccuacaucuacaaaucugagaagggacugcuaccauacagaacccugagcugagaauguaaauuccaucagcugaaagcccucugcagucggaaguacuucacuggccucaggggaauucaugaugccaccagacuuguggacacacaugcuuuuaugugagcagcaagacagagccccucccauucaaaaagcuaagucugcugaccaaucaucuaccagccgugcaugggacauuccucccaucacaucagccuaagcagugggcccagugggccuggcugaaaagcagcacugccuuucuguccuccggcagggaaagggcuuucacauuaggggucuggaacacaggcacucaugcaugcuaggcgagaacuaccacuccuguuuaaacccugaucuuaagaacuccuggaugaagaacaaccuuuguguguuugaugcaagggcucgcacccagggcuuacggacaccauguaaguggucuaccacugagcuagagccacagccuaaaguacaacuuagguaacagacaggcgcagaucugaggcugaucuguagcccauauuuccugagcacuucauuauuagaaagcagacaaaaaaaaguauuuugcucauuuuggcaccuacuuuuuguuaaauuugagagaacauuuaauguaacauuuccaggcuaacagcaaggggcagcuaugcagcggcauaccaauagcaaggccgucacugaaauugugcagcccgucgcccaugaucaccauccaggccaauguggcaaugccggcguccuucagcuccucucgagaguagcgcuggcuguggcugugaggguggugguucuggugguggugguggugcagaaugugaugguagucgugauggugguggaugaggucgucggacuggcccagcguaucguggaagugugaauggcacuuguucuugcagccccugggcacauauucauuguagacuucuugugggugugcaugggcuaucaugaccucuuccucuuccaacaucgucggcugcugggaaucaaagggggagggcucuugggagucggcucgcagauagcuuucagguccuagggauaaaugcagagaacacugagaccaaaugaacaucuguugguguuccugaacacagcccagauguucccacugcugaccagucaaucaucaggacugagcagcagagcacuguugaugaggaauggcaacaggcucuagugacuucuucaaaugugaaauauaucauguuuuaagaauggguuucaagugcagaacuguagcacggaagaagccgagggaggguuacgugagcucagaacuccaagaccaguccuggcaacacagugauagcuagaaccuauuuuauaagauugaaggguuuauuuuuaaguuuaauuuuuaauuacacguauucauuuggugugcgcaggauuggcacguggcgacagcacauguguggaggccaggagacaaccgcuugggguugucuucccugccaugaguggagucccaacugaacucagguaagcaggcugaacacccagcacccgccugcacugagccauccgccucacucguccuacuuccucuuagucccucucuuuugucccaguuaguuuauuaaugacucuuguuuuuuuuuuuuuaaagacuuauuuauucauuuacuuuacaugcacuguuguuuagccugcauguuugucugugugagggugucagagccccuggaacaggagucacagacaguuguaagcugccaugugggugcugagaauugaaccuggauuuucuggaagagcaaccagugcucuuaacuacugugcucacucuccagccaauuaaugacucauuuuuuaaauuacaguaaaaauuucagaauuguaauacauguugguuuaaaaaucauuagaauaugacuguucucaaagugguaaaaaacuagugguuuuuuuuuuuguuguuguuguuuauucacuuucucugacauuucuguccaaucacacaagucuaaaaccguugugaucacuaguaacagugauagaacaggacuuccacaaauuggaacugaaaaaccaaguucuaucauaauuauccacaguccauuugaaauucagccaaugucauacaugcuauucucuguucuuacuugucagccagucagacuuguaacugucauaaaguaaaaagugagagaugaggaaucucaucuugauaaauccaaauucugcagucaguacauaaaacacagaauuccauguuccagaauuucugcaguaccuaagugaccuuccugggagcugugacagugacuuccacacaguccuucugguucaccagggagggauguguaugguaaacacaguugaaagcuccccuuugcuccuguaugauuuuaaagcugggaacauuaacauuuuuagucucgacaaagccacuccucugaggagcacagucacagggcaggcccagcucuugguggaagagaagaccagaaggcucaguacaggaguggcccaagcuugggaagacaaggguccaucuggugccaccaacacccaggcucagagcuuauuuugauuuugugagacagggucaacauagcccagguuagccuuuggauuguuauguagcagaggcugucuuuaaacuccugaugucacuacuuaucucucucucucucucuuuuuuuuucuucuuucuuuuugguuuuucaaggcaggguuuccucuguauagcccuggcuguccuggaacucacucuguagaccagguuggcuuugaacucagaaauccgccugccucugccucccaagugcugggauuaaaggcaugcgccaccacugcccggcgucaccacuucucaaaugccgugauuacagacuugcauaaagccuguuuuuuguggugcugagaauggaacccaggcaucaaugcacgcuaggcaagagcuaccaauugaacugcauccuuugaaugaaagaauuuggaauauuagucuuccacaacugcccuucugauuaucccuuaagaucuuuuaccuccuuguauuugaaaagaugaguuuuucuucucauuaaaaaaaaaaaucauggugugcugugguagcgcacgccuuuaaucucagcacuugggaggcagaggcagguggaucucugugaacuggaagccagccuggucuacagagcaaguuccaggacagcuaggucuauacagagaaacccugucacagcaauaaacaacaaacaaaaaaaaaguguagcccuaucagcugacuuccuguucauuggauggcuaaauugaaggaaaacaguaacagcaaaauaaucuuaauuacuuuaucaucaucaucacuaagaaacauuuauuggcugggcuuguggcuccuguccaugguccacauagauugucugcuuggacaaagaaaaggagacuggaacaguaaggcugcccuuuguccugcacacuguuaccaguuuucuggggagcaucccugaccugcugguccuauccuuacaaaugucacugaaaaccauucagaaugcugaagaaggaccaguuacagaacgaacagucaacauguuuuauuugcuauuuagagaaaagcagcaugccuuagucaggguuuguauuccuggacaaaacaucaugaccaagaagcaauuggggaagagagguuuauucagcuuccacauugcuguuuaaggaagucaggacaggaacucacacagggcaggaacuuggaggcaggagcugaugcagaggcuauggagggaugcugcucacuggcuugcuuccccuggcuugcucagcuugcuuucuuacagaacccaagaccaccagcccugggauggcaccaccuacaaugccaaccacccacccccaucacuaauugagaaaaugccuuacagcuggaucucauggaggcauuuccucaagggaggcuccuuucucugugauaaguccagcugugucaaguugacacccacacagccagccaguacauaacauuagaaaaugcaggggacuuacugacagcagcagguucccguccguaggcgguagcuaucuguugagcuccuacccugugcuagauauucugaucacuuguuuauaguuuugcucuguagcccaggccucacuucccaauccuccuguguagagaucccaaugcuuggauuauaggccugugaccccaggccuggcugaagcuucugucucacaggcccuggggacauggggacgccuucaacaaguuuaaguugacucuaaugguaagaguaugaauuugugaaaaauucuaaaacuauucuuaaaacugugacccucagugaguagaaagcaaagaaacacaagucucuuccgucagcuaagaggaaguuugcuugucuguguguaacuucgggaaggaaguaccauuaagauuuucccagaacucaaggugauacaaagcagcacucaccuuggucucacacgaccucacuuagaaggaagugagagcauagcauagugucccgagguucacgccaaaguccuggaggcauagcuccaggaacacacacuguggcuuuaagcuaagacccucaagauugagcuccuugauagcugacagucccucacagcaggaggcagcagaguguggugaccucucaccugauaugccagccagccagguauguuacucugcccuaacuggcucuagccuuaagaucuguaccugguggaguaaguggaggguagaaggugaacagaagggagacuccaucuaugcagcuauggggaguucaucgucuauacuggcugagacuugugggugguauggcugccuuggggcugcccugcuacuauuagaagcucauugauucuccaagugaggcucuggugaaaucaauauuuagguuugucacugaugccuuguccugggcagguggggagagcaaccaucuguuucuauuuccccagggaaagaauucaucacagauaauuacacaggaacccuccagcagugauuuccuguggcaguuccccaugacucaaugagagguguggaggaaggccuuagacauauugacccauauucuuuggucacagccaacaccugcagagaacugccuucugggguaagccacuccuuagacacucgauccugccucucaggaggcucccagcacaugcuacagauccucaucugagcacuugaaagagaauuuuuaaaaugagauacuguaggaaacaaaugaaaggucuagccccaucucucccaaauggucccuggugccuguaucccagugucauccagucugagucuugagagacuuacguuccccuggguccaccuucucuucauuugaggaaagcugagagucguauuuggacagcugcuucuugcucuccacauccucaucauuuucagguuucuuuugauucugaaacagccagcaaaaccagcuuuuugaaauaguugauuugcgucuguggacagcuuucaauacagcugggucugugguucagagcuagcgcacuugccuaacauaggugggaccuugggucccaagccugagcaccacaaccaaucaaaacccagguaagcaaaagacacagaaaaggcaaccucuacugaaauaaaagccauccagggacagugccucuacuucuuuguuuggcacagugugggcuuucggccauaacagcugucaaaaaggcaaaggaccccaagucagacuaaccacaguuaucuuccuguguagccuugcuccagcuacugugguauggacucaugugguaaggguuagaaacacacgaguccuggcaaugcugcagagugcggacuuuaauuagauccuagggugacucauccauacgcuaaaacccacaaaaacaaccuguuacacacgagggccaguuacagccaucuccuucaggcuugcuuaccucugggccacuucuuagacacugaaacccacauuuuucauacauuuuuguuaugcagacucaaguacuuaucccuaguaaaacaccaauaacauuuuaaaaaaagguuuaguuuucauuuaugugucuguauauauguaugcccagagggccagguaagggcacuggagcugccugccaugggcucugaaacuuaaggaccaguccuguaggagcaacaagugcucuucaccacugggccaucucuccacuccucguguuucacuuucaacuauuuauuauuuagccuugaaauuaucaguuuaaaauaaaaucuuaaucuuucuuaaaaaccaucuuccuuucuuguacauuuuuguguggugacugggagagaacucaggucuucaugcauguuaggcaagcggucuaccaugagcauuccaucagaauuucuuuccucccucccuuccuuccuuucuccccuacguccccaccccaccacagccuuuuuuuuguuuuuuuguuuuuuuuuuuugguuuuuugagacagggcuucucuguguagcccuggcuguccuggaacucacuuuguagaccaggcuggccuugaacucagaaaucugccugccucugccucccaggugcugggauuagaggccugcaccaccacugccuuggcuccaccccggcuuugauccacuccaucaguagccaaggcugcacagcccucuguuuaucucacccucucuguguccugggauugggugugggccucaggaacugacuauuacugaguuuugugaccacuccaaggguuaaggcucccugugugagucugagcaacauuuauguugcagaggucccacagaacaaacgagccuuagcauuaucuacuuauguggaagacaauauucuaauuauagaaaugaucacaaacuauauuauuugcauuacauuuauuuacaugagcaagacacaccuagucacuaccgccgcuaccgugcagcuguuacucagagggcuggagccucacuacggaugaggcuuacacaauucucugcuuguaaucauugauacauuauaugaaagaaaaccacaggguacuauuagaguauaaaacauaggaccuggaggacuuucaggacaggcucuuuaaaaaugcagcaguaaaaccgaaacauaagggugagccggacucuggaguaaaggauggagaggcaggaucuagggaguuuuuuaaguaugagggagggcccucaauagcaaagaucuagcucucuucuagagcuaaaaggaacuccugauagccugagagaccucucuccacgguaaaggugguggguuaguucaagaguggaagcugcagcugaaggaagccagguaacacagagcaugcugggaaugcucucugucuagaaagcaaugggaagucacuggaggacugagcagagcuguagagcgcugccugcucaaaggaagaauggaaaugaugugaacaggcugguuaggaggugacuguucuacucagagagggagcuaacuaagccuggacuacaacagcaucaaaaaugguugcguggagggggacagaaagacuguggacauauuuaaugugcccuggcugaucuagagugggaugguggaugucacaaugaucugguucccagcgagagcuggaacuuucacugguuggaaggauaagugacgucgaagugcuguaaauacacagacugagcauaugagcaguaacucacacuggaaugcagacuccacacuaccacuacaccugcucaaggaaaagucccucuuaugauaaggauucaccagccucuggcagccaugguauauacugaacuuuuuuuuuuaacuuuauuuaucuuugugagggagaaaagaaauugagauguaauaugaagaccugaaugcucuuaaaaaaaaaauaaacccaacauugaauccuaaccugggaacagaacagcuaauguuuccaaagcguggugaaggcuaucuggaguaguuucugcugguccauguguuucauguuuccucuguuccauacgcauuuaucaucaccugcuaugugccagacacaacauggacagagggaacugcacugaacagacgcccuggaucuucaaugcuuauauuacauucuacuggaugucuuaaaauagagauacucagcuucccuguggcaauccaccgcaguaugaagaucacauuacugcugcacuuaaagauacuggcacaacacacgguucauaguucacuagagaccuauaguuagaaaauaaacugcuauauuucacauaacagccugccuuuuagaaucucgagguauagaguaccagguuaaaggaggguuagguaagauuuagguaaaaacuuaaaacuaggguuguugagaaagcacagugggaaagacacuuucugccaagccugaggaccugcgcugucucccugggacccgugugguguauggcuacagcaagcuguccucuuuccucuguguguguccuggccuucaugugacuccuccacauaaacauaauuauaaaacugaaacuaacugaaauaaagauauuaacaaacuaugguuuuggacauuuggaaaaagaaaaacaaaaaaccccacagucaugcagugguaacacacgccuuuauucuuagcacucaggaggcagaagcaggcaaaucucuugaguucaaggacagccuggucuacagagagaguagacagccaggggcuacacaaagaaauugucucaaaaaaaaaaaguaaauaaacaaauaaauaagcacaguaaaaauuaaccaaaaccucacaaaccaaauuucaaguauucccuauguaaaaaugaacaaauuuuaaaauauucuuauuuuuacuuucucuaguuauguguauaugugcagguauguguacaugagugcaggugcuugcacacaccagaagaggguguaagauucccuggagcuguaguuacagggggcuggaagcugccccacauagaugcuggaaaacaaaccugagucuucuuuaagacagcauauacucauuauaugcucucuagccccaugagcuuauuuuuaaagcuaagaauaauucuaaaggauauauauguauaaaaaggaugucuucaaaccagucuuaguauagcaaugaaaacagccacauggaaccugauuuuggacauuaaaauaaaguggcugagcuggagaguuggcucggugguuaaaagcauuuuacccuuguagagaaccuggguuccacucccagcaucuauaugguagcucacagccaccuguaacucuagaccggggggaaucugaugccuucuucugauuuucacuggcaucaagcacacacaugguauauacacauauaugcaggcaaagcauucauacacauacuagaauaaaauaaacuaaauauuuuaaaaauuaaagaaaaagcaggcuggugagauggcucagugguuaagagcgccgacuacucuuccaaaggucccaaguucaaaucccagcaaccacaugguggcucacaaccauccguaacaaaaucugaugcccucuucucgagugucugaagacagcuacagugcacuuacauaaaauaaauaaugaaagaguccagcuggguggugguggcccaagcuuuaaaaaaaaaaaggaaaaagcaagaagcuauucuuuguguugccccuugagacccacauagcccaggcuggcuucaaacuugcuaugcagaugaugacccuaagaucuuaaucuuuacgccugcaucuuccaggugcuaagagcacaggcaugugacaucaugcccagcucaggagcaaguuauuuuuacuuacuuuccucucaucacagggccauuaaacagagggcucacauuuguaauggguaauuuuuuuaaucuuuuuuuuuuuuucugaaacaagagccucccuauauuguucagacugccaugagacucauuauguaguucaagcuggccuuaaacucauggcacuccuuccuccaaguccuaagcaugggguuuucaggcgugugucacccugcccagcccugcccaguauagcacaagacauuuuucugagugcaagaucccuaagggugaacaaucacaggaucgagguggcaccuguguucacacaugugccuguccccaccgugagccugaugcucagggcgagccagcuacgcuucauuuucagacuuuccgugccagggacgccgguuguauaauugcccaacuuaauuacagguugcucaaacucgaaaugauggugagaauaguuacuucugugagcaagaagcugaaugccuuuaaaaaugcacaggcaaguucugacaaaaaaaaaaaaagcuaaucuauguaagcuguccauacaguauuuucaaaagcuagcauccauguucagaauagcagaauagcucuguaaguauguaaccucuuguucaauuuuagagaaaccaaaaaaaauccaaaauuggaaauguagaugagcuccagcauaggcauaaauaaaauagguauugaagucaucacccuaccgcaccccacccgccaagauucugcaucaggugaugagcaucuaacuggcuucaaucuaaauucuucugagacaggucucacauagcccagcuggccuccaauugacauggcagcugacuauccuugcagugcggagauuacagucaggcaccucauguugcuugcacuccucacuuacuuuuucuuucuuucuuuuuuuuucuuuuuuuuuuuuuuuuuuuuuuugagacaggguuucucuguguagcccuggcuguccuggaacucacucuguagaccaggcuggccucgaacucagaaauucgccugccucugccucccaagugcugggauuaaaggugugcgccaccacgccuggcgcacuccacauuuuugagagcucuucugccagucuucugacugagcugccugcucacaucagguuacagggacaccaccucaugccuggaaggcaguauuugcaguuugcaaaggauaagcuuguaagucacguauccuccgaaacacaacaaaacugcagcugcagagcaauuaauuuaaaaccaaugacauuucuuaaucacagcacaaauacauacugaugcauuccauagcauuugugcuaauucgaggccuuugcuuuggggggugugugcauguauguguguguguauauauauauauauauauauauauauauauauauacguauauauauauauacauacauauacauacauacauacacauauauauguauauauacacaagaguuacacagaauaaagcagauuggacacuucaugguugaggcuuggguggugacugaguuggcaaaguaaaugcugugcaacuaugagggccucaguuuagauauccagaacccccaaacugaggguggcaaugugugcccgugauccuagcgcuaaggagauggagaagggagcuccuccagguuuuccuagccgagcuggcaagcuccagguucagcacacacuuguuucaaauaauaaguggagugugacugaggaagacugauguuaaccucuauucucuauucagaugcaugugcacaaaaggcaggcaggcaggcagggagggagggaggaaaggaaaggggggaggcagggaagaagguagggaagcagggaggcaagaaggcugggaaggagggagggagagaggaaggaagggaaagaggcagggaggcaggcuucuccuucagggucaccaugaugcagaagcucuacaugaauaccucugggguccaaagcaccuuaaaaggaccaaauaccuuccacaaagauuacacauuuugggugggcuauccaaauggcagccagagugccacucuaaguaagugcagguccucaguaacuguagccuuaccuucuuuuucuuaucuuuaaauugcuugaucagugugaguacguguuccacaagaaacaugaaauauaagcccccuagagccgucagaccuuuccacguggaaucaaaauaggagcuuucuucuauauucugagccgacagguggcugaacagggggccucuuuucauuuccaucgcuggcucuucauggcuaugacugugcugaugacuugcaugagacugaaagggaaaugauacgcacuuuuaauucgcugguuucuuacgucagcaucugacauaauucagaauuaagcuauuagcugaagacuuuagaauuaaggaggcauugaaaaacuaaagaggacaaugggcagcuagcaacccagagcucagugaaugcuaucugcuaugcacuuaacagggugggucuguuugguguaagggugauacucuccaaacugaacaccauaacuuagaacauuuucaaugucugccaaguuacccuggccaccaugaacagaggcuuaccaugcacaguaucugugacuuacagggcccacuugaaaggcuccuaucagguucaucagaucagccuugugagaagccuaggcagugcacagggauggguccugcaggcaucugagaagcugugcacugcaucugcaggcuguagcaaaauguagcaguaacuagccaaugcuacuugacaggaaacuagugaggugugcagcauccucacaaaggcaugggguaucagcuaugcacaggccacuuccugcagaugguacgccuaaacaccugucauuugguagucagggagacugccacucagaauaguuuucauuuugaauccaacaugagauugccaguguucuagaaaggaauaacuuccucucuaccaaaccaauaaaucucugggcuaguuuuccuuuuucaguauuggauacugaagccagggcuugcuucauuuccagcucuaucaguaaaccacauccucagcccugagaaaaauuaaaaaugggaccccaacacuuccuuucugggacuuaucacgccugguuauugaaauggucauccaggucaugaagaaugaaucucuaaacacacagauucaacucugaaggaaaccccuaaaugucguggguacaugaagaggcguacacauuuucagucugugacaacagguaagcaagcaguucccauuguggcagcugucacagugcuucagguucaagcaggguuucucucuuucagucagucuaaaaagcuuaguccaacuugguagagucaguaacagacacaagcaaaaaagcaaaaacaaagucccuaaacauguacuacaaucgugcaugugaucaaauauacucuacaagcaacuuuucagacuuuccaaccucugauaaauaccaacagcaggagucugagcgcaaugccaaugcucaucuuuucaaugugugaggauaaagcacagcagggaugggccagccacggaacuuacgugugggagaagauguaacagagcaucgccacucagcguuccgacggccagcgccacgaggaagcucagcaggaacuugaaaaauacccgguucaugaguggcaccaagaugacucccagcagagacaggaaacugaugauggaaauggcuaugaagccaccaagccaggcuggcaaaccaaucagagcagaggaaagucauguaacuuauaacccaagaggauucccacgagggcauuaaacaucauguaaagcagagcagcugaauuuggggugguuaggaccacggcacccucauguaauccuguugcagguccagauggagagccucacacacaaauacagagacuucaagaucagggguaaaucuggucuacagagggucucacuaugcagaucaggcuggccuggaacucacagauccaccugucucugcuuccagagugcuggaauuaaagguguguguuucuaugccuaccugcagcagaaaaaaaucuucaaauggggguuaacggaagagaaaaacuuacaaggauaaacugucucuuacuuggggcccaaugacugcuuucauucuuagaacagcuaagcuaugaaacaggagagggaagaaaacaaggaaaaacuaauuuccuuguaaacaaauuuuuaaaaagccuuucuuucuuccucauuauaguguucuuccuccccacucuguuucccuucuuuacuuugagacagucucucucucaguacauuaaagguaccgaaugccucccacaaagauuacacauucuaggcaggcuauccuaauaucagccagaaugcauacauauauaggcuaggcuaguuuugaauucacaauucaccuuccuuagauuccccaaggcuggaauuacagcugcuaacauacaaggcuucauucacuuaaaaauguauuuauugccagaugugguggcacaugccuuuaaucccagcacuugggaggcagaggcaggcggauuucugaguucaaggacagccuggucuacaaagugaguuccaggacagccagggcuauacagaaaaacccugucucaaaaaacaaaacaaacaaaaguauuuauuuuaucuuauguauaguguauaugccugagugugugccugugcaccacauguauucagaagcccucagaggucacagagagcacuggauucccaggaacuggaguuacggaugguugugaggcaccugugggugcuaggaacugaaccagguauuuugcaagaacagucagugcucuugaccagagacaccucuccggugccaacaccuucccccgucccaccccaugccuuuuuaaaagaagcaaacaacuuuuaacauguauauuuagaacauucaggucacagaacaacuaagacauuguaucuagagcgacaaugaaaaauagucugaaauauaaagagaaguacaaccuaagugcaucuacuagaaacuuuuuauggaauugaggcaacuguaccuauuuguaaagaauaggucuuuggagggauuucugccuucuucucacuugcuguaugaaucagacaagcccgagcaucaauuugauugaugauggcugggcagagauaguuaaauuccguugcauucaacagagccuggaugcucaugccaugggaugucagcagcuugguuguauugaaacacugaaggaaaugacagggaaaaaaaaucacagacagaaauucccacuggaagacucuaaaaugcagucugacucaucaccuuuacucacuaaagcuacuuuguugauaaaauuaaugccaguuaaaaucagcucugcuuucagcacuuuggaauuugcuucuaguagccuaaagaagauacacugacacgacgacaguaugucauucuccaagggagaaaaccuccuguggaacaagcuuggggauaaguggagauucacaagccuguuaacucauuguauaaaguuauuaaggaaaugagcuuuaauuucaaaaugggguucauuagagauugagaaauagguuuugggacuaauacucucugaguuggccucaacaagcccaagacacgcugcucuuccugcuaugacacugcuugcaaaaacucagcuccguucugucuacgugccuggcagagugacucucugcaaagagagauuauuaaaugauacagaugacucuuacagagggcaaugcugguuaaugaaacaaaccugccccagcaggcagaugcggucaacagcuuaauuggaccuuaguuugaagagaaacuccucuaugcaaccgguccaaaaaaacaaaagcuuaccugguuaagguaucuauuucucaucuacaaacacauuucagacucucacaauuguucaccaacacuacuugcaacaacuucagagccaguguugccagcguugugacuacugcuacaaugacuccaaacuucacucauaucccagcauagcuacauuuugaucauuaaagacuagcaacuaauacuuucccuguuguuguugcugguuauugaccagcugaagugauuacuguagggcugggaagucucgucuagaaaagucacaugaucugagacucucacuaccugacauucuugguccaauuugcuccagguucaaucacuucccaagucacuguugguuguuucugccaaggagagacacagagcuacucuuguugauuucagcacuuuaacugugcuugucccuacaacuucuucagaucccccacugucuauuuauuaauauuauucauccuuagacaccuucuccacaauuaaccuuagcaucucuccacgguuguaauaagcccuguauuaggaauacucagcaggcagcacugugcuccugcagagcuaguucucaaggauguuuacaacccagcacagcccaguacuauucuucugagcuagucuccaaggauguuuacaacacagucugcauggugagccaacgccuugcugagaaggaagaaaagcucccucuuuuuauaacaaccguuuuauuuuuauuucacacucaccccuaggaggaccaaacaggcgcauuaaauacggcacagaauuuaucuuaccuccugaauauugucauuuguguuucuggaauacauaaagcucuuucugggcucacucacagacucauugcuuuucuuccuagcuagccgacucagccggcccacucggcuuuucuccgugaugcugggugggguagaaggguuuacaucuuuggugcgucucccagguuuuggagucucuauugucucuacaaagcgaguuccuucagagacagcguuguauaccgccgaggucacuucacuagagcuugcacucuccuugauguuccuccuaccauucaugugcucugcugggcgagauccuuucccuagacuaguucuaggauuuuuaccugaauuaucagagucaaggucuggacaaaaggcuuuccgauuguuuuuaccagcaaccgugugacugcggugggaauggugcucgugguccgagugaugcucgugguccgagugaugcucgugguccgagugaugcucgugguccgagugaugcucaugguccgagugaugcucguggucagcaugaugcucguggucaugguguauauggacucuuuuaaucuuaucuaugccuauguucugaagcaauuuucugaagccuucaacagacaaggaaucauucucuccguagcgguagaauagcugcugcagauggugucgcugcaugguaacugccaagucaacauuaacaccagguucccaauuugaauuuauuuucucaguagucugagagaaagcagcuguugauuguaguucaugaagggggcuuguaacccaaagggcaaaggucaagaucaugauuacagauaaaucuguggccauugcaccuuccuagaaaagauagggggggaaaugcuuuaccauauuucuagaacaacugaagaaaccucaugcugaaaacugaugccuaauuacaccacacagcacugcugguucugacuaggauagcaugagguaccauggagacaugggugacugacuacgggcuuguggucuccugaagcagaugcaggacagucacgugcaaagauacaauuaauuaacccugcaaaugcuccgggaggaggaagaggaggaggggaagggaggaagaagaaccaugugcucauagccuugccaucagcuucuuccugagaaccucagcucaaaaccacuucccccccaccaccaccguuuuacaaauagaaaaaguagaaacaauagucucaacuggcaaucugaauuuuuuuuuaaaaaagauuccauuuucuuuagacacacaucaugcuccuuauucccuacauaauuuuaccaaguuuauuguugugugaaucaggucauuuccuaccuaucuucaaacagacaggaacacacacacacacacacacacacacacaagagagaucuccgcacccccauucagcacugaaucagacuugauuuuguggcagugcaucugauuucccaauucuucugaauaacugcauaauaguucucugaacaaguaaauuaagcuucuugaaaacacauagcauuguucuucaguugcuacauauuagcuagagaauguucucucagauaaaguucagaacucaaggccugaccucacuccuuuucagguggaacuggaaaagcagaaauuagugcagcagaagcacuauaguacaguacagucagauuuuuggauggauuuucaacacgucucuaguaaaagauacugagggauuuuugaacuauacaggggcacugggaaacagacuaccauauuccaagcuguuucuuggcacagucucacauucaugaccucaucugaaaagccgguaauaucuauuugcaaggaugaauucagaguggaagugcuuguuaaacuccucuguugcccaagugcugauuaucauacuaggcgcacagguaaacggaggcacacaaaaccauauaggaccagaauccugccaauuaucuuuggggccucacauggugggaauucacgugauaggcaaaaagauucaugaaaaaaaaaaaucauccccagggggagaagaggcgagucaccagauggguggggcagaucuggccuugagccaggguaagaugcugagggcuggagaccggucccuggaucuccucacaggcugagucucucuguauguggaagaaacaagcaagccagaagaagaggccuugaaaaaggagguaguggagaaaacggaaaagcgcacaaugcuugcuuuaugagggcuucuguaaugaaacauguuaguaagcucccuugaaggugaaaaguuaaaccaucgcagaaaguuccuaguuugaggcucccaaaccuauauggggccccuaaguugggaggggcagcuaucccgggcuaguggggcgugaggcggggcccucgaagcaucccuucuccgucgcccggcuuggucccagcaccccgucuccguggauccgggccugcgggggcucuguccugccgccccgcugcggucuugcggaacucaccucuccuggugucccgccgcccggccccgcgcgcagguucgguuccccgcgggagguccgaagggacugggaacccgcgcagcuccggucuccgagaagccuuuacgaggcguggagcagcggcagaaucaugagcccggccaccccucgggcccgggguugccgcgccuccuccaagcaggacaaucgguaauuaccgccgccucccgcuucuagcaccguggcgcacgcgcagugcagccccggagcccggucugccaagaccgauccgcuuuuccgcguguucucagacgccacgggcucgccgcgauggaggggcgggcgcgaguccuuuccucgagcccuuccgcuccacgccaggacuucagcccagucugguccgcuguaggcagccgggcccgauggaaccgucugggaccacgagcuccuucgagagugcccugccuacagcggucaggccuggcucacgcgcggagcagcggucagagugaugcgcgaggcgagcgaaggcuaccgaagagaaccacgccagcagacggg

SEQ ID NO: 8842 - RNA, 23947 nt, Mus musculus
cccgucugcuggcgugguucucuucgguagccuucgcucgccucgcgcaucacucugaccgcugcuccgcgcgugagccaggccugaccgcuguaggcagggcacucucgaaggagcucguggucccagacgguuccaucgggcccggcugccuacagcggaccagacugggcugaaguccuggcguggagcggaagggcucgaggaaaggacucgcgcccgccccuccaucgcggcgagcccguggcgucugagaacacgcggaaaagcggaucggucuuggcagaccgggcuccggggcugcacugcgcgugcgccacggugcuagaagcgggaggcggcgguaauuaccgauuguccugcuuggaggaggcgcggcaaccccgggcccgagggguggccgggcucaugauucugccgcugcuccacgccucguaaaggcuucucggagaccggagcugcgcggguucccagucccuucggaccucccgcggggaaccgaaccugcgcgcggggccgggcggcgggacaccaggagaggugaguuccgcaagaccgcagcggggcggcaggacagagcccccgcaggcccggauccacggagacggggugcugggaccaagccgggcgacggagaagggaugcuucgagggccccgccucacgccccacuagcccgggauagcugccccucccaacuuaggggccccauauagguuugggagccucaaacuaggaacuuucugcgaugguuuaacuuuucaccuucaagggagcuuacuaacauguuucauuacagaagcccucauaaagcaagcauugugcgcuuuuccguuuucuccacuaccuccuuuuucaaggccucuucuucuggcuugcuuguuucuuccacauacagagagacucagccugugaggagauccagggaccggucuccagcccucagcaucuuacccuggcucaaggccagaucugccccacccaucuggugacucgccucuucucccccuggggaugauuuuuuuuuuucaugaaucuuuuugccuaucacgugaauucccaccaugugaggccccaaagauaauuggcaggauucugguccuauaugguuuugugugccuccguuuaccugugcgccuaguaugauaaucagcacuugggcaacagaggaguuuaacaagcacuuccacucugaauucauccuugcaaauagauauuaccggcuuuucagaugaggucaugaaugugagacugugccaagaaacagcuuggaauaugguagucuguuucccagugccccuguauaguucaaaaaucccucaguaucuuuuacuagagacguguugaaaauccauccaaaaaucugacuguacuguacuauagugcuucugcugcacuaauuucugcuuuuccaguuccaccugaaaaggagugaggucaggccuugaguucugaacuuuaucugagagaacauucucuagcuaauauguagcaacugaagaacaaugcuauguguuuucaagaagcuuaauuuacuuguucagagaacuauuaugcaguuauucagaagaauugggaaaucagaugcacugccacaaaaucaagucugauucagugcugaaugggggugcggagaucucucuuguguguguguguguguguguguguguguuccugucuguuugaagauagguaggaaaugaccugauucacacaacaauaaacuugguaaaauuauguagggaauaaggagcaugaugugugucuaaagaaaauggaaucuuuuuuaaaaaaaaauucagauugccaguugagacuauuguuucuacuuuuucuauuuguaaaacggugguggugggggggaagugguuuugagcugagguucucaggaagaagcugauggcaaggcuaugagcacaugguucuucuuccucccuuccccuccuccucuuccuccucccggagcauuugcaggguuaauuaauuguaucuuugcacgugacuguccugcaucugcuucaggagaccacaagcccguagucagucacccaugucuccaugguaccucaugcuauccuagucagaaccagcagugcugugugguguaauuaggcaucaguuuucagcaugagguuucuucaguuguucuagaaauaugguaaagcauuucccccccuaucuuuucuaggaaggugcaauggccacagauuuaucuguaaucaugaucuugaccuuugcccuuuggguuacaagcccccuucaugaacuacaaucaacagcugcuuucucucagacuacugagaaaauaaauucaaauugggaaccugguguuaauguugacuuggcaguuaccaugcagcgacaccaucugcagcagcuauucuaccgcuacggagagaaugauuccuugucuguugaaggcuucagaaaauugcuucagaacauaggcauagauaagauuaaaagaguccauauacaccaugaccacgagcaucaugcugaccacgagcaucacucggaccaugagcaucacucggaccacgagcaucacucggaccacgagcaucacucggaccacgagcaucacucggaccacgagcaccauucccaccgcagucacacgguugcugguaaaaacaaucggaaagccuuuuguccagaccuugacucugauaauucagguaaaaauccuagaacuagucuagggaaaggaucucgcccagcagagcacaugaaugguaggaggaacaucaaggagagugcaagcucuagugaagugaccucggcgguauacaacgcugucucugaaggaacucgcuuuguagagacaauagagacuccaaaaccugggagacgcaccaaagauguaaacccuucuaccccacccagcaucacggagaaaagccgagugggccggcugagucggcuagcuaggaagaaaagcaaugagucugugagugagcccagaaagagcuuuauguauuccagaaacacaaaugacaauauucaggagguaagauaaauucugugccguauuuaaugcgccuguuugguccuccuaggggugagugugaaauaaaaauaaaacgguuguuauaaaaagagggagcuuuucuuccuucucagcaaggcguuggcucaccaugcagacuguguuguaaacauccuuggagacuagcucagaagaauaguacugggcugugcuggguuguaaacauccuugagaacuagcucugcaggagcacagugcugccugcugaguauuccuaauacagggcuuauuacaaccguggagagaugcuaagguuaauuguggagaaggugucuaaggaugaauaauauuaauaaauagacagugggggaucugaagaaguuguagggacaagcacaguuaaagugcugaaaucaacaagaguagcucugugucucuccuuggcagaaacaaccaacagugacuugggaagugauugaaccuggagcaaauuggaccaagaaugucagguagugagagucucagaucaugugacuuuucuagacgagacuucccagcccuacaguaaucacuucagcuggucaauaaccagcaacaacaacagggaaaguauuaguugcuagucuuuaaugaucaaaauguagcuaugcugggauaugagugaaguuuggagucauuguagcaguagucacaacgcuggcaacacuggcucugaaguuguugcaaguaguguuggugaacaauugugagagucugaaauguguuuguagaugagaaauagauaccuuaaccagguaagcuuuuguuuuuuuggaccgguugcauagaggaguuucucuucaaacuaagguccaauuaagcuguugaccgcaucugccugcuggggcagguuuguuucauuaaccagcauugcccucuguaagagucaucuguaucauuuaauaaucucucuuugcagagagucacucugccaggcacguagacagaacggagcugaguuuuugcaagcagugucauagcaggaagagcagcgugucuugggcuuguugaggccaacucagagaguauuagucccaaaaccuauuucucaaucucuaaugaaccccauuuugaaauuaaagcucauuuccuuaauaacuuuauacaaugaguuaacaggcuugugaaucuccacuuauccccaagcuuguuccacaggagguuuucucccuuggagaaugacauacugucgucgugucaguguaucuucuuuaggcuacuagaagcaaauuccaaagugcugaaagcagagcugauuuuaacuggcauuaauuuuaucaacaaaguagcuuuagugaguaaaggugaugagucagacugcauuuuagagucuuccagugggaauuucugucugugauuuuuuuucccugucauuuccuucaguguuucaauacaaccaagcugcugacaucccauggcaugagcauccaggcucuguugaaugcaacggaauuuaacuaucucugcccagccaucaucaaucaaauugaugcucgggcuugucugauucauacagcaagugagaagaaggcagaaaucccuccaaagaccuauucuuuacaaauagguacaguugccucaauuccauaaaaaguuucuaguagaugcacuuagguuguacuucucuuuauauuucagacuauuuuucauugucgcucuagauacaaugucuuaguuguucugugaccugaauguucuaaauauacauguuaaaaguuguuugcuucuuuuaaaaaggcauggggugggacgggggaagguguuggcaccggagaggugucucuggucaagagcacugacuguucuugcaaaauaccugguucaguuccuagcacccacaggugccucacaaccauccguaacuccaguuccugggaauccagugcucucugugaccucugagggcuucugaauacauguggugcacaggcacacacucaggcauauacacuauacauaagauaaaauaaauacuuuuguuuguuuuguuuuuugagacaggguuuuucuguauagcccuggcuguccuggaacucacuuuguagaccaggcuguccuugaacucagaaauccgccugccucugccucccaagugcugggauuaaaggcaugugccaccacaucuggcaauaaauacauuuuuaagugaaugaagccuuguauguuagcagcuguaauuccagccuuggggaaucuaaggaaggugaauugugaauucaaaacuagccuagccuauauauguaugcauucuggcugauauuaggauagccugccuagaauguguaaucuuugugggaggcauucgguaccuuuaauguacugagagagagacugucucaaaguaaagaagggaaacagaguggggaggaagaacacuauaaugaggaagaaagaaaggcuuuuuaaaaauuuguuuacaaggaaauuaguuuuuccuuguuuucuucccucuccuguuucauagcuuagcuguucuaagaaugaaagcagucauugggccccaaguaagagacaguuuauccuuguaaguuuuucucuuccguuaacccccauuugaagauuuuuuucugcugcagguaggcauagaaacacacaccuuuaauuccagcacucuggaagcagagacagguggaucugugaguuccaggccagccugaucugcauagugagacccucuguagaccagauuuaccccugaucuugaagucucuguauuugugugugaggcucuccaucuggaccugcaacaggauuacaugagggugccgugguccuaaccaccccaaauucagcugcucugcuuuacaugauguuuaaugcccucgugggaauccucuuggguuauaaguuacaugacuuuccucugcucugauugguuugccagccuggcuugguggcuucauagccauuuccaucaucaguuuccugucucugcugggagucaucuuggugccacucaugaaccggguauuuuucaaguuccugcugagcuuccucguggcgcuggccgucggaacgcugaguggcgaugcucuguuacaucuucucccacacguaaguuccguggcuggcccaucccugcugugcuuuauccucacacauugaaaagaugagcauuggcauugcgcucagacuccugcuguugguauuuaucagagguuggaaagucugaaaaguugcuuguagaguauauuugaucacaugcacgauuguaguacauguuuagggacuuuguuuuugcuuuuuugcuugugucuguuacugacucuaccaaguuggacuaagcuuuuuagacugacugaaagagagaaacccugcuugaaccugaagcacugugacagcugccacaaugggaacugcuugcuuaccuguugucacagacugaaaauguguacgccucuucauguacccacgacauuuagggguuuccuucagaguugaaucuguguguuuagagauucauucuucaugaccuggaugaccauuucaauaaccaggcgugauaagucccagaaaggaaguguuggggucccauuuuuaauuuuucucagggcugaggaugugguuuacugauagagcuggaaaugaagcaagcccuggcuucaguauccaauacugaaaaaggaaaacuagcccagagauuuauugguuugguagagaggaaguuauuccuuucuagaacacuggcaaucucauguuggauucaaaaugaaaacuauucugaguggcagucucccugacuaccaaaugacagguguuuaggcguaccaucugcaggaaguggccugugcauagcugauaccccaugccuuugugaggaugcugcacaccucacuaguuuccugucaaguagcauuggcuaguuacugcuacauuuugcuacagccugcagaugcagugcacagcuucucagaugccugcaggacccaucccugugcacugccuaggcuucucacaaggcugaucugaugaaccugauaggagccuuucaagugggcccuguaagucacagauacugugcaugguaagccucuguucaugguggccaggguaacuuggcagacauugaaaauguucuaaguuaugguguucaguuuggagaguaucacccuuacaccaaacagacccacccuguuaagugcauagcagauagcauucacugagcucuggguugcuagcugcccauuguccucuuuaguuuuucaaugccuccuuaauucuaaagucuucagcuaauagcuuaauucugaauuaugucagaugcugacguaagaaaccagcgaauuaaaagugcguaucauuucccuuucagucucaugcaagucaucagcacagucauagccaugaagagccagcgauggaaaugaaaagaggcccccuguucagccaccugucggcucagaauauagaagaaagcuccuauuuugauuccacguggaaaggucugacggcucuagggggcuuauauuucauguuucuuguggaacacguacucacacugaucaagcaauuuaaagauaagaaaaagaagguaaggcuacaguuacugaggaccugcacuuacuuagaguggcacucuggcugccauuuggauagcccacccaaaauguguaaucuuuguggaagguauuugguccuuuuaaggugcuuuggaccccagagguauucauguagagcuucugcaucauggugacccugaaggagaagccugccucccugccucuuucccuuccuuccucucucccucccuccuucccagccuucuugccucccugcuucccuaccuucuucccugccuccccccuuuccuuuccucccucccucccugccugccugccugccuuuugugcacaugcaucugaauagagaauagagguuaacaucagucuuccucagucacacuccacuuauuauuugaaacaagugugugcugaaccuggagcuugccagcucggcuaggaaaaccuggaggagcucccuucuccaucuccuuagcgcuaggaucacgggcacacauugccacccucaguuuggggguucuggauaucuaaacugaggcccucauaguugcacagcauuuacuuugccaacucagucaccacccaagccucaaccaugaaguguccaaucugcuuuauucuguguaacucuuguguauauauacauauauauguguauguauguauguauauguauguauauauauauauacguauauauauauauauauauauauauauauauauauacacacacacauacaugcacacaccccccaaagcaaaggccucgaauuagcacaaaugcuauggaaugcaucaguauguauuugugcugugauuaagaaaugucauugguuuuaaauuaauugcucugcagcugcaguuuuguuguguuucggaggauacgugacuuacaagcuuauccuuugcaaacugcaaauacugccuuccaggcaugagguggugucccuguaaccugaugugagcaggcagcucagucagaagacuggcagaagagcucucaaaaauguggagugcgccaggcgugguggcgcacaccuuuaaucccagcacuugggaggcagaggcaggcgaauuucugaguucgaggccagccuggucuacagagugaguuccaggacagccagggcuacacagagaaacccugucucaaaaaaaaaaaaaaaaaaaaaaagaaaaaaaaagaaagaaagaaaaaguaagugaggagugcaagcaacaugaggugccugacuguaaucuccgcacugcaaggauagucagcugccaugucaauuggaggccagcugggcuaugugagaccugucucagaagaauuuagauugaagccaguuagaugcucaucaccugaugcagaaucuuggcggguggggugcgguagggugaugacuucaauaccuauuuuauuuaugccuaugcuggagcucaucuacauuuccaauuuuggauuuuuuuugguuucucuaaaauugaacaagagguuacauacuuacagagcuauucugcuauucugaacauggaugcuagcuuuugaaaauacuguauggacagcuuacauagauuagcuuuuuuuuuuuuugucagaacuugccugugcauuuuuaaaggcauucagcuucuugcucacagaaguaacuauucucaccaucauuucgaguuugagcaaccuguaauuaaguugggcaauuauacaaccggcgucccuggcacggaaagucugaaaaugaagcguagcuggcucgcccugagcaucaggcucacgguggggacaggcacaugugugaacacaggugccaccucgauccugugauuguucacccuuagggaucuugcacucagaaaaaugucuugugcuauacugggcagggcugggcagggugacacacgccugaaaaccccaugcuuaggacuuggaggaaggagugccaugaguuuaaggccagcuugaacuacauaaugagucucauggcagucugaacaauauagggaggcucuuguuucagaaaaaaaaaaaaagauuaaaaaaauuacccauuacaaaugugagcccucuguuuaauggcccugugaugagaggaaaguaaguaaaaauaacuugcuccugagcugggcaugaugucacaugccugugcucuuagcaccuggaagaugcaggcguaaagauuaagaucuuagggucaucaucugcauagcaaguuugaagccagccugggcuaugugggucucaaggggcaacacaaagaauagcuucuugcuuuuuccuuuuuuuuuuuaaagcuugggccaccaccacccagcuggacucuuucauuauuuauuuuauguaagugcacuguagcugucuucagacacucgagaagagggcaucagauuuuguuacggaugguugugagccaccaugugguugcugggauuugaacuugggaccuuuggaagaguagucggcgcucuuaaccacugagccaucucaccagccugcuuuuucuuuaauuuuuaaaauauuuaguuuauuuuauucuaguauguguaugaaugcuuugccugcauauauguguauauaccaugugugugcuugaugccagugaaaaucagaagaaggcaucagauuccccccggucuagaguuacagguggcugugagcuaccauauagaugcugggaguggaacccagguucucuacaaggguaaaaugcuuuuaaccaccgagccaacucuccagcucagccacuuuauuuuaauguccaaaaucagguuccauguggcuguuuucauugcuauacuaagacugguuugaagacauccuuuuuauacauauauauccuuuagaauuauucuuagcuuuaaaaauaagcucauggggcuagagagcauauaaugaguauaugcugucuuaaagaagacucagguuuguuuuccagcaucuauguggggcagcuuccagcccccuguaacuacagcuccagggaaucuuacacccucuucuggugugugcaagcaccugcacucauguacacauaccugcacauauacacauaacuagagaaaguaaaaauaagaauauuuuaaaauuuguucauuuuuacauagggaauacuugaaauuugguuugugagguuuugguuaauuuuuacugugcuuauuuauuuguuuauuuacuuuuuuuuuuugagacaauuucuuuguguagccccuggcugucuacucucucuguagaccaggcuguccuugaacucaagagauuugccugcuucugccuccugagugcuaagaauaaaggcguguguuaccacugcaugacugugggguuuuuuguuuuucuuuuuccaaauguccaaaaccauaguuuguuaauaucuuuauuucaguuaguuucaguuuuauaauuauguuuauguggaggagucacaugaaggccaggacacacacagaggaaagaggacagcuugcuguagccauacaccacacgggucccagggagacagcgcagguccucaggcuuggcagaaagugucuuucccacugugcuuucucaacaacccuaguuuuaaguuuuuaccuaaaucuuaccuaacccuccuuuaaccugguacucuauaccucgagauucuaaaaggcaggcuguuaugugaaauauagcaguuuauuuucuaacuauaggucucuagugaacuaugaaccguguguugugccaguaucuuuaagugcagcaguaaugugaucuucauacugcgguggauugccacagggaagcugaguaucucuauuuuaagacauccaguagaauguaauauaagcauugaagauccagggcgucuguucagugcaguucccucuguccauguugugucuggcacauagcaggugaugauaaaugcguauggaacagaggaaacaugaaacacauggaccagcagaaacuacuccagauagccuucaccacgcuuuggaaacauuagcuguucuguucccagguuaggauucaauguuggguuuauuuuuuuuuuaagagcauucaggucuucauauuacaucucaauuucuuuucucccucacaaagauaaauaaaguuaaaaaaaaaaguucaguauauaccauggcugccagaggcuggugaauccuuaucauaagagggacuuuuccuugagcagguguagugguaguguggagucugcauuccagugugaguuacugcucauaugcucagucuguguauuuacagcacuucgacgucacuuauccuuccaaccagugaaaguuccagcucucgcugggaaccagaucauugugacauccaccaucccacucuagaucagccagggcacauuaaauauguccacagucuuucugucccccuccacgcaaccauuuuugaugcuguuguaguccaggcuuaguuagcucccucucugaguagaacagucaccuccuaaccagccuguucacaucauuuccauucuuccuuugagcaggcagcgcucuacagcucugcucaguccuccagugacuucccauugcuuucuagacagagagcauucccagcaugcucuguguuaccuggcuuccuucagcugcagcuuccacucuugaacuaacccaccaccuuuaccguggagagaggucucucaggcuaucaggaguuccuuuuagcucuagaagagagcuagaucuuugcuauugagggcccucccucauacuuaaaaaacucccuagauccugccucuccauccuuuacuccagaguccggcucacccuuauguuucgguuuuacugcugcauuuuuaaagagccuguccugaaaguccuccagguccuauguuuuauacucuaauaguacccugugguuuucuuucauauaauguaucaaugauuacaagcagagaauuguguaagccucauccguagugaggcuccagcccucugaguaacagcugcacgguagcggcgguagugacuaggugugucuugcucauguaaauaaauguaaugcaaauaauauaguuugugaucauuucuauaauuagaauauugucuuccacauaaguagauaaugcuaaggcucguuuguucugugggaccucugcaacauaaauguugcucagacucacacagggagccuuaacccuuggaguggucacaaaacucaguaauagucaguuccugaggcccacacccaaucccaggacacagagagggugagauaaacagagggcugugcagccuuggcuacugauggaguggaucaaagccgggguggagccaaggcagugguggugcaggccucuaaucccagcaccugggaggcagaggcaggcagauuucugaguucaaggccagccuggucuacaaagugaguuccaggacagccagggcuacacagagaagcccugucucaaaaaaccaaaaaaaaaaaacaaaaaaacaaaaaaaaggcuguggugggguggggacguaggggagaaaggaaggaagggagggaggaaagaaauucugauggaaugcucaugguagaccgcuugccuaacaugcaugaagaccugaguucucucccagucaccacacaaaaauguacaagaaaggaagaugguuuuuaagaaagauuaagauuuuauuuuaaacugauaauuucaaggcuaaauaauaaauaguugaaagugaaacacgaggaguggagagauggcccaguggugaagagcacuuguugcuccuacaggacugguccuuaaguuucagagcccauggcaggcagcuccagugcccuuaccuggcccucugggcauacauauauacagacacauaaaugaaaacuaaaccuuuuuuuaaaauguuauugguguuuuacuagggauaaguacuugagucugcauaacaaaaauguaugaaaaauguggguuucagugucuaagaaguggcccagagguaagcaagccugaaggagauggcuguaacuggcccucguguguaacagguuguuuuuguggguuuuagcguauggaugagucacccuaggaucuaauuaaaguccgcacucugcagcauugccaggacucguguguuucuaacccuuaccacaugaguccauaccacaguagcuggagcaaggcuacacaggaagauaacugugguuagucugacuugggguccuuugccuuuuugacagcuguuauggccgaaagcccacacugugccaaacaaagaaguagaggcacugucccuggauggcuuuuauuucaguagagguugccuuuucugugucuuuugcuuaccuggguuuugauugguuguggugcucaggcuugggacccaaggucccaccuauguuaggcaagugcgcuagcucugaaccacagacccagcuguauugaaagcuguccacagacgcaaaucaacuauuucaaaaagcugguuuugcuggcuguuucagaaucaaaagaaaccugaaaaugaugaggauguggagagcaagaagcagcuguccaaauacgacucucagcuuuccucaaaugaagagaagguggacccaggggaacguaagucucucaagacucagacuggaugacacugggauacaggcaccagggaccauuugggagagauggggcuagaccuuucauuuguuuccuacaguaucucauuuuaaaaauucucuuucaagugcucagaugaggaucuguagcaugugcugggagccuccugagaggcaggaucgagugucuaaggaguggcuuaccccagaaggcaguucucugcagguguuggcugugaccaaagaauaugggucaauaugucuaaggccuuccuccacaccucucauugagucauggggaacugccacaggaaaucacugcuggaggguuccuguguaauuaucugugaugaauucuuucccuggggaaauagaaacagaugguugcucuccccaccugcccaggacaaggcaucagugacaaaccuaaauauugauuucaccagagccucacuuggagaaucaaugagcuucuaauaguagcagggcagccccaaggcagccauaccacccacaagucucagccaguauagacgaugaacuccccauagcugcauagauggagucucccuucuguucaccuucuacccuccacuuacuccaccagguacagaucuuaaggcuagagccaguuagggcagaguaacauaccuggcuggcuggcauaucaggugagaggucaccacacucugcugccuccugcugugagggacugucagcuaucaaggagcucaaucuugagggucuuagcuuaaagccacaguguguguuccuggagcuaugccuccaggacuuuggcgugaaccucgggacacuaugcuaugcucucacuuccuucuaagugaggucgugugagaccaaggugagugcugcuuuguaucaccuugaguucugggaaaaucuuaaugguacuuccuucccgaaguuacacacagacaagcaaacuuccucuuagcugacggaagagacuuguguuucuuugcuuucuacucacugagggucacaguuuuaagaauaguuuuagaauuuuucacaaauucauacucuuaccauuagagucaacuuaaacuuguugaaggcguccccauguccccagggccugugagacagaagcuucagccaggccuggggucacaggccuauaauccaagcauugggaucucuacacaggaggauugggaagugaggccugggcuacagagcaaaacuauaaacaagugaucagaauaucuagcacaggguaggagcucaacagauagcuaccgccuacggacgggaaccugcugcugucaguaaguccccugcauuuucuaauguuauguacuggcuggcugugugggugucaacuugacacagcuggacuuaucacagagaaaggagccucccuugaggaaaugccuccaugagauccagcuguaaggcauuuucucaauuagugaugggggugggugguuggcauuguagguggugccaucccagggcugguggucuuggguucuguaagaaagcaagcugagcaagccaggggaagcaagccagugagcagcaucccuccauagccucugcaucagcuccugccuccaaguuccugcccugugugaguuccuguccugacuuccuuaaacagcaauguggaagcugaauaaaccucucuuccccaauugcuucuuggucaugauguuuuguccaggaauacaaacccugacuaaggcaugcugcuuuucucuaaauagcaaauaaaacauguugacuguucguucuguaacugguccuucuucagcauucugaaugguuuucagugacauuuguaaggauaggaccagcaggucagggaugcuccccagaaaacugguaacagugugcaggacaaagggcagccuuacuguuccagucuccuuuucuuuguccaagcagacaaucuauguggaccauggacaggagccacaagcccagccaauaaauguuucuuagugaugaugaugauaaaguaauuaagauuauuuugcuguuacuguuuuccuucaauuuagccauccaaugaacaggaagucagcugauagggcuacacuuuuuuuuuguuuguuguuuauugcugugacaggguuucucuguauagaccuagcuguccuggaacuugcucuguagaccaggcuggcuuccaguucacagagauccaccugccucugccucccaagugcugagauuaaaggcgugcgcuaccacagcacaccaugauuuuuuuuuuuaaugagaagaaaaacucaucuuuucaaauacaaggagguaaaagaucuuaagggauaaucagaagggcaguuguggaagacuaauauuccaaauucuuucauucaaaggaugcaguucaauugguagcucuugccuagcgugcauugaugccuggguuccauucucagcaccacaaaaaacaggcuuuaugcaagucuguaaucacggcauuugagaaguggugacgccgggcagugguggcgcaugccuuuaaucccagcacuugggaggcagaggcaggcggauuucugaguucaaagccaaccuggucuacagagugaguuccaggacagccagggcuauacagaggaaacccugccuugaaaaaccaaaaagaaagaagaaaaaaaaagagagagagagagagauaaguagugacaucaggaguuuaaagacagccucugcuacauaacaauccaaaggcuaaccugggcuauguugacccugucucacaaaaucaaaauaagcucugagccuggguguugguggcaccagauggacccuugucuucccaagcuugggccacuccuguacugagccuucuggucuucucuuccaccaagagcugggccugcccugugacugugcuccucagaggaguggcuuugucgagacuaaaaauguuaauguucccagcuuuaaaaucauacaggagcaaaggggagcuuucaacuguguuuaccauacacaucccucccuggugaaccagaaggacuguguggaagucacugucacagcucccaggaaggucacuuagguacugcagaaauucuggaacauggaauucuguguuuuauguacugacugcagaauuuggauuuaucaagaugagauuccucaucucucacuuuuuacuuuaugacaguuacaagucugacuggcugacaaguaagaacagagaauagcauguaugacauuggcugaauuucaaauggacuguggauaauuaugauagaacuugguuuuucaguuccaauuuguggaaguccuguucuaucacuguuacuagugaucacaacgguuuuagacuugugugauuggacagaaaugucagagaaagugaauaaacaacaacaacaaaaaaaaaaaccacuaguuuuuuaccacuuugagaacagucauauucuaaugauuuuuaaaccaacauguauuacaauucugaaauuuuuacuguaauuuaaaaaaugagucauuaauuggcuggagagugagcacaguaguuaagagcacugguugcucuuccagaaaauccagguucaauucucagcacccacauggcagcuuacaacugucugugacuccuguuccaggggcucugacacccucacacagacaaacaugcaggcuaaacaacagugcauguaaaguaaaugaauaaauaagucuuuaaaaaaaaaaaaacaagagucauuaauaaacuaacugggacaaaagagagggacuaagaggaaguaggacgagugaggcggauggcucagugcaggcgggugcuggguguucagccugcuuaccugaguucaguugggacuccacucauggcagggaagacaaccccaagcgguugucuccuggccuccacacaugugcugucgccacgugccaauccugcgcacaccaaaugaauacguguaauuaaaaauuaaacuuaaaaauaaacccuucaaucuuauaaaauagguucuagcuaucacuguguugccaggacuggucuuggaguucugagcucacguaacccucccucggcuucuuccgugcuacaguucugcacuugaaacccauucuuaaaacaugauauauuucacauuugaagaagucacuagagccuguugccauuccucaucaacagugcucugcugcucaguccugaugauugacuggucagcagugggaacaucugggcuguguucaggaacaccaacagauguucauuuggucucaguguucucugcauuuaucccuaggaccugaaagcuaucugcgagccgacucccaagagcccucccccuuugauucccagcagccgacgauguuggaagaggaagaggucaugauagcccaugcacacccacaagaagucuacaaugaauaugugcccaggggcugcaagaacaagugccauucacacuuccacgauacgcugggccaguccgacgaccucauccaccaccaucacgacuaccaucacauucugcaccaccaccaccaccagaaccaccacccucacagccacagccagcgcuacucucgagaggagcugaaggacgccggcauugccacauuggccuggauggugaucaugggcgacgggcugcacaauuucagugacggccuugcuauugguaugccgcugcauagcugccccuugcuguuagccuggaaauguuacauuaaauguucucucaaauuuaacaaaaaguaggugccaaaaugagcaaaauacuuuuuuuugucugcuuucuaauaaugaagugcucaggaaauaugggcuacagaucagccucagaucugcgccugucuguuaccuaaguuguacuuuaggcuguggcucuagcucagugguagaccacuuacaugguguccguaagcccugggugcgagcccuugcaucaaacacacaaagguuguucuucauccaggaguucuuaagaucaggguuuaaacaggagugguaguucucgccuagcaugcaugagugccuguguuccagaccccuaaugugaaagcccuuucccugccggaggacagaaaggcagugcugcuuuucagccaggcccacugggcccacugcuuaggcugaugugaugggaggaaugucccaugcacggcugguagaugauuggucagcagacuuagcuuuuugaaugggaggggcucugucuugcugcucacauaaaagcauguguguccacaagucugguggcaucaugaauuccccugaggccagugaaguacuuccgacugcagagggcuuucagcugauggaauuuacauucucagcucaggguucuguaugguagcagucccuucucagauuuguagauguaggcucauugcuagucaacugaaccuuucccuccuguugcguaugccuuugcuuccuaugggcaucuaggcccagugagaugggcucugagaccaggcugaccuagaauucacaaagauaccccugccucuucuuccuggguacuauaacuaaauguacaaccaugcccagcuuguuuuuuuuuaaguaagaaggugaaggcugagcuaggaagaugguguuuaugcacaauguaauguccuuguuuucccgucguuucuguguagcguguacugugcuuucggggccucagacucacccuugcugacuuuguuuacacaggugcugccuucaccgaggguuuguccagugggcuaagcaccucugucgcuguguucugucaugaacugccucaugaacuagguaagagaagcaugugggcagcuucugcugugggacugaaccaugcugcugucgcugguggcugcuucauagccaaggccugccuucccagccucugcucaccaaacugcccuucuuucucgcuggacaagaaugcauaauaccuguguauuauaccuguguccagcuacagcugggucccuucuguagucguccuuucuguguuggcacacuggggacaugaguggcugggcuccuacaagugcacgugcaugaccgucaucccaccacuuggguggcaaagcagaaggaucaggaguugacagucauccucauccacauaguuugaggcuagccugggcuaagugagacccugcuucccaacucccaacucccaauucccaaacccaaagacaccagaacuacagcaugcaugggaaugcgucuuaaauuacacaggaaguuaggaaggaggcuguagcuuguauaguaguagcuccaugggugugcacuugcccagacugcauggcaaccucgauuuagccccagcaccaccuaaaagacaggagugggucaacacucaguagguaagagcacuggcugugccagcccgaggaccugaguucaaaucccagcauucuguguucccggagccccagcgcuuuggaggauggagacuggagggucagugggcuuacugacugccaggcuagcucagaguucgggaagggacugccucggaggguagagugggaaugacagcaggaagucuuggagcugaaggaaagggguuggugaguggcacuucucacuucacuacaaugugaaaccuuccuccaucguuuggaucccaguuccuguuucuucucaugggcacacguucauucacaaacacucggacagcuucacuuuugguccuuggcaugcauccugccauucagaaggccucccgucuaccuggcgcaugcucuguaagcccguguuucccuugcuccccauucucaguccuuccugccccgugaggcucuuaacauuuccaucuccaugacucagggcucuuagguguugccuuugucacuugcggccauuccuucaaguccacaccgcccucccuccaucgccaggugguuuauuauuguuucugcuuuaguguuucugagauugggucucauguagcccaggcaagccuuaagcucacuguguaguuaggacaacugaacuguugccccugccugcagcugcagugucaaccccuucuagacagugcaggagugcagcagggcgugugcccucccucccucaccaucacugacacccaggaagccuacagacacugcugcauggaauuaccaagucugugaaacugcuggagccugcgaacgcugcucuagcccuggauaguuucuuucuuuuuauuccccuggaaaaggaucaaacuuuuuuucuauaucugaaaaaucuauuagaugugugucaaaauuaucuucaaugacccugcccucauuuuuuuuguuuguuuguuuucugauaaaggugacuuugcuguuuugcuaaaggcuggcaugacugucaagcaggcugugcucuauaaugcucugucagccauguuggccuaccuuggaauggcaacagggauauucaucgggcauuaugcagaaaauguuucuauguggauauucgcacucacugccggcuuguucauguaugucgcucugguugacaugguaaguuuccaagaagucgagggcauugacuaaauaaacagacuuguaugguaaaaagccauugcagggucuggggaaaggcuuggcuguuaagagcacauccuccucuugcagaggaccaggauuugguucuuagcacccacauccugugauucagccccaugcagcuccaucaccaggaucugacccccucuguaggcaaugcacaagcacaaacccacauucacauaaauacaauucaucauuuuuuuuucuuuuugagacaggguuucucuguguagcccuggcuguccuggaacucacuuuguagaccaggcuggacucuaacucagaaauccaccugccucugccuccccagugcugggauuaaaggcaugugccaccacgcccggcucuaaucuuuuuuuuuuuuuuuaauuaaaaaaaaucauugcaaaaaugguguuaauuccaguggugagacaggauuguggguccagaaggaugguaguuaagacuguaggugcccucugagcucguugucuuuuguugguuucuguuuauacagcuuucuccuacccaagaguuaccaggaaacacaugaaaacuccuccguuuguagaaucaggcccuggauugucuauaaacucacaguaagcccagcccaggccacguguugucagcaggccauacuuaaaaggcccuuuugacaaaguaaaacucccuuguccauuuaacacuccuaaagcaggcuucuuuuuuuuuuuuuuuuuuuuuuuuuuuugguuuuucgagacaggguuucucuuuauagcccuggcuguucuggaacucacuuuguagaccaggcuggccucgaacucagaaauccgccugccucugccucccgagugcugggauuaaaggcgugcgccaccacgcccggcuuaaagcaggcuucuugcuacacuuccauucuaugcagugugagagcugccucugcaucagaagugaacaucagacguaccugcagcagggaagccagcaucaccucucacuguacagugggugaauguuuaccugcuuggaaccauagucgucauuguccuagucagcugcuagacaugcucagugccagggcccuaccagggucagugugcauguagucagucaaguccugggacaaagaccaauacuuuacccagccccaagccacacuguccuucagacucucugguuucucuguucugaaagcuaaacuguugcuucugccucuuucaggugccugagauguugcacaaugaugcuagugaucacggaugcagccguuggggauauuucuuccugcagaaugcugggauacuucucgguuuuggaauuauguuacucauuuccauauuugagcauaaaauuguguuucguauaaauuucuaauuagguucuaaacccuagagcagcuuaaagaaguacuguuguuuguaguuccaguagaugguagaaauacguucauaugcugugauacacagcauuuaaaacuagugaguuuugcaauuuuucuaucaaauuuugccauuuguuaugcuuauaaagucaguuccauuggguaacauaaagguacguuuuaauauuuaaguuauucuguuuuggaaauguaaauucugugugugauccaccaguauuacccagcuguauguuucggcaugccgugucuugucuauucuagagaaaaugucuuuagugcucuucuguguagcuuuagcauuacuucccugcuggaguugggcccuugcucgugcugagaaagaaugggcacaaaacccaagacaccaacaguucacacugagcauagucaggaaauaggaggaaaagagaacucgggaggauugaggagguauauauugcuuugaaaaaucacaagguugguuguaacguugagagggggaaauucuagauguguuuuaaaggggcauguuuaguuccgaguacgugcguggacaucugucaaauuguuauguuccugugaaacaagugaacacucugauacacuucaucugcuuguacaucuguaugauagagaaauguaaauauguuaauccaagcaaugugucacuuggcugagaaaugaggcauuuaaaucuguguguggagaugggccaaaugaguaacuagugugucaccagaagacuugguuuucaccauggucucuuaugccugaaguuaugugaacauucuaguugucuaggcuuccaaguggcaaguauuaaaacuuuagcccaugagaggauguuaagaccuguucugaaaauauuuugacuucuuggauucaaaaagcacuuagcucucuuucucucucagugcuuuaaaaugucauugugaacaacuguccuuugauguaugacacuguagauacauuggggcugucuguagcacugucuggauguuucuuucuuaaaaaauuaaagugucaacucaguggcag

SEQ ID NO: 8843 - RNA, 2408 nt, Mus musculus
gguagaaccaauauuuucaauaagcaggacuaagugacuccaguguuugcuaauagccucacaugauuuagauuuaauuaaguaaucaggaucaacuggaguguuguuuuuaauuaaaauguuacugagggcuugggccuagucagucauuauuuggauugacaguacacacacuuagaaagauugacaagucuccagguaugcauccccauggcccggcauaguugucaguguaguguguauguaccugagauacucaguccaugugaggcauugguagcauguuucuuuuuauauuuuuacuaacacagauauagcaauucugcacucuugguuuugccuuagugcuccauugcggaguacccauagagcugucuucuauauguuacagauuugggcaucauuucagagauuuauagaacgugccuugaaaaugccaagcgcuggccagaacuuuagaccagagcgaacuggugugguuuaaagaaaaaucacagugauuucuuauagcacuuagucaucaaaaacucccacuguaucuauacuagcuggccucauuguucucacagauuuucauaauuacagcuuccauguaauguggugugaacugguuuugaucaaaucauggcaaaauauguggcagccccuuuccccaauagcuauaauuauuaaaaaaacaaaaacaaaaacaaaaccaaaucacugcagguauagaguaccagcacaccgcuucccauaggaaaguucugcacggaccucuguugcaauacccauacugggcaccgugugcauugauggcaagcaggacaguguccuuggcaggcucacuaguucuaaggcaccaauaaguauacuuggcuccuuaguucucauaguaccuuuauuuuaaaggccuuaaaaagcaccuuaugugcuugaccaaggguugauggcaucccucaccacuuacuguuccagugcucauaaauuuucaaggcaguuuuucauaaaaauguguauaaguucaauauuacaucacugaaauguacuggaccaaaaauguuuuauauuuuacagcauuuucaauuuugaaauaaucgcauguacuuuaccaguugacacugaaaaaaaauguagguuagugauaguuaauuuguaaugucuguacugucgccugcucucccccauuucuccuuccaacugagacucuauuugugccuuacagcaaugguucaguauguacaaacccaucaccuacaacacaagccugcucacagaagaguccgacaacuuugugaacaagcuagaccccagcaaaguguucaagagcaagaacaagauuuuaaucccaaaaaagaaagggccuguaccaccugccaguggucagaaagggccugggcccuuaccuccuccuaccucuaagccuaccacaggcucuggaaauccuguccgaaaauaagcauucuaucaccucaguaauauccagacacagauggcccuguggcagcggcauucuccugagagaccaaagccuuaggccuuuguuuccacugucauuagcuaggggcugggacgaucacacugaauucuccucaggaguuccuuccucuguagguugugacaaccucaucuccaaagccaacgaagacuuucagauguaccugagcuuucuuaugucuguacccaauccuuaacuucuuagcaguaauuagagaggucacccucccaaauaaacccaugguuugacucaugaagcaucaguaucgacuaguuaugugaccaucucaguuaaugaaaauugcacaccuucaguugcauucaccacacuucagcuaugcaccugaugguagaguccauauuggacagcacagaaaggggaagguuuuugucacagaaguguuuuggacaacauugcaugugaacacguucauacuguccuucagauacaauaacguaaugccuuaguuucauacgcuuuauguuuugagaaaacauuuucaaagacagucuuguguucuuuacaaccuagaccaggaaugcuuaaaggugugaucccuagacuuagaauugugcaccaaagucacugguaucauguggggauaagaugauuggauuccaguucugaucugcaaaauaagaauuuccaagaaaaauuccaggugucaggguuuucuuuuuaagacaaggucucacuauauaguuuaggcugaccuauagcucacacacccuauauagcuuccugacacacacacacacacccugucacuaacguuuuaauuacagauguacaguaucaugcguaacauuggauuuuuagucaauuuaacaguacuucugaguuugaaacuuucagcuuaagaucucagugguuucaaaccacaaaguuucuuuguaauuggguaaagcacguauaacuuuuuuguuuuuuu

SEQ ID NO: 8844 - RNA, 1903 nt, Mus musculus
uccuuucuuuuuuuuuuuuuucaagagaauuaaaucguuuauugaguacacaugauaauggauacauaagcuucauucccaucuguuauuuuaucugauaccaucauucaauuuugauauugcauagggugugccaacaaccauuuuauaaccaaauugugaccuugcuuggaugacccuuucaauggugaaacucauuaaaaguuacaauaguaacuggcaguuuaaggacaucaagguuuuugaagacaauggcuucuccacccaugcaaccauaaauaaauuccaaauggaacuuggcaccacccugaaggaauucuaacuucacacuguuggggaaguuuaccaagauggcuucagaauagacuaacuuuacacagcacauaaaaaaaaaaagacacauuuauucagcgucaugaucagacuauuacauuuagcaaucaacagcaugggugaaaaaugucuacagucaaaccuuuuguuggaaugcuuuacacuuuccacagaacagaaacuaaaauaaccuguuauacaauuagucacaaauacaggccuggaguuuuugcccacacacaugaguauugucuaaaacaugucuucuuuguagcagcuaggcccugccaccacugggcuuggcugaguucacaaaucuguuguaaccuguagcuucccugucacuucucuggcucuccucuccugcuaagcuauguuuccuggcuguauguaauuagaaccuccugccacugccauagcuacugcugcugcuggaaccgccauagccaccuugguuccgugguuuagcaaaguacuggccuccaccaccauaagggccagagcuccugccuccaaagauuccucccuucaucggcccaaaauuggaagacugauuguuguaauugccaaaaucauuguagcuuccaccaccuccaaaauugcuuccaccgccaaagccgucucugccuccuccguuguuauagcugucauagcugccacucccaccauagccacugcccugguuuccauaacccuguccaccccuuccauagccucugcuuccuccagaguaaccagggccgccuccuccauaaccaccaucauugccaaauccauuauagccauccccacugccaccauauccaccaccaccacggcugccaccaaagccaccacgaccacugaaguucccuccucgaccaaaauugucauugccaccaaaaccgccuccacgaccaccaccaaaguuuccagaaccacugcgaccucucuggcuggaugaagcacuagccaucucuugcuucgacagagccuuucuuacuucacaguuguggccauucacaguaugguauuucugaauaacaaucuuauccacagagucauggucaucaaagguaacaaaagcaaagccccucuuuuucccacugccucugucagucauaauuucuaucacuucaaucuucccauacugcucaaaauaaucucguaggugauguucuucagugucuucuuuaauaccaccaacaaagaucuuuuucacaguuaagugggcaccuggucgcugagaaucuucucuugagacagcucucuuagguuccacaacucuuccauccaccuuguguggucuugcauucauggcagcauccacuucuuccauaguggcauaugugacaaacccaaagccccuggaucucuugguguuuggaucucucauuaccacacagucuguuaguguuccccauugcucaaaauggcuccucagacucucgucgguuguuucgaagcucagcccuccgaugaagagcuuccgcagcuguucuggcuccuugggagacucggacuuagacaugacggcagaguuacgagagccuucagcgaugcuuccucggcagcaucaaagagcagaagc

SEQ ID NO: 8845 - RNA, 2561 nt, Mus musculus
acuauuuaaucaugaagguaaagaaaggggaucuauuuacauaacaaacacuuaagacaaucaagaugggugggguguggucaagucuucccagcccacaucuuuuaacccuguaaaucuucaugguauuguccucaacacagcuugcaaaaugcaaccacucaguccccucuucacucugcucagugacccuacugcagcucuuccagcauaaccuucugauagucaggcugugauucuggcuuggauuuguuucuaccuagaugguccagucauugauuuuuuugauuggucuuguuccaggaguauauacaaaucuucucaguuucuaauccaauugcaacaauguaucauugggcuggguuaagcacagggcagacacugacagcugucacagaacugcccacauccaggauccaggagcagggacggauggggugcucuaugggguuauggcuggacuuacacucgccccagacaaccacccuuuugucucgacguccagugaagaaguacuugcuaucaggacuccagucagucacaugaucaaaugguucuacuaugaacagaaguaauuuuguuggugaaugcaaagagacuuaaaaaaaaaaaaacaaaaaaaaaaaacaaaaaaaacaaaaaaacucccuugaggucauauguuaucucuuccacaaagaccagguucaauuucaaucucuggaaacagccagaaagaacuugccaucaggugagaaugucaucugugugacagucagaguguggaaagcaagacucugcacuuguuuccaagaugccgugcuccaaagaauguuagcugccugcuccuucugagaugucuuucaagcaaaagcaaguagagucuucgaauggauacaggccacacaaacuaucucauagccauguccauacaguuucugaaccucaggccacaggguguucugcagaaggugauccucagugggaaguucauuaaagacauugggcugaaaagucaccuggggagaccggaaggcagggcuuaggagcuuauccuccucaaaggguugagaggucaugucucccugaaagacuuuauuugauagcccuaaugcagggacaguggcucuuucuguaagaucauggucauuacagagcauaugacucaaugacugucacaaaauuccgaggagcagaaaaaacacgaagaacuuucucgucugcuccagacacaagcugaaacugaucaaucaucgccaaacacuugaggcuguaucuauguaucugaggccuugagaucucaugccaagugaccugggauugcuccuucuucuuccauggagcaaaaaggcgaguggucugaucggugcuguaguaaagaugaacucucccucuggaucccacaucaggucuuggacgccaucgaauuguccugaaaugacaaucucugacccaguaccuugaguuuaagguacuguuuccaaaggugcagugcuccguggaaugcaugagugauuaucauggagccauuuucaccaaacuggcaaucauaaaaccccaggguauuucuaccuacuucaccuacucggacuuguucuaaucaaaccccugccucuucauguggagcacagagaauccugguuuuguccauggaggcagacaguagucccacugguuguugcagaacaccaucuuuguaaaaugaaggcugccaaugaacuguguuuaccuaguuuugguguccagccagcacugucuccaggguaaccgcaacaguugcucuaacaccgccaacuuuuauagugaacguguuuuccuucagccuuauacuaccauccuugguuucuaaagaugccgguuucauauacagucuccauauucuuauuaggcaguccugugagcagcuugcuaggaaaaggugucuaccaaagguugcccauuccacgccucuuauccaguccuugugucggcaaagaggaagcgcuuucugaaacugguuauccuguugaauaaauaagugaauucugcagucauccucaugacaugcuaauacuggcacauuaguaccgggcaaaauagacagacagacagaaagaacaaauccacgccugaaguucaaagucugaagacauuugacuucagaccccuuuuuagaccagauucaguagaauuugaagcugcagaagcuaucagugcaugcuacuccccuucggauggcccucucugguaaacagcaugcacagcauaaacagguccuucauggccuuggagacagacugauuuuaaaaccugacuauucucuaguucccaaucaaucacccgauugucagauccuccagacuccggcucaguggaaggggagccauccucucucuguauguauccacugcaggcaguugacucgagcagugugaccauucagauuuguaauaacuuccuuuuucagagggucauagagaacaauggagcaggaugugcugaaagccaggaguccuccaggccaguuauuccaacucaaagcuugccgaacccgguucgggcagcaaaacucaugagaaaccuccagcacagaagaaaccaua

SEQ ID NO: 8846 - RNA, 75382 nt, Mus musculus
caagauggcugguugcauuugcacaugcguacagcagcccgcccaggggcuguuccgucgcguuugcuuucguuaggugcggggauugcucggcuauggcagaugggcggaacaggaaguuuucauguuuugaugcagcggcgguuucuuccuggagucuuccuccucgcgggcugucucuguggcgucugggcuccgagcugucaugggggaggcggagaaguuccacuacaucuacagcugugaccuggacaucaacgugcagcugaagaugugagagcugagcgggagggcgggcggcgagggccggggauugccccgagaggggcugcuccuugaagggaaucggcagaacaacccacggcgaagcccccgagggcuacggagcccuuugcguguuccgcuuuugugggaauaccgcgaucugauuuuacccaggaaagccuuagggaaaaaaauucccccgcccaugagagaggaagaaaaugaaggucuucccuuuauugcagggauggaaggugguuuggggaguucggaaaucgugaaagugggauaacugaguacaugggugcagcuuuaauuacacacgaagcgaacuuuuggacaguuuaacauuuuuaaaagcagagauguugagaggacauaggagaccgugucaguuauagaggagucaagaagaugggaggaaagaggcuuuucguaaaaccucggggcagcacguuuacaauaaagauccagagcauggcguuuugaaaugagaacccucgugggaaagaagcguuccuaaaguugcuaacuucagacuaguagaaacguuuguaguagggacgcucacccuccagacaagaguaguuuuguuguguaguuuacauauugucagaacugaccugugccauuucucagggauagggagagagacuugagggucgugccuugggagccuucuugcuggugaggacaggacaucagacuccuaccuggagagaacacacuguaugguuuucuuuacuucauuugcuccuaucuccuacaugccauuaauuaggcuuaauuccggcaucuguguaagagauggcucuagaacuaaagguguauaguagcguaaagacuggguaauaaguugucaaugugaagucagauuuauuuauuuauuuauuuauuuauuuacagaacucucuggaacucucuuuggagacuaggcugaacucgaacucagagaucggccuacuucugccccacuaagugcuaguaaaucaguaaagcuaaucuuaaggccuggaucaagugggugacagaguuuaacaugaagaagcccaaagaagagaaauuuuuaaugaggacaaaacgaguuuagccauguuaggauuuucagaaugucuuaucacauacaaaagugacguuacuuguaaaaauaggaaggcguuaucggguaguuuaugguuacguaaacagagacucagcuuauuagcucuuuauguguguaucugugugugugaaaguaaacauugugucuguguuuucagagggagcuuggaagggaagagagaacaaaagagcuauaaagcuguccuagaagaucccauguuaaaguuuucugggcuauaccaagagacaugcuccgaccucuaugugacuugucaaguguuugcugaagggaagccccuggccuuaccagucagaacauccuacaaggcguuuaguacaagauggaaguaaguuguuuugaggggcagaggguuuguuguuacugguuuucuugguuuuguuuuuguuuuuugcugucauuguuuuguuuugaccauaugcgauuuucuagagugucuuuccauugccuuacuaauguuauaaguagagacaguuuuucagggauuacuguaaacauuaggcagacuguugaaaauacauauuucacaugugaacaaaguuguauugauguaguagugacuuuaugucuauauuuaguauguugacauuuugcaaaguaaauauuuuacucauuuauaacgugaaccagaaaagaaccauggcuggacucugucugucugucugucugacugacugucauaauuugaaauggccaaccugcuauuuggaucuuuagaaguagaucuuauauauguguauguguguaucuuuuuuuccaaauggaacuuuauguucauaguuuauccaugaacuugcaugacauaauagcaaggcauuguugagguauagagucacuguaagauaacaugaaauucuguauuauggauccuugaucuaaaguccugauacuucuuaucugauagacuuuauggggcauuucuaauguucagucaguguaguucuuaacagguuucgugcaagcagcuguuaguauugaaaggugcaucuauugccuaacucauaaaauaaaauauuggauaaacacuuuacacuuaaaccuuucacacuuccauuguccuguauaagucauuaccuaucagaaguagucuauguuaauuuuuugcauuuccuugguuuagauaauauauuuagaggaacuaugagguacuaguaucuaaauguccaguugugaccugugugaguucugguaauaagaaauucaccccaaacguauccaagucuaucuuaaccuguacucuucugucauguccuacaguuaagaucucuguggcucagugaagaaaggcacugucgaucaaaccugacaguccgaguucuaucccuggaaggagagaauggucuccugaaaguuguucucugaucuuagucacagcuaauguagauuugcacagagaauguaaggucuuguuuuuaauuuucuguaauucagauuaagagaguuguuguuguuccuguccuuuaggcauggucuuuuuguuuuguuuuguuuuguuuuguuuuguuuuuuccuucuuuucccacacaaugcuggagauugaacucacaaccuugugcaugcuagguaggcacucuuccaaugaacguaacugccacuuaaacuuuuuaagcuguugagauuauauuuucuucucuaaaacauuuggaaagagagacaggguggagggggauauuaauuuaauaauuuucauuucaaaguguauucauuugcccagagaaucaagucuacugggcucguggugggauuccuguguccagauucagguuugguaaucuucagaggggaucaucacggauugggcaagcaccaaugaauggggaggaagauggcaaaacaguguugagaacacacagccuuugguguuugaauugaucccuucauugauuuuggaaugucuagaguaguuuuuucauguguuagcugaaagaccacuucccgguagagaacaguguguaaagcagguugaacuguaguugcuuugcuguaaggcgaucuugggcccaggaguuagauagagagcagaagacuugaggagaaggaucccgugaucaggguacugucucucagaguguaaggguagacaacaagaugaaaacuuccauagauuaauuuggauauugacacuaguuuuucucuuuaacuuuaccacauguuaauugucuccaugucugucaacuccugugguuucuucauccacaaauaauaacacuguuugguauuuaccagucuguuuugucaugugaguaguaauuuacuuaguugcguauacucaucuguaccaucucauaaacgugcaauuugguuucuuaaagaacuuuauagaaaaaaagguuugauaauguuuugcuucuaaucaaaauugauggcaucucucuuuuccuggaguucagaauuugcaguggucauaaauaacguuuuuguugucuuugaaaauucucuuguuucuuacuggugacacuuagcuguuagcacugagcgcucccuaagaaugugcgcaaauaacuuguuaauguguauuuguuaauaacacaggauacagaaagaaccagcaauuucuuacgcucuacucauucuuaugugucagugucagugucagugaaauaagucgaagugaucaaaauauauuaugaaaaaauuuaauaaaagugaacuugaugagauagaacagaugugcaagucgguacuguucaaguguuacaaaaacaagcaacauugaaggguuuccacauuuuuuagcauauaaaccuaaucuuuuuagagccuucucaucugucugaaccaccuuuuauggguuaauuugaaagaaagauauguauguauucuguugacuuuguucccauaguuggaacgaguggcugaaacuuccggugaaguacccugaccugcccaggaaugcccaaguggccuugacuauaugggauguguauggaccgggaagcgcugugccagugggaggaacaaccgugucgcucuuuggaaaauauggguaagcauucugcccacuacugcacagagcgcugccucuuuucuuuccuagagaacuuugauuauuuauguaaugugguuuuauccugugaaaaccaguuagguccaugggccuuacacauucgugagauuggauuugaaauggauuuccuaauauucugcauuagcuacuuuuuuuccauugcuaaauuagugacaaauugcugaccaguggcaccugaugggaucacauguuuaagggcucauucugucguggcuugggagggcacgguggcagagugaggcagcuggucccauggcagcugcagucagaagcagagguuggcagcuugcuuucccucugcccaugucuuugucgaggaugcuagcuucgagagcaucacugccuacguuagggugggucgcuggaguuaacccagucuuagaaacugccucaguacauguuccaaauuuugucucuuaggagguucuacauccuacaaauuugacaaucagaauuaaccaccauagcagcuaaaugaaaacacugucuacugcuaagugaaugcuagugucguuucuauuagaaagauggcguucugaggaaugagaaccugggugcagaucuggaaacugaaagcuguagugccuuuugguggaccaugauaguggcuuucacgagcuggcugcuaccagaugccuuaguuuuuguccuuuuaacguuuaaacaugguaauuugcacaucauuaaauguaaaugagaguuaucauuuuaauagguuuauucacuauuuucuguaaauugcuucagugggaucuuuugcccauuuucuuuuucacacaacaacccuuuuugauguugcuaagacaggaucugacuguguagcccuagagcuggccuaaaacucacuguauaaauccaucugggcuugaugucauaaugaucuaccugccucugccuccugaauuccaggauuaaaggcauguaccaccaugcccagcuaaaagugccuucuuucuaauuguucacuucuuagugaugucugaggaguguuuguacauggaggaaauuggcuauauguguacuguguuaaacaguuaccuugaaaauacuauguuucuuuuuuguguguuggggggguugguucuuuuauacauauauauauaugcaugcauguauguagacacacacacacauauauauaugcacuagauuagauuuauggaagcauguuuuucauuacacuuuuauuccuuuauacuuaaaucuauaaacuuuuguggacagagugauucauuauguaucaacuuuaacaacaaaagcuugucuuuuauacaugugucucaguuccuuuacauacgcugucuucucugauaauuuaaaagaauucugucauuauauccugaaccuaagaaaaacaacauagaaguaagguaguggagcgugagggaaggagggucgggguaguuaccuggaucugaugcuugcuugccuuucucagugucuggucuccuagggugaguuagugaauagucuguuucuucuguaaaaugaaaucauauccacuucauaguuuauggugauuauuuaaguacauuuaauaagccucgugaauauuuuauuuacaaauaguuccugugauagcucauuguagauggugccagcccagggcaggugagccugagcuguaucauaaaguaggcugagcaagccagaaggagcaggcuagccagcagccaucccccauggcuucugcugggugcaguggcuuaauuuguaugggaugagucuggagguuguggguagguuaguuggguccugauagauggcuagagaguauaagggcacuggauauuugacccgggauagauguagggcuuaggggagaguccauggaggggaggaucaggcagacuauguuuguaauucuuuguguagcucacugaguaaaauuuucuuugcuucccauccaaaggaagugaaaagugugcccgaaagacaaauuaaauaacauagauugccaaggaauugguaguacuaauuuggaguuaaaucuguuugcuugaaaugaacuaagauguuuaaaucuuggaaaaaucugugcaugcuauugauccauguccugugccaccacaguucugugauuggggaaacacugcuggggccauaguuuucucagauguuucuuuagcaauacaaugucaucagcggccucuuccaaggauccugguaugcacguacuagaguagcguauaaaagugucccucaaagcuucuaauaccgcaagaugcuacagugacugccaaguugugcucuuucccaacaucuguguuguauaugugagucauuaugagggagaacuucuuagagaguucuaaugaauaauucagagacugguuuuguacaguagcucugccacagcaaacucucuuuaaugugaacaucuagcuucggagauuucuaaggcgcuuaagagcugauuggucauuacuugaauugguagaaccacaggcaagaugaggugcaggugugugcgaauucuaacgucauggcagugucugccacaguggccugguccuuccagccagagccacaguggcagcugguauugggccucugauggagcugaaggagggccugccgcacuguucuucugugucaucuguuuggcuuaauuucccaaguggacgcauugccugacucuccaccuggggccuguguaauuuucggcaaguugccauuaguguccagagaaaggauuugaucacuugaucaucacccacucagcaucguccuccccuccaccccgcucuaaacuucucuagauguaucccaagucgcauaaaucauuuaguaagcugacuuccugccaucucuggcuguuuguuuuuaguucacuucagccagaguauucacugaggaguggagaggugggcagaaggaagggacaccaugugcugugcugaagggguggguggggacacgcacuuuuaggagucauguuaguuaccucacuguugccaguuccuuugagacugcuguaagguugcucuguguuuuguuuguuuuguuuuauuugagacaaggucucauuugauugccugugcuagucuagaaucugugauccuccugccuccaugcugucugaucuguuggauuuuaaaagaaagaaaaccuuacaagaggcugucuuugcaugcuuuuguaguagccauuaauuaaaauauaauguuuguaauaaugagaaaacugaucuauaccaaggagucacauuauuuauucauggucacagccgcaccugcuguaggugcuacaacugcugcccagacccagacaagcuuacagaaaaguuagguaacuaagagcuuugcuguccauccgguaguuguggguuccuauuggcuagaagugcagugucugcuauucuaagaugucugcugaagugguguugagugcuguccuccaaacugcagacaccguuuucaucugaacagcggugaauacucacagggcucccuaugauuggccuuguugacuggguucucuucugaggaggguguaggagcaucccuggacccuuuuguacuuuccagcuauuugggugcaucucugccuugauuguauguggccucaucucaucaggaggugcuggcuuauguagacuggcaaguuaagagucaucgguucuaggaugagacuugcccaugucuagcugccuugcagucacccaaguuucuguaauaacugcucacguaugcucugaaauuuaccuugcucugccacuagagccguaugagaaaguagugaauaauugcuuaagucugcccagcaacgaguucccucaacagugauaacauguacauuagguuguauuuuauuucuuuuuuucuuuuuuuuuaacacuuuauuuuuuuauuagauauuuucuucauuuacauuucaaaugcuauccugaaaguucccuaaacccucccccugucccccuccccaacccacccacuccuguuuccuaucccuggcauuccccuguacuggggcauacucuucacaagaccaagggccucucauuccauuaauggccgacuaggccauccucugcuccauaugcaacuagagacacaguucugggggguacugguuaguucauauuguuguuccuuccauaggguugcagaccccuuuagcuccuuggguacuuucucuaguuccuucauugggguccuguguuccaucuaauagaugacugugagcauucacuucuauauuugccaggcgcuggcauagccucacaagagauagcuauaucaggcuccugucagcaaucuugcuggcauaugcaauagugucuggguuuagugguuauuuauggaauggauccccgaguggagcagucuuuggaugguccuuccuucugucucagcuccuccgaacuuagucucuguaacuccuuccauggguauuuuguuccccauucuaaggaaugaaguauccgcacuuugggcuuccuucuucuugaguuucauguguuuugcaaauuguaucuuggguauucuaaguuucugggcuaauauccacuuaccagugaaugcauaucaugugaguucuuuugugauuggguuaccucacucaggauguauuuuauuucuauagauugcucuauagggaauaacucuauuagggaaugaguucccuaagggagaaaagagugaccuggagagguuugugguuuuagccgccgcuuagcucucuguugcacaaaccaugguggucucuggacuuaauaagcaugcaugacacauauuccuuuaugaugaacuucauaaguuaguucacuucuacucugaacuuuuuuuuucucguagcauguuucgccaaggaaugcaugacuugaaggucuggccuaacguggaggcagaugguucugaaccuacaagaacucccggcagaacaagcagcacacugucagaagaucagaugagccgccucgccaagguacacaggcuucaacgacaaguagagcucugagcagagcagauccuaggguacuugauguugugaguccuacugcuugucuugucgauuuaaauccaccuuuaguagcaguuuugagauauuauucacaucuucacuccugaacgguauaugaacgguauaugguccauagccuuuauagccauccuugcggacguuuucaucucugaaagcuccauguacucaguagucaguccucagucuucccucccugggcuuccugacagcugcugggccgcugucuaucugugcacuucuauucuuuuuuuuuuuuuuuuuuugguuuuuggagacaggguuucucuguguaguccuggcuauccuggaacucacucuguagaccaggcuggccucgaacucagaaauccgcuugccucugccucccaagugcugggauuaaaggcgugcaccaccaccgcccguaucugugcacuucugcaugcauggaaucacgcucaauauggccuugugucuggacuugcaucugauuuggaaaugugggucucugguauuuucauaucauaucuguuuccuauauugcucuuuuaauugaaaaagauagccuagguccugcgugaauguauuguuugguauacucuuuugagcuuacuuucuccaaaugaauaaaacuuaagaugugcuuuggcugcucguuucuaggucuugcuuguguucuuacuggauauauaagacaguucacaaguuucccuuauguuugccccucuuugucuuuuuuuuuuuuuuuuugauuagauauuuucuuuucaaauguuauccccuuuccugguuucccuauccccuucccucccccugcucaccaacccacccacucccgcuuccuuguccuggcauuccccuauacuggggcauccagccuucucaggaccaagggccucucccucccauugauguccaacaaggccauccucugcuacauaugacucuuuaagagucuauuaacagugaacuucgauuuagcuacaucuaugauuaaacaauuaguagauuuuuuauuagagucaucucaucuauagucuguggucuacuaaaauuugaaagauucaguuuuuaagagucagaagaauauaguuucacucuggcugccuaaggauaaugggaaugugaugugaagaccaaccacuuaaauagcccaugcaaaaauggcguuggguaauuauuaaacaggagguauugccuccauguugaaauuaauguguuugcugugauucguuacuuaguuauggaagauaaauucuaacuauggaaugaauaaguaacacccaaaagccugcuuucccaguuuaccgcuuaaaacaguucuuugcgagugguuguaaaggaauacgucucucuacggauuuagacuguuuuauaaaccugccuagcuuuccuuugaggaacaauggcugggagaagaggagguaacacuguauuugcucagcuuaggucuccucucuguuuguuauuguuguuugcuuuuguuuuuuagaugcauaugaguauauuauagcuuucuucagacacaccaaaagaggccauuacaacccacuacacaugguugugagccaccaugugguugcugggaauugaacucgggacuucaggaagcacagucaaugcuuuuaaccacugagccaucucuccaggcccaugggucucguuuuuuuuuuguuuguuugguuuuuuuuuuuuuuuuuuuuuuuuuuuuuauaauuuggauuuccuagaguuuugauaagguacagaaggaaauguauguauuaaaaucuucucauuccugcaucuugcuuauuguccuuuucuucuccaucucuaaacauuuucaacuagugcuuacuucuguuucaacugauaugugaucauagugagagaccagacuuaaagacggucuguaaacuuugaccgucugggccagccucuugguaaugguggccagugucuacacuguuuccuucaccucuguuuuccggcuugccauagugugagaauuugaugguagguggcacaccguccuggggcuuuggaugugaccccugugcucuggcgucugauguauauugaaucugugucuugggacuugaaagguuagugcagagcaugcucccccccccccccccccgccuccuccucauuucccagcccggcuggaugccgcugcagugugcuuuccuuucugucaggucgauuaagaggaggccaagggaagggaacaaguagauggagcguguuuccugguccguguggagauauuggaacguguggggagcugagcacugaagccgccaggaggggaagucauggaacuuacagugcuacaucggggucuggucccugugggcuggggucuggaucucagguuuagggcuacaggaagcagaggacagaaagugaacgugguacacagaagaaacaggauggacuaaauaacuguccugacguaugcugccugcauguggcuuguagacucuaggaaggcuacucaugucuaccugcugucuguacucacauguaguacuacacugugcaugcucuucauaucauaauaugggaauuuauaaaagaacugaccggaaggcacaaugccuucagucacgcuccucaguuauaauccagauuguuaaguacaacacaaugggacauaacaguugacagagggacaacugucucaguuauaaccuagaucauuaccugacuacacaguggacauaacacuugaaagaaugagaacugucuacacaaauggggaccuaaugaaguguagacauugcuuacaaagaaugccuuuucacauuuuugaggaacauguggacacagaaaaguacccauagcaaguacuguuaggaaguuagucccaguagagacuugacuauauacaguaauaaauacacugcagauaaucacauugcccuggaguaguaacacuguaggauuggaccuuaaucacgugagcaagcacaacugccgucuucuuaaacggcuuaucuuacagaggaaaauuauuacugauuaaucagagcucacagagaaauccauuccuguacaaaugggaacauacacuccuggcccuagcauuuagguuguggaaagaggcucaugucguucuguuuaccuguuagauguuuuuuaaaugacaauaauaaaaaauaaaauuaugguaauuguugugguuugcgugagaucaccauggucucauauauuugaauacuugguccucagucggugggacuguuugaggaggaguaggaggucuggccuuguuugagaggaugugucauuugggacaaguuuagagauuucaaaagcccacaucauuucuaguuaccucucucugacucguacuugcagaucagaauguaagcucucaaauguuuagugcaauguucuugcucugccaucuuacucucugaaacuguaagcccagauuaaaagcuuuccuguauaaguugccuuggucauuguauuuuagcauagcauagaaaaguaacuaaggcaauugcuguaauucuucaaggcuuucagaauuuauacacauccaccauucccaccaugauaugcagcuuucacugaagccauccugguugcuccagaucugaccaugugucucucaagaccaugggaaauaaugaagugaauggcgucagccucugauagggcauacuuuaucugauagggaaauuggguaaaugccuggaagcuguuugcagugguaacuauugaauucugcagaacuucuguaacuaagcugagaaauaucuagaauuucuucaaauaucaagauguaaucucggcagcuauuaaguagucaucauaacauaugcagauagcucuugauuuuccauucacguuggaacucaucauuacaucucucuggugacacaugcagccaugcccacuguuucuguuugcagcguuuggaguguauguguuccaguacuuacugaauggcucccacaguugaggucugaaagguaauuuacacucagcuuuugugguggcuuuaccacauuuaguaucgcuucaguaauagcuguugaaaagauugagaaaggucauauuugguaugcagcuaagagagaggaaaaaaggccuagcauguguagggagugacauguauuagccacgacagaaauucagcugguacagaggcugcagaaaguucccagcgcguaauggagaagaaggaaaccucacgucagcauccacgucaagauacaacucaccauuaccaguucuuuccucauagcaagucauugcacggaccaacuguugggcauaaacacagaacuaauguuugguaaacaauagaaauuagaggggcccaaagagcacagugacagugugaugacacagagugagugacaggcagguggagagggguggagccucccucauaucacuccacaccagcuuuuacaggagaaaauacuaaaagacacauuuaucagucuuagcaacuagauagaaugauagcaccuuucauguuuugcaucuacuugcauauuagggcacaaagagaagauaauauuuuuuaccagcaugggcucaaaagugacaagaguucaaaaagcauuugucagugugagaaccagcucucuagcuugcaaugugacacucuccuguaagucacacugcuuggucuuuggucugucucucucucucugucucucucucucugucucucucucucucugucucucucucucucucucucucucucucucucucucucucucucacauacacacacacacacacacacacacacacacucacacacaccuagaaucaucaugugacgagaugcucagcguuuauccagaucuguaggauaaugaucuccacccacuuccauccuuuucuugauggugagauuuuacucuuuacagcugaaaaagaauuccugugugauauaugcauaucuuauuuucuuuauguguucauccuugauagauguuagaccagaucuguuucuuagcuguuaugacuggcacagcuauaagcaugaauagcaguuacuaauaucgcuaucuauuuucacguuagugauuaccaugagggaaaacagugcuguuugcuaugcaaaagcaaguugguuauuucuucaauaguacuuuuguauuacaguugaucucaaacucuuuuuagaagguuuuguuauauauggaugaguguuuugccugcauacauagaaauaaaccacauguagcccugcuguucacagaaagcagaggagggcauugaguuccuuggaccuggaguaauggaugagaguuacucuguggguuuugggaacggaaccaugauccucugcaguuacugcggauguuccuaaccacugagcuaucuuucuagccccagaaccucaaauguuuugcauaagguuaacacuuuugauuucugaaauacggaggacucacggguaugauguugccaaggauagaagauuuugauguccaguugugcuccauuuuaugaauuuauuaaaaaaggguuuugaucaguaagucacgcugauguuuaaaauauacacugucaggaacaaagcgaauucuaaccugaggcccuugcagcuuacugugauuucucugugaauuggaaaauccaguaugauauaauuucugaaacuaggccaagauuaguguguaagaccccagugggcucaaacaucagcaauuuuagaaauuuaaaucguuuaucauugucuccuaaaauaaggcacacaugcaugugcguguacauaagccuuaaaggggagauuuauugguccccaggaauuaccuuugccuaaguaauuuuuucagaauguuacauuaaaagugggaagaaaagaugauguauuauucccgaaaggaucuacucacuauaauuucacuaaugauagucaaaacauaagaacuguaaaacaugcaaauaacaugcggggaggacuucacucugcgcuuggcaagacuacaggcuugauuuuaaaacuuuuuuuucuuuuuuaaugauuuucauuuuuaagacaagguuugucucuugcuucguuucuuauucugauauaguaugcgguuuugguauguaauagugcuuucuaugugggaaucugaaauguaggaaucuuucauauguugagucuaauguccuaaguaugaagauuuauauguagacuucaauguguaggauucuucauguguguaaucuaguguguaggaacacuuaauaugaagaauuggauauguagaaggacuuaugcagaguugguauauagacucagcaucuuuuagcuuagaucuuuaaaacccaaaaguguucugaaucuuggcucauuuuagaauuugaaguauuuguauauacuugauuagauaucuugagaguaggcuccaaauaaaagcauaaaauucacuuguuuuaauguauauuauauugucguaagcagugucagaauuauucuuaaugccccguguacugcgacccauccucugaggccgauggggccgucucccuuuguggccugaaaugcuugggauugcguaguguuacagacgcuugacuuucacgucagggaggagcgauggggauggccaucuuccuuccuccuugguuggaucugugcugagauuaacccuguugcacuuuccuacagcucaccaaggcucaucggcaaggacacauggugaaaguggauuggcuggacagauuaacauuuagagagauagaaaugauaaaugaggugaguugcuuccuuccucacaucaggaaaaauucugacggugacuaagcuaacauucuuucuuuaaaaauaauuuuuuauugucaguucucggccagauauggcuuccuuuagguacugugaguuuuauauuaauaaguaauaaaccuggccuuuuagaguguuaaugucaucugaaccauuagcagggcuaccuaccuaucauaugugacgacccggcgccucacguguguugccguguugguuagguuccuuugacugcuuguugagucuccauuagcaguacugucuccucucugaggucaccacgugccaucuucagaagugcacuguccaguccacaccucuguuucagcacuucauuuacuacucccuggguguugaagccccaguaaggacuccauuauacauaguuuaccuuuucucgaucuuguguauugagccauuguaaauauuuaauuaaaagaugacuucaaugaguuuuaaaaaguuguauuuguuaaagcugacuuacuuuguagguuuguuuuaagaauaccauagguuugauggaagaauuugugucuagagaggggaaaccacuuuaugaaucagauuccgagaggagaauaucacugucuagcugauaaugaccacugugguguacaaaucacaugacuuaaaccuccacagguucuuagcaagggagaagaggagggaguggggagaaagacaauggagacugagugugacagccccauauucuugucuuaaaugaaucuugucgucgguaacaccuauauugauuguacaguugagauccuuucuaaauguauucacauguuuacaacacagaccacuagaagaguuagcuuuugcacuuuuaauaauaguuccauuagaaaaauaguuuauucaaaacccaucuguuuucuuccaggucagugcuucguguguagagauguagcguugggcgugcuuucccaccuuggcuguguugcccuuccucucugcuugucacuagacaguagacaguacugcauggggacaguagacaguacuguauggggacaguagacaguacuguauggggcugcacacuuuaagugcccuuggcguugugcaccguguacgugcaguaacagcagaagcuagaagaagggguccugauaaaagcugcuaaugacgaguuaucuuaggagcagucagaaauugugaacauuuuauaaaaauuacuuaagccucuuacuuuugauuacagacuuaaaaaaaaauaagauuacuuuccuauauacaucauaauuccugaagugaguuaauuaguguaguuuaaaagugaaaguacugaaaguuguuacacguacaaacuggcaucuuuauuuuugaaauaaaauaaaauaaaacacuuucaaguuuuaaaaucauaaacucuaaggugcugaguaagccaaaugucuuauugagucuggagauggaguaacauccccuucuagaugaaacagugaugcucuauggcuauugcauguggauaauaacauaaguuauauuuuaaguaguagucauugauuccuguauugcugaguugugaugaagacccuuauuuaagaaaguuugaaagucgucauuuauugcucucucucuuuuucuuuuuuagagugagaaacgaagcucuaauuucauguacuugaugguugaguuucgcugugucaagugcgaugacaaggaguauggcauuguuuacuaugaaaagguauucuccuuacgacucugugcuuucugcugccaagggcuggccaccaaugacugcccuuccugcuuagacacaugcuuugguugcagaagaacaaccaaccaaaggcuuucagccgcagcugcuucugcguacacagccauaccacagagcugcagcccagucgggucauguaggucugggccacaaauucaauaaguaugcaagugauuaagauuuucugauuaaaauucuucugcagaccugugaguaugacaccaaguaauagcauuauuuacaguuauccauuugcacaauaaauaggaaauuauaauuaauguuuccuuggcaagacuuugagaguucaggugucuguuauuuaacauguacacaacauguugaaacuguguguaucuuugcuuaugaaaaccuucauugauaugcuuguauauaauuuauucaaaaauuugagacaguguuuuuacuguacugaaggaacaguuguguauuguuuguguuuucucguuaugggaagaauagcucaguguucugaauguagcucuuucaaguucuuugcuuuaaauucagguugaaaagguuuccuuuagugcugcagaauaauuauauagguaaaaauaugcucguuugaaaccgccuaaguagaguuucuuucaauauuauggaaauaguguuuaaaucauuucaaaugagaacagaguuuguguaugugacacuagagaugaacacuuguagcauacaguaaguuuguauauaggucacuuguucauuagaaguagcuuauuaaauuauauuugcauauuagugucacuuguugacgccgccuccaguggcuucaugccuguacccuuugcagaggcugccucaugccuguacccuuugcagaggcugccucaugucuguacccuuugcagaggcugccucaugccuguacccuuugcagaggcugccucaugccuguacccuuugcagaggcugccucaugccuguacccuuugcagaggcugccucaugccuguacccuuugcagaggcuaccucaugccuguacccuuugcagaggcuaccucauaccuguacccuuugcagaggcugccucaugccuguacccuuugcagaggcuaccucauaccuguacccuuugcagaggcugccuagcagaaagguuuucacaagagaggguuuggauuuacccugcuauuuauuacugugugauccuucucaguugauguucuuacuucuucucccugucgucuguuuucgcuuuagugcgaaguuagaauaaguuaacuuaaguuaacaaaaggaaaagguuauugagcaagcuuuucaccaauaucuuaaaauuacuuccuguuuugugcugugcguguuuauuaaauccacacugcugcucguauggggcuucuaugugaagaaacuucaaagugggcaguacuuuuaaacauugugagggaccuuuugaaaggcagcauugcaauagaggaaauaauaacagaguagaaauuggaauaauuuuuuaaaccuuugaaagguuacuccuagguagcugcucaugaauucaugccugccugcucaccauucuuaguuccuuuagcauaaggcuugcugggccagugcagcacagucuaguggaaacagacuuugucgucaccugucuucugugacagacagccuuagugaagauuagcugccacaguugggcugaugaauguguuuucugguugugaccgagagcaggccaguuagacagcagcucuggggcucugcuguuucccguaagacucaauuacgguagugccuuuucaguugcuucugauuuuguugaauaucuacaauugagaaugcacuaagcucugaggacagcagaacuccgauagcagugcuagguacacagucacaagggaugagugccaaucauaauuagccuauugcaguaauuuugcagagacauguauuauacugaguuggauuaaaaacagaggucauucauucuucaggaaugaugugcuaacaagguaaggcagcuuuaauucuuaacauaugucaagaauuggugcuaugcucuuguccgugugaaggcuuguuuuguccccugaguugcccuguuguugcaaucucucacuggccagaaaugugacccacacuugagugggugacagccggacugauuuagguuaagauuggacuguuuucuuacccauugucauaauaaaccaagauuuaacaauuguagccacaaacaauaaaaaacaaacuguuuccagauuucauaucuuuacaacuauaauaaaauuuuuucuacuuauuuuccaaaaaauuuauuaguaauagaaauuuaaaaauguggaauugaaagaggauaagaauuuaugaacaaaacaaugauguuuuuaaaguugaauguaaauauauuagcauuuuauaauauuauauccacuuaccauuugguuaaaugucuuccuuuuuuaucuuuuaaacccugcacuauucuaggauggugacgaaucaucuccaauuuuaaccaguuuugaguuagugaaaguuccugauccucaaaugucuaugguaagcugcuuuacacaguuuuuaagaacaaugaucuguagaguagacacagacccauguaauauauuuuaaacuuguaauacacauaccugacaaacccagacauguucacuuguaauaagugcucuucagcuauuggggauugguuuuaauggaugcuuguaaggaacacuggcaucugaagagugaggucugccuaaugcaggagugacugggagguuuugucuggugugaaaguggugauccuuaaggauuuggguggggggagcccgaggaagccgggugucacaugcauguuccacuacuggaaccugacucauguaguuucacagccuuguaguggguccuagggacugcaguggcaccagagugagucaaacaucagacaucuuaaccauggcuuaaaggaaagacuuugcuguuugugacuacugaagcuucucuuuuguauaucuaaacaauucucuguauauguaaacaauuuaaaggagaauuuaguggagagcaaacaccacaagcuugcucggagcuuaagaagcgggccaucugaccacgaucucaaacccaacgcuaccacaagagaucagcuaaauguaagagaacauacagacuggauaagaacagcuagguggacauuuuauuacagccaguacuuuauagcauuucaaaguuugcugaauuccguaacuucaugguuucaaguuucaugcuaucuacagaaugguuuggauugguuauuaaaucauuuugggacuuuuaguaauucugucuguguggaaacauaacuagaaaauuguaaguauuuucacaguuuaguguucuuagaaaugagcuaugaaggccggcauguaaacacuaagaguugcaugcugauuugacaagagggggacucauuuuguuucucgugauuuuguggugaaggacauugccacuuuggcuuccuuccugucuaguugaauuaaaucaacucugaaaucauaugcuuauauagagcauggccgucucauuguuccuucaauguccuaaugaguugcuuuguaaauugaugcucagcauauauuuugccuuaauugccucugugugccucccuccaccuuguguaauaauuauguuauagaaauauuaagcaaaugacauauuauaugaaauggaaauauguaguaaguguauguuugacaaauauaauucuuuuucuuuuguuuuagauuauugugaguuacccaccaaccaagcaacucacauaugaagaacaagaucuuguuuggaaauuuagauauuaucuuacuaaucaagaaaaagugaguuuuuugaauacuuuauguaucaaauuuacuuauauucuuuuuuucuaaugaucaaaaggaaaguaaaauuacacuaaacaugcagcuauggucaagcagucuugcuacacagcaauauacuggcuacacaggaaaagguguauacacagagacacauauuccuguguguuaacuccuagaaaaugucugaaugaauuuugaaggcagauuuuuuucaguuucuaccugugcaguuuguauccguugcauaggauagaguagcguauuucauuucuucuuguucuaguggagacagcuuggcauucuggaugagacggcacagcaccuguuccguagcacgugcagagugagccugaguccuuucauucuuacccucuucgccucuuuguuccugagugauuaggaaugcagucauacugacuacaaagcuugugaauucuucagaccguggggauagaagaaauagugugauacguaauguggaaacugaauucguagagugacaggcagcugguuagcagggugggggugagaugagaacuggaccuuugguaaggaaacuggagggagaagugugaugaauugccaggucgagccucuagugugaagacuuguucuugugccuacacugcuaccacugugcagcuugguaacugcaggccagucaugauggauuaaagcucgaguuuccuguacuugauaugggaugauuccuugguaaugaaauguauauaucuugauauucuugaaguauucuaucuuagagcgagggcuaaagaucuacuuaaaaaauagauucauuuauuuuacuuuauguauaugaccauuugaccugcauggauguaugugcaccacaugacuucuuuucuuuuuuuuuuaagauuuuauuuauuuauuuauuauauguaaguacacugucgcugucuucagacacuccagaagacggagucagauuuuguuacagaugguugugagccaccaugugguugcugggauuugaacuccggaccuucggaagagcagucgggugcucuuacccacugagccaucucaccagcccaccacaugacuucuuaaacagcugaugaaugcuagggaccuuuaaauccacagcaaacccacuaugcacauuguacaucccugucacacagaucaggugcauuacagagccacggaaguauacaugcuccuucucgagaugcugguguucaagcuccagaaggggaggggucagugaagaucuagagagcauagaggaugugcagcaggguuucugaguccacuggaggcugagcagagaugcauuaggauaggaaaaguuugcgucaugcaacugccaucucaugcuggagagugaacccgugugcugcagucucaugcugugcuggcucuugauuuaguugaguuuucuaagguagaagugaaaaugaaguuagggaccaucuugagcucuucagcuuuugcucugucucauuuauugaugguuugggaaaccuuuuguggaugugucuuagcgguuacccuuuauaccuaugaaaggggaagugggauuuuauguuacuccagcuuuugagagcuugcuuuuccuccagagcaugaauuaguuaacaaccuugcugugcuaacugaagagucgugugguuacaaaucauggcuugcaugcugcggucauguaaucugcaugggaagauggagacuguaaugugaagaugcacagcgucaaaguccagggcagccuuacagagaccuuccuuaguuggaaaggcuuguaagguaaaucguugaucucaguagucacuucccacugaauucagucccuucuaaauguuugccgaugauauaaacugaguggcagguguccugaagacaguaucuugucuucagagaugcugaugaagccgcaguucucagaccagaaggaucguaaguaacuggcagggaguaaauaguauuuuuaaugugcaagaagggcucuugagcaaaccaauguaaauuggccuugaaguggcaggaguaaucaucacauagcagcccguguguccugugcugauggcagccaucacugaugcacaagccuucuuucagucugugucucgcauagggaugggcuugccgggcuuucggcucucagagaacuucucauuucuaaucucaggaaggcucuagaaacaauuuagugggcguuaguuauuaggaaaugauacuuagaauuuucauugcauuuccuugguguuauccauccccucuggcucuuacaguguuucuuccuccgcuuccauauuguucccugagccccaaagggagggcuuugaugaagacacccacauauaggacugagucuucucacuuucuucacauucuccaugugaagaugaugaugacugcuauugacugagagacacugcucucuggguauaacagauugucauuaggaaucacuuugguuuuccccuaggcccaugaccuguguaguuucgcguucuugcugacccaagcagugucaggcauggguuuuauccuauggagugagcuaaaauccaaagagauuguguugguuacuccccaggccugucacuauugcaccaggguaucaugcaggcaggucagcaguguagaucacaggguugguagcuggguugguguuguaucuuucuccccugguagcaugugaugcaccucccaguaccaugaaccuagucgggaggguugaagucuccaguuagguaccaguugauuuuucccauguccagugaguguugucuucagcaguagggccuuaaucuucaaccaagcucuggcaagugccugggcuguucaguguuuuccuugggucccuuuugacucuacuagauguaaccuguucuuggcgcccaaaguuucacuugguuaugaaagcugucuaguugagcauugucuccuccauuauuuagauuuccauuuagauuuuguucauucucauaaauacauguacauguauguaugcacauauauguauagguccauugcuguguauugugggcagggguugagugugcaugcauguacaggccaaaggucacacccaggugucuuccuugauugcucucuaccuuauuuuucgagccagggucuuucagugagcaugaaguaucccauuggcuggacuggcuggccauggagccacagagauccuuuggucuucaccucccauccuaagugccucgggcuuguggaaucugcacuucuggaggaauugacuguggaguuuuauugaaaguuaguuugaaaggaguagagcuaucuuucuuuaagagcgagucuguagaugacagauuugugacagaaugaaaagagcuuuccauuuugccuggggugcugccaggagaccuggcuuucaggguuuagugugaggaaaacaggagugugccuuucugaagugaguuguguauuguuugugcugucaggacuugaccucugccaggcagccauguccaaacuugaggacauggaauugccagagaaguaagccucuagaaaaauccugcugucuguuacacagauugcuuguggcuggcucuguaccuaccucucuugcuguuugguuuuugagugcuuugauacucuuuuuguuguuguuuuuguuuuguuuuaacugcaugucucuuuaaggaguugcuucuuagagaggcauccuggugucuuugaucucucugagaguguguauuaaagcuaaggaacugacccugauuagguaccagugaggccaguugggagauuucaccauagcuuguugugguuucuuuugacacacuguugguauugcaaagcuaagacuguuuccaaggcacguuaauguucuugggauuuaccucgcccagcccauuacugucuugaggucuccaauauuuuaaagccagaaaaacagauuaaaaaaaauuauuguguccugcaauuuuuuuauccuggaaaauauaguuacagggaagggguuuuguuuguuuggguuuguuuguuuuguguuguuuuuuguccugcacugcuacucaaggaccuggauucuucugucaaggccaaguagaccucugccuguaccagagcucuuugacccggcaaucagauauaguuccuaacugucuauuuaacucuuuucugacuccaggcucugacgaaguucuugaaguguguuaauugggaccugccccaggaggccaagcaggcccuggaacuucugggaaaguggaagccaauggauguagaggacucccuggagcugcucuccucucauuacaccaaccccaccgugaggcgcuacgcuguggcccgccugaggcaggccgaugaugagguacaugacuguucaguaccccuggugacuguucugugaugcauuuaaagaaucuagucuaagccuggcgugguggcacacgccuuaaacccagcacuccggaggcagaggcagaggcaggcggauuucugaguucgaggcuagccuggucuacaaagugaguuccaggacagccaggguuauagagaaacucugucucgaaaaaaacaaaaacaaaacaaaacaaaaaaaucuagucuaagacuaaucacuggucacaggcucuuacaugugugcgcugggagagagauacaagagggagcauauaggccagugguucccaaucuuccuaaugcugugguuccucagguuguggggacccgcccauaaaaauacuuuuguugcuacuucaugauuguaauguguuguuaagaauuguaauguaaauaccugauauguaggauaucugauaugcaaccccugugaaaagaccauugaauucccaaaggguccuggcccacaggaacuauugauccaugcagcuagacuaguuagggcuccagaagcauugaaagucuuucugcaagagcugcugugagaggagagcuacccucuaguuuguuacaugauggccuuccacuggcaccagagcugcuaguccucugucuggagaaaaggcuucuaaugaaaaaugcuuuaaugcaacacagcuagggaguaguucagauccauuccaacucaguguacaagaggccacauucaucauagcccugcagagccuguaagccuuuguagcacagaggugcauggccauaacucucuuccaacccccugccuucaccuucagcugcuggcaguugugcacauguguaaaaugucccaagguggucuugcauccucuggguacccauagcaacuguaaccuucaugugagugucuguaugcaccccgcgcagcugaggaggcaugcaguugacacaggcauuguuagacuuugccuuagucauuccuagugagguggacuaauguggcaaguguucuuguuuuuuagagugaguguguucuuaaaggugacuuacuaguuuaugccagcccaaugggacauaaaacacagugugaaaccugacuguaaauugcugcugagcuagugggacagcuguuauuaaugacacccuaaaggucauuuuuaauuagaaaugccaugaauuuuucagaagcacaugaaacauuaugauugaaauauguacauauuuuguuaaaauuaaauauaucucaaaugguuugauagaauucacuuguuuucagccaucaucuacaacacuagucuccaucacagucucccugguggguuacugacacccguucauaccuccgugcucucuuucaaauccguggucucauuuuucauuaauuguuguuacaugcaugugcguguguguguguguguguguguguguguguguguaugugugcauguguguguguguaugugugcaugugugugugugugcauguguguguguguguauacauauacacaugcuccgucuguauaauguuauauuuuugcaucuguauaauguuauauuuuuguauguauguuuucaggccugcccauguaguauuggaugaccaauuggugugcuuuucucuuaccugcuggcuaugaguuggguuuuccguguucagugucuuaggaugcauaacucgcaugacuuacagaacugaagaacacacuacugucuauugcugguuaauuagaaagggcauuuaagagaauccuugggugaaguccugagcccggagcuuccauugccauggaaguuuaggcauagcauuauccucuauguggacacagucuucaugcuauuguuugguguucuggacacuuccucacauugauaugaauaaugaaaccauuggcaacugguaacuaaaacugccccuuuggacaggcuggucuaacuuuuggacguuaauuuuuuccacaauguugagaguaacucguuuuaugaaaccuucaaaagaaucuuaaacuuaagucaacauaagagacaaccgcuuuaugacguugagccuuuuugccugguacugugauuuuauacucaggucuuuuauaaaguucuauguuguuuuuagauuaaauuauaucugacaguugugucauuauuauuacaaaguauucgugcauuucucuuauuauccauuagguaaaaugccuguuugucuuuuugucucuucacugugucucuuucuggcucuuauacauacuucuugggcucucacaucuccuacguguaaggugguaccagaaaagcugugccuguuuuucaagucuggauugcucuccucucauugcagccaagcacagauaaugucccagcucugccuugcuuucgcuuuuaugagaaugccuuuaguaucuugccaucugaugugugcuuaauggucauuuuauuuaauucuugcuaaguucagaauaguucuuuuugcgugugcuuguguucugagugugagagucugagugugagagugucaaucaagaaagccucuugauggaucgaucaccuuuuggcucuuauuccuaucauguuaaucuguguggccuuccccuccccccacccccaccauguaauuguacuguaaaucucggauuaccuguaugaauuuggcuuuuuaaggguucuauuuaggaauguguagaguguugauucuuacucuuacaagguucaggccuggaaguccugcaugagaauugagugaggaauguguuuggggcacacugaggcaaagcuguuuguguucuacagagggcacagcaugaguaccggcagggacacagcagaguguguaaagcaagaauuguacaugcgaggacagugacucuugucugcaagcacaggaacacugucucugacacagccuugcuuuccaaagcauggagucaacauuggggaagguggcgcucacuacaccacccuuggcucuagggaaauuucuauugcaucaacuuggguagaaaucuguuuguuuguuuguuuguuugcuuuguuuuguuuuuuaacacccugcuuuugcuuugucuuacuucaaaguuuaugucuuccaugcuuggggacuuuuuuauuuccagcacaaugaggaagcaggugacuuacuucguauuagcuuuaauuuauucccauacaaaugaaaaacuguguugucggagugcacacugccaaguguccagcacgccgauggggauaugugacuuaaaggagggaugcgguuucccacuuccccucuccugggcaauucagcgagaagcaguucucaugccuuauuggcugagucuuguccaucacuggaaaacgucucacauuagagaacauucaggugaggagcaacuucuuguuguguuuagcuccaggcuccugcugacuuccagaaagcagaagagggacucagccuagacacugguguuucaagcccuuuccuuaacuggaggguuagcaacugcucagccucuucugugccuggugaaaagaaggaugugagguuauuagagggcugugguggugggagccgggggauuuagagggaucuguggauaucucaaagaauagggggaggaggaggagaaggacucggguucuagagcuuuugagguuuugaggguuuuuaaggaaaagaagaacaaaaguuguuucaaaaagaguguccugagauggaaauucuuuugaaaaugugaaguguauuauuccccagcagucuuagacauggggugcauuugauggucuccuguuaacaaggcccuucuuuaaccccuuaguucuuucuguaggaaccaucucaaccucucuccuaccuucuccacucuccuguucuguuguucagacaacucuauguaacagaaaccaccauuggccacuuacuguggccugcacacuugccacuccuuuuuuuuugacuuaacuuauuuuaugauugugacuguuucugcagccuuugcugcgccggucuuuuuauaaauaaggacacaaggaugcacccagcagcucagcggcuucaugccgugccaaaggcaacaaauggaagacgugcaagucucgugucccugucugccggagagaaguguggcucuacucagugugcuuuggauuuucuaaugcccgcuucuuuucauuuguuuauuuguaggauuugcugauguacuuacugcagcugguccaggcucugaaauaugaaaacuuugaugacauaaagaaugguuuggaaccuaccaagaaagauagucaaacuucagcaucagaaagucugucaaauucuggagucaguucuggagacauagauagguauggccuuccagggaagauuauuuauaauguaacaauuucuccauuuucauguuagccucuuuucccuuccuauuguaucacauguauguuuauguaugcauagauuacuagaguuuagucuccugcucgaugccuacuuagaagaccugagauucugucuaaggucuuucuucuuccuggguuacauauucguguacauagcucugcuuucucaucucaaaaaucaggauaacagccuggugugggggcgcacaccuuuaaucccagugcccaggaagcagaggcaggagcguaucucugaguuugaggccauccuggucaacaaagcaaguccaggacagccaggguuuauuacauacacauugaaaaacaaacagaacaagcaacagcaacaacaacaaucaggaugacaauagcuccuugcuugcagaauaaaaaugucuacacaggauuuuacaucuugguuaugucuccuguuauguuuucagcucccaaauuauaaccaacccucuuccucccguggccuccccuccuccugcaucuaaagcaaaggaaguuuccgauggggaaaaucucgaggugaguaaaagcuugucaagauuucgguggaagaagaaugccagucagcauucuguguuggucuuuaaaaccuuggguugauuaauaaaccgaccauuauaacguuguucaguaauggguuaugguacaugguuaugacauuuccccucacuuaaugggcuggauauugcuucauuuauuuuauugaugcucugggcauauaaauggguuuagauguaauuuaaaaauaaucuaaguucaaauauucuauuagggagacucaggauguucauuuuaauauauuaauguauguuagugcaguuaucaauauuuguaauuuuacuauagaaauguauguuucuauagaauuauauacuaaguaggugguuuuaauucauauagacagguaaacucauuuuugaagggaacagcucugcuagacuaguagguacaucaaaacaaaacaaaacaaaaaucaccagcucuuguguguguguugaggacaugaucauggaagagcugagcucugagggggaaguagcuggucauugguguagggucugcaggucaucauguggcuuuucucaaagcugaugaaauaauugaggugaagagcuuagcagccuuagcuucccugggaaugcugugaugugaccagaugucacccuccuuaccaccuggcuuucaacuauugguugagcaguuuuuaaucuccuucugacauuuuucuugggacugauaaacuaacccccuuuuuuuuuuuuuuuuuuuuugugguuuuugagacaggguuucucuguguagcccuggcuguccuggaacccacucuguagaccaggcuggccucgaacucagaaauccaccugccucugccucccaagcgcugggauuaaaggcgugcgccaccaccucucagcugaacuaacauuuucuaggcugauuuguacucagaguucagauaauuuaaaccuucacagaaagguggggauccuucugaguguugaccucccucuuaggcaaccucagaaaaguaacaguagccuauaggccaucagcaccuucaaauugucuuucucaguuaccaaauaauuuuggucaagagaacugguaauuccauauccucugugugcugucuuaguuuguagucaguuugguguggguggauuguaggauggaugcgagagauggauggauggaugauagauggauggauaauggauggauagaugagaaucucuacugucacuucagaugaaaacuguuccagcuuaggaucucucauuguuuucuuccuguuaauagcagaugguaauaugucuuucuuuuaauuuuuuuucagcaagaucuauguacguucuugauaucaagagccuguaagaacucaacacuggcuaauuauuuauacugguacgugaaaauaauuugguuuuguaucaccccuuugaacuauauuuccuaugcuguaagcacagaugauuuaagaugaaggccaccuccaagugccuaggugccgugcuccugccucccgucuccuagcuguguucacagaagucagugcaaucguagucuuucuaacgcuaaguuuucaagagcuaagaugcaaaugacuaugguggcccccaucucccucggugggucugcuuuccuuuccugcuacuuaaguaguauauaacacuuuauaacuuuucaagagugcauuuuuacguuauuuaccagacgacuagaaugcuacaaaaauagaaaauugaaauuaaaaauuaccuucucucauuuuaaacaugaggaggcugaggcagaaggaugcucuaacugaacuuggcaggcauugguuaggauagacacugccauuucuagaggaguccaagcaaccauuuccucucuucccuguguaguuaguuauaggagacaaggauaaccaugaugguuuacaugaaaacaaugagguacagagagccuccuuucuguaccaagguaguaggaaguguggccguauuguugaggacauugacugaguggcagcgaucccugggcuuguguacugacgugugaguccugaucacguuuacagaggaucuuagggcgcagccucuugggugagccuucuggaaaccugagcuguuaacuauagagaugaucucugacuuugucuuauacuuaauguguggucuuaacuuaaauggcgcaaauuaauagauguuccaucuaaaaauuccuuauuuuuuaagaaucauaagacuugcuguucuuaaggaacugaaaaugccgucuuauuucagccugggucugaagagccugauguuuuagcuugaaugaaacuucagcccauucucccuuucucaaaaagaaauggaaucugagcccucguaaagagcacagaggcccggucugcagaagcaacguugucuaagccuuuaugguguuuuccuaccauauugauaucaauuauuuuaauggcaucagucauuuucuccacuguaccugugaguuuuccacacgcccaauggcugagcugcuagaagcgaaauaucucuauguaucuacuucagcaguugaauguaauauucauaaaacucuauuccccucacaugaagcguugggaugcccuugaacaugcauugcagaacacugugguugguuuuaaguaccaguuuuccuucuaagaguucacuuacaaauucucaucuugccaaauugcuauuuugauuuaauagaaaccuacgguuaaugguuuugcauuccuaucugaauuauuuagugugcuucuguucgcaccauuauagaaaaaaaaaaaaaacauuuccuugugaaaagcuuaaguaaauagucaaagacucaaugacauaaaaauaacagggaacauaaaacacagacagcccuacuuccauucgucagcgcauucuaucagacccagacucugugugguuucccgcucugucucuaaugcacugaauagccuguuuauuuuuggagggcuaacuagucuuuccauuucaaacucuauauguuauguauuagaaauauucaucagugaaaaaaccauugauagugaugcuuggcuuugauacugcuauuuuauagaggguaggggaauucuaugagaaaucauuucuaaguuugccuaaagugauccagcuuccugugaacgugagccaagucucaguaaggacggaguuccagaugucugacaaaugaauuuaaauuucacucauugaauuaaauaacuuuauauuuaacugauucugcuguuuucuucugagcacccuagguuuacuuugucauuuuuccucccuuuccaguaauuucaguaauauuccugcuauccuaaauccuugaggggccacuaacugcacacacaaacccuuuaaaauggauagggucaauguuauaauacacagaguuaugucucuagucuguaaaugcuggcaucagaauuuauaagucugugcaguuguguauuuucauuguccuuccaguguguugaaagugaaggucaacucuguaugcugugauguguuuucucuaacuucuuuuuuuuguuuguuuguguuuguuuuuguuuuuuuucgagacaggguuucucuguguaucccuggcuguccuggaacucacuuuguagaccaggcuggccucgaacucagaaaucugccugccucugccucccaagugcugggauuaaagccaccacagccugcuuuucucuaacuucuaauaccuuucacagucaugagcgguagacagcacuccaugaaauugucacggaagagucagccuaguggugucaucuuauguugaguacuggauagguugucacauuuucccuucagaugacagcucuccaggaaacagcaugcagggcucaguagacucuaggguauaggugugagcagcaaacugugagaugcuuagacucugggucuuuugauccucauuugaccauggagaugaugcuuauguuuauguuagaugacucauuucuuacuuagcagaacauuggcuugaaauacuagaaauguguuuaauuauagagaucaccgugcauccucgagcccuggaagcuuuaguagcuguguacuuauuuaacacugaaguuaggggcuacugaguaaaguggugagcucuguguacauggccaugcccaauugugagugaguuugcuacuucugugcauaggaaaagaaacagaacguccaguggugcuggggaccaucggugaauuucagcagccaggcuuagccuagugugagcacauugaugauuuugaagcuugcagaucucuuguucugacaauauuaugugcaguugucaugugacugcgccuucugaaauaccaucauagaaaauaggaguuuucuuguuuguguccuggcucaguccucuaagcuuguuccauaagugauccucagagcucuucaucugcccuuuguaccugggaugaaacacugaagugugagucuaaucugauuuauuauugcuuuuguuguuucuugagacaaggucuuguuucaaagucugugcugguccagaagguagguuguaccugucucagccuuccaaagagauggcauuauaggcauaugucacaauaccuggucaauuggaauuaauucuaauuuaaagacaaucauguguuccaguugugguuguagauguuccauaaggcaucucuagucuuucauaccuuuauuaauuuuaguuuacacucuuguugacaaaugauauacuauaucuaggucaggguucaauuccucacagcacuuucccagaaacuccagaucucaggcacaucugcugugguauagcuuagcucugggacaagagagagaauaagaccuauuuuaaagcaguuaucugucuauaagaucacgucagauacaacagcaguuucugaaagcauuugagguaugacacauccaucaaugcuaagagcuaaaaguauggaucagggacagacaaggaacgauugucaguacaaguguccggaggaucucacuuagcgaggaaguccaggagcaaggugcauagacuucuuguaguggagagagggugggaggauggagagacgggcaaggacagugucuuuagcacaugcugccauguuuagcaaaucacaaaguugguguuuagcagcugagaggacugaccugccuggagucugagcuauacccaggcauggcgggcuugauccucgagccuggguaagcacaguuaggcuaagguguugaaagggggaguguugaugcuucugcuacuggagguaggacaacuaaguuacuuuaagagaauguguauguugugaaguugaggacuaagaauguucuugugagagcugaagacaugcgacgcuaaugugcaauuccccauaguggcagucugacuggugcagagccgucaugugcguucaguggacacaguuagcaggcugcaucgagugacugagcacaggcaugcuagggagggguggaggaccacaggcagagcaugcaucuggguauuugagucagcacuggguguguguuagcuaugggcuucugcucucugaugcgacugugucaugccucagcccuuuuuuuuuacccaugugauggagacacguuuccugcuucacuuuuaagaaaacuuaauuuuuguguauuuuauuuacuaugugaaaaauuuuauccuaaaaccaugaagaauuuauugauagaacauucaguaauuaaagaaagguugaauuuuauauuuuuuauuuaaaaauacuacacugucuuuuuuaaaguuucuggugcuugaaaaucacuguggaugaauaugaaaccgagcuauauaauaaaauggaaaugacaccuuacaugaaaaaaagauaucuaaauucauauuguagaauuaccauuauugagauuuugccuaaaucaacggcauugaagucagacagcgauaacgaucaugagccuucugggugggguguaguggagaagagaacacaugagcacuguagucacaggcaguugauccucuagguggcugaauggauucugcuagggacaguaucuauaaaggguaacggugugugucaguuaaggaguuucuaaguuucuggugguuuuuggaguuggcguagaguugaguaagcuuggcaggauagaaguaauucuuccgggaugcucaggguagagcauuugcucuucaagcacaaguuuggaucccaaauacggacauagaaagccaggugaguggggacacuuguaacugccauccuuggggugaggagagacacaugccugaaguugagcugccaguuuuccuaacaaaucgguaagcuccaaguucagggagaaauccucucuuaaggucaacagcagagucaaccucugaccuccauagacacacaaaugcaugucugcuaauacauauacguguuccugaacauauuuguguacaugcacauacacauacacauaggcaugcacucacacaugugcucacgcaugugcgcacgcacgcacacagggcuggggagggagcaugcguaugaauauauggauucugacuuggcaacccccccccccccccccagucagccaaaagcgcuguccugagaaguacguacacucucccgguguucacuguuuugagucagggucucauggaacccagggcagcacuuaguccucugcuucccaagugcuagaguuaggcuugcacacccugccucuucuccagguucacuguugauaaacaagcagguugacagaaauguguuuaucauggcccacugaaagugauuuaaagcugcucuacagcuuagcauugguaaacaagagagaaguaagaaauauuaagucuuacauaauaaauaauaagagaaguaagaaguaagaaauauuaagugccauagggguucuacuuuuuaauuaacuacaucuaugcuguauguuaugguuuguuacuaucaaaacauuucaaaacauguauuacguuacuucucaccucagcuuauuuauggaugugugguguuuauaaccauucaggaaauuuagauuuaggaaaacaauuuuauuagcugucuaaaacaacuuuuguaauagaaguauugaagauuuuauauggguuuuugagaaauggguagauuggauuagaaauuuuuaaaaaaucaauuuaaacuuugucuucuugcaaaaauaugucugagaaaagguagcuccagagggcuuuucagugcaagaacaccuuuuauugcccaaguaugaggcaggggaguaauauguguguuggguaguuacuugguggauauguaaguuuuacugacaaagagaaaaggaaggcauugcuguuuccagguauuucauaucguaguggagcaugguuccagggccucacuuagaaaaccguggagcuuagcauguugaugcuaucccuauugaucaucaugaugggugccugcuuaguguuaacuuguaaagggauggcgcuggaaggugucuuuacuccuccucggcucuuacagccguguuuuaaucucucuuaugaagcaguguaaguacugacaggauggaccugagugucucuucucaucaccccagcaucugaacuguguuuuugaagguaugugauaguggagugugaagaucaggacacccagcagcgggacccaaagacucacgagauguaccugaacgugaugaggcgcuucagccaagccuugcucaagguacucagaugcugcagcuggcugguuuaggguuggugagauggcugcucuccuggaggaccugaguucaguucaggggaucugacacgguacccucuucuagcccgaaugggcaccaggcuugcucaaucgugcacugacaugcagacaaaacacucagacaaaauaaaauaauuaauauauguuuuauuaaaaaaggagauugauguuucuggcacaugaaaauuugaaaucccaaguuuaguguuuauaaauuauuggaacuuagucauuuccuaguguguguggccucuuuguuugauacccaugggugaaucacuacaacagguuuuugcccuuaaauaucuaucuuaaauaaacauuauauuagccaaacaaugaguaaguccaugcucucuuaauuuuacuuuuucuguccuccuuuuucaucucagcucuagcaguaguucuccuguacauauuuugccugacuucaaaaaacaccuuacagggcagggccauuuucugcugcuguugcuucucuaaagcagugucuaugucuggccagcagagggugcaagagaaagaaaaacaguugauggugcuacugaaagauuuccugguauuucuuuacugcaucugcuguuuucuuuuugaacuccuuaaaaagcuaaacuacagcuugacacacacuuuuagacaaaguacaggucccagaguagugucaggccaacuaacagaugagccccgcagcuuaccccguuauagccccgcacucucucugagccuaagcguuuuaaaugggaagauacaauuuucuccacugcacuuuccaggcgacugugagcaaugaacuagaaagugcauuguguaauauugcaugaacugggaauuccugcauggaugguuucuguguacuaagacaucuacucagcaacuguuugcugcauuuggguuuuucuuuuucagggagauuuuuacuuaagcuuugcaaucaggaucuuuuuuagcaaguagaagcguuuuaggguaaauaaauccuguugugucacauggucauauacacuaacaauugcucaggacccagguaauuuucuacucucucuguugguugugcuuagccuagacagaggguuucucauuacuucugaaucaaggucuuuuucaguuucacuuugaagguuaggggaggaagagaaagaucccacugugaaagcagagcucauguccucacuuuguucccucagggugacaagucugugagagucaugcgcucccugcuggcggcucagcagaccuuuguagaucgccugguccaucugaugaaggcggugcagagagaaagugggaaccgcaagaagaagguaagcccacaguccaguccauugauguugccauauacacaaauuccauuguuugcuuccuuuuuagggacaguuucuuacaugcucuguaaccuccugucccccuaugaucagugauagguuuaaagccaugaaugagccacuaugccugacucuagaugaacuucuaauagguaauuuuaguuccaggagcccauggcacuggugaugugggguccugguuuguaaguuaacacauguuaacaugagauggugcugaaaggcagguuagaggacuaagggaucaguugguccaguguccccaaguguagugucaucuauauugcauugcugucuuuaucuuagcaucauaguuguuuagagauguaagaucauugacaugcacacugugagaaaacaguggaccagaguaccuugcagaaccgguaugccuguaugugugcucuggcuagcagccaucucuccuaagugggaagcuugcacauaauaaaccagauagcuagguaucuccucuacuuuaaugaugugaaggauuuacauggugucgucccuucuaauccuguaagauaaaaauaggcggauguuucuugguggcuuuugucaaagaccacaacccaucugagaaauauagaucuauaagaucaaagauaaaacaggagaaguugaauugagucaaacuuuaaaaggcaagaauuaaacagagagaugaucaggaacguuguucaucugaugagagaaggaaauuggcagagcagaaauacuuuuuuaucaaguuugcauuuuccuuauuauuuagaagaaucauagucauguucaaauaaagucccagugccauuugcccaucaccacauccugccccagagcucccugggugagaagcagacccuaguggguccccagcagugggugugccuguagcuuggaucuuugaucuuaucggccauucucuggauagucugaugagacuaggggugaaaccugaggaugaagguaaguaacagcaagacuuggacuccucagacacugguccacaccagcagucugccauccaucuuuucugaaggauuggucgugccccuuacugacauacagaaacagaccuguaccugcuaagaauugauuuuaaccucagaggucuuggaguccuacugaagggaaauaaucuuguguguggcaguccuuaaauauuuguugaccauagaguucuuaagugauucuagaacuuccuccccugaugcauauaucauacuugaagcacuuuaucucucuguauauggaagucugguuuuccuccguaaagcguggauaugccugccuguuuaaagaguacaagauucuggcuucaaagaaaauggauuauuugaaguuggguagaugagcuuuaguggaugucagagaugacuuggauugcucagauucucaaaucuguguucuauccaguacgucuaugaguuuauaaaagugagaaucagagguagugcguagguagcagcuuccuccaaauuaauuaaauuuuccucuuagauaguuaaaagaugcauuaggguagcauaauggaauauuuggcuaauauuuggucaugcaaaauuaagcaccaaauacaauuacccuucucuguggcuucauaaauccuuuugacaaagaaauugaaccuuuaaguuccacuugaaugucuauuccuggcucuucuucagcugcaguaagaaagugcauuuucugucgcucucgaaggagccuagguauucaggaggagguguuucuugaaggcaugcuguugcuauugcaaaguggauuauuuauuguugcauauauauauauauauauauauauauauauauauauauauacucugcuucacauucaagugacacacaaacauacauauucauagucuuucuuauauauaagcauuuuuaacucuaguaaaaucacuucccucuucccuugccuccuucucggcccucccaguuaccuucccuuuaucccuucacacccaccccacacucaagcguuacauauacacuuggugguguguauagggcuggccgcucugcaucggacaaaacuaaucagggggcucauucucuucucccaguaguaaauaauuaauugccucugguucuguggcuaggccugggacucagugaucuuguuuuucuuuuucuauguuaacauauccauuaaucuugcuacaguuucugucuuauuuacacaaccauuucuaggacagacuuuuauagcaggcucccuggugucacaacucuagcaauggaagcagugcgaccugggagaauggaaccgauaaaggaugcagacucaagucucaugcaauagccaacuuuauuccgugccucagacaacuauacucugagaauaagaaggucacaugagugaaguucuaaugauuucaagcuguacgcaucccaauaaguagcauguggcgaaagcaugguuuuccauacagacauaauugaauagcaacaacaaguaauaauuaauaccgugaaguuaacgcacuccuauccacuacauuuggaggaauauaagacacauuccaagaacaauuucuuguuuugaaggaagugggcucaugggucucuugcuuuguuuucuugguguuuugucacaaguacucagaacucucuucacgugaguccauuccuggacuguguuccagcaccugguauugguccuuacacuucuauccccucuucugcuguguucacugagccaaagaugcagaagcucuggugugcaugcauccacuggggcugggcuccccacagucaguugagcuccgcauuggguccaguuguggauucuguggagauugcuccguuuccuggaaggggaagcuuggaugagaaguguucuuaccugugagaauaaggagaagauuuggaauggagcaaagaacuaugcuggccuagcaaagaggaggucguugaugauuucuaagguggaugcccucacuguuccaggaaguuggugagguuuccaguggaggcaugguuuccauccuuuggaguaggcauuaagucagauugggugacaguuguugcuugcugccgaugggugaaugcagcuucuuggaccucuguucucguccugccaugcugguccuugugguucauaggcguuacaguuaggcaggaacugcguaacugccucccucccuugacagcuugcauuguaucucuuggaagcaugaaagcucggucucaggaaagagcuuugaggucaguucagccucaaggugaguccuguguccuacgggugugcugucucccgcaauaggggcaagggacagcaauuuuugacaaagccucuagggaccauauucuuuuuauuuuuauuuuuuuaauguuuguauuuauucaguucgcaucccacucacuguccccccgaaacucccuuccacaacccaccccccauauuccccuuuucuccucugaguguguggggccccuuggguauccccccacaaugguacuugaagucucugugaggcuagguguuuccugucccacugaggccagacaaggcaguccagcuagaagaauauaucccacaugcggguuuuggaauagccucuguuccaguuguucaggacccauauggagaccaagcugcauauguguuacauaugagcagggaguccgaggguccaacccuguguguucuuugguagugguucagacugagagccccaaagguccaguuuaguugacucuguuggucuuaggaaccauauucuuuuauauuuagcuaaaauuacauacaauauaucaguguacguggaguguauguauagcacauuuacauaacgugucuaugucugugugcguauguguuuguguguggauauguguuuaugugugugugucuuaaaaaucuuuuaaguacucuugucugacagugcucccuacaagagccauaaacuaacagaaccuucagaacaagacauaagaaacugccuugggaaggggcaggguuguccucgagacuuccuugguugucucuuggguggagggcaggcccucguugcuguaguuuuucagguacuuuuuugugcuuuguaaaugauguuaauagaaucaguuuuauggcauuauuauauguugggaacaauucucucauuuccaccucauugcuccucucuaauucacccuagaaugagagacuucaggccuugcuuggagauaaugagaaaaugaacuuaucagauguggaacugaucccauugccgcuggagccacaggugaaaauaaggggcaucaucccggaaacagcuacccuguucaaggugagugugaugggugagaccccguguguagucagggcagagcuaccaccauaagaguguuaugccugcguguauauguggguacugcccauauaccuggugccagcgggucagaagaaggugguagauucuauggaaccugaguugcagaugguugugaagcaccaaguaacuguugggaacugaaccuggguccucuguaagagcaaaaaguguucauaacuacugagauaucuuucuggccuguuauuauauuuuaagaucuucuguuacaauuauagagacauuucuaaagaaaauaugucauauuuuuaucuccggaacuuuauuuuuaguaaauuuacuucuuuaaaucguaguuagagccauauauauguuaaaguuaaugucaggacuuacauuauauauuaaguacauaaguucaaaggucuaguugugaggcccuuuuacauuuuuuuaaacauaucucagcccaauacucauucuacauacuuuauauuuuuuuuuuuuguuacauuuuuagguaguaguucucuuuacucuuuuuuuaagcuuuucauuggugcuuugugaguuucacaucaugcacugcaguccuccucaucuccccgccccucaucuccccgccccucaucuccucgccuuuuugcccuugcagucuccccaccacaaauaaaaaacagucaaacaaauaacaauaaaaucacaaaacagaaaagaaaaccucaucccggaagauauaguauuucacagugugucccacaguauagcccucugcccagugaaucauuggucuucuguuguuggggccgaccuguggcucucaugucuggguucgagccugggaggcaucuuggaacugaaagacaagagggaaucuaggcggguagagagagaaauggagccaagacaguauucuguucgagacucaaauguuuaaugauaaucuguacuuuauaaagagggaagcccauccccaaguuccuuaugaaguugucagaacugccuuuuagcaggaacugggaagaucuuggagaaccaguuuggccucaggcagguagcaggcaguggcacuucaaaggagagagaugagaagcagcacagcagguggcuccgccucaguggucugaaccagccuggcuagggagguuacauucugugacaccaucaauuuuggacccucaccugaucuccucccaguuauucuguuauuguccugaguuguggagauccugaagcguuggaccagcuagacuggcucccucacaagcuccauuuauagaugauacagauuuuggggugggccaacucagauaacuggaucugggccuaugugguagcugcgcuggucagcacgccagcucucccuuauccauucccccagggcaagcucuccagcacugcuccugcugggccacccauugcugccugagguggagguagggucugcucuccugcccucagggacggugccagcuccacucugcugcccaguuggguugcagggcccacucucccaagugccacagcuuagccugaggggcuaggccaccucucagggccucaggacugucuuacccaugcuucucugugauggccagcuccacugaguugcuaaggcgagguacagagccuacucucccaagugccacagccagugagggggcagggcuagcuagcucucaggagcuucugcauucagggccugcucuccuuacuacccggcuggcaagggacaggggaaggcaucaucccguucacacaggccauuucacagcaggugaguggccaggggcaggggccagcucucuuucacuguccucaggguugccucacccagaccaccagggucagcucugcuuugcugccuggacaagucacauggcccacucuccugggugccgccuccagugagagaugggagcagcucuucagugagggguggugucaauucugcacagccccuagacauccacgugguccccaacaguugcccugacauaucccuguguucucagugguacugugagacacagacauuugacacccacccugcugccguguugccacagacuuagauauagcccucaguggcagcuugggcugggaccucaccauggccccagguagcagggcugaucacucauaacagacagccucucccaagguucuaguuuguucucuguccgugaugcucaagcuuccccaccugucuuucuuucccuucagagcagcacauuaugguggcuccuauugcacauuggcugcaggcuggcaguccccugggugacauccucuguccacagugcacagcuuggcauggugacaagcgggugccuuuggccugccugugucaugcacucacaguuccugcaugguacccugcuuuucuuucugacagccaguucauugcuuaagguccuguguaucuguguggguagcugagaggcggcauucccuucuguacgcgguagaacuucauucauuaacuggcauccguuuucagucagugucuuucucuugcagagugcucuuaugccugcccagcuguucuucaagacugaagauggaggcaaauacccaguuauuuucaagcauggagacgacuugcgucaagaucagcuuauucuucagaucaucucccucauggacaaggugaacacaagucugcguuggcaggggcgucaccucgcuuuagaaacugcagugugucauguccauguucacagacccagaagcacuuguggccuuuacucacaaugcuacaaagcucagcagucuccucuugaccuugaccaagcuuauuuuugucacugcaaaguggcucuaauggcaagugggauugcgcaugccaguacaacauuuuuuuuucucccaagcuucaugguguugucagaucuacugagucagauuuuugcugacugccauuccugucucuggcuuuuagagaaaccugguuccccuuugccuuguguccgcccuuccuggcacuuucugucugggaaggugagcaugaagcauuaggaauaauagugacguuuauuggcagaguguaacauagucaaaauagauaaaaaucugucuuuucaccccaacagauuagcucacucuaacccugagaguuaauguguugcccguaagauugcuccugugucuguaugguaugcacaguauguguccauaugcagcgguguguguccacaagccugcuuccgauggccaucacauucauuucauguguuuuaucuuuuaaucaaagcuguuacggaaagaaaaccuggauuugaaauugaccccauacaagguguuagccacuagcacaaaacauggugaguuccuucugcauccugauugccuucuucagauuccggucaguaacuuugccuuuuaaauugaaaaaucauuaagaaaguuagaacgugugugagcuuauucagagaacugaaggcauacuggguuguccuucccaucuuccugucccccgaccuccaguucucuucccuuguccugucguacgccccccccuccuuguucauuuccucugucuucuuccguuuccgcaucuucccugucccacuucccaccucuuugcuuuuuacagugguacagggguguguuuggaagauacuugcacaugcacaucggaauaacacaccucccuaccuccugauuggcuguaguucauaggauuuuucucauagcugccugcacaguccuugggguguuucuguggcccagaaagucuuugaaccauguuugcaaaagucacucggugagucuguagucagcugcguuuacaguauggacacaugaacacauaugcacgcauuugagcacacacguaacacguagguguuugugguacugaacagcacuuccuacgcgcuuuacccucccuuccucucccacaccuguuuggaggugucaggaggacacccuucagccucuccuuggaacaaaauucugaaagcacaguugagggguuugugcccuugugcuuuucugcagcaguuuauuucucaccuuuauuugcuccugggacaaagaaaaagaggaggccaccuaagugaguugugaauugcugucaggccgcugcaucuguguccagcucuuucauggccacuacccugcuuucauaaggcuuugguuagaguggauccccugggcuucucuaaggcucuuucagaccgagcuuuaacggugugggaucucuaucugccccuucauuuccuagaaugcgucacccgguacugccccgcuucuuaaaagcauggcccaauugcauuguggccuuugauuucuguguaccuuggaucucccuucccaacuucauggucuccucucauuuaugauguuuauuuccguaaaacuugagcuuuaaguuacguauuuggagauaagcaucuugucuuucauaugugccguaguucauacuacaugauagaaaacuaauacaugccuguugaagugaguagcuguagcuuuucccucucuuuguacucugcagggacgcccugugcccacaaggugucaggaccaccgaauauggguccuguuugcugaauccagacaugcugccucacucacucagauuugcguguuuguuguuuauacucuucucguuccaggcuucuucuuacucuuacuguuuuacauacugcacccuucugggucuugguuuugguguguuguuguuguuguuguuguuguuguuguuguuguuguuguuguuguuuggugguggucuaagggguuuacauguuccucucugcccuucaggagaugauagaagguagaguuaguggucagaacuccacauuucuuagagggauuuuuacauuuuuacuguuguuaauuccucuuuguuuuaaaguuauggaaggcugcuagguuugagaaauauaguuuauuuguguucuuugugcuuauagaaacgcauucuagagcauaacauaaauaaaucaaacuaguugaaaaaguugccuaguaauucugugaccagcauaaaguuggcacaguggccacagaccuugcucugcaaacagaagagugcauggcuacagggcaggguaugcccaucggagccuuggcuucucuggcuaggcagcccgguggaguggagagcaucagccuuccugaugggccuggguguggcgagcgugguguuuaaugcauuacuauuucuuuccacguaggcuucaugcaguucauccagucgguuccugucgcagaaguucuugacacagagggaagcauucagguaaugacgucaucacggaauacucaagguugacgaagaaggacucuguuaaaagucaagacuccguuuuucuugucucugcaagguuuuguuuccuuaagauauaagaauuguuuguaguugaaaguuaugcuguuagucgguggaugcccaagccuuugaacugacauagcuaucuauaaacacuuaacacgaaaccuccccucccccauacgccauacagacuaaagcuuagaguuguguucuccuccaaagugcagauauacuaucauuuauuuagccaauaauucaugaacauguuuaguuauuuucaauguuuauucauaaaaccaguuuacaccaaaauuuuucuucaaacauccuuuguacaguugugcccauguuguggcaaauuuugaauuuggggaauuuuuuucuauuuuucuuuuuagaggucuuguaggggaauuaugcuuauuucauccccucagaagaaagagcugucuuccacaucacuuugccauuuuuccauccaaucccgcuguacgcccuuucccuguggccacacuagucguguccucagacugugugcuugucuguggaguugcuggaguaugcugccuuugaugacaguuugcugaagcaaagauuuccccugcugaguccagccaccgcugauguuuguagguagcuuagcagcucaugugucauuuauuuuuagauuugauugaauguaaagguugcguucacaguagucucaccuuucuaucuccaccccugaguacaugacagcgcccaucaggaagcucuugcaggcuccucacaaugacauuucuagcuuucggagucucagugcagcuuuccucugucuuuucuuugaagaugcaugugauaguccucccgcagagugcuccuucacaucacagcgcuccucuggggauguuugcauuuugaucaguguguaugagucaccacauauccuagauacagaucuuuccacacauucaugcagugucagaaagcugaaaacagaaggcugauucucaggucugcuacggaauucccaagucauguuguguguuuaaggcucccacuagaaagggcuucccuguggguaggaaggaaauaaccagaucuccaggcucuuguaacagcauguauuaccgagcccugccauugcuguguuuauggccucgaacuguuuuuugacuccauuuuaaacuagucgcuuuccauuacgcagaauuggguaaugccuaacuuguuuaccuguguuaauuuguaaacauguauaucauaucuuugcagaacuuuuucaggaaauaugcccccagugagacuggacccuauggcaucagugcagaggucauggacacuuacguuaaaagcugugguaagcguuuugggguguugguuuucugugggugcauuugagggaagcugguaguacugauguugcuguauuaacucauaauuacaacauguuacgauuuaaacguuuuauaagagaaaaaguaaaagauguaggugguaaaaggaauccguggacuuuugaaauggccauggugacaucugacugcuguuagucacagugggugcaggcucccucucccucacuguucucccaugcaggagccgauuagccccaacugaagacuuccuguugggaaccuuuaucauuaaaggagauggaaaaccucagucagaaauaauguucucauuaaugcugagcagcucuagcaguggcucucauggccuuggaagcuguuuguucucggaagaaaguaggaccaugcuuuggggcuuuuuauacuuuccugucaugugugucagucaccaugcagcuuauauucaugagcacuaguuuccuuuucuuuaagacccuguuguauaaugauacuuuuaaaggagggauuaaauagagauguaaaucagcuaguuguacauuauggggugauuggcaguuuaccuuauauguauuuauuuagauagucaccuguagcauaucaguuucaaugacaaguucuaaaugaguauuucagcuaagguucaugaaucuuaaguuacaaaaauaaauaaauaaauaaauaaauaaaaccccaaaaccugauaauuugacaaaaauucuugaagauuuguuguuguugcaaauuaauuucucuaguguucaggauauaacagagccaggggguggggugcagcuuccuuaaguugggggagaaauuggagacaguaaaaaccacguaggaauuaaaauagcaccuaucacucucauggucaauaugcaaccuaagugcugaguguaucuuucccacccgcuuguuuuccagcuggauacugugugauuacguacauucuuggaguuggagaccggcaccuggauaaccuuuuguuaacaaagacagguaacaagucagaagaagauggauucuguagugggggguuuccuuuuauucuagaaucaaccuauuaauauaauuugcacacuuauugguaaaguguagguccucuuaaaauuucuaauucauuuucuuucuguaugcguaugugcaugugguuguacaugugccaugguguauguguggaugucagacgacaacugucaagagccaguucucugccaaccaugugguccagggugauccaagggaaguugcugggcccauguggaaagugccuuuaacugcugagccaucucgcugagccaagguuuuucuuaagucccuugaaauggggcacaggaaggacacuuaggggaagcccggccuguguaagagcauguuuacagggagccugugagugacccuggugccccacucugcgcucggagccucuguagagagcagcugcuuguaggcagccagacgcuuaggagcaucucaggcugaauugguccuucuccugcuccugcccauuuccucagguuacaacuaucucaggguuuucuccccacagaggacaaggaauagccauuccuuucucccuucugcaugacaacuuguuugcucugaaaagauuuuucuuccucagccuccgagguacuaggauuuccggguuccagcccccaccuggccuuggcccagauccuuauaugcaguuucugaaccugcaguucuacaagucacucuguccauagcuucagcuuggaauagccacuuaagcuagcuguccccuuccaugacaccucccugcagccuugcucuccccucccuucccaucagcagguaacagcccagucccugaagccuccugcuccaccucacgauguuucccuuguuagcaaaucuguuccucaccuccaggaccugucaauagcaugccagcucuguauuuucacugucccuuauugaagccaccaacauaaaaucucccacccacaucucugucuuguuaaaucacugcugccucaaggcaagugcccucuuuccagaaaguucugugcucgggucucucuagggcacacuuugguuaccgucucauaugacuuaggauguccucagcacauccgcaguugucugacgucugccuuguccucugucacucuguacuuaccacuucauuuugccuuuuugauguugguuggagguguuuauuuacaccagcagguguguuuuaaguaccuguuagaugcaaggauccuuccugacugcccaucagugaucccaagucagcaugcaaggccuguggagcaggggccuugucugucagcagcaugucuggagagcggcagaaacacuuaacuaagagaacaggaaggucguuuggagcaauugaguuaaucaucucugcucuuccuuguaguccuuucucuaaaauaaguaaucaaaggcccauuaugcccugaacagggaucuuauaccauaguagacauucagagcuuuggguucucuguguagcugcugucucucaacaacugaugcagaaugucucucugcuucucuucccauugccagcguagccaaggucaggggaaugcucugccaaugacaguggcugugcugugcguagucagaggucccugucaucugauugagaggccaaaggcuucagauuaaauucgcagaugucgcggagaauauagaugggccagagaggaacugacuguggacucuaggcauguggaaauaggucguccacuuaaaguggaaauuuaaacauguguguaaaggcaaugugcugagaccaggagucugaguugacauucaucccuaaauuuccuuucuuagcuugaguacuuuuaacuugugugcaguuucccuaguugugcagcagggggcacuguauauccaccauuaaauugaaggcuuuaucagaaggccuuguagucaauuauaaggauuuuuguuuguuuuugguuuuuguuuuguuuuaguggguuggaauggaguuucacuuguuauugaauuauuaugcuauccuggagaaagcaggaagcugcaaauuuaaacuggcaugagauugagaagaggauuuuuuuguuauucagaguugaugucuguggaugaaaccauaguuuagccagggugaccagucaugguaggacuuguuuuaguuguugaucuauugcucugaugaaauaccaguuaagaagcucuuagaaaagaaagcauuuaaauuggggcuugcuuauauuuucagaggguuuuagucuguguccgucaugacagggagcaugguggcagggagcauggcacugcagccaggaccuuauuauaucuugaucugcagaaagcagagaaagagugggccuggcaugggauuuugaaacuucaaagcccauccacagggacacacuuccuccaaacaaggccacaccuccuccaacaaggccacaccuccugauccuuuccagacaguucuacuaacugggaccaagcauucaaacauaagucuaugggaaaaauucucauuauaccaccauggggcuaaguuaaauauggcuuucaaugaaucauuuuuauaucuaaaaacuagaggcagguaaucaaaauaacugaagaacuccuuugucgcuuaugauauauaauauaauaagccacagaaaccauaguuuagccagggugaccagucaugguaggacuuguuuuaguuguugaucuauugcucugaugaaauaccaguuaagaagcucuuagaaaagaaagcauuuaaauuggggcuugcuuauauuuucagaggguuuuagccuggaugcucggggucuugacuaaaugggaacacacuuacagguucucaaauagccuguccacuucugagaagccaguggugcuuguauccauuucagauccucaaagugaccaguuugaguggcacuggacacugcugaccuaaagggacaguuauuuaaaacaucuccucuauuauucuuaaagaaaagcugacauagcaguucagguaucugucucugaaguacgucucaggacucugggcuacuuagccuagucugugccucuuagcugagcacaguaagccuagauccuuguguuugugugcuugugugaggagguagugugguccauguguguuggugcuguaagcacuauggacuucccuuagggguaagcuguguucugacugagcuaagagugcccuuuuggcucauacugauaguuggaugcauaauuuuaaagauaagaaauuaccugauauauuuugauauuuccuuuuaucugcagcauuuuugaaugaugcuuuaacaagaacuugauggcuuaugagaaaauuauuuauucugauuauuuaguguuauaauuucuauguaucagauaagguacacuucgauauuucaaaacaaguagaguguuuaauuuuccuuugucgggguauggugugauuuuaagguuguuuuucuuuuuucuucuggaguggaacuugacuguggagucagguauacuauccuuguuacuccugguuuccuuaguuuaaucuuguuguuuuucauaagaagcucuucuuagguuaaaggggaaaugauuagcagauuauuaggaugucaguacugauuugaauuuauauauccaacccuuuguuagaauuacuguaaaagugguuccuuggccuuagcuggcuaugagacuccauuuaauaaacaucauugguauugcuacauugcuuauggugggcgugcagcuggccuaagucugagguucuuuacaaugguaucacuuugggcgacauuuuuguuucugaguuuacugauaaaacaacaagaaagguauagucacauaggaaagaaauaaaggaauuaaggggaaaugguaaaaugguugucuacagaaagaagcugaacuaaccauggaauagagugagagaggcagcccuacgguugggauuauaggggaucuuaggagguuagaauuuucagagcaggagugacagaagauggacagggagcaaacgagugggaugccaagcagggugggacaaaguaaaaaugacuuucagauugucugccauuaaauguuuaauuuuaguaaugugugugaaagaauaacaauaaaucaaauuuguaauagguuggugucacucaaccacauuuccuuagcagcucauuuacuaugucuuguagggucagaggagagaauuaccaugggugacugguuugcuuuguacacacuuuacugcuugcuugugugugguuaugaacgcgcuucuugaauuucuugauuuuuuuuuuuuuauuuuauaaggugcgcuuuuuaaauuuucuuaaaauuaauauccucuuaaaauacauggcucuuugaacuugugaaauucaacaacgguuucacuguuagaaccuacaauccaugcaauugagucguaaccucgaccugugaauuuucuugcaagcacugauaaacagcagaccuuggaauuccagcaguacuuauaaggaaaugaagaacuuggacaaggugcuccuuagacaaacgaugacacugguugaggagggaagauggggcugggcaucugcuccacugugagucccaggagaaaugacaccaugaacauguccauuuuuucgugacucggacagucuuuaauacugugugcgucccaucucuucccccuccuagguaccauagcuaccauaagagcagagugccuggacacaggcauccuaguuaggcagagggcggcacucagaggcuaagcugugacauucuuaucaugaugcccuccacccuuggauuguaagggauuaggaaacgugcgauuccauugagcuggacagguuccagcucccuuauuuugcagcagauugucauauuguuugaaaaauagccauauuuaagaaguuuccaaauccuuucauccugcuuggaggggaaggaagucuauuuugggauucuuaaaaggcggugucuuuuuguuuuguuuuagugcuggacuuaaagccuugggucuuuaaaccucuaugcguauacucuaccaccaaaucccagccucuaaaaacuuguuugucaauccuaagaguuguuuuuaugucaaguggagaugaaggcuucacaauauacaacacaaauuugauauugaugucuuguaugaguaguuugacauaacuauaaaucgauauuuauuaaauauuaugagcuagugaaauuuaauguaaugacauuaaugugucagugaauaugcuauugaaaccaugugccguccagugugacgcgguguggauuugggcagaucugucccuaugaaggugcuuagguguaugucacaugaaccccuauagauccacugucuguuccagucuugccgaaugacuggaaugaagugcaaacugucucugacucaauauaagugauguauagucauuaaaaaauacauuuugaauguauaguuguaugauccccucauuuucuguggcagcagcaaagagccacagcucgcagacaucugugugacccugagacuaagcaggugguccucugucgaauggguggcugccagagugugggguuggccggcuggguucagggagugaauuauuuuacuccucacauuuucauuuuaugguguguuugcagauuuguaaucauuauaauugaaggaacaucuggauaacuggccguucugucaguaucauuagcuggaaacaucuagaauggccgugcuguagauaaaacccucagcccagaaaucacaaggcacaucaaugcaguaaacagcaccauggcauucagauggacucggcugucucuuuaauacaagaucaaggaagggaagaaaggcauucaaagcaucuccuaaugacucuccagccucuaucagcagcauuuaccauugucugggcuauaaccggaauuaagagguccuugguuuaauaaaugcaaaacagaugcauugagaguuccugguacuagggauuuuccagguuucaggauagcaacaauagaauauuacucuugauuuuuaacuuuuauuggcucauuguaaguagaguaggggagaaagaugagugaacaagcuuuaguuuauaggcuuuaucucuaaugugguagcaacugcuuagggcaagucugcucugcuguagccugcagagcucaugagcuguuaccacaacugucuucgaaacaaagcaugcucccuucucuggggauaucagggugucuuggucuggaacuuaguccugucauuggcccuuuaaacaagaaauagccauccaaaaauaaaccaguuccugcauaauuugaccauuucuguauuuauggaaaggcuucgugugauggcucaauaaaagagaagcuugcuuuucuguguaaguguuuuucugugagcgcuguguguucugugaaccuuaggguaguucagauaaccauccauuccucccuggccugcucccucugcugugagguuguuccucagaccugguguuugcagcugagcucuucaggcacagucuccuuauuccuuuaccugaaaauguccagcuuaacuaaucguuuacuuuguucuucggacaaagaugcuaucucagugagggucuuacugcugugaacagaccaugaccaaagcaacucuuacaaggacaacauuuaauuggggcuggcuuacagguucagaaguucaguccauuauuaccaaggggggaacauggcagcauccaggcaggcauggugcaggaggagcugagaguucuauauccucaucugaaggcugcucgcaaaauauuuauuggcuuccaggcagcuaggaugaaauucuuaaagcccacacccacagugacacaccuacuccaacaggaccacaccuucuaauaguucuacucccugggccaagaauaucacagaugccuaaaaguuacagaaagggagguggcaucucuguaucuguaucuaauuucugucgucuguaaucuuagguacagucaaccuucgacucucagacaucuuuaaagugguuguuauuaacauuuuauuaucauuuauuuauuggccgacggugcaggugaaggucagugaguaaauugcuggggucuucucuccuuuccuccaugugggacucggugaugagacacagaucgacagccugccagcagauacguucccugcugaucagcuugccagccucaagaguuauuuuugagagaaguucagaguuuaauuuuuacauguuauuugaaaugcuuaaauauuuaugagcuacuugaagagacuugauuauugcaugguaaauggcuugauuuaauuuuaaauaaauccuaucauuuuaaauuguuuucuucuuuacagaacaaguuaagacuuuaaucaccccugccuuaaggguuuuuguuuguugguuggauugguaguuuucuugauaaucuccgugugucugugugugugugugugugugugugugugugugugugugugugugugaaugauaguggcaacuggccuuucaagcauuuacugagugcagugccagguacuguguuacaguguucucucuuuugauucuacaucugagguacuuguuaauuauaguugacauaaaggaucuaucacuguugcauaucuuucagggagaaugcacuuaacugugauauacacaauguguauaugacuucagugacuguguauaucaaugugcaaugacugcgacauauaaaauauacacauuuacacacucuacacaaugagugugacagcacucaggaaaagcagugaacaggaaggcaugacuaacaucuugauuaggaguccguguggaauauuggcuugcacagggucccuugugcucaugagcaauaaguuuaguacucugaggcagggccgguacccuugaugggaaaaauaaggugauaauucugaggcugcaaggaacaaaacuuagccccaaggcucugcucugagaauucagucuagagcauccuugcuucacgcagccuguaaaucacuagaugcuucaugguuuccauggugaaucaccacuaggaucccguuccuguggcucugcucugagacaguguaagacuuuucucagaggaauuacagcucuuggcaguccugaauaugguguucaaauccccagucuccagcuagggaacagguagaggaagccaaccauguaacuugaaauuugaaggauuuuuauuuuguagucauaguuucacagcaguaguuauagaaagagcaguuuaccugaccuuaauacacaagacaauuucuuccgaauuugcugcugccgauucuuuugaaaguuauuuggguguaugcuccuugauucugcacuucuaaaccugagcuuuuaucuuuuaauauuaacuggaauggcuuuaagguuuuuuucuuucucauguccaagaauugaacugcacuguacuuugaagggcauguuugaagguauagaauaauuuaaugaauuaaucauucuuucucaaaaaggcauuuugaugaauuguauaugguaucuccuuccugguuugcagugcuaacgacugugagacugacugaguuucuuguucacacccaggcaaacucuuccauauagauuucggguauauuuugggucgagauccgaagccccucccuccuccgaugaagcugaacaaggagaugguggaagggauggguggcacccagagugagcaguaccaagaguuccgaaagcagugcuacacagccuuccuccaccugcgaagguaagguccugcgcuagcuguccacgugugcugcuggcacaucuuucucagaaagacaggaugcuuuugaaauacacauuugcuacauagaauacaaugccaguauccaagccuauccugcuuucccacugacugucacguguguaaccucccaguugagaugcugguguuuugugagugggagauuuggcaaaccaagagaaguuucacuucacccuuuguccccggaggcaguggagaugagcauggcagccacggcaguggcuuagggacagucgugauacuccagccguuucguuuucuagcauuugguccagcccagcuuuggaugcuguucaggaccauccagaaguuuccuuuuguucuccucacugccucguggcucacgcugcuuugaagaaggcugauuucacucguucuuucuucuucggugucacucuuccaucuuucaucacggcuugauuaaaaacacuagaugacuuauguucucaggagaaaaggcaugcacuugagcaugaacagaacucugacucuuagucaaaagugacagaucauuggacucuuaaccaccuaacuaugcaaaaggaauuguccuagugcagcagaaauucuaucguaagacaugccgacauucucuccgaggaugugaggagggcggcugcggccagccugcauggucugugucacuaaccuuaccauguucuuauaguauuauggcauccacaaauagcagcaguuuuauuuuugauuuguacauauuuauuucucuugccuuguucuguuaguuagagcagcuaauacuaauuaaacaagagcagugagagcaggcguuccuucuuggacccuacuacaguauuuagucuuaugaaauuaagaacaaugcuaacuguaggguuuugcuagaucuuucaguuuugucuauccugcagugagucauguguuaagcggcacuccuaggggguucuauagacuuuuaggaggaaucuuuaggugauuagucaugagcccugugacccugagaaagagggcaggcaagaggucacaugcugauagcuguauggaugccugagaacgcacacacugaaagcagaaggaaucagugugcuuuauaaagugcuaguggaccauuggcagcagguagguagagugagaaaauagaagcaaguuacuaauguagagcugagguucugccgcagaccagccucggucgcccccccucaaucugcgggagauaucaggguucugguuacaggcgagcaaggaguuggcaugggugacaaacagacauggacacagaucgagaguguaucugaauuaauuucucaaaagcaagcacuagucuuauaauaccgaagaaaaacaagaaagcuaggccaauacaucugccaagguacaucugacacaaaacaaagaaaauacguacagaaaaagcuagggggagcuaggccguguuuacaacugagaauaggaacaacccuuaauuaagaucagcuaaacacaggagccaggugaguugucugagacuaugcuagucuauuguuaaacccaccaccagggguccucuaguaaauaccugauuacgcuauucuucugggccuagugaaaaauaugcaccagaagaauucuguucuacuaacccuuucaugaauaauacuucaguuccuccuaaaaccacaacccaccugcuuccuaggccauuguauauuccuguguauggaagugacuauuguucuaaguaauuacuauguagaccagcccugagcuuucuagcucuauucaaguaaauuguaaugccuguuuacuuuuacugucucuacuagagguaaauuugaauguuacugaauagauaacauucuuacugaauuccaagcucaggguuggcuucaaggacuuucuaggacauugaaacacugauggaggcuaaucuaacuuagcuauaugucaaaaucaguccuuaaaggcacuuauaauaaaacaauauugagggagagcacacagauucauacaccagacuaacguggggacaggauuggagcauacgugcuauaggaaugccaaggauccaggaggcuaaguuuccaugaaacucuuugucucaggacugcuuccaggcuucuaggccuaucccaugagucacuacuggaguggguguagcaagguucgcauuccuucuaagaaauaccacaaagacaaucaauggaagggaaauagcaucaucccacgagucacucaugagaaaucccagggagucgaacaauaauuucagcaagcaggguguauuaguuagggcuuuauugaugugaacagauaccaugaucacagcaagucuuauaaaaaacauuuaauugaggcuggcuuacagauucagagguucaguccauuaccaucaaggugggagcauggcagcauccaggcaugguacagaaggagcugagaguucuaugucuuuauuuaaaggcugcuaguggaagacugacuucuagccaacuagagugaggaucuuaugcccacacccacagugacacaccuacuccaaccaggucacaccuauuccaacaaggccacaccuccaaauggugccacucccuaguccaagaauauacaaaccaucccauacaguaacgagcgaaugcuuacgccugcugucuuggaguuaauaauaaucauaaaguuacaguugucaccacuuuugggguguucuugauaaggcaaagaaaucuaaaauucuaucucacugauuucauuuucuuucuugcuuuuuuagguauuccaaucugaucuugaacuuguucuccuugaugguugaugcaaacauuccagauauugcucuugaaccagauaaaacuguaaaaaagguaauuuuuuuuaauauaacacaguucacauuugacauauaaaaguggguaaagaauuuaacagugcaugccuucuuuuugucccagcccuuggaccagugguucccacccuuccagauacuacagccuuuaguacaguuccucauguuguggugaccucccaccccaaaauuacaguuguuucuacuucauaaugguagcuuggcuacugugaugaauucuaauauaaauaucagauaguucgcaggcagaucaggguccugagcuacagguugagaucuacugccauagaccauugaguauuaacagagucuaaggaagaguccucucuguacauuuagucacauuucagaccagcaaacucucagcucuucuguggcaauccuggucaguccugucuggauucaucucuguacccauguggguagcuccaccuuugccauugccaacaaaaugccugacuugguggaugcagguggaacaugcugaggcugcccuaucauggagaugaagcugucucuauagccccauauguccucccucuguuuuggacuuuacuggaucacuauagagcccugcuuuuaguuuucuuuguaaacaaccuauagagaugacagguaggauccgccaccugugagcagcagcagucagcucaaugucuuaacgagacuuggaccaggccguggauuugaagccuuuccuuuaaucugauuucugguaguagcuucagaggagagcugauagaagagugcuuuauguauccaaagggaaaaagaugauugucaguauucaacuucagagaaagacugcagcauauuaacucagaaaagacuaaaaucuccgaaagacauucucuaagauagagcuagcugcucaggauuuaaaaguggaggcugacaucaacagauccuaugucuaauggaauggacuggagaauuacguucagcucuaacugagccagagggaggucaguucuucccuuagguggcuggcuaagaggaguuugaauggagguauuuuauuuagucucuucaugaaaugaacuccuaagaguuccuguuuuguucagguggaugacacauuggccuuucuguuuuucuuccuuuacccagucugcacuauucagaggaauuguguuuugugccagagaagauaaccugaguagguccugguuuuuguccuuuuauuuuuacuuuacugaugagggccacccaucaggaaauauaacugauugaugaaaauuauugaguggugaaggaugccugcaccaggcuucaagugacuuggaguucuguuuggaucugcucuauuaaguaucucuuccguaguguguuucaagcuuguuuauaugaucuccaucguguucacucuucccugaguguggacguucagaagucaucugugagauugcaggcaguguuuaucagacagggacuagacagugguuucauuggcggugguaccuuuggccguuuaagcuguaccauagacaguggcauccuuggccaguucuaguuuucacugcauccucucuugugccaccaccuauuccaagaagucacagggcuuccuuaccagauguccuuacagugcuguuuuaaagcaugaaacaauucccuuuaugaaaaaugagccaaaaaagcaaaucuguuagauauuuucuagacuaguaauuccuaccacuuuguuucaguuuaauagaacuuuaaaaagcauuuugucauauuuuuucaaaacuguauuuuauaacagauggguuuguuuucugaucuuuuauccaaaugugaaauacccaguuacaacacuugaaauuuaugugguaguugacuaaaauuuuuugcauauuaggugcauugcuucuuugaaaagacguagauuuuugcugagguaagguggccaccacuauuuccuuguguuauugauuaaauaguauacuagcuaugggaacacagaguauauaagaggcaguuuguucacaggcgugagggucagauugcccaagcgguccuaacauuuuguguuuagcuuuguauaggaaguaacaacuuuuauaauucuuugggaaaugguuccuugcacuuaacaguuuguuauucagacugcugugccuggacacacgauggcucugaaaucugaaauggaguuaacagggcucaaccccuaaauaugggccuugcccuuuaaugaagcagccgagauaggaaggucucugguguggaccuuccagaauucgcugaucuucaucuaaaguaagccauaaagcccucaguucagaaagccuaccacaaacugggggauaaggauagaaaugguaaggaagccucagggugcucccuguccucaucaggcuggagaggagaugcauacagcugcuccuguuccugggucaucacgcugugaaggaggaaaggguucuaacguuaccagaacauucuuguuuuggauaaacaugugugccuuucuguuaauauaaauacuacauguuauggauaaacgccuacauuccugaacauuacauucaguaugaacauuacauauuacagauacaugugugucccuuucuauuacuauggauauuacguuauagauacaugugcgcaccuuucuguuacugugggcuuugcacaaagguuauuacccugaagcuugugugggaggcucccucuaccugcaagccagaaguuaagcauccuaucaucagcguaaacagaguaccgaguagccaugggucagucugccaaagaaagcccagguagaggaaaagcucacucaaagcugucauaauucuuucaagccaguugcucaaagcugucgucauucucucaagccaauuacuucgaauaaagacugucagauaguuuaauaaauaaaaaaauguauuuugauaaaguuuauuuuguuauuaauauaaccaaagcuuagugaauuaaauuccagcaaugaauaaguagauccuuaguugauuacauaagcauaauaugcuuauuuaugaauauuaaaauguaugugugaaauacugaaaucauaugaaaauaaacacuuucggaauagcaagaaaguugaauagguaaaguuauuugccauuaagccuguugaccugaguuugauccccaaaaccuaaauaguagaaggcaaaaguugauuuucagaaguuaucgucugguuuucacagcugcaugcccauacacacauacaugcacacacagaugugggagugugcuaaaauagguaaacaagcaaacgaacacacaugcacacuaggaagcugaggcagguggauuugaguuccuagccagugugguuuauauagcaaauguugugccaugugggucacguagcaaaacaguaucuuaaaaaguaaaaagaguauguaaauugaaaacuaaaaguauaaaacaccuguaugcuguuuggccuguguuaaggaccugauguguguagaucugcuuuucugaagugagcauggcucgccugcaccaggcugcuccagcgcuccccuucccauccccacucccuguagacugugagcagugcugauuuguuccugagguaguccugguguuugcuugaucaagauuaguagaaaccauuucccugugccagggaaccuaccuuguaaucacagaaucagacaacaaacagaauacgguucguaaaguuccaacuuccuagacggugguggaugcuucaggugagagaagaggguggggcagcacacugagcuggcaguaacggugaugugagguuagcugugggagagacacaaagucuuggugaggaaauugggaggagacauuucauaagcccacagcacugagaugaaacuucuuacuacagaggcgcacaucacuuaagcaaaacgcguacucccuaacaggccuuagcuuugugacuggggaugguagguugaaaagaugaccuuaucuucuaggaguuugaaauguuuguuccuagcuuuucaaauguauagcuguuuuuaguuggagggagaggacaccaaaguggagauauuaauggauucgcauauaaacauggcuuagcagccuuguuccugcucccuuuauugccauaauuaaagagaaaccucuaaauucugaugcugagccuauuccagaauuuacgguacuguuuucuaucggaggauuuaauggagacauucuuucuuuaaauugauuuccuacuaaacuuuaaaacaaagaaauuauauguauuacaagaagccauaaauagaugacuauauuugagaugaccuuuaaaaguaaauuacccaugguuccugugagguugcccauggcuccugucggaucagccugucggcucugcagcacaagcucuuuugcaguuugggaggcugucguuggcuuguacagcagcuccugucuuuguaagcaguuccaggcgcuggcucuccuguagccacgguuagguggggauuggguuuuccuuuuuuuccuuuuuuccuuuuuuuuuuuuuuaagauacucuuuaaauccuuuucuauuacacuaaggaguuuuggguuauauaucgcacaaauaaaugagcucagcagaaaaauaaguuuaagccuguccuuucuucuggcugagucaacuguguuauuucaccugccuuucuggauaagaauuuagugaggaaaagucuacauugcuuuuaauugaaagcugcugugugugugagaaauccugaacauugguuuuuuaaacaaagguuuuucuauauuagcuuguguaaaauugaaaacauaaaaaaauacuuaguuuaaacaaaaccacugugcuucuuaauaugaaaauguguuucaguaguuuauuggaaauuuccuccaaauugugugugugugugugugugugugugugugugugugugugugugauugaauauggcaaacuuaggcuaauucugguauaguacaaaagcuuuuagcuaaucuauagauguuauuuuauuagauucacauuuaauuguucucuauaaauaaaagacagaguuuuauuguuaguaggaacaggggaaaucaugucauuguuuagagauugcuuauacaaauugcuuguguggccugaugcagguuagcgggagucgaaugcuuuugagguugcuaggugcaucauucggagagggaugugugcauaucccaugcaggcaaagacacuaggucuuuaacuguauuaugcuaaagggugacugcauaaagaggcuucaugguuaaauaucuccuacguuuugccugccucuguuggcguuugugggcuaggacucuccacuguuacaguuacuggagacacuguuagauguguggcccgcuguugaguagaaugucaguguggcacagaacuggaccuauauuggcuuacuuaugcuuuuggagcguuugagcaucuguuaaugguaacgucgacuccucaaagcguaauuauccacugcagaaacguuguugcugccuaagugacugucuuagagagguugcuuguuucuugcaaguaagugguugaauggaucugcugugguccaggucacaaguagauuuucaggaaccaagcacugccugcagucccaaaaugaagaaacacucugaaugcacagagucuuuuccauguucucauauaacucccggacugaccguuagaggacccugauucacaagugaccaagaaugcaaguggcacuuacaagacaagguacaaguacacagaacugaguuucuagcaucaagcauaagcagacuuguuguguagcaguggauaaaauuucaguuuacaacuuuuugcuucuaggcaauuuccagauuguuugaguagguauaaguuaguaaauaugcuuuaaacuaagccagguguucagcaguccuuaguguucaguguaaccucggccaguuuaacugccugcccacuaggaugaccuuucacaucaguacaacacaauuuuacagucucucuccauaccgucuagacuguauguuaauaaguauguuagcggauaggcaaacgugacacaaagccggagaacacagaagcagucucugcagucucugcaguugcacacgugcucacgugcacacgccuaaggaagagacacuugcggagugcaggacugcgcaugggaguccaucaggaaaacuagaaagaaaggccaaggacaaagugaaaaccagagcuggaaguguggcccgucaguguuaacucccacagccauaacagcaagguguguguuguggcaguuuguggaguuacauagaugaaggagaaaggauacaagcuauagcuugauuaguuagcugacucuugcaaagccagaggacaaugacagguggccuagcacagccagggagagcaaugcugacugaaugcgcaaaacuucuuuaaagaagauguuucauauuucguaaaaagcauuuuaugcccauuauguuuucuuucuucauguaaguaugucaguuaagugcacaaguuugauaagguaggcuagaguuuuauuuugauccauuugcuuucuaauuauuguuaauguucuugaaguaguucuaauguugucagauguccugccacagaaaaauaugaagagcaaagacucaaacuggaggagacccagaucagcccuccaaagugccagccugucccugaguuugcaucuacuuuccucuugcccuucucuccugggcuauggaguaugacaugccuccauguuucaaugugcugugucuguggguaguuaaaucccauaaaucgcacuuugccuuuucuaaugaacucagugagggaccaauacucaaaccaaagaaacagaaagcacggggugguagaacaggauuagggugcugucugggaagaggaaagcaguuuacaggaaugaguggcagcuaagcaggcaauggagggcaaauuugaugacuauacagugcugugaaaaauaaaaggaaauaccaaauuaaauaguauuguccacuugggaaucuugcuuucucccauucuauguugaaggaguauaugugaauuauuuauguguaugugaguuauguauaugugagcaguaaagugcagugauuaugugcagggcauaagccugucuggauacacacaccccuuuaccaguuacgaguuccuguggcaauuuccagcaugcuuggcuucugaagacaaacauuguccuuaguagcaccuuaauaaagucaaauaagagacuuuauagacugcuuacacggguuuuagccaaaauaauucuucagucacuggcuuuuauguuuucagaaaaacacagguacaugaaaacucaugcaugcauacacuuuauucuucuaguacugagugcuauugaaaaugagcaaugcuuuaaaguaugaauuuaaaaacccacaaucccaucuuuggacauuauagacccauugaaauaaucccuugccaagguccaaggggcugcugugggaaaggcuuuuuuagaagaucuuuagguuaccagggguugacguaguugcugugcacuagcaccagguguaugcaggccagggcgauaauguaauaaauaugcucccaccuuauugugucuauuucuguuacauaguaggucuugagcuagaauguucaagcagaaagugcaacucugagcuaaaguaauagcauuucuggauuuaaaaggagucagugucugauugggagagagcauucagagcuccugaugggcauaacucuuggcauccuaaugaugucucuucagagcacauuccugacucauucauuaaagaacuugauguugucccugguccucuccagguucaggauaaguuccgccuggaccugucagaugaggaggcugugcacuacaugcagagucugaucgacgagagcguccacgcacuguucgccgccgugguggagcagauccauaaguuugcccagguacgucccaaaggcuuagggaacuuuggguggcauuuggucuuuaaaaacuucucuggugaggccagcuuaggcuaaagggccaaacaccagcuaaugucuguccaggagagaaaaucagcucagguaaggacuaaccuagacauguguuaccauucaugccauuucuauaaauaaauaaguagaaaacaaaauauacaccaauuuuugaacacaccauuaaauauccgaaguaauaaacauuuccacaaaaccucuuugugaauuuauuauuuccuucuaaaaauaccuacuggacuuuacuccagccgaggucaugagugggaacugagggagcuggucuguugaauccuggcuguuccucgugugcuaaguaguagagauuuuucuaauguuuauauuucguuuuuaauugugugauuuagcauaguauucccuuuggggggggccauauuuuuguuuguguucugugcuuuuggaguuucccuguguauauauugaugagcaaaaccugauucuacugguuauauuaaucaugcuuaccauggaguucgaagccauauaucugacaguuguuaacugaccacauucucagccaaacuaucauccuucagggugcccggugcccagacuccucucucuccucuguaaagaagcagccucauuguguauaauaaccaaucuguuugaaagcggaggcaucagccuguuuucuuuccuagaugcaaaauaacuguagaagacaagcaguagaugcuguugagaguucucauuaugcaguucucauuuuaccaguaagauggaagaauaggcauguacaauuucucccagacaaaauaaaaugcugaguucuuuuuccaaagaaagucuucacuaaaacccacuuuuuucuacauuuagaaauuuucugaagagccagguuuucauuguuguguggcagaagcagugguaugucagcccguguccuacauguauucccagugcacucagcuuaucugaggaggaauaacaaggcaguacucauauggcugagaaacaguaacgacggacccagcagccaccuaucggacaccuauauaagccaccagugaugugcacucuguguuaccuuguuugaccugugacauacguucccaucugguaaauugaggccaauagguaacgagcucuggguccauaacugucacuaaagguuuuucauggcuauauacgcgaucgaggguugcucuauuagaccugagcagaguuuguuaugaauagguuuuuguuauuuuuauuauuuacuuauaaauaaaaaagaaauauucucaucuuuucugaucaucagaaauaaaaacaaaguaucugacaugaauuugcaugccuucaaucucaacacuucagaggcagaaccaggaggaucuuugugauucgaauucuuuuaaucucaggacuugggaggcagaggcagguagauauuugugaauucaaagccaccaggacagccagugcuagauagagacccuaucucaagaaauaaagaauuuaaauucaaaauuuuuuaaauugcucaaaaaaaucacaaaaauaugcacaugaguugcccagaauaguuaaucagaaauaaauaguauaaaugcugaccaccuugaauucaccugaugggcauagccuauccugacuggcucuggcccgugcuuuucucuugacuacagucagcucugaagcuuggcugccagucacuugguacaugguggaggcauugaggucuuccaauugcaccguuacugugauggcaguccccuaccuaucugauggaugccugcuaaaauucccucgauaauuuuuuucuuucauacaucuuccacuuaucuguguaagaaagguuuauaacacuuccauucauaugauccuggaaauuccuguccucuuuuuuucacuguucuuuuaaguaccuauucagucuauuuaguguuuucaaagcuaacuguuugacagucaguucgaauguucuucuuggggaagcccaccucuccuguguccaguguuccucaguugacuauaguucuuggugugggugaggccucgugggcuuuucucacguguuuguuggcuucaccuuggucaggucacguuuggagucaggcugguaagauguugugggugugacuucugauauuacaaggagacacaaucucacagcguacucccugagccuuaggucugggcuggcuccggccccuuuaaagauaguucuucaggugucaggagcugaauguuuggauccagcucucacgcuuaguagucucaauuuuucccccauaggcagacacuuuugaaguguuuaagaaagcauuugagaccaucuguucagucacaggauuuuucucacacacacauaaaaacauacagaaacaugcguggggauuuuacuucugggaugcuuccaggaucuucagacugcuagcauggcaguguggguccuugauaguuugucuuuaccagcauuuucaauauuuaaucacgugaaagcauuugagaagaacccuguagguuucaugacagucccucucuucagagucucccugacuccugugcugugcccggaguacagcuccugcuugugaggacucuagggauaucuucuucuucugggcugccuuggcuggccccaguggaaaaggaagcaucuagccucaaagagacuugaaaugcuaggggauggggauacccaggggggcuccccaccgccucagaagagaagggggugaccuggaaggggucagugagcaggauguaaaauuaauaaguaaaaaggaaauaaagaaaagaguugaguucaagaguaucaggaccucccugcugggucuaaagcauccgccaggauuacccauugaccauaaccugcuucuugccuugugauucuguguauaucaaggaccauccuuuagagaguucauuucuuugauggauccuauaaugaaaauauuuaaauugcuucugaaaauguaaauuauuucuuucauuagcauaaaauaaacauuucaccauauucuugcuuagguugauacuuauaucagauuaaauuccaugggaaucucagcaguaggugucugcaacuguaacucuuggcaguaagaucucucacugucauuucccaugagauggagucgauaggcacuaaaagcaugagggguauuggugauaugggaugcgcccaucuuagacucagcuguuacugagcuguuugcuggcuuaguucuuucagaauugcuuuagcuuugguuuucagaccaaugcagaauucagcacuuccauucuggaagacauggcagcuagcuuguuguuggcagagcggggcacugagagcuaaguguacuauuugcagugugauuuaggauggcccgccuuccuaugcuggguggagcucugcuuuucucuccuacauaacaauuugccaccuugggcuugggcuugcagugaggcagcaacucuucccccaaguauugucucacguaagugauuccugccagccuugggaacccaugcacagccacacaguccugauccucuugggagguuuagcaaaccuuuuauugaucguuguuuaaucuuucuucauaaacagaaaacuaaauuauuuuuuguuuguuuuuaauuuugauaguacuggagaaaaugaaaggggauuugacccauccugaugccuggcucaauaagaaaacacaggagaagccacugcuguguacuaaagacaucaaagaaagaacaaggaagagaggguguccagaaguuacgucgugccugggcuuuguguccuugcaugccacugcuuaaauccagcccacaggguuuguuuaaagcugcugcagacagaguagucgcucaucucuaauuccaaaacucuggaggccgaagugugaagagugacacauuuuugaagccacccucagcuacauaaugacuucugggucagccaaaaaucacuguauauauuuguguuauaguguauaaagauggaaagaggauuauguauaugaaacaguaaagcauuuuacccucugagucucau

SEQ ID NO: 8847 - RNA, 502 nt, Mus musculus
uggacaucuuagcaaggcugcugugguccacacgacucucugagcuucgccaugccgcccaaagacgacaagaagaagaaagaugccggaaagucagccaaaaaggauaaagauccaguaaauaaaucugguggcaaggccaagaagaagaagugguccaaaggcaaaguucgggacaaguugaacaaucuuguccuguucgacaaagcgacauaagacaagcucuguaaagagguuccgaacuauaagcuuauuacuccagcuguggucuccgagagacugaagauucgcgguuccuuggccagggcagcccuucaggagcuccuuaguaaaggacuuaucaagcugguuucaaagcacagagcccaaguaauuuacaccagaaacacaaaggguggagacgcuccagcugcuggcgaagaugcaugaacagguucaaucagcuguacauuugggaaaauaaaacuuuauugaaucaaaaaaaaaacaaaaaaaaacaaug

SEQ ID NO: 8848 - RNA, 572 nt, Mus musculus
guuuuuuuuuuuuuuuagaauggaagcuuguguuuuuauucauggcucaccaguuucccuccuguccaggagggugaaguaagaggggugaguuuuagucuaggauggugcagacugcagcugcccuuuguagacguauuccagcgcgguggcaauggugcacauguccagcuugaugcuccuagcccaguucuccacauccccaauuuccuuaagcgccugguugaaguucuccaccauuccaauccacuggccugucugcuuggcaaacugggcagccuggaccuguagggucuucaccucaugguccagcuuucucugguucauguaggccugggcuacacccacguugaggugauccaccaacgcuucggucaggcaggucgcugcagcgauagcuucucuccucuucuccugcagcuccuugcguucguucugcuuggcuugguguucuuugagcaagcgggacagcaugguccagucuggcugggugugggcacggcgggccccucccuagggcugcgggaacuggacuaugccuuggcucacccagaaggcgucacgugauucau

SEQ ID NO: 8849 - RNA, 9712 nt, Mus musculus
ugaauccucaagagaggagggaggaugccagaaggagggcgaggaggagcggcuggagagaggagggggagggcaggugcugauuucagcccuguagcgucaggauugcgucaauucggguuucagccacgucuggagucucagagacaagcuuuucagaagagccaacaggaacagggcaggguggcacauugcugauagagagcgcggaccuuccuccagccccucccgcugccggugcugguccccaauccccuguguuuccccuggaagccuuguuccuggauccuuccaggugaaucugcccggaguucuuucagcaccucggacagagcacgcagaaaacauggcuccuaucaccaccagccgcguggaauucggugagcaaguugcugaacuuggggcuguggcugggcucaggggcugugcugugcuuugcucucuacugggucuugaauauguauauuuucaaguagcuaauuugaaaggaagacgagaacagcagaugguuaauuguagcuuacuuccuucccuugauauuuuucuccuuaacauugccuugugauuucaccuuccagaaguucccgaauguucacgcggcucuguaagcugcagccugagcugaggaaagaaaaggacaucuguuguuagaauacugcuucauuuauuuucuggauggguccuauuuguguguaaaucuuuuaggaaaagcuacguacgccuuugguuacauaagaguugauacgacauaaaauaacuuguacauugaggguuugagaugcguguucuauuacgcugucauaaauuucucugcuauauuuucuuguauaccugaagaauguugcuaaugacagauaaaauucugugauacuguaguucuggggacuuuagaacaaccggcuuuggccuuuuucaugucccugguugagcuuucuggaguccggcgcuguacaguuuaaguaaaagcuacucaaaacuuggguuagagcugcugcuuucucgauugcuuuucuuguucguauuccaaaauuuugucacuauggucuccuugucugcuucagugaauaaauuagacauacauuuuagaaaaucaaugggcaugucuagguccaauuauauucuacugggaaaagaucaggguuuuaucuauaaguauuuuuaaguuaaaggaugaagaaauuuuugaauaguaucucucauguauaauaauugugacuaauaugagugcuaaggacguaaucucugcucucaaagcuaaguacaguaucaguaguuacauuagcagaguaugaguccauauuaucuuggguguugugaauauuagauauaauaaaauauucauaaauuauuuucucagccuuucaucauuggaugugugugugugugugauauuuacacucaguuacuuauuugaaauaaagcauuuucucacagugggauaucuucugagacuacccuugugagaauguuuccaugcccacuugucuuucuacuuagaaauaaugacuuuaacugcuuuuauuguucuuacaguggcugaagaauuucuuaguuccugaguuugcuuuuguugccuugcccugaguuauuagauugugugugugugugugcgcgcgugcgugugugugacaaagacuugaauagaagaagcugauacuguuuagcugauuaacucuucuuucucuuccuccucuuccucucccuucccuucucucucuccuccuccccucccuccuccucucccuccuccucucccuccuccucccucuccuccuccucuucucccuccuucuuuucuuccucuuccuccuuuucuccuuucuucuuuguagcauucacuuuuuuucuauuuagaagacuaaaagcuuuacuucauuuuuuacaaugauucaauuuagccauagaauuaaguuauagauauuauguuuaaucucagauguuucucuuacuguuucuccaucugacuuccuuugaguucacuuuuaggaaucuaaaguagaugggaagaauauuuaggagauggagaagagauguaaaaaucccuuuucuugguuuuagaaaguguuaacccuuuuugggcuggaacuuuuaugcuuuguauucaccaauuagaauaaaacagggauaaaauagagggaaauguacacaacacuuugucuguuguauucacuuuuugcuaaagguuuacuuagcugcgucacugugucagauguaguaaguagaaguacaacuccuaaauguuugucagaagaaccugcuugcauauuagaugauaugugcuucauguacaauuacuguuggccugucacuggauaucaccgauuuaauacguucuaaguuaagagaacaacggcauuuucaauuuuauuaccgugugccauguagaaauauacaaggauaaaauugaacucuaaauuaccuaugcucacuuuacacucacaguuugagaaugauuaugcauuuaugaccacauuauucugccuaacccacauagauuacuuugugauuuggaaaauucagugcuugaagaauuuuauguucauauauauaaggggauuguaauaauauaaauuaauuacauguuauuaccauacuauguauuuuauuuuacugucuuuuuacccuauuaacaaauguuuaccuuuucaucacagcucacaauuaaaaagaaaauuuuaaugaguuuauagcaauagccaauggccauuuuuuuuccauaaguuuuuaguuguguggacuacugucuuuaacguauucuuuuuuuuuuuuuuuucugcuugaauccugggugaauaaagauauacuaagaagguaguaugugugugugugugugugugugugugugugugugugugauugaugcuucuagaaagccccaaaaugugacaauuguacuuccuuauauuauuauaguugacuacugauaucugaguuaaacaaagccagggugagaauacuucacaugacccugcauuuauuccagauauacuuuaauuuauuaauuuauuaugagaaucuacugaauuuaagguguuuaaaaucauaaugucuuuuuaugugugucacauagggcuauguuuagaccucagguuagugggaaacaucaccauuacucgugccaggaacucugggggaguaagucaauccucccaaccgacagcaggggcuggcucuguuaugcuuucacuacagucuccccuuucaauccugauccuuuaauguaugccauuggucaauugguuuuucagaugaaauucccacaguggugggcaucuucagugcuuuuggccucgucuucacugucucucucuuugccuggaucugcugucagagaagaucagccaaauccaacaagacuccuccauacaaguuugugcacgugcuuaaaggaguugauaucuacccagaaaaccuaaguagcaaaaagaaguuuggaggagaugacaagagugaagugaaggguaaagccgcucugcccaaccuuucccugcaucuugaccuagagaagcgagaccucaauggcaacuuccccaaagccaaccccaaagcuggcagcucuucugaucuggaaaaugucaccccaaagcucuuuacggagacagaaaaggaggccaauuccccugagagcuugaaguccagcacuucccucacgucagaggagaaacaagagaagcuggggacacucuucuugucucuagaguacaacuucgagaagaaagcauuuguggugaacaucaaggaagcccagggcuuaccagccauggacgagcaauccaugaccucugacccguacaucaaaaugacaaucuuaccagagaagaagcacagagugaagaccagagugcucaggaagacgcuggacccuguuuuugaugaaaccuucacauucuauggaaucccuuauccccacauccaagagcucuccuugcacuuuacaguucugaguuuugacagguuuucuagagaugaugucauuggagaaguccugauuccucuuucagggauugaauuaucagauggaaaaauguuaaugacuagagagaucaucaagagaaaugcuaagguaauuauauaagcauucaaguaucuauaaggaauauuuaguauaguuuuaaaaaauaucuaugguauuuucauucaaaugaugaguugguacacauuauccuuaauuacuguggguaauaguaagcugagaacaagagaauagagaaggcaaaaggaaguuuaauccacaauugaaaugcucaaggaaucuuugugauaaaaaaauaagagaaagcauugcaugauaccuuauacaucauuuauguaacagguauuuuuaaaauuucuauuaaaauaguuugaaaaaggcugcgacuuuaaaauucaugugugugucucuuagcauauguuauuaaaguguuucaguucagaguaacugaauuugaaaccgaaauuaaaaaguaagccaguuccuucucaggaugugggauuugaauguacuuuucaugaaauugcuuuugaacaagggucauucuguuauguugacuuccgaauguccauuuuuuuucuccugcauacaggaaguguguuacccugcccucugacauggacuccuuugauagcucuuggauaauuaggaaaugacaugauaucaauuuagcaaagagaauccuuuucugcuuuaaauaaacuucacaguuccuaaucuucguauuucagaacaauuuguucuaaugccgcaacuuaagaaaacaacaaucacauuauuuauguuuuuuaaaaaucacaauauuuuugagcuaaaaauaucuuuagaacacuuuguaaucaucuuccugucuuguauugacaauaguggaauucaggcccagagaguugcacagcuugugugaggcaccugacugacuggggcccaugaggaucaaauagcucccugguuguuguuuugcuuucuuuggugugcuuuuuugguaaacuguuuaguuuuaggugguuuuucucaacuuuagcucuuuuuugaugcauuuuuauuuagcuguucuuaauuauaagcaagucccauguuauuguuuuguuaguuguaguuaaagcuugaacguuacagucuuagcagucuuagguaaugucuuucauauaaaacuaagcauaaauagccuucaguaaagggaucuauguuacucccuaaaaccaaguuuuaaaguuagagucaguucucccaaguacuuaaauuuauuuauuuucuccuuagauugaaaagagacuuugacuaugaaaggacaagaauucuaacuccaucaugacccugguccagaauaauuguuggaugcagaauagauuuucuguggcuugaauucaaaugccacuagugccaauagugaagaauuuaaaauaagauaaaauaugugccaugcaauccuacacauaccaguugauaagauuauucauuuuaugacuauuaaugacuuuggagauuagagauguucuuacauagcaaaagcgaaacaaacaaacaaacaaacaaauccucuugaaaguauaauguaauacccuucaaaacauguguauuggguguggucaaaucuuugcaaauuuuagcauucuguaguacuugaaacaaccacaagauggcaggcaauggauuuagucguuauggagcggcauaaaagcaguuuuucagauuucuucgccuguuaaaauaaaaacuagauaggaacaugacauuaaaauaacaaagcuauuauguugcuguauguuuugugaugagaguacaaaagcugaagauuaaaacuccauccacgguguuucucuuuguuagaagucuucuggccggggugaacuucuggucucucucuguuaucaguccacuacaaacacgcucacugugguggucuuaaaagcgcggcaccuaccgaaaucugaugugucuggacuuucagguaagaauggcuucugaaauacuggaguucagccucuacaauuuucaacuaacauuggagucugguuuugucccucaggaucaugaguuauaggcuuguggauugucuuuuuuuuuuuuuuuucuuucuucuuugugggaaaauucgugagucaguuccgccaacaauacagagaaguucauuuccugagagacaacuucggaggaagcacuucagugaaugguuuaaagcagaaaucaagauggaaugaugaggaaagacggagccuaguauugcucagaacaagaguuuugaaguuuugcguuucaaaugagcuuacucaugugcaucuuuagugacuucauuacuuuaauaauuauguuuuaguuuucaaaaagucugaaaaaauaaaaugguuuuuguagaauauaaugagaaagaaaaugagcuaaguuauggguuaaaaugaucuuaaaauggucacuuuucuauuucuuaguauaguauccucucuauuucuuaaacacuauagaaauugaguacaauaauacuugaaauguauuuugaaaacuagaaguauauauuuuaauaaagaaucaccuagugguaugaagauaaauaacaucucaaaaccaguuaauuaugugauaaagaaagucacaugacccugaacccauuuaguaagaaugucacaggaaagaucaacucugccaaccacaugcagaaaagcuaaagggcgggauaugaccugcaugguuuccaaaucccuguuuagcaacaaaagcagcacucaccugaagauagacuuaccaagaucacaaagcgagugagcccagaaagggugagauuuaccuuccccucaguuaugcaauuaauuauuagugggcagcaugcagcauucucuuaucuucccugacggcaggucuagaacuaguuucuauuuaucauuauuuucaauuuaauuaaaacgaggagagugaaaccuauuuucacuucccaucuguuuagacuuguuuacauuguaagagccccauuuccacuguauugggguguccugcucacuaaggaggccagacuugcagcugauuguugucaacauaacacuuguuguaugccauugcagaucccuacgucaaagugaaccuguaccaugccaagaagagaaucucuaaaaagaagacucacguuaagaaaugcacucccaacgcaguguucaaugaacuguuugucuuugauauuccuugugagagucuugaagaaaucaguguugaauucuugguuuuggauucugaaaggggaucccgaaaugaggugauuggacgguugguccugggugccacagcagaaggaagcgguggggggcacuggaaggagaucugugacuuccccaggagacaaauugcuaaguggcacaugcucugugaugguuagcuuccuggccaugagcugcaacuuaaagauuuuuacuaggcaagaagcaauuuucuuucuuauacacgauuguaagcuugcagcacagcaagcuacuuuauuauuuauuuuuauuuacuuauuuguuuugguuagaaguggauuaaguuaauagaccagaaaauaguuguaaauguguauuaugauaauuuccucuuuuauuagagguguuggccaaguuuucauaagauauucaguuucccucugugugguauuaagugggccaacccagccuguuaugagcacccuagcuuaaccuugucacagauguguguuguaggugaugguuucaguuuugcuugguaguggaaaucaggugauuguuagaguuaaaaaugagaaccacaccuuuuuguaugaaaauuaauccauguuucuucagguugggggagauagguuuuauuuaaauccaaagauauuuccaaaauguccucaagucugguuuuuuuuuuuuuaguuaaauacgucauguacaaaugauugucuuauauaucaaaguaugcuguaauuuucauggugauuauuugauacagucucaucauaagaaggguagcuuagguucauuucauaaauacagcaaacaaguugagaaauuaauuuauaaaagggcugaauugaagaacacugugguugauaugagauuuuuuuuuguuccaucacaugugagucauguaaaauuuaacuucaccuaagaaccauggucuugaauuauucacugccugucagaagccucaguguggccuaagauacuccuauuuaccauugugaaguugucagacuagugaaaaaaaauaaaccuaagcuagcaauucaguuaggaauacauuuuuuuaaauauaaaaaucuaucaguguacaaguguauuuucaagauugucuuucccccucagaguagacauggcuacuuaaguuuuuaacuuacucuuaccgagaaagaacuaagcgacuuaaaaagaaagaaaagaaaagaaaaaaaaaacuuguggaauucauugucaaguugaagucaaccacauuaaguaaaagacuaagacaagaaaagaguaagccuuucagaauuuacaaauauucacaaaauacaguuaagcuguaaaaauagcagagacaguguguucuucgcugucuuuagacgccaguuuguuuugagcuguuauuuuuaagauagcuuaaauuaucgugucuugugccacucccaauugcuaaguucugaaauucuugcaaaaccugugugaggcgagcagagcucuggcauuuccugggaagacuuaauucaauggcaaugucuuuauauuugagucaucagagacucaugaguaugacuuagguccagccgaauuauuaaauaugcaaguuagagauaaugucuacuggaaauuuuaccuuugagucaaguuuugugucagugcuuuagcauuuuugagaauguguuugauaucacaguguuuguaaauucgaugaaaauguauuucugaaccacuugucugugcuuuuuaugacuacgacaaaacucugacuuucuauaaggagauauauuucauucuguuuguacaaaaauuuuaugccuuccccucacucaucgccauccagugacaacgucaucugacaucucugccuacucagcagucugagaauaacauggagugagcugcggucauguggaguuggggaggccaggcggccucugcauguauguacauuugaugucauaggccauggaaccuguggagcuuggagcuuuaaugucaagagacuucauuuccaaguaucccacagaauggcaggaagcugauggugacccagguuauaggauguuugguggaaaaaaaauuuuuuuuuuuaaaauagaaaauaaaucugacaacaaauacuuuaaaaauuguaaauaguuuuuaguuuuacgacuuaaaguguuuugauggggaaaguugauugaaacuauaacugguuuuaagggaaaaaaaagagagaaacacaagaaaggagaaaagcaaggaaaaaaauugaaacaggcagggagauaugcaaucucauuauuucugaaaaauuguacuguuuauaauguauuacaaucuuaacgugaauauccaauucugcuaaaauuccugcacuguauucaacauguacauuauuauuuuuugugugcuuagccagucuaaccccccaaaucgggagguuaccauguccgaggaacugugugauucaguaacugacccguucugacuuguuguaguucaguagugauccggagggaagcaugguguuagggagaugcugucuguuccuuugugccagcacuguguguuuguaagacaugaauaaacugcugcuuuugcccaacuucag

SEQ ID NO: 8850 - RNA, 8782 nt, Mus musculus
auuaauagcauuuauuuucaguuugcuuuuaaagcaagcaaugaaauagcuacaauggcaucaacucugggcaaucgguccucuuacuucauuagcucuuuugaaauaagggagggcagaaugggcugagcuuuggagaaauacuguuuaagaagcuagacagguuugauacaccauuuuaccauaugaagcuauaguuaaugagguacuaauuuuaauguaacauacacagaauauauuuauguuuaugacaaaugagcuuaaccauauguuacaacaacuuagaugggaaacauauacuuuaauauaauuuacauuguaugaucagauuacugcgaaaugcaucacaagugaauucuacuuucaugaaacagaacacuuuaacuggugcaugcagagggcugagaaggcagguacuauguauguuuggguugcuuagaacauuagcacagucacuaccaugggaacacggcacacagugacuuaguuucuguguuuucauagcaugaauauguaagguuuaaaaaaugucuauucaaagaacacuucagugccaagugugugggagcugguagaaaggaaagaaacgaggcuuugacuuagaaaauuuuccaugaugcagagggcugaaaccaguguauccccagacacacugcuggcacuuggggaagcuguuugccagugugcagacaccugucucguguacaguaguuuucugaaacaaccucauggcucagcuuccuucaugacaguacauauugcauuucauuuguuaauugaauuccagagcaaagguguguguguguguaacauuaaaugauaggugaaaauuacagcuauguuucuucuuuauaaaucugcuaaguguuuguuuuuuaaaagugauaaccuuaagauucaaauuaaucaaaauuugacaccauauuuuuucagauccucauuccagaauaacaguccuuugaaaguaacugguaauaauauuauuucagaauuugguccaauucuuguuauuuguuugcagaaaccuauuagaggucagaacauuugacuauaaauguuacuauaucagcaguauccaaauauuaaaagucauaucugagaauuaauuuaaaaagaauuaauuccaucuauucccaagaaucuuaacuggucaaaugucaaguauuaaaaggaaaauagcugacagacaagaaaccagcaacacuaucaaccuaauguucagacuauaaauugguaguaagaacaugauuauuuuuaauguaacaauuuacaguggauuuccuccaaauaaguauggcaugcaugcaauaguucacagaauaauuuaagaagcaaggaugcauauuacagugggucauuugauauggagacuucccucucuuuacucuguauuccucuuauaaauuaugauagucugauaaguaggacucauuuauuuuaaugucuguauaucaucaggagaauuuuggauuaagaauugccaaggauacguuucaggacgcgucuccgugugccuccgagucuaacagaauagcacaguucaaaucuaguagcccaacaguuaaaauaauuggugagugugcgcugaauccucaagagaggagggaggaugccagaaggagggcgaggaggagcggcuggagagaggagggggagggcaggugcugauuucagcccuguagcgucaggauugcgucaauucggguuucagccacgucuggagucucagagacaagcuuuucagaagagccaacaggaacagggcaggguggcacauugcugauagagagcgcggaccuuccuccagccccucccgcugccggugcugguccccaauccccuguguuuccccuggaagccuuguuccuggauccuuccaggugaaucugcccggaguucuuucagcaccucggacagagcacgcagaaaacauggcuccuaucaccaccagccgcguggaauucggugagcaaguugcugaacuuggggcuguggcugggcucaggggcugugcugugcuuugcucucuacugggucuugaauauguauauuuucaaguagcuaauuugaaaggaagacgagaacagcagaugguuaauuguagcuuacuuccuucccuugauauuuuucuccuuaacauugccuugugauuucaccuuccagaaguucccgaauguucacgcggcucuguaagcugcagccugagcugaggaaagaaaaggacaucuguuguuagaauacugcuucauuuauuuucuggauggguccuauuuguguguaaaucuuuuaggaaaagcuacguacgccuuugguuacauaagaguugauacgacauaaaauaacuuguacauugaggguuugagaugcguguucuauuacgcugucauaaauuucucugcuauauuuucuuguauaccugaagaauguugcuaaugacagauaaaauucugugauacuguaguucuggggacuuuagaacaaccggcuuuggccuuuuucaugucccugguugagcuuucuggaguccggcgcuguacaguuuaaguaaaagcuacucaaaacuuggguuagagcugcugcuuucucgauugcuuuucuuguucguauuccaaaauuuugucacuauggucuccuugucugcuucagugaauaaauuagacauacauuuuagaaaaucaaugggcaugucuagguccaauuauauucuacugggaaaagaucaggguuuuaucuauaaguauuuuuaaguuaaaggaugaagaaauuuuugaauaguaucucucauguauaauaauugugacuaauaugagugcuaaggacguaaucucugcucucaaagcuaaguacaguaucaguaguuacauuagcagaguaugaguccauauuaucuuggguguugugaauauuagauauaauaaaauauucauaaauuauuuucucagccuuucaucauuggaugugugugugugugugauauuuacacucaguuacuuauuugaaauaaagcauuuucucacagugggauaucuucugagacuacccuugugagaauguuuccaugcccacuugucuuucuacuuagaaauaaugacuuuaacugcuuuuauuguucuuacaguggcugaagaauuucuuaguuccugaguuugcuuuuguugccuugcccugaguuauuagauugugugugugugugugcgcgcgugcgugugugugacaaagacuugaauagaagaagcugauacuguuuagcugauuaacucuucuuucucuuccuccucuuccucucccuucccuucucucucuccuccuccccucccuccuccucucccuccuccucucccuccuccucccucuccuccuccucuucucccuccuucuuuucuuccucuuccuccuuuucuccuuucuucuuuguagcauucacuuuuuuucuauuuagaagacuaaaagcuuuacuucauuuuuuacaaugauucaauuuagccauagaauuaaguuauagauauuauguuuaaucucagauguuucucuuacuguuucuccaucugacuuccuuugaguucacuuuuaggaaucuaaaguagaugggaagaauauuuaggagauggagaagagauguaaaaaucccuuuucuugguuuuagaaaguguuaacccuuuuugggcuggaacuuuuaugcuuuguauucaccaauuagaauaaaacagggauaaaauagagggaaauguacacaacacuuugucuguuguauucacuuuuugcuaaagguuuacuuagcugcgucacugugucagauguaguaaguagaaguacaacuccuaaauguuugucagaagaaccugcuugcauauuagaugauaugugcuucauguacaauuacuguuggccugucacuggauaucaccgauuuaauacguucuaaguuaagagaacaacggcauuuucaauuuuauuaccgugugccauguagaaauauacaaggauaaaauugaacucuaaauuaccuaugcucacuuuacacucacaguuugagaaugauuaugcauuuaugaccacauuauucugccuaacccacauagauuacuuugugauuuggaaaauucagugcuugaagaauuuuauguucauauauauaaggggauuguaauaauauaaauuaauuacauguuauuaccauacuauguauuuuauuuuacugucuuuuuacccuauuaacaaauguuuaccuuuucaucacagcucacaauuaaaaagaaaauuuuaaugaguuuauagcaauagccaauggccauuuuuuuuccauaaguuuuuaguuguguggacuacugucuuuaacguauucuuuuuuuuuuuuuuuucugcuugaauccugggugaauaaagauauacuaagaagguaguaugugugugugugugugugugugugugugugugugugugauugaugcuucuagaaagccccaaaaugugacaauuguacuuccuuauauuauuauaguugacuacugauaucugaguuaaacaaagccagggugagaauacuucacaugacccugcauuuauuccagauauacuuuaauuuauuaauuuauuaugagaaucuacugaauuuaagguguuuaaaaucauaaugucuuuuuaugugugucacauagggcuauguuuagaccucagguuagugggaaacaucaccauuacucgugccaggaacucugggggaguaagucaauccucccaaccgacagcaggggcuggcucuguuaugcuuucacuacagucuccccuuucaauccugauccuuuaauguaugccauuggucaauugguuuuucagaugaaauucccacaguggugggcaucuucagugcuuuuggccucgucuucacugucucucucuuugccuggaucugcugucagagaagaucagccaaauccaacaagacuccuccauacaaguuugugcacgugcuuaaaggaguugauaucuacccagaaaaccuaaguagcaaaaagaaguuuggaggagaugacaagagugaagugaaggguaaagccgcucugcccaaccuuucccugcaucuugaccuagagaagcgagaccucaauggcaacuuccccaaagccaaccccaaagcuggcagcucuucugaucuggaaaaugucaccccaaagcucuuuacggagacagaaaaggaggccaauuccccugagagcuugaaguccagcacuucccucacgucagaggagaaacaagagaagcuggggacacucuucuugucucuagaguacaacuucgagaagaaagcauuuguggugaacaucaaggaagcccagggcuuaccagccauggacgagcaauccaugaccucugacccguacaucaaaaugacaaucuuaccagagaagaagcacagagugaagaccagagugcucaggaagacgcuggacccuguuuuugaugaaaccuucacauucuauggaaucccuuauccccacauccaagagcucuccuugcacuuuacaguucugaguuuugacagguuuucuagagaugaugucauuggagaaguccugauuccucuuucagggauugaauuaucagauggaaaaauguuaaugacuagagagaucaucaagagaaaugcuaagguaauuauauaagcauucaaguaucuauaaggaauauuuaguauaguuuuaaaaaauaucuaugguauuuucauucaaaugaugaguugguacacauuauccuuaauuacuguggguaauaguaagcugagaacaagagaauagagaaggcaaaaggaaguuuaauccacaauugaaaugcucaaggaaucuuugugauaaaaaaauaagagaaagcauugcaugauaccuuauacaucauuuauguaacagguauuuuuaaaauuucuauuaaaauaguuugaaaaaggcugcgacuuuaaaauucaugugugugucucuuagcauauguuauuaaaguguuucaguucagaguaacugaauuugaaaccgaaauuaaaaaguaagccaguuccuucucaggaugugggauuugaauguacuuuucaugaaauugcuuuugaacaagggucauucuguuauguugacuuccgaauguccauuuuuuuucuccugcauacaggaaguguguuacccugcccucugacauggacuccuuugauagcucuuggauaauuaggaaaugacaugauaucaauuuagcaaagagaauccuuuucugcuuuaaauaaacuucacaguuccuaaucuucguauuucagaacaauuuguucuaaugccgcaacuuaagaaaacaacaaucacauuauuuauguuuuuuaaaaaucacaauauuuuugagcuaaaaauaucuuuagaacacuuuguaaucaucuuccugucuuguauugacaauaguggaauucaggcccagagaguugcacagcuugugugaggcaccugacugacuggggcccaugaggaucaaauagcucccugguuguuguuuugcuuucuuuggugugcuuuuuugguaaacuguuuaguuuuaggugguuuuucucaacuuuagcucuuuuuugaugcauuuuuauuuagcuguucuuaauuauaagcaagucccauguuauuguuuuguuaguuguaguuaaagcuugaacguuacagucuuagcagucuuagguaaugucuuucauauaaaacuaagcauaaauagccuucaguaaagggaucuauguuacucccuaaaaccaaguuuuaaaguuagagucaguucucccaaguacuuaaauuuauuuauuuucuccuuagauugaaaagagacuuugacuaugaaaggacaagaauucuaacuccaucaugacccugguccagaauaauuguuggaugcagaauagauuuucuguggcuugaauucaaaugccacuagugccaauagugaagaauuuaaaauaagauaaaauaugugccaugcaauccuacacauaccaguugauaagauuauucauuuuaugacuauuaaugacuuuggagauuagagauguucuuacauagcaaaagcgaaacaaacaaacaaacaaacaaauccucuugaaaguauaauguaauacccuucaaaacauguguauuggguguggucaaaucuuugcaaauuuuagcauucuguaguacuugaaacaaccacaagauggcaggcaauggauuuagucguuauggagcggcauaaaagcaguuuuucagauuucuucgccuguuaaaauaaaaacuagauaggaacaugacauuaaaauaacaaagcuauuauguugcuguauguuuugugaugagaguacaaaagcugaagauuaaaacuccauccacgguguuucucuuuguuagaagucuucuggccggggugaacuucuggucucucucuguuaucaguccacuacaaacacgcucacugugguggucuuaaaagcgcggcaccuaccgaaaucugaugugucuggacuuucagguaagaauggcuucugaaauacuggaguucagccucuacaauuuucaacuaacauuggagucugguuuugucccucaggaucaugaguuauaggcuuguggauugucuuuuuuuuuuuuuuuucuuucuucuuugugggaaaauucgugagucaguuccgccaacaauacagagaaguucauuuccugagagacaacuucggaggaagcacuucagugaaugguuuaaagcagaaaucaagauggaaugaugaggaaagacggagccuaguauugcucagaacaagaguuuugaaguuuugcguuucaaaugagcuuacucaugugcaucuuuagugacuucauuacuuuaauaauuauguuuuaguuuucaaaaagucugaaaaaauaaaaugguuuuuguagaauauaaugagaaagaaaaugagcuaaguuauggguuaaaaugaucuuaaaauggucacuuuucuauuucuuaguauaguauccucucuauuucuuaaacacuauagaaauugaguacaauaauacuugaaauguauuuugaaaacuagaaguauauauuuuaauaaagaaucaccuagugguaugaagauaaauaacaucucaaaaccaguuaauuaugugauaaagaaagucacaugacccugaacccauuuaguaagaaugucacaggaaagaucaacucugccaaccacaugcagaaaagcuaaagggcgggauaugaccugcaugguuuccaaaucccuguuuagcaacaaaagcagcacucaccugaagauagacuuaccaagaucacaaagcgagugagcccagaaagggugagauuuaccuuccccucaguuaugcaauuaauuauuagugggcagcaugcagcauucucuuaucuucccugacggcaggucuagaacuaguuucuauuuaucauuauuuucaauuuaauuaaaacgaggagagugaaaccuauuuucacuucccaucuguuuagacuuguuuacauuguaagagccccauuuccacuguauugggguguccugcucacuaaggaggccagacuugcagcugauuguugucaacauaacacuuguuguaugccauugcagaucccuacgucaaagugaaccuguaccaugccaagaagagaaucucuaaaaagaagacucacguuaagaaaugcacucccaacgcaguguucaaugaacuguuugucuuugauauuccuugugagagucuugaagaaaucaguguugaauucuugguuuuggauucugaaaggg

SEQ ID NO: 8851 - RNA, 2277 nt, Mus musculus
uacaacugcugccucgccuccuuggccaggggcgacagcugccacccagaacucgggcacacggccucaggaucccguugguccucggcggggacaggcagccccgaggaggccuugccuacccgcgguggcugccuccaugagccccuccccccccguugcgccccgggaccccucgccgggcaccucgagaccccacucuccaggguacuguccgccucggaacugagcaggccucgagaaggccuggcaagagaaagcccggcacagcccccuagaauuccccaccuucucuccugacccagacacagccggggcggacgggaccucucgcgcucugccuucucuuccucuugcuucauggagccaugcgccuaggugggggcucccgaaaaagcagagucccaagacgggugaggacgcccgaaggaggccggcgggagggcacaggaggaagcggcggggcgguggcggccggggagagcuagagguauucccggggcgggcggaggaccgagucgagucgggacccgaguccuccucuaucccagcaggcaccggaggcagugagguaauggaggaagaauguagggaguccuccaguggaccaaacguccucuagcgagucggugagaaccauagagaucccgaagcucugggaggaccgcccauuggucacgugacauuaguccgcacauuuuugugauuggcgcugcuuaguguauaggcaacuguuuucauuuguggggggccgaggcucacgcagauggcagugagcgagucucuccgggaaaaccugacaucuacugggcuccccuugagggugaggagcccaaccaguucagcucacccgaugucaggccggccgcugcaaauuugccuggccgcccgagccaggccgcggcgcagagcacgucgggaguuguaguuuuggucgcgcgacgguauuguccggaggaaggcugcagguggcacuucaagcugccgccuagggagcuacggccuugccccaagcagucgcccacguuagcgaugccauucagagcugccaacggcuuuucuccccaugugcccacgcucccauuacucugccugaccgaguucugcccucgaaagcggcguggaagugcacagcuuagaucaagccaaagauugccagaaccaggcccauguggagugugccaggcugaaugucaaacauuggcaccuggccuccuuagcuucccacugcacuggagaaaggcaggcugacucagcuuuagggauggcccaggcaacaccuacucccgacuguaguucagcaucaccagaagccccagaugacaucagcagaauacccacuauacaggauucagcuuuuuaaaaaaaggacuaagcaacuccacagacugaguaagacagguucccagcacccacaagguagcucccaacugccuauaacuccagcgucaauagcucgaacaccuuccucuggccucccgggcacugcacacacacaugagcuacauauaaacauaaacauacacauuuuuuaaagucuuuuuuuaaguggcucaagcgcauuuugcuuuucuguuaaaguaugaaggcauccugaacguauuuaucuucaaaagaccaaagaacgguguuuuuaaaauauaaaucauuuaacagugcauuaauuaccuguaggaaacaaaacccaaggaaacagaauguucagcgccuuuuagagccaaagaugucaccccuaugcuuuaaagagagggagguaacauaaauguaaucccuacaguagucuucacaauuccuaucacaggcuugaagugcuugcuucuguuaagugucugacuuucccugaugccugaagaacugaaaacuguaugaucaucacuuagagccagaaucgcagcaggcagaaaaccugagaucauguuuuuguguuuucuuuuucuucugaauaaggaggcaaauuccagcuuuaaucaaaauaaauuucacacagugaaguucuuuucuggcugaauguuuuaaaacacgacauuugggaaauggccucagucuauugcucccaggguaguacuauacagucauuaaacagcccagagcuaagggaguuauugcucccugguuaucaagcugccaggagguaaauauuagaacuaagcuggacuuaaaaugcccucaaauuaaaaacaguuguugcuuugagauggucaaaggaauuuucuugagaacuaggguucagauguugucuuuaacuggugcugaaaggcagggaacagaacuuaaaga

SEQ ID NO: 8852 - RNA, 7833 nt, Mus musculus
uaaacuuccaguuuauuguguaccaagaguugauccacaaccuccaugcuucagaagugaacaccauguuaggguugaacaugggcaccaugagccccugugaguccuggauaagauucucaaaccaagaucagaaauccugugaugacauuucaucguacaguaagcugugaagguuuucaugcuuacccgacucucaguggacauucugguacucuuccugcauugagucuccugcugugagcucuguggcauagccugcugaggaauggaauggagaugccuauagaggucccaaugucaucgucguaagcaggugugaaaggagagaucucuuccucaccacccggcuaccucaacucuuuucugguagcagugccuauguagcugcaucuagguucucagaagcacagacauguaaacaggugguuggguugggcuuuaggacauacugucacaggagagcuuccagggucucugagcugguuuucuucacaggcaaacauccugagggaccuuuaaguaggggaguucuuuauucugauuugccugcagaaguaggaagacuugcuauaucaguccucaguaggacuagaacaaugcuguguaauaaaacaaggugaaccuuuaacuugccuaccauacugggacuccucacuucaccagugcaaauguccaaacuguucguguugcucauuuaaacucuugacauucccgcucccaucuuuacucauuccaaaauagcugauagcaaauucuuuucauucauuugguggcaaaacguguaguacuaggaaacuagggaggugcuuugacagcucugucucaaaggcacugacugcucaggcaacucaaaggaaacggccggcuggaagaaaggcuccugaggauggcgcacugguuuucagcaacauucauagagacucgggaggcagauguggccucaaccuggugaacauauguuuugauuucuuuuuuuaggauugauguggugaugguguggcuuuccaaaaugggcaaauauucaaguccuagcucaucaguuucuugugccaggaauggaggaagggaaguagaucuacuuccauaugugcuauucuaggcaucacuucaaaguucuugcgguuuucauuuguuuuguuuuguuuuaaaacugggcagagagguuguaccaggagugaugacagaccuggaauggaugagggaagugcugaugacauuggaaugcccaggaugcauggcccuuacugccaggguggguuccuucacauaccuaggaugaaggggucucaugcugccugccgaggggaaugaaggcuauguuauugacaugugacagcaggugcucucaggugccauggauugaugcagggugcucagcucuggacugagguacccacuuccaauuuguaaaacaguauugauacauagggcuacacucauuacuguucaagcguucuauguuaagaguuguuuaauuucuaaagauuuaaagcaaaaugcaaaaaaaaaaaaaaaauggugcuaaacuucaccccugagcacucagugagacuggucaugcaagcaucuacagugccaugcuccucaagccuguuuuucuuguagaaauguugcccuaucuugucuuucccaauguauaguguguguuuuguuuuauugagggugggguagaauacuugccauuuaagaaaaugacagaaagacccagaaaggugggguuggggaaucgguaaacaagaauccagcuagcaaggcccagcaucacacugaagugggcucagugguuucagagugaagucgccuuacuccugcacauucccucgugcucccaaugcaguucugcagugcaaaugcucaaguuccuccugccuugucaaggagaccuggaaaucagcaaggaaaauuauuugccccaaaagacaugggcucuauuggugucaguccugacuugagcauaggcauucacaaguugaaguacagucuuggucaccucaugggaacauguggcagauagcucucaggaaaaagcaauuguggauuguccacuugggggcuuugcauagggaggucaagcucugaauuagaacugagcugccuuccauacguugaccaaagcagugauaaggguggccaguuagugguaguggaaagggaccguuuccugcccuggguuuccuuuagcuauaggcugcaagguccccacugcucucagagagccagcuaaacugcuggcuugguuuggaauuuguuucaucccuagcugugagugccuuuuggucuggaaaguuggcuugucucaucauacccacagcuaggacauauacucuguaauuaugaauuguccuuguuuuccugagcuaaaagcgaaugucuuugaucauuagaguuuguuaguguuggguuguuuccacugugagguucuuaaaauguuuuugcuuccuaauguuaaaauaacucauguuagaaacccuguacacaugaaaaaggguuuguaguugagacauuacguauauuuuacuguuuauaauaaaucaucuauacaaaagucuuggguguuaauuuuaauauuuugagcaaaaucuguuuuccaugcuauguuaacaucuacaauuucacuaauaguguuacuuuccauugauuucugaagccuagaaaacuguuuuuguguguuuuuuuuguuuuguuuuguuuuguuuguuuccccgaagagauuguauggccuucacugcaaagacuucagaccaauuacuuguauuacacuugguugccucguggcuauauaacuucugaguacacgucaucaagaguccugaaugaaguauuguagagaauaaaucauaauggacaaaaacugucuucugccucugugugaccaccugacuugaguuacuggaaacagauuuuccauuauuuuguuugauguccucauaagagauuugucugccucugccucacaacugaugggaauaaagagaugggaaauaaacccaucccagugagaguaccuguuaaaagauuccuaugagcuagguaggauagagccauccuucaaucccaacaugggagggcuacagugagagacuguuucuuaaaaagcagaauaucaaaaacuauaggugagauggcucagcccaugaaggauguugccaccaaaugaccuuuucaccuugcaacacaauauaguugaaggagaaccacgcuguccucugccucuauauauguggucuggcacagacacacaaaauaaguggugugauaaaaccuuaaagauuccuaucauuugagauuagaggugcuuaaauaugugguaugaaguuguccuuuauucucugagguuaacggugcuaauucuuggugaaaguaggggugauuagauacuuuuaaagcucuuuccaaaccuagacaugguagcucaggucuguaacaccaugauuugggggacaggaagauggacaagaguucaaagccaggaugaacugcaaaaugaaaucuuaugccccauccccaucccugcucccccccaccccccaaaaaaacguugauuaguggcacaugccuguaaucuccggcagaaugacugcugugaauuuggcuauagaguaaagcaauagucaucuacacuggagaaauggcucaaugguuaagagcauuucuuacugaggaucuggauuugguuuucagcacccacauaaccaucuguaauucuaguuccaggggaucugacacacucuuguagcuuucuuagagacugcacacaauauacugauauacaugcaggcaaacaccaggacaggugucucaugccuguaaaaaccaccacuuagaagaugcacagacaggcagaacuuugaaaacucaaggccagccugguuuacaaaauuguuggagugucagcuagggcuacagagugagaaccuaucucaaaaacacaauuccacuccagacuccuggcauguuaaauggaauucaaacuccagguuuaugauuguauaguaaggguucuuaacuguggagagccaugucuuuagcccuagccuguuggaaguucuuuagccaagguccaguacacaaugccagggcuggauggcucucuagccaccuggauugucauaauguuguauauaaagugggauugugggaaaauggcaaacccuuuaucacaguaguccucaaccuuccuaaugcugugacccuguaguacaguuccucccaacuauaagauuauuuucagugcuacuucauaacuaauuuugcuguugugucuguaguggcuauuccugauugucaacuugacuaucucuggagugaauuacaaggcucaccugugauucagaucuugaggcuggaagacacaaguuucugaccuggaucuuggcauggagcucuugcggcacaguggccaugaaaagcuuaggcccaggcaaaguaggaggcauggaggucucuaaguucagcuugggacaaagcaagucccagauccagguguggugguacacaccuuuaaucugggccacaccugcuggagaccuacauaaggacauuggaagaaggaagauuagcucuccgccugcuugccuugugggacugagcaacugcuagauccuuggacuuccauucacagcugcugcugaccauuguuggggagcuggacaacagacuaagucaacaaauuccuuuacuauacagacuacccauaaguucuguggcucuauagagaacccugacuaauacagagucuuaauguuaggagauagaauccuuauguaauuauguuucccaaacuuauggggucaagagucauaacuugaggacuggugcuuuacaaccugggcauguacagggagacaguguuuauguuucaagucaagauaagcugucagaaguugcagacaaugaaacucuggcacguccaguuuggcaaaaacuaguuuauuaggguuacugacuagaguauggccaacucacagcuacacuacugaaaacugccaacacuugugggguggugagcugugacaggcagccuggucccuggucgagcaguguucaguaguguaacaagggcacugguggccaucuagaagaccaucaagcucacucccugauguugaacaccaaggaaagacagaggaccaagcccuggagaaugggaaagugacacaauuaucccuagggauaaaagacuacagcuuggaaacccugauggacucugguuugauaauuuucuagagccccuggggucuccucuucccacuauggguguccuguucagaugccuguccccgugcuuuucugccauuucuccccaugucuucugugaacaagagacagcaaucuacgggagccugcuuuuucuuuccuuguccaccucuuacccucaaacugucucccagauggaauuuggguccucgugcguauaaggacaagcacugugguaacuaaaccaucucuccagaacucacucucuagaccaggcuggccucgaacucagaaauccaccugcuucugccucccaagugcugggacuaaaggcgugcgccaccacaccuggcuacucccuaccucuuaaacagcucugacuucuaguacuugaagcuuuaggagauuaauuuaaaccauauccaaacuucagacucuugaccuucucuuggcaucuucucugacuuucuguuagaucauuugucgauauugcucuagcuacuguuggugagcucauuuggaggacagaaggacaggaggacagacuuuuaccuaacucaucauuuuaaccauauggccuaacagauggcuuauacugguuuccuaaauaaaaaugucauauacaggccaaucugugaaauguaacuuuauguuuuucuuacucucucucucucucucuuuuuuuuuuuuuuuuuuguuuuuuagcccaggcuguccuggaacucauuuuguagaccaugcuggccuaaaacucagaaauccaccugccucugccucccaagugcugggauuaaaggcaugcgccaccacgccuggcuauucuucuuuuuucucucuaugccuggugacuucucuccucaucccucccuccuccaucuuuuucccuauguguguguguguguguguguguguguguguguguuuguagacugaaucucaagcccauuucuacuaccuagauguaguaugacauaaacuauuguccugaaucucucugcaggaguucugauaagcagagcauaucgguuauaaagguuuugggguuuuuuuuuuuguuuuuuguuuugcuuugcuuuaagauuuauuuauguguauggguauuuugucuacauguaugucuacacacuacaaccccaugggacuauaguuauagacccugugagacaccauguggaagcuaggaauugaauccaugaccuguguaagagcagcuaaugcugggagaucucuccagucccuguugugacuucucacaugcuguucaggaaagcaucaugaaaugguuaaaaagccccaucaauacuauauaaccauuuauuuuaaucaaugcauuccuucuacaaauacagauacacagcaguuuuguaaaacucacuuuauuuacaaauccaaagacuaccuauucuugggccagugagaucaugcagcagauaaaggcccuugauauucaauacugaugacuugauuucuauccccagagcccaugucaaaguggaaacagaggacaaauuccacagaaucaccaucuaaucuuuuugugcaccacaguauauuuggccccacauaauaaaaauacauauuuuugucuuguaauaaauacuucuacuaguuuuuuaaaauuuacuuucuguguaugugaagauuguguaugguguguguguguguguguguguguccuucaagagagaccagaaagugcuuuagaucccguguagcuggagucacagguguuugugagccaucuagaaugggugcuggaaaacgaacccacgcccucugaaagcaucaaguguuaaccacagagcagucucuccagcuccuucaauccauuuuuuauuaaguuagcagaauuuacuaguauucacuacuaagccaagcacuauagaguuuccaauagcaucacuucuucauuuagcuuccuacuugcuauucaauguccaccaacaagaugaguucucaauauuaaguucaccugcucagaauugucuuuucaacaggauggucuauaaccuaaguuagcauggauucagggaauuugcuaaauagccacgccucucugugaacauuuuuaaagacaaggccucacuauguaaccugggcuuauccugaaacuaucauuuuguagaccaggcuagccuugaacucaaaaaagaucggccuaccucugccugccucaagcaugcuggaauuaaaaccgaucuccuucaacucuucauccucgcgcccagugguuuacuucaugaccaccacacccggguuauuuuuuugcuuuuugguuuuuuaacauaaucaaaucauugaaagauauuucaguauguuucuguagucaccuacccagcuuuucaucacaggccauuccuuggaucaggcacuuaguucacuccuacaccucacuuucuucugaaauggcuuacuugacucuguggccucauggcaagcggguguugccggaaacaaacaaacaaacaaacaaaaaaacccacaaucuccaagcgggcacuacagaaccccaccuccaacgaccggaagccgcuaggacagcaccccgaccgccccccucgcgggcagccucgcgagcuccccgcaguguagacccuguccgaccugcccuucuccgcccucuccgcuuccuug

SEQ ID NO: 8853 - RNA, 3378 nt, Mus musculus
cgacccuuuuuaauggaugcuuugucugaguuucuguuuguguaucaguugugugucuggugucuuacgaggccagaagugagcaucagauccccuggaacuggaauaauaggcaguugucagugcuaggaauugaauccaugucuccuggaggagcagccacugagcugcucuuaaccacugagcugccucuucagcccugaccacuggccuuucuaagaaagccuuuauaaaagucacggcauuaccagcuguuugucccgugaagacagguuuacuuggcaaguugaguggugcuggacauaaagagaugcugacacaguuggacagugcacagaaagcuucccuagcuccgaggguauggagugaggaaauggggagucucuggaugcucgaaccugaagguuucuagucaacuucaaaaauaaacaugucagcacucacaccauuagagcugcguuccuccacacucguacuccccuggcacagcauacaaauaccuuacaaccagaguccgugaaacuguacaggaauccagagaccauccagcucauguuuugagaaugaauucauuuauaaacagaaccucuacguuagacauuaaauaucuacauacagcauuuuuagcacuacugucaaaauauaaaauaacuguuuagaauuuuauaaaacauauuuucaaguaaugaauucuugggacaauauuggaaacaauuuaauaucuugaacauaauaacaaaaaaugcauaucacuacuugaaaguagcauuuccuuuccugagagagguggguagcucuauuuacugccaggagagcauagcaaaaggacuacuaagggcuaguugucuuggaaaucugugaagucgggauauuggccaguauaggaucacaucuuggggcacuguuugaccuaaccuguuaaggcaacauuggagcagccugggaaacaauuacuuucacauuguacaagccagugcucagauaugggucuuaaccucagcuggacauguaugccuuauauauuauuauacauaaaaaaugucuggacccauccaccaguauuguaagugaacugaugggauguggcuucuuggguacuuuugaugugccagucuagugugagaaccacuggugccacguuugaaguugaauacccuuuacuuucuaaggcauccaggcucaauacugaauaguguuucuggcaauaaauuacaauagauucaagugcugauucuccccagcaccauaaaaacuacccgcugaacuuuacguaugcaaagcauuuuacucaacauuaucaaacuacguaggacuuuuaccaagcagcaaauguuaggaaucaugaaagcuuggcaaaccugucauuuauaacuauaguaacugcagaugucaaaauguccuguaucccaggauuccuuuugcagaaaccuuugcaaauuuugccaaucauacuggauaucuggcuuuuugguccagaauauugcuuugacaaguaaauauuuacacuuaaauauuauaaagcaccauauuuacuucuuaacugaagaaaaccccugagguagaauguauuaacuaaucacuauuuuaaagccagugguuaaauuuacuguuuaaucugauaaucuggauugcuuuacagugaauaggaaauaaggagggucuggaaagcugccgcugaacugaaacccaacauaccccugcauuucuuuaacguagaauguaguucuuuccaaagcagcuaagucagaaagcuauucguuuuuuuuuuuuucucgcuaaaacugacguccguguaaagccaguuuagugcaaaagcaguucaugauagugaucuccaggcgcacuguuaaaucagacauuuucguggcccaugcgacccagaaccgcacaauacugaagccaaaggaucuugaagccgccggugcaucaguucuugacauccgcuucaagcgcacggacuccgccgcgcaguccaguuggugccuuguccuuguuggccuggguacaguggagugucccuagccuggcugguuuccucuuccucgagacugggacugucacaccgggagcgcguuggcuaggccagucccgcgauuuaggcgaccgagcgccagucgcagcgccgucacaccgccccagggcaggagcccgaucaacgcguagagcagcgcggcuaccugugcgcaagcgccgagcgccgucagcaccguacugcgcaggaccagcgcggcguagagcguggcgcccaaggcggcggcguagccaagcgugcuccgcgagggcgucuccucgccgcguagcaggcggccgcacgccgggccgccccgcagcagcgccgcgcucgcccacgccagcaccgagcccagcgaccagaggagcgcgaacuugcgcgcgcgcagcagcagcaccggcgcguagagcgccgccaggccgaagcagagcgcggccagcagcagacacaggccgcccgccaccaggcgcuggccucgcgucacgcuggggaggcagcgcaagcccgcggguggcggcucggcagcgcucugugcccacggccaucgcagaacccugcugccuagccaggccccggccucaggcuccucugcugccuucgcgccgagcagcggcucugcggccgccggccugcucgcuuuccccugcuucagguagucuugcagcuggcgguggagauccgccaucucggacccgaguggcguuggaaacggggcugacacuuccgggguuugucaaccccgcgaccggaaguagccggguccucgggcggcgauuggucggccugggcggaagugguggagucggcuguccagcuguguuguguagucuacgagauccugaguuuuguguuuuagucaccgaguaagucuugucagcauuaaaagacacgagagcagcuguagcaauaaaaggauccauagggacaucuagugacacgcguauaucaaugucaggugucuaacauugcuaaaacugugauaaauggaggaaucugggggaaaggguaaacacuuuucuuuccuuuucucuguuuccuucucucccccacccccuuuacaaguaucuacauguuuacgguuaccucacaauucuaaugaaggagcuggagagauggcucagugggucgaaacacuuguugcuuuugcagagaacccagguuuggaucccaguacucacagggcagcuaagaacccguaacuacgguuccaggaaaucugacccccucgcaugugguacacuuaacaacaugcagacagaucacccauauacauaaaaaaaaaaaaagacaauuaaaaaauucacacuacagaguuuaggcuauuuccuuugaaaguggaguuaauaaaaggcuaacuuccacccuua

SEQ ID NO: 8854 - RNA, 65425 nt, Mus musculus
cagacaucacgggucuguguacaguggcggcccggcuguccucagcugcaucgcccggcgaggguggcgcggcguuccccggucgcgcgaccggcgacaaagacgacccacaguggacgauccagcggcagagucgccgcuuccgcuucgcugcuucuccggucaccggcgacgcgggcccggggcuuccuuuucaucggcccagcuuauuccgcgggccccggggcugcagcuacccagaagcggcgaagaggcccugggcugcgcgcccgcugucccaugugaagcagguugggccugguccccggcccgugcccgguugucugcugcggcccuucaggccucagggacccccgcgaggcgcugcuccuggggggcgcggugacaggccgugcgggggcggaggggccagcucgguggccuccucucggcccucggcuccgcgauccccgcccagcggccgguaagugcuucugguucugcgugcgacugggcccuuggacgggaauuccgcugcaggggguggggguauggggaguagggguagcccugcuaggcuaggguugaccccagaacccccaggucagcgcgacgugggcugggaaacuguuuuagacucguacuccgcgggaauuuuauucuaaccagaagguugcaaguagcuagucgaagggaagcagagaccgaugugcgcuaaaccaaaaaaagugcuugucuuuggguugucggaauggcaggcuauugauggagguugauucccuuuaccuuggagcggucggccagcccuccgugugcauagaguagagcccuacuuugcucucucuacuuguauaucgacucaucucacuuucccagcccugcgauuaugcauucuaccagcuuuaaaaaugaaaaaucaaggcucagugagauaaagguauaacuucccaaggucaugcaagugguuaucgaggaagcagauauguuucuguagggucuucguuucuccguccugcaaaaguuaagugccguagggaaaggagauugguugaagaguuugucccugcuuguaccuggcgagauagcguuuacacuuuuuugacuuaaguugcuggauauauauuuuguugcagcuugccuucagucauuuuagucuuuaaagacauuacuuguggaaaaagugguucugugcauccuuuuauguacggaaaacaauuugccaucuuaccgaaaagaagaaauauacuugauaaaacugcacauuucuugaggcgauguuuuacuuuugcgcguuguuguugguguguauagaaacucacaguuagguuauuuccuuugcuugagaauuccuuauugcaaacuuuugcuggauuguguggcaaucucaguauucugagauucuuugcauugucuuaaguaguaucucaggguuucauuuaaagucaguguguaaaauaucacagaaaguuaucauuuguuggcaugauuuauguaucuaugcaaaaugcuacuaauuauacuuugcucucuauacucucuaacuacuaauuaguuaacaagcugacagaaaauuugcauuuuaguaccacacuguacuguuugguucgugaguaagcagagcuggaccucuuuacagaagaaaacgcugguaaaugccuuugaaguaacugaagcuucauguaacugcagaugcucaauuauaauacucaaauuucauuaguguauuacaccuugaagaaaacuugcaguugacuuuguaauaauguguagggaagaggucaccuuuacagaguuaacaggugaguggcucacagacuggcuugcuugguuagaguacagacauuuguugaaguaggcucaauuugguauuauuguagaaugguugucuagucaugcucucagggugucuccuuagaaagacuagcugucaagagcuuaucuuaaauaaugauguauuaagauggaaucuuuuccgugguguuuuagguggagugguguuccucagcugacugcugccaaggggacagucuuacauuaguagaugcugcauugcuuagugugcgucugcguuugcuuguuucucccuuuuggaaaacuggagcucucuaggucucuacaacguuuuaucaugaaagcaauuuaagcauaaagaaaaucuaucaguaguaaacagccauauggugaccucuccacucaacauuuguugauaacuugcuguacacaauguauauuaguuuugguugaaccguuugaaacuaaacuguugacaucaugacacauuaccccuguugugucagcuugcuuugccuaaagacaaggguacuguuauuguuuauuuucuucaacaugauaaauccuuaguuuaacuaaaacaaaacaacacaaaauccuuauguguaugugugcaugacuagugccugcggaggucaaagagggcauccgaucuagaaauaacauugcagguaguuguaaacuaccagaugggggccgaaccgaaucagcauccugugcaaggcagcccgugcuggugcuccuucuuaacugaugagcgacacuuccaguccuuccucacugcagucuaauagcacacguauuuacaucucucaaauuguccugagaaguguuugagagcauuguauacagccuuucuuacccaaacccgaucucaucagaguuuauuccuuuugaguuucuucuaauuuagacuacccaaacccuccuuguaaaauaacagagaccaagaguucaguuaucuuagaaaaugacucacauuuugcauuugucacacauuuuccuuccagugaaggcagcuagugggucuuuucucuccccuacuuaaacuaacuguugauuguaaacaagaauaucugauaaauuagacuuaguauugcuucccauuuugaaguucacacugucuaguuccuuuacuucuugaugcuguugaucaugugguugagggaauuauaguaagaccuguugcuuccuacaguuagcaagauaucuguugggggauggugguacauuccuuucaucccagcaccugggagaggggcagguggaucucuuugaguuugaggcuagcuugguuuccauagaaguuccaggacagucagggcuaaauagagaagcccguuuuccuuaaaaagaaaaaagaaaagaagaugcaaaaauaaaagacaucugggauuaugauaaguggugguucuaaccuguucuccaaucaucuuuaaauaguuuuuuauucuaugcguuuggguauuuuaccugccuguauauuucuacaccacaugcuuggugccugcagaagccagaagagagcauuggaaucuuugaaauuggaguuccagguuguuguaagcuacuauguagguucuggaaaucgaagcccaguucucugguagagcagccagugagcuuaacugcugaggcaucucaucagcuccucuguagucaucuuuucacuuacagauuguuauagugugauaauccuugucagucugacuugugaauucauuguuggucaacagguguaaacaagaucauggaaauuguaaaauauccguagcugcucuauugaauaaaaucugauuuuguaauuuuuuaagacuuuuggugaugguuucaaauuacuggcuguuaggaacucuuaaagaaacuuggcuucagaagaacuggaagaauucaaugacagccuguucuuguaauaaguacuuaguaaagaaguuuguuuaaaucugauguagucaguguugguuggguugaagaacuaaguuguauguugggaggagugauauauguagcucacugguuaaaaaaaugcuuugagugcacagggcccuggguucgagccuuaccacccaaaacaaaacaaaacaaaacaaauugugguuuugaacuuuacuccauauucuauuucauaauaauuguauaaauaagcauuugugaauaaagaaugaacugauauugaggcauauuaauuacauuuagaacuggaucucauuuuuauuaagccagauauaaauacauauguaauauagaaucaaauuuauuuucaacaacauuaguagaugaauuuuuaaagguuucauaauaagacuaaccaaguagcacauuuuuucauuaaaaauauuuaacucaugaaacaguuuugaagacuuuuuaccuauaucuuuguaaguuaagaugaucucuauauacagaaauaaaaagcuuuucuauuuuucuuaaaaugcuuuuguaguauaccuauauaucuaugcaccuauauguaaaugcuucaaagaaacacuaauaugauuuuggcuugaagccuuuguauuuauuuugaauguugguugacaguguuccucauuguggcuaauugcauuugcauuguaauugaauuguugcuuuuguuguuauuuaacuuagacuguuguuuuauuauuauucuaaaacuuauauauaugugcacaaugcagggcagaucccucggaagcuggaguuacagccaguucuguaccaccugauguaggugcuagaaucagcucagguucucugcaagagugggcuuacucuuaauagcugagcuguguguagaugguucaaagccaugcacacacaggcaccacuaugaacggaguaguuaaaaaccaaaagcaaacacaugaaguugggagggaaaugugaugauggggauggagaaagaacugcaggggacccaguggaguaacuuggaucaaaauagguauauguguugugggacuuucucagaccugccugaaggagcaguaaugacaggagacuucuaucauaguuuaaaguuuaugccuuuugcuggggcagucuuccagcuaccauuuuaacuuaaccugaccaucuagcuagccuaugaccugccacauggccagcucuauacuuuucucugcugggguccaugucuguuccuuuccuugucuuuugucucccugcaucacucucuuuguccccuacuuugccguaguuauuggcugccagaucuuuauuacaacccagucagcagugaggccacuucugauauaucacuagguugccuuuaggcuggugaggaaggacauuuacaaaacagagaaacuggugauggacauagaaaugaaaauaccagaguccugccagcacucaguucucugccaguacagaauuaacaauugaaaauacagagacaccuucacacaacgugaagaaagguuacaccaacguauaugcauguaugaaauucucaaaaacuguuguguuccguaagagucuggugguuuggcugagaaaugcuuccauagcugugggcauuuuaacaucuggucaccccaugggguaacacuguaaagcuuuguccugcuucuagaguucucucugcuucguuguuuucaaguugaggauguguguguuuguguccuguucugacuuccuugccugcugcuugcuaccaugcuuucuuguugugaugaacucuuacugucuggaaccuuaagccaaauaaacucuuccuucugccuugaucacgguguuuuaucacagcaacagaaaagugacuaauacagaaguugauacuacagugaggaaccuggccauggguuuuuguuuuuauggaauauggaagacuuuggaauuuugaauuggaaaagcaguugaauguaaucaggucuuaaagggcuacccuacuaaaaacuuggagcauuugaacuauggaggucuacuagcuuaaguggucucagagaggaaagauauuagcacccagguuagaggcuguuucuacaauauuuuggcaaagaaucuggcagccuucuacccuuacccuaagaacuugccuaaggcuaaaacuaaaaguagugggcugauuucuuuggcagagggaauuugaaggcagugugauauugaauggcuuuaugcagaucuucagugaaaagagcaacuggggcagaaaguagcacaaaccgcucaguuuaaggaggaguaccacugaacuuuguuguugccaagacuugugcggagggagaugagauuaagaucagguugugaagauuccugugcauuggaauaaagggagggguccccucagggcgauacucuguaugcuagcccguucccaccuccucaagcuuucaacuugugaaagcgaugaggcugcugcuaguguggcucaaggggcuagucuccaucccacgcuggcagcagaaccuggcaguguuggcccuggacugcuggcacuggagacaugaaggaugcaagaauggaagcguugugggguuuccuccaugguuccagagagcagcugagguuagguagugucuggugagaggcccugagaggccauugguuuuaagcugugaaagcaaggucuggcuuagaagaacccacggucuugaagagaucagagucaaaagauuucugccaagagcuguauacagaaaguggaagcagccaaagggaagauggaaccguauuuguuuuuugaccgagaacauagagcuacaggauuugauauuuauccugcuggguucugguugcuuugguccuguaguuccucauuauuuuccacuuuuuccuuuuggaauggucauguauauucugcgccauaguuggaaguauguaaguugcuuuuuuauuuuauugaagguuacaauuaagagccugccuugagcuuuccuaauagugcaacucuuuaauacagucccucauguuguggugaccccuaccauaaaauuauuuuuguugcuacuucauaauguaguuuugcuacuguuaggaaucguaauguaaauauuugacguguggcaaccccugugaaaggguucuuuggccccaccccagcuccaaagggguugcaacccacagauugaaaaccucugcccuugaaucucagaagagacuuuagacuuugggcuuuuaaacaguguuaagacuguguuagucagaguucucuuaaggaacagaacugauaaaaugaaaaaaugaauauauguauauauacauauaaaggagauuuguuagaguggcuuacaggcuguggucuggcuaguucaugaauggcggaauccugguagaaagaccaagaauucaguccaggagacuguaugucuuagcacaugugcaagggccuuagggaauuccuaggaaguugcugguuuuuauucugugguggaaucuccaagagguggguucuacaccagcaaaggaaugccucagaccaugaaagaugaauuugucagguagaguaagcgcaagcaggcauaugcuuuucuguggucccgacuuagaguggauccaggaaagaaaacccccucccucauaggcaugccccaacugccuggguuuuagcugauuccagacauagucaaguugaaaaccaacauaaggaucacagacuauaaaagauuauaaaggucuuuugaaguugggcuaaaugcauuuuggguuaugauuuggccaugcaacuguuggagccagggaagggaauguggugauuaaagugagaaaugucccuccuagucuugaauuggagcagucaguguccaguguggugcugugugggcgcacauugcuagaaguguguacuuggauuugggcugugagagcucaaggccucggccuacuuuugguuuguccucucucucgugcuugugguugaggagugagcugaaguuuuuuucucuggcugcuugcauguagccuucuaacgcgcuuuccuaccucagggaccauaaacccaaauaaaugcuuccuucucuaaguugccuuggucaagguauuuauccuggcaauagaaagauaauaauacacaguuuuucagggauaugccuagaagugauguagcuggguuauuugguggugcugguuuuagcuucuugagaaaccuccuauuaauuuccauaguggcuauacaaguuuacauucccauuagcaguauguaaggguuccucucaacccacacauccuugcuauaauuggucguuaguucccgccuucucucuuuuagggugauaguuuuucugacuaggguaaaauggaaucucaaaguaguuuuaauuuggcugaggauguugaacacuuucaaauauuuauugguuguuuguguuuuuucucuagagagcuauccauucauuugauauagcucauuuauugauuggaaaaucuggaauuuuuaguauuuaauuguuacaguucuuuauauauucuagauauuagaucccuguccaauggguagcuggcaaagacuuucuucauacugcagagcgauugcuuugcuuugcagaauuuuuuuuuuuuuugacuuguaacugcauuugacaacucuuuggcuuccuuucugugcuauuggagaucuuuucagaaagcccucacauguagcagugucuugaaguuuuuagcuaugucauuaaggcuuuuggucuauuggaauuauuuuuuugugcagggugacagauauauggaccuaacuucauccuagcuuuaauucugugcuuaacucauuuaacucuguucuccuggcuugacuucaucuugccuacccacccacuccuccuuuaaaaaacaacaaaaaaaaaucucauucuugguuugcaucucagccgcgucuuuucuuuggcuuucuguucuuacuucaugaggcuugucuucuggaguugaggacaucauaugauuuucuguaaguuuuagaguguagaagaaggagaaguaacauuugaauguuuccuguguuccagaaacuucauucaacucucgacauuauacauuuuuauuauuauuaacuuuugcaaugccugggguguugaagccuccucaauaauaggaaggcguucuguuacuuagcuccccuagccaccucugcacagucucuacaguuuauuuauuugcuuauguauuuugagauagcauuucacaauguugcccuggcuagugcuagucuagaguuugccauguagacagagauggccuacagcucagagaucugccugccucuaccuccugaaugccaggauuaagaugugugccaccaugcccagcauuaguccacgguuuuuaaccugugaauaaccauaguagaaacugggccuuagaggagcuuguccugaguugucaacauuguagaguugaguuuuucaugguucuuccaguuagagcaaaggcuacuuccacauugcuuacaggcucuugccacaugcuuuguucucugugggaauguguguacuagaaccuucugaaauaaggcaguguuuccuauuuguguaaaaauuccuagaugaguuaguccucauccccaucaucauuuauacuugcuaagucauggaauucugaucagugcuugaguaagcgugaaugaggcauccacuaguguacacaugcacacacacacuaaaacugccuggcaaguguacucacuuuaauaccgggauacugggaguaccugacacaugauuagaaaacugaugguauaguuuuucucuagaaugaauggguaguguuuucaacaugcuuguauuaaaauuacaaaucucugugguugaaaacagcaaaaacguuuauauuuuaaucaugcuacauauuguuuguggaagcuacucccuucagaaauugucuuggccagaaauuccuuaggcaugucccugaguaaaccuuccaacccaaggaaauacucagcagccaauuucuaaggcauaaaauuuuguggugcugauacauauuacaugauccuagaauagccggugcauuuuuuucccucguaucacgggcuauaaugucuuaggagugaaguccuuagcuguggcuauacgcuaaucucaguugagcauaugcuccaucgucuuuaaaaggagacuguuaguuggguucuagugcuugccuucaagcucagcccucaggagggagaggcagguggagcucuaugacuuaagggccagucuggucuacuuagagugcuccagucuaccaggcuggccagggcuacauagugagaucauccccccccaaauaagaaacaaacaaaaacaaaaacaaaagcagaaacagaaacaggaagaaaaaaaaaagaaaaagaaaacccaucuaucugcauuaucucuauuuuaaaaagaaaguuccuaaguccuacuuaauaguaauuauuacacuuugugugcuaggaaauacaacaagauauuacuaugccagcaaaaugguaagaugguacauuacagucacggugcaaucacagcuucuuuaacugugagucacagccucauaugggcuugcaauccgggguaguuugcguaauguuuuggcaacaggaaaagguaucugaauucagugacaaaauaaacugaaaaucuggcauguagcacauccagaguguuucuggcagugcugcccuugucgcauucagagaccucauugcaccuuguuucugaacauacaacaugugcugucacacaccauccuguaacagugaacacugccugguuuuagauucuagaucaucgugaauuaagaauugugguguuuuuaacugugugugcaaaguuuucucuuagagaagcauaauuuaauuauggaaaacaaaacauacuuuuuuugcugccaugucucaggaucuaaauaauaaauuaauauaguuuuagauuguguuaggaugauuuuuuuuuuaaugcgguuugaggaguguggagcuagcucuggcaguaaaguaagcacgggccaugcaggcgugaaggccugagucaguccggaccugaggugaaagcuggguguaguagcauuggggaguggggggagaugcugacaagugaccucugaggcccuugaccagcuagccuagacugcuugauaaguucuaagccacgagcgacccugccuuagaaacuaagguggaggcuucugaagaagggucuuacacgugcugcuugacuugcugacuugagcugcauaaggaaaauuauucuugaaugaauuuuggguugagauuaagcacuuuuugaaagggcccaacauuuacuacugccauuuuguacuaugugcaguguacucugaacacugaugaucacaaaaucaaauaauggucaacucugaguaauuuggaaggcauucuuuauguuguagcacaaucagucaaggcuucauucuuaagagcauuuuauaacuauaacuauaaaugaaaaacgagcaagugcauccauuucaccaaaugcaaauuugcuuucaucucuauuaaauguuaaaaugacaucucuuccaaaaacuuauuuuaaaauaaaaaucuaggaggcaagcugguucaucaaggaaggugcuuuugcucagugugugccugaugaccugugugcgauccuggacucugcacagguggaaggagagaacagaccucuauaaacaugccacggaaugugugugccuucacauacaaugagaauaaugagaauaauugaaaauccacuucuuuacaguuaccgucagaugucugauuuucuuuuuguauaccccgcuguuuaaaauucucgggugaaaagggcugaguagaaaagguuucacaaguucugauauaaauuagguuuuuguuuagauugaaacagaagacacuggucacauuuucuuauauaagaauaaaguguucucuuuuaucuuaaugguggcaggcaugacuuuucauggggagauacaacacacaucuacucuccaaagauagggagcccaugagggccaaaguauagauacccccaaagucuaacuuggugaaucaguaaguuuuauuggguuacuuacgggaacaugggugagggguuacuuaaaggagcggaagugacucaaagacaacagcaucaccuaaagcccaccccagcacgggugacagcccagcacgggugacagcccacaagggcuggaaacccggagcacacugcacacacagccugcagagcauaacagguuggagacuaaguuccggucuccaagucuuuucugcuguuuggcuuugacugauaucugucaucggucuggugcuuacuugggaagagaggggccuagugaaccuaguaguuccagggacguccugaagcgcuuuugaauuguuuacauucuuugucuuaaggagcuucccuggaggugaaauguuucaguccauuagaaaacugcaacacaacugcaagugguaaaccugcuugccgcccucaguuugcugcuuauuagaaacaggcugaggccgaacgcuuuuaacacacgggaaccagacccaggccugcucugcuucaugcuuucccacagagcggugacccccgcccugaccuuaggauuuauaaaaguacauuugccuggguguucuugugugaaagaccugucuagcauaugauuaugagacccacaguuuaaaagaggagagguaguuuguugucuuucuugugaggcuguugaacaugacaguaguaugaggguagauuugguuuaggacaguucuuggaaacgggauaaauagcuuuauuuaaugugauuaauugaucugaauuaaauuucuuuuuuuuuuuuuuuaagcuuuauuuauuuauuuauuauauguaaguacacuguagcugucuucagacacuccagaagagggagucagaucuuguuauggaugguugugagccaccaugugguugcugggauuugaacucaggaccuucggaagagcagucgggugcucuuacccacugagccaucucaccagcccugaauuaaauuucuuaaaagcauuuuacagccuggucuacaaagugaguuccaggacagccagggcuacacagggaaacccugucucaaaaaaccggaaaaaaaacaaaaacaaaaacauuuuauacccagaagguuugguagugcaaguuuucaguggauccuugaaagaaaaagcuggaaguccuggcaguagugauguaaccaggaaguaccagguccuagaacaucacuaggagacacuagucucauuuucuuauagaaagauaaaauguucucuuuuaucuuaauuauucacagaagaauugaauuauucucacuuuaugacuagagaaagugaauguuguguuuauugcuaacccugacucauugaccguuguuaaugugguagcugcgcuaacugguguccucacuacuaaauccugcccugccccucuuuaauaagaggagaaaguagggagaguggcuuuuuuggaagcaaaaauggguauugcagaagugauuuaauuggaggccagaggaagaccaagcacccuaaauuugguuaugaaaaagucucagaagggaaaguugcagacauuucuuggucaguggauugggagaaggacggugcuuguaccaugugaaaguguuaucaagaagcacagcuauacuggaauaagagauuccaggaaggaguaaaagcagaugcgguugugggcgagacuccgaaaucccacuguguaaggcagauuugagaaaagccacuuagcaacuuguuugaaacagugguucagcacaggugacaggugaaccugggggccacgugguggagcuggugggaagucuuccagaugauguuucugcacagccaccucuucauuggcucugggaagcucgcucgcuuuuagugguggaucuggauuuggaagaacagccauaugugaggcagggagacaagagauaugguggaaucuguuuacaacccucaaucucuaccuagucauguuuuugagagaaauuugcuuuucuggccaacaguaaucuggaauaggauguugggaaauguaguuugaauucauuaagcugguguaguaccacuacuguaacagucaagggagggugaacaacuccacagaggaagauauggaagucgugggaguuugcagucucugcccguacuaaucuaguaaugccaauugcuuaaccuauccacaccuggcuuuuuaucuacuuuauauugcugugaauaguuuuuaucagggucagcauuguguuacagcucugaggaaagguuuccccagaggaaguguugcaggucugaagugaagguuaucuugccagucuggagccaaggguuaccacaaagucacaguacacaacaaaccucauauaggagauuuauugggaaagaggguggcuaccugugcucaggugagaagcagagaaccgaguggaggcaggcuuuacaaggguuucuuguggauggagauugccagggcagguauuggugggauuucaaguccugagcuuggagugagcucaggggcuguuggguggaggagcuuggacuuuuuacccugcaggcaaugguagaguaagugccguagcuuaauuaccacuaguuauuacagaaguaauggcaagagagagaaauacggcacauugugaagggagagguggagagaagagacaugaguggagauaagaauauaauaugaaguccauauauuggaggauuuucagucuagccugugagaacacauggacucgcagagagauagcaaguccuugagaguggcuaguguugagugauggugugggagcugcuuaacguggugccugaugcucccagguaaugagucuccccacugucauuuacagagaugaucaaagauagacauagccuuuauaagauauuguaugcaugcuguggcauacugauagauaaauguuaaaagaauuauccguauuuaacaaaaauaaacuggaauagccauuagcaaacuggaauguaugauuucccugcauguguaaaaaugaaugucaugcaaugaaauauuuacaaagugccaugggaaucuuuaauauaaaacauuauauccuaaaugcucacauggaaaaaguaagcauuuaaauauaauuauguuaguaguaguauugguauuuuaggaacgaaguauauuuaaaugucaccaucacuuaauggaaaugauguaaauagauaagaaccucagcuuggccaauacaaauaaauuccauauuggaagagcaugcuccagcaugagaugcagaaaguggcaauacgguuaauugaauuuuuuuuucccuuuuuuggggguggugauaguguuucauucggaguuuuauucauccauaaagaaaauuacaucauuugcaguaaauggacugaacuggagaccauugugaaagugaaauaagcuugacuuagacaaauaaaugcuguguguuuucucauaugcagagaaacuguuucuuguauguauugguauguguauagaaguaaggauuacuaaagaggagcuggagaugggcacuuggggugguagaaagguaggcccaggaaguaggaucuagcaagucuuuugaaaaagcagguaguauguuaguaguuagucacagguuuuuguuggcgauuggaguuuugguaacggucuuuugaguuuugagccuuuaguauuauuugggacuuauauaaggagcagaauagggcuuggagugguuaagagcccauuguuuuugcagaggaccuggguuuguuucucagcaccuacauggugggucacauccuaaccccagugcuggagggucuggugacugcaguucucucagggcaccaggcauacaugcaggccaagcacuuaagauaaauguauuuaaaaaacgaacggcagaaaguauuaaacuucuaccagcaaaauaagugggaccagguauuguuuuauuaggucaguguuaagguguaaauguuauugcuguuguuauuauauauauuuuuugagacauuuuuugagccuuagauguccuggauuucacuccauagaccaggcuguccuugaacccuagagaccuuccugccucugcuuccugaguucuaggauuaaaggugaacucccuacugccugguguaaauauuacuuuaagaaggauuuguuagguuauuauuguguguauucugaugugucugggagugcacaugccauggugcauguggaggccugacaguuguguggaauuaguucucuccuuccaccuuacguggguuauagggauugaacugaggucuugagguaccucuaauaagccauccuauuggccuuguaaauauuacauuuacacuucggaaauauuuuagauuuuuuuuuuaguuaaaaaaugugcuuuauccguauguguguacaugcuuguguguaguagaccagauuuucccuuaggagaccaaugguccauuugguccuugcuccauuuggaguugauuuuugugcagggugauaaguuuggaucuauuugcauacuacuguaugcagucauccaguuagaccagcaccauuuguugaaaaugcugugugcuggucuaacugaaugucuuuuuccaguguguauuucuggcuucuuacaaaaaccccaggaguauguguauguccuuaugccuaggucuucaguucgauuccagcuugucuguuuuuaagccaauaccagacuguuuuuguuaccuuuguagcacaauuugacaucagagauagugaugccucuaacaguucuuuuauuauucaggacuguuuaaccugucuuuaguaauuuguguuuccauaugaaguugaaaauuguuauuuggggaucugugaagaguuguguuggaucuuucauggggauuacauugaaucuauaguuuccuucugguaagauggccauuuucacuauauuaaucucaccaaaccacaagccugggagaucuuucuucugguaucuucuucaauuucuuuguucaaugucuuaaaguuucugucauauaagccuuugacuuguuuggucagaguuacaccaagauauuuuauguuuuuuugagccauugugaaaagcauuauuucucugauuuucuuucucagucgguuugacauuuguauauagcaguggcucuuaaccugugguucacgacucauagucaagcaacccuuuuacagguguagccuaagaccaucuugcauaucagauguuuguauuacaauucauaacaguagcaaaauuauaguuaugaaguagcaaugaaaauaauuuuaugguuggggucgcuaccgcacgaggcuguauuaagggguugaaguaucaggaagguugagaacuacugauguauaggaaggccgcugauuuuuguguauuaauuuuguauucugcuacuuugcuggaauguuuaucagcuguaggaguuuacugauggaguuuuuagggucgcuucuguuuucuaucauaucaucugcuuugguuuccucuucuccuauuugaauuuccuugaccuccuccaguugucuuaaugcucuagcuaagacuucaaguacuauuuugaauagguauggagagaguaaacaacuuugucuuguuccugauuuuaauggaauuguuuugaguuucucuccaucuaugcugauguugauuauguuuguugucagucaguuauuauguugagauauguucuuuuuauuccuaauugcugcaggacuuuuauuaugaagggguguuacaguagguggucucuucgauguguucuuggauuuggcuugcaaguauuuuauugagauuuuuuuuuuugcaucuauggucaaaagggaaauugguuuguaauucucuuucuguguugggucuuuauaugguuuagguguaagaguaaauguggccuuguaaaaagaauugcaguguuccuucaguuuucuauuuuguggaauaauuugaggaguauuggggguaaacucuuugaaaaucugguagaauucuucucuaaaacuaucuggcucugggauuuuugguugggagacuuuuaauugcugcuucuauuucauuaaggauuauaggucugcuuaaauugcuuaucugaucuugguuuaacuuugguagguuuuauauauuaaaaaauuauccuuguuagacuuuccaguuugguggcgugcagguuuuuuaagucugaccuucugauucucuggaucugcucagcccgugucuguuauguccccuuucccuuuauuuucauuuucugucuaugccuugagcuauuuuggcuaagguuuuugucuucuuacugauuuuuuucauagaacuaucucuuuguuucauuacuucuuuguauuguuuguuucuguuuuauugaguucagccuugaguuugauuauuuauugccuucuacuccuuuucggguauuaucccccccccacacacacacacacacucccagaguuuucaggugugcuguuacguuacuaauaugagaucuccguuucuuuucuccuuuguagacaugcagugcugugaacuugccucuuagaaccaccuucuuuuuauuucauaaauuuaaauuauguuguguuuuuauuuucauucaauucuagaaagcuuuaaaauuucuucccuagcucccaauggaggagcuagagaaaguagccaaggagcuaaagggaucugcaaccuuauagguggaacaacauuaugaacuaaccaguacccaggagcucuugacucuagcugcauauguaucaaaagauggccuagucggccaucacuggaaagagaggcccauuggacuugcaaacuuuauaugccccaguacaggggaacgccagggccaaaaagggggaguggguggguaggggaguggggguggguggguaugggggacuuuugguauagcauuggaaauguaaaugagcuaaauaccuaacaaaaaauggaaaaaaaaauuucuucccuaauuucuuucuugacucuuuuuuuuauucaguugugaguuauuuaguuuccaugaguuuguagacuuucuuuuguuucuguuguuauugauauccagcuuuaauccaugguggucagauagaaugcauaguaucaauucaaauucuuguuaucuguugcagcuugcuuuguguccaaguauguguucaauuuuggagaaaguuccauguggugcugaaaagaagguauauucuuuuguguuuauguauaauguucuguaacuaguagcuauguccauuugguuuauaauguuagauagcuccagcauuucuguuuaguuuuugucuggaugacccaucuauuggggauggcagguuauugaaguuagccgcuuucacugugugagggucugugugauuuaagcuguaguaguguuucuuuuaugaaguugggcauucuugugugcuuggugcacagauuuuaacaauugcaauauguucuuggauuuuuccucugagaauguagugaccucuaucucuucugauuaauuaguuuugggaugauuugugaggcaguaaaauggcuacacugguuuguuugguucuaaggcuuguuuacuuggaaaaucuuauccuuuuacucucaggugaugucuguccuuaauguuaagguguguuucuuggaugcagcagauggauggauucuguugauguuaagauguguuuuucagauguagcagaaggguggauccuguuuucacauucagucuauuagucugugucuuuuuacuggggaauuaagaccaccauuguuguugagaauuaucagugagcaguguuuguugauuugccuuauuuuguuguuuguugugguguggcuuuuuuuuuuucuccccuucuuuugauuagcuaguuugagauuaaaauuuuauuacuuguguuuucugggugugguuagccucugcagguugaaguuuuccuagagucuucuguaucacuggauuuguagauggauggaacuacuuaacauuggcuuuauugugcaauaccucucuuucuccaucuauuauaauagaaaguuuuucuggguauaguaaccuggacuggcaucuguggucucuuagaguuuguuggacuccugccuagacuuuucugacuuuuagaguuuguguugagaacucaggaguuacuuuaauagguuuuccauuagaucuuauuuggucuuuucccuuuccaauuuuuaauguuccuucuuuguucuauacauuuaguguuugauaauuauguaucaugggauuuuuuuuuuucugguccagucuguuugguguucuauaugcugcuuguaccuuguuugauaccuucuuaaaucagagaaauuuuccucuauaauuuuguugaaaauaauuucuaugccuuuaaccaguguuucucuucuuccuuuauugcuguuauucuuuuauuuuugucuuucauagugucgcagauuuucuggauguuuugugccuggauuuuuuuauauuuaaaaauaucuuugaccaaguuuuccauuucugguauuuuguuuaagauuguuuuuuaucuucauucuguugguuacacugaauuccaucuagacaguagagguaaauuugggauugucaguuagcuuguaggugguagugguugauguuauaggaaaggaagaagaagucugacaggaugaaaagaggaguuguguaaauuaaacuucaguggcaugcacaggucacaguaaugcagaagagauucugaagcugacuaggaugagcuguggagaguggggcauugcuguucaagugcuaaugcauauucuguuuucuguuauaauaaacauuuuauuguuauuuuuaugucugagcacuugaacuuaguuuuuacaagcuggugaauacugauauguuauuucugucacagaacuaugaucauacgcccaggaaguauaaauauaauguugaaaaacacacaucacuguuuuauuccuuaucuaguaaaacagauuaucaaguacaguuacuaaguuacauggcuauuagaugucgcuuauuuuauuuguagaacccucccucccuccccuuuuuaagagagguuggggaaagaaggggaaaaucauaauuccaacaaauaaguuggagaacaacuucugauaguauggaaacauuuauaagaaguucaaaauuuugauuaagaauuguuuagcuacagaugucuaugaaucauaaaaaugaccagcaugguaugauaucccuaaggauacaguaguggcauacauaccuuggugguuaccaacagcucuuuaauuggacuaaagaccaagucaacaagaggcagcuuaugucucguacaggaaaccuagcuaacuucucagggcuagugacacucuagaucuuggaggagaaccuaaacugccccucuguuaaaccugcacaauccugcauucuaaacauuuguccuuauagccacagagaaguguaguccucaguccucagcaagggaacuucucuuuucaacaguggggacuauucuuacagaauaccacaaccaaucagcacguggggccccagugccagugaguacauccacagaagagcuccuguacucaaggcuugcaacacugcacacugaggaacagggaguuuguugugagucugugucuucuagaaacgccagaagcuccaugcagcaagucagugucagcggcguaacugcucauacacagcacucacagcacucacagcucauacacagcacucacagcucauacacagcacucacagcucauacacagcacucacagcacucacagcucauacacagcacucacagcucauacacagcacucacagcucauacacagcacucacagcacucacagcucauacacagcacucacagcacucacagcucauacacagcacucacagcucauacacagcacucacagcacucacagcacucacagcucauacacagcacucacagcucauacacagcacucacagcacucacagcucauacacagcacucacagcacucacagcucauacacagcacucacagcucauacacagcacucacagcacucacagcucauacacagcacucacagcucauacacagcacucacagcacucacagcucauacacagcacucacagcucauacacagcacucacagcacucacagcucauacacagcacucacagcacucacagcucauacacagcacucacagcucauacacagcacucacagcucauacacagcacucacagcucauacacagcacucacagcucauacacagcacucacagcacucacagcucauacacagcacucacagcacucacagcucauacacagcacucacagcucauacacagcacucacagcucauacacagcacucacagcucauacacagcacucacagcucauacacagcacucacagcacucacagcucauacacagcacucacagcucauacacagcacucacagcucauacacagcacucacagcuaugccuaagaugcuucuucacacguguaagaagggaguuagaacaggcaacuaaggaaugcugagaguaaaagacauagucuuucucagggaggaauacagcaauugguuaucugguauggaccagcagugguucuuuagugacaagguccuaugugggaugcccaagagaugagaagauaaagaagauaggaaagcugggguggaaggacuugcacaagccaugucuuauaccaggcaaguucauuaagaacuagagcaccuuguauacuguuuuucaggggaaaauggucuuaggacugauaaccacagcccacugggaagaggcaggaccucagaaacuacaaccuugacuccuuugaggcacugccuccagccccagauuggccuugccaaguccauccuggacagagauucagagcuaacguucccuuugcccuuucaugagggccucugagaaagucuuggguaccagucauucagguuguuuuuaggaacacacacacacacacacacacacacacacacacacacacacacacacacaauuuuagaaggucaugauuugcaaaggugugugguguggguaugcaggaaaguuuggagagaggaaagggaagagaugauguaauuauaaucuuaaaaaauaaaauaaacuauuuauuuguaccuuuaaaguacuugcuaaguugaauauauuauauaugauguguacuucugugacaaaguagauuuuuggaguagaaguuucacauaacagcacagaauaaagcauaggaagucauuaaauaaucagcacaggacuuaguaaaaaguuaucaauggcugaacaaaccugauacgcauguguaugagugugggagaugcaaacacagagugguaacaaggaacagcccugcagguuuagaaaugacagaaggaaaauaccacagaagcgcuaggguguucucaguuccuagaacuugguucuguaguaugcuaagaauauacaagcauuguacugaguauuuugguacccaaucuuucuaaauuuuguguguauuguugaguucuggcauaguaguacacauaaaggcauaacucacuacaguaugacuucuggaaaggucaguugauaaaguuaguuauaagugcauuuugaauguugagcaacagauaucuuuuugcuaagugguggauuauaaccuaaaccuaugguugcaauucugucaagcuuguugcugguaaaacuagauuucagcauucuugugaaagcuucaguagacuuauucauggggcuuacauauugguuaauuauguauagcaaauuagguacuauuugaaguucuacuuuagggcaguggcacuugacaccacagauuuauugaaauaauaguuguuucuaugaucacugaaaucuuugaagcagagccacauccuaggacagauauaaaacguugcuugcuauuaaaagcuucacacaguuuucauuaugaauuguacuuaugaguuauauuuguaucuacauauuuauuccaccuucaguaaaugcuaggccaagaagcagcggagcucucccaaggccugcagcaaacugggcagcaccuuagcuuccagcuuuuucacaagccaucaacaaacugguuggaugggaguguacugucauccaaagcccaaccgagaacacgauugcucuuucucuacaagaguaguauccauaaacuucucuacauacucuuaauauuguggugauacguauguaugucuguguuugguuguguguguauaauuauauauguaaaauuguuguuguuuuuugaaacagggucuuacuauguagcccuggcaguccugguacuugcuguguagaccaggcuagcucauaaagaucugccuuccucugggauuaaagacuuguggcaccaggccaggccaauaccacacuuaaauucuccucuaaguuuguuuaaggccauacugauuggauuguguguuaggacucucauguucuuauauaugacuuccccaggagcagggauguccaugaaguaauguuaauuuaguuaacaaaacuaaaaacaaaaaaacaccaaauagaauuaugaagaaagaauuuuagauugaaugcagaaaugaugcagaaaaaccuaaacccacuccugagaucuacuugauuauccagugcauucuacuugaaauucucagugcuugaaguauggaauuggaagaaaugggaagugaaacaaaccuccuaacagugauucuucaguccaguaacacugagguauuggaaaggaggugcaucgagguuuacucuguccaggcccgagcucuugugaaaugcccaguguccagguuauccacucucuugugggcuucaaaguagcaguggauuucugcggcucacuugucugcauugagguucuguugugcccagcaggacucuccacugccuuuuagaagcuguguguggccaagaccaccacauaaaggaguguguuuacucucugaagguuguagccuaaucauacagccuguccugaggugggaggaggguggcaaugcagcugacagggaaucagacgcuaaacagccucuguuuuuaagugagugauuauauuaaccaugcuaaucuuggugcuggugguaauaguagugcuuuaguaguaauagugcuuuuuaaaaaaaccuuguaaugauuuucuuuuuauaacaaccuuuguuguaagagaacauagugaagacuuagauaaagagaugauaacauaguuacaggagauccuggcuaggacuuuugaguuuauucaaauugugaugagaaaccacuaauagcuucuaagcagagaaagaacauaaacauuuuguauuaauuauuuaauuuuuaaaggcaggcuuucauuggccuggaacuugccauggugaccuugaacuugaacucagagaucuuccugcuucuucccuccacucugggauuaaugguguggguugccauaccuggcuuuuuuaauuugaaaaagaugcuuucauugcuguuuagaaaaugaauuuuauguugguauauaauugaacagguuagcuagucaaaaaguguuuagguaauucacauguggcuuggaaucaagugaugguguugaaauauauauuuuuaaggaaaagcugacaggauuuucugauggaauggaagaugaaucagaggaaugaaggauauuauaaaauuuuaacuuugugugauugggaaaauggaguuuuugaugaaauggagacucuuguuuuaaaaucuuucacuuuuaaaaaaauuaaaauuuuauugauuauuguuccagguggcccaggcugggcuugaacuccugguuuuauuguuaccccucccaaauguuaggauuacaugcguucauccuggucuugacccuuuuauucagaggaagggucacugaaugacauugauagugaauuauuacuguagauaauuuccaacuggugucauuuugauuguauuacauuuauuauaguuuuuuuuaacuugauauugcgcuguaagaaaaagcuucauuuucuuucaauuguugguucauuguuuccguuuuccuuuuuuagugggcuguaaucaaucuaucauuccauauuugacuaguggaagcccuuucuagcaguucuuguccuuaaaaagggacuuuauugauuaguacaugcgugugcaugcaugugaauguuuguucauguacaugcauguauguuuguccccauauguguauauaacuucuuuuaaacccagguuaaacccagguucaggcuuguguggcaaaugcuuuuuuuacuugccgagccaucucacuggucucuuauguccuuuucacaugguccauuaguauuuguguacuuacacuuugugugcuuuacuaagcugugaaauacaacugucuuauguauuugccucuguuucuuucuugguacauauaagaaccacaauuucauaguagcuccauucucaguccuguauaacaaggccauuuuugauucaccccuucccuugucuucaagagcccagggguucuagugggagcaucuguuguggggaagcagagcagcaugguauaugugguaguuuaaauaugcuuggcccacagagugacacuuuugggagguguggcauagguguggaauuuguguggaaauagguguggaauuuguuggaauagguguggcuuuguugaaggaagugugucacugugggcacaggcuuuaagagacccuccuccuagccaccugggagccagucuucuccuauuggccuccaggugaacauguagaacugucagcuucuccuguaccaugccugccugaaugcugccaugcuuccucccuucaugauaauggacugaaccucugaaccuguaagucagcuccaacuaaauuccuuuauaagaguugccuuggucacagugauggaaaccuuaaguaagacaauaugauaagguuuucuuagugcuauguaugcuguauuuccauucauuuuauauuugacaguuuuaggugugcauuacuuagaaaucuaaacugucacauuuaacguauauuuuuuauuguuugcuuuucugguuguuuguauagauuguuuuuguuuuuauuguuagucugcuuuuuuuucuggagacaggauuauuuauuuguuuauuuauuuguuuauguauguauguauguauguauguauguauguauauauguauguauguaaccuugacuguccuggaacuccacccguagaccaggcuggucuugaacucaacagaguucuaccuggcuuugcuuccugagcacuaaagauguaugccaccguccagccuguuuguuuguuuguuuguuuguuuguuuguuuguuucauuuuuuaaugcuuagaaaaauuucuugcuuauuauuuguuucuagauugagccaguuauagucagaacauacuuucugugaucuuaguucuuuuaaauauauuaaguuuuauuuuaaggcccacaucuaucuuggugaauguuauccuaugggugcaguauauguuggguagaaugucuuuuguguauuaugucaguuaacuggauauaaucacauuugugugcacuuucuuauguguugagccuacuuguuuuuauuggauauaucucauauauucaugguaugaacuccuuuaaacauuuuuaaaaagauuuauuucauguacgagagauuuuuccugcauguauguauguguguguguaugcauuauguguaccauuuguaugcccggucccuagggaggucagaagaagguaucagauccuauggaucuggaguugugggugguuaugagacaccacauggcuguugggaauugaaccugggcccuuugcaagaaaaggaaauauucuucaccacuaagcugucucuauagccccuguagcaguacuacuacuacuacaacagauacuacuucuuuuuuaauguuagggguuagauuugcuaguauuuuauuaaaauuaguuuuuacuuuguagcccuggcuggccugucuuugauuuuaaaauuugucucuuuacaaguuuagagcauguuuuuaauuuguucugguaaucuuugcacuuaacugguuuucuuucuuucucucucucucucucucucucucucucucucucucucucuuucuuucuuucuuucuuucuuucucuuuuuugagacaggguuucucuguguagcccuggcuguccuggaacucacuuuguagaccaggcuggccucacacucagaaauccaccugccucugccuccagagugcugggauuaaaggugugcgccaccucugcccggccuuuaacugguuuucauuccauuuauauuuaauauaauuuacauaaggcauaucuaucuacuauuuucuguuuucugugugucacauuuucccccauuuucuccauuguuaccuuuuguguguguuuuguaguaugcuguuugaaguuuugucuccuuuacucuauuuuagauuuacuuuuuaaugguuaucaggggauuacagugaauaucuuuauaacucaaagcauugugguuggguugauaccaauguaauuacaagaguguacauacuuacauacuugugucuuucuuccuuucuuacauuuauacaaauuauacauauuuugugcugagcaacaguuauaauuauuuuuuuuugauccaccugccucugucuccugaguguugcuauuaaaauaaugcaccaccacugcccgguguuacacuuauucuuuauacuguguuuuuuaaaacaauguauuauuuuuucuguuguuguuuucauagaaaaaauuaauauggcaggaagacugcauauuguuagaaaggccugauuacaaaaugacacccaggggcugaguuuuaaggaggguugugauaagggcucauugugucuaagcuguuuauagaaacaguauguuuguugcuaaucaccugcuuuucuucuugaauauugagaguuuaguguguuagggaaggguaccuacaugcucagcucucaauaguaaauauucugaaaaacuuauaaauuauuucuaguguacacacacauacacauaucccucauaguguuauuuauaccauuguauguguguguguguguguguuugugugugguugccucuucucuucuaguucuuacuaauuaauguguuugucuucuuaccuuuuagggcaauaaagaauguugaugggagaaccauuuuccuaauuuucaaauuauugagcuggucgccauaauggguaaguuuaagcuaaaagcauuuuuaaaaaauuauacuuaaagaauaggaugaagaauaaaauauuuaucuuacaacaaacuucauguagaaauucaugguacaguagauuuaugucauguguaauauagauuuagcuaacauuuuacuuaauggacuuuaggcguuagggaguaguagaaugcuugaauaguuacgcaucugugaggcccuggguucaguaacaggcaccaucacaacuaacacuaaagaaaguaguuuugaguuggaguacuuuuuauauuguuacagucuuggaaugagcauuuagcugcaggacccaguagaaguucaaaguaagugcucagguguuugugguuuguuuagaaaguaacgugguaaggaaaaaagcagucaucagauuuuauaauugaguaacuaggcaagccaucauugugcagaggcaguuuccuucacaauacucuguggcauuguaaguguaauuuagaagcagucugcccuauagggcauucaguuuauacauccaccacuuuuucuucuucuuugccuccuuuucuccuuaauauugaggguuuucugucuugaggcagcacuagacagacacuagaaaggagcaggguaaauggucagccugauccuaaauugggaaaaguggacagaguaauuaauuguaugcuguuuuaaacugagauugaaccugguaacccugacaguuacuugccaaaauuugucucacuuuuaaagcagcuguauaagaaaacacauucucucucucucucucucucucucacacacacacacacacacacacacacacacucacacacacaguguaggugguagaguuaaaugucauuuagaugagucuuguuuuggaaggcuuagcguacccucacuguacauagucggagccaaagcuccacauuccuacuuugaaacuucucuuccauuucuugguagcuuuguacauggcaccucaugacacccucuggaacccagccucuccacucuaagcaggcuucuaauagcuccagacugcacacacacuugcugacuccuguuggcuucucaccuuucuuuuucacuuauacuucagcuuauauagugaguugauuuuuaaccauuguaaaugguugugcuugcugggauuugaacuugggacuucuggaagagcagucaguacucuuaacuccugagccaucucuccagccccaaggacccuaacauuuuuaaagagugucguaucaagugauuuuacucuauuugagauuagucugaguuuacucagguuuagacaauuuuuaucaacagcguacagucugguguggacauuuuuagggcaucuauuugugaucacauuguaacugaguugguuacuauuugacuaagcaaacacuaugaaaaauauuauuuuauacaggaugcuuuuaagaagguuuaaauauuuucucuaaggguugcaaagauggcucaggaguuaaagagugcuuacauauugcucuugaagaggacccagguucaguuuucagcaucacaucaggcaguucauagccaucuguaucuucaguuuaaggugauccaaaaccuucuggcuuccauggucaccugcacacauguggcacacacguggcacacacaaacucaggcagguacgcacauauacacauguugcgggaaauauuaaagugaacuggcacguuccugcgcuagugacaagacaaccagcgagccacagagcucaugcugagccacacacacugggccacagggcuccugccuggugcgucucacuccacgaucccuuugcccgccaacucucuggcccugcagggagggccagggggccuccacugaaccaucucacucagcagccgucuacuagccacccuccaccccccacgcaguuuaucuugcuaccaugcaaugccccacacacccaggaucagccgccucaccaccuaauuacccgguugaaucaagacucuuaaugcuaaaucagauuuauguaucaauaaaaucacaauuuacaagauaccaauacaauaauuucagagucaauugauaaugauaaaagcuuuaccccaauuauucuaaccuugugaaaaucuuagcuacuuguggcuguuuaaaaccacgggggaucuuugccuccauguuggcggcuucuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccuccucuuccuccuccucuuccuccuccuccguuggcuccuccucuguuggcuccuccucuuccuccuccuccucuguuggcuccuccuccucuauuggcuccucuucuucuuccuccucuuccuccuccuccucuucuuacuucuuuugaaaccuaucugucucaccaacuccuagcaccgccucccuuuuccuguccaaucgcaggucuccuacuguccuaaugugauuggacagagaaaauucugcaacauacacauaaauuuaaaaaaugauuauauuauuuaucucuuggggcccgugagauagcuuugaagguaaagguacuugaaaccaugucugacaaaccugaauuugauucucuggacucuggugaggaaaggaaagaaccaacuccuguaagcucauaaacacuguggugcacacccagccacacagauaaguaauaaauguaauaaccuaaccuggcauuuauuaauaaaagcauuacaacuuuuaccuuaauuacuaguauacaaauauuuuaacuuauagacuguguugaauauuaaaaaccaaugaaguauauauuuuagcuauuuauauagucaaaugcuuuuggaacaauugaacuaccagauucuuuuuaaugauuucuuuuauagaacauuuuuuuguuauuauuacuccaggagauaaauuauugcccaaaauaauggcuacauuuaaaaauguuaauuguaaagaccuuuuauucuuuuauuuaucugauguuaauaaucauuaguagauugauuuacuagcaaaacucuguugucucauagucuugcagagaauuugugguuggcauuacagaggggacauguuuaugauuuuaaaggaaaucuauuuggaagacacuaaaguuuaugcuuuauaguccucccuguaguuuucuggguacuauuuccuaaggaaugaauuuuucuuauauuuuuacuuuuaauuaaauuuuuuuguguguguguaaguggguguuucgccugccuguaugucuggugucuguaguguauaauagaggguacgggauugucuggaacuggagacacugugugggugcugggaacugaacccugguccucugcaagaagagccagugguuauaacugcugagcugucucuccagcuucacauuguuacuuuuaaauugcuauuggccuucuugauaaauacuuuuauuuguuuuuuuaaugauuuauuuauuuuaugugcauugauguuuugucugcauguauaugcaucuaugagaguaucugaccucccggaauuggagucacagacaguuguaagcugcuaugugguugcuggcaguugaacccagcauccuuuggaagaucagccuguguucucuggaagaacagcaagugcucucaacugcugagcccucccuucagcccgauaaacacucuuuuauguuaguagucuugggaagaaguuugagggaaaccuucaaaguauuaguaggccauuguccacagauggagccuuucugguuuucuccuguaagcaucaguaagaggaacauaucucuaaaaugaagucugcgauuuggguauaauugguaaaggaaggucauguuuacagaagguuuauuuuuuccccucauuuuuuaauuuuuuuauuuuuuacuauuaaggucuuugauaucugguuuguguuuuguuuaggagccauagaaaagaauuuguucuagcagggcuuuuuugacucagggaguuaagucacugaaugaaucauagugacuuuuccucccuuauaaaugggguuggagggagagcucagcugugaggaacacauacugcucuuucagaggaccucaguucuauucccagcaccuacauuagaugacuaucagucaccuuccagcucuagggcaucugacaccucuggccuccacgggcaccuguacucucauauauauauauauauauauauauaugaauacacacacacacaugcauacauauauacacacaguuaaaaauaauauagaaauuaaguaaaauaaaaacuauuuaaaacaaaaaugccccauuuguagaugcagagcuugagucuuaaguaguuugauguuauuuucagagguguguguauguguguguguguguaugugugugugauucuuguaacacaauuaacauuuuguuugauaaaaagaggcagguggaucucuaagaguucaaagccagccugauguacauaauuccaggaccauacagcaaaagauguauuucaucuaugaaugugugucacauguguguggguacccggggaagcuaaggaggguacaggagucccugggauuggagucauagaugguuguaaguugcugcaugagagugcuaggaaccaaacuugaaucuuccgaaagagcagcagguaccauuagcugcugagccaucucuccagucuaacuaauucauuuauuuacuaaauuccauuauaaauucugcuuaaugacuaugaugaauauauguugacauuagaguucuuuuaaaaauguguauguauuuaugucuuuuuaaaaaaauacccagaugaucagcaagcuuugaauucaaucaugcaagauuuggcuguccuucauaaggccagucggccagcauuaucuuuacaagaaaccaggaaagcaaaaccuucaucaccaaaaaaacagguauuuauuucaguaaugcuuaaaugauuccauuuuuauuauuuuuaaaccaugugacuguuucugugugagucugugcaugagauuguaggugcucauggaaagcugcaguacuggagcccacuggagcuagaguuacaggugcuugugagccaccugacaugggccuugggaacugaacuuugguccccuguaaaagugguguguguucuuaaccacugagcacucuuucuagucccagcaucaguaguauuuuaauaaguguauuuuguucuaugaauuacuuucauuucauagacuucuuuuauacuuugagucagauguuuuguuuauuaguauacuauucugauagugcaauuuaaguuuuguauuuauauuuaauauguaaaccaauauaaaugcuauguauaaguacaguauugaagaaauagugacaagaaaaaaaugaauauacauuuuuaaaaagcuauaugguaacugcuugcuaaaguuacuauuucauccauucuuuagcacagaagauaaagugucuuuuguuuguuaucccuugaagucucuucuggauacuuuuuuuuuuaaauauuuuuuauuagguauuuuccucauuuacauuuccaaugcuauccgaaaagucccccauacccucccccccacuccccuacccacccacucccacuuuuuggcccuggcguuccccuguacaggggcauauaaaguuugcaaguccaaugggccucucuuuccagugauggccgacuaggccaucuuuugauacauaugcagcuagagacaagagcuccgggguacugguuaguucauaauguuguuccaccuauaggguugcaguucccuuuaguuccuugggugcuuucucuagcuccuccauugggggcccugugguccauucaauagcugacugugagcauccauuucuguguuugcuaggcccuggcauagucucacaagagacagcuauaucugggcuucuggauacuuauaacuggaguaauuugauuccuauuaacuagacuagcaugagcuaggaagcauagaaugucaaaauacuagaguucccucuucccauaguguccauuguucauggucuguuuagguuagaaaauaacaugaaaugcuguagacacaagcagcgcuaaguuuuaaauuucaugccauuugaaguagcauaaugaaaccugccauuguuaugaauuauaccuuguguuucauauccaugcuguauacuuagacacuguuuaaguuauggggcugacuauugacuaugauaguaaagcaaugacaguuugaauacgcagaaaagaagcuuuaaagcauuucacuuacgagaagaggugaacguuuuaaacuuaacaaagggagacaagcaaaccaacaagcauauucagaggucuugaaacucacagaagaggaaggacuguaggagagcagcauucuccacuuccuuagcucaggcuagucgugcaugaguggauauuggugcucgucccuguugucagagcugacgauguaauucucaacccagacuuuuggcagacguuuggugauuggaauugcaccuugaaaaugaaaccccuuuucuuucuucugcucuauguuaaaugaguaggcuaaggaaaagaugacuuagaaauguaucuggucucugcaugauuaugacugauaucuuuauuauagaaugauguucgagucaaauuugaacauagaggagaaaaaagguaagcaaggcuauauuacacaucaauuaaaucauguaauaaaauguguauuccaguuaagcuauuaggauucuuucagguuugaaagaaauuuuguaguuuugaaauugaaaaugaaauagucuuugguaauggauagcaugcaccuagaccggcgagaaauagaauuaugucaaaaugcauucuagcuguuggaaacacuggauguguuugcuuugcaaaauugggaaguaaguaagaucacuucauaauacacacguuacaauuuuacuauuuacuuuuaauuuacuguccucaaaagacuucaaugcugugguguauauuuuguuaacaguguuguagaaguaaguuggaaugguggcugcagguacuuauacagcaggaauguaagcuuagccuucugugccugguguccucugcuaugucugccucaggguggcagugcagcuggugagggcugacgagaagaccucauaggagcacagaagauugugguuuuguuauugguguuucauuguauuaauaaaaggccuguuaaucuuaaggaauuagaaguuucucacaaguccuauaacuugaauaugugaacauauuucacuaggugcacugaaaaaggaaaaagaguauaccuuacauaucaauauuccuuauuugggauucuuuucuggguguuugcuagcuuuuccauuccuugagcucuguaccuaguaugugaucuauaaagcuagcauggaaguggcuucauaaucugaugugguauucucuagacuuagugcgugcucccugggcuggccaggcccuaggaauagaagcaaauaccgugcuuuucuuucccuucaauccuguaugaugucuuagagaugcuuaccuaacauacgugcuaagauuuugaauugagaaauccagaaaucaaaacuuaauuuccacaggaugagggacuuaacuguucuuaaccuuuucauugcagucuauuacacacaugcacaguuaaucagauuuaaacacucuccuaaguagcacuuuauauugagcuuuaauauuuaugugauugugaauuuaacacuuggagaaucuuccuuuaaaaauuauaauuagaauaaaacaaauuuuaaucuuaaauuuuguauugaaaauuuuuguauuugaucaaguguguuauaacuuuuacuuaauuuacuuaauuuuacuuaauuuuaauaauguuucugacaaacaaaauaacauauuuaaaaauuauuuuuauguaggauccugcagguuacuagaccaguuaaacuagaagaccugagaucuaagucuaagaucgccuuugggcagucuauggaucuacacuauaccaacaaugagguaaauauacgcauacuauuuuuaguaguccuuauuuuggaaaauuaguguguucauguaagaguuuguguuuuuauuuggugauuaguaaaaagugguacauuauaggagugagaugcacauuuagauuuuacuguuaaguggggugcuacugugcacauagcuaagacaacauacagugggaggaaguagaccucaccuugcuguuuccugcuuccaauuuuccuuucacuccguauucagugaaccugcuuuccuugggauacauagacuuauuugauauuaguuaggaugcuuuggauucuuguauugauguuggugucaggauauguggcccugaggacucacuauguuuucagggaaccaauuuuaaucuugaaaguagaauuggauuagaugguaacucaaguuucuuacuguuagugggauuuuaaaauuuuuaguuaauuuuuuaauuuaaucuucagaaaauacuuuuuacuggccggaugugaggguuuaugaguugcagccuuucauggcgucagugucacagguuuguggacgaagcagauagcagaggauugaagaucuuugaaggaaaugcauaaagucugggacgggcauggugguacaugcuguaaucccagcacaggggaggcaguggcaaaggcaggcauaaugagccucaagacacccagggcuacaaugagugacccugucuuaaaaaaaaagucggugaguguccucuuuauguuacuaaagagaagcuagcaacugaagcaauguucaagcugagaaaagcuuggugugaaaagccgcccuacaaagaguuucaagggaagggugggagaugggacagcuuaagaacagcauucauagagaggguaaccacagggauggagugauaagggaagucagaaaaacuuggucuaagaaaauacaugaaccccccugugcaacuaaaacacuugagaauaacacagagauacaaauauccuguugaacauugaagacauuuuaauucauccccauaagcaguacagccugauugcuuacauacaaaaugcuuucuucugcugaaugcaaagacacuucauugcucugggagggagcuccaggggcuguaugcagccccaccaggaccggugucagccccuugugccugcaccagcuuacauacacagcccagcagggccuggcuaggaaucccaagaaggcagggcgcauguuuucauaaguacaagucgguaccuuacacaguacccugaguaauaugcacugcacuacagcaguagcuugacaguuuacaguucaagaaauuugggcuuuuaauuauguguaagcauaucucuuacccagucuuuucuugguacuuuaucauauguacauacuggccggguguucagcugccagccugcguuuucaggguugucuagcgguauggacacaggugaaguacgugcacgguagaugacuaacuguccacaacggacuugucauggccaucuucccuucuuucuucauuucccucccacuccccuaccuagaaucuuuucccauauaaauaacuugaucuugaaucauuaucuccuaauuuucaaggaaacaaagcuacccuacccuccuacuccuucaucuaccccuucuccccuuccuccucccucccaggguguuuuaucagcaauaggaaaugggacaaagaugauguguaccagcauaaaaugagcugcaaauagaaacuggaaauaaacuucuaaguacagaguagacaaauguuagcagaguauaauacagaauucaaauaauccugguuuguacauaagguuagcagcuuuucaguuuucuguuuuuauuaaguuauuauaguuuuggagacagaaucuugccauguaaacuggccuggcccagugcucacugcauggccuaggauggccuugaacuuuugucagucuuuagaaaaagagacauugcuuucauacaccaacuacagagugagguuacaccacgguagguccugggccagggcaccucuagugcucacccugugcugugcgcugagcagcauuugccaggggcugcucgucucugugcucugcuggagcaugcccucauccccaggacucccagccaaggaggcuuuacauuuaguaaguguggcauauguccauuuguuuuuacucuguuucuguuccagugaaauguugcagacuucuucuccuuaagcugcaagaauuuuuuuauuuaaaaaauaaaagguuuugauuuuuauaaauucaugugaaucauauuuuuuucauagaccucuuggguugcuacuguuguuuauaacaucuuagccaugagagagaggacuaaugagaguagauuucauacugaggauuuccugagcugauuacucacuuagcgcacuuguucuugaguguagugaucuagacuuccaggaccagagaugaauucaggggaacuguagagugcagauauguggcugaugauaccuucccauggcagcugucacuuauacucaagguuuguuacauuguaaacacaacaggcaacguguaaaccugugguuacuacucaaaaaaagaauuaagaauuuuauuugugcagaugaaaaguaguggcuuauuuuauauaauuugugugugugccuuuaaauguucuuaggucugaauauacuuacuuuaccuuaauuuaacaauauuuacuauacuuuaauuugcuaauguuacaaaaauauuauagaaaauuaauuuuuagacauauuuacuaggagaauguaaugauuaauaaggcaaaaauguuaauuauuuauuaaugcugagauuuuaguggugcugaaagagagcagaaugcuggaauagacuagacauguauaaucuccuuagacuuucacuguaguaauaaaauacaaggugagauuucuaguucccuaguaaugaagcugcucacagaagcaucugacugcugugaugucuacaugauucuugucucuuuuuguucaguugguaauuccguuaacuacccaagaugacuuggacaaagcuguggaacugcuggaucgcaguauucacaugaagagucucaagauauuacuuguaguaaaugggaguacacagguaugacuuggaguguaugucucacugaagacuauaagacuguaaucaggguuauauuuauauuuuaauuuauaaaguguaaauuuacauauuuuuauugcuguagcuuaauauguuuguuccucaaaacuauauaguuagaauuacaaauaauacaugugaaacuaauagaaacugacaauuugagaagaauuauauuagaauugauguccauuuugcauuuuuauauuuuacccuguuuuuguguagacgagguggcaugugcacaugccauaggcacaugugugaaggucagucuuucucauuuucacauguuggauucaggguuugaacuugggucaucaggguugacagcaagcacacucaccugaugugcugcugucuuacugcuuuugaaaugucuaucuucuccccauuucaaccaacuuccugccucccucccuuucuuauucuugggcucaagucaucuuccugcucucaucuucuaaguagcugggguaguagguuugugccacucuucugggagauuaaaauuuguaagaguagauuuuaaaaggcccaauaagaauagaggguagcuagcuguauuuuaguaagagggugauucugcugaaagccucuugugggaagaauagcaucaauugcccuuuucucuucuaggcuacuaauuuagaaccaucaccgucaccagaagauuugaauaauacaccacuuggugcagagaggaaaaagcggcuaucuguaguaggugagaaagacggggucugaauaaggaagccagugauccuucuuaucuuuuacugugugguaacgugaaauagaucucugaaaacagcacccugucucuguagucucugcaguuauaugcuuuagccacuuggucuuaucugauguuccugagaaauuaauuucacauauuguaggacuagcaauaaccaauuuaaaguuuuucuuucuacacagaauauuucaauauucaaaaauugaaguacaaucuugaagagguuuuagucauuuuaauagagggaggacauaacuguaggacauagaaaugagugggcuagacgcuucugugugauaugaguagagagggagaguaacuguaggacauuaauguaguagacugacucuuguucuacauuccuggggucuuagguguuuccaggacguacugucaauaugaaaauagcuaagaauauauagacugugucuuacuauuguucucucaguauccuguuguauuuaucaucaauaaugcauuccguauuccuaagcuucugauaaaaagauauaaagauuccauggacuauauauugugagguggccuucuugaaccugugcuaggcagagguguucugaauccgccauaggagcuggaguuaaaaagcuggaguuuuaagugguuaaaaguguuuucuuuuugcagaggaccaaaguuugguucuuagaaccaguguccggugacucauaguuaccugugacucuuggucuaggggauccaacaguauuuucuggccucuucuggcacucacaugcacauggucaugcauauguguagacucauacaugcacagaaauaaaaguuauaagguaaauucuucaaguaucauuaaaaauauuaaaaaaaaagacaaaauaaaauaguuucauugcuuaaaggacagacaauugauacaauuauuuuuaacagauagggcagaggauauagucauuccagauagcaugaguucuuguacugaggcauaaauuugaaaggggaaguuggagaggagaaacagauaauuagggaagagaaaacaagaggacagaguaagacacuuggagaguuagcgaugacaauaagugaaaagauuaaguuagcgugugaguaacuagagcaguuguuuuuuuuucuuuuguuuucuagaagaagcugcuuuuuaaaaauuaauuuauuuuuucacuuuacaccccaguuguagccaccccucuucccuguccuauccucucaaugaagcccccuauggguaccagccugcccuggcacauaagucgcaguagcagaacuaagcacauccucucccacugaggccagacaaggcagcccagccaggggaaggggacccacgggcaggcagcagaggcagaggcugcucccgcuccagcuguuagagguccacaugaagaccuagcugcauguccgccucaaguguguaggggccuagaagaagcuguuuuaugaccuuuuuuuuuuuagguguuuugucucacaugagucuauuucagaaaacuagagaugugacccauaaagaugauacacagagcuuacucuuuuuguccuuacucagauauacuugggauuacuaaaaagcaaaagcaaaaacaaaacaauaccaccaccaccaccaccaaacugagagaauguuugaguuaugggaauucaaacuuucacugucacucucgguaugagaccaguaauuuucuccuugccuuuagacagugggcugaaagccauaaccagcguacuuguagacagagcucuucuccaacuggaggcacagcugcuagccuucuuuguggaaguaaaguaaaacagccccuacauuccaguuguuagacagggaaagcuuacgugcacuaguuaaauugcccuuugauuuccucaauauuaacccacuaguaaguauucuuguuguuugacuuugguaccaggauaagggaaaaacugaaaaugguacagaauuacugaguguguuaacaugcccauuaaaugaauauuaagaaauaugaguuauauaauuggauggagaaacuuuuauaguuuccuucuuucucagucuccuuuuaguugcguguauaauuuuaaaaaaugcucuauaauuuuaaaaaaguaugcagaaagaugaaaauaucagggauucaguaaugacaguggcuguagguguuacaaagccugcaugagcuccacucaaagcuuagcacacaccucuuugcagacagcagaugagaucucugcaccuacuuaauagaucccuugcuccuucucccuacuuaacaggugaccccuuuacaugugcuuauuucuuuuuuuaaauuuaaacuuaaauagaagaacauuuauauguuuguguacuuuaaaaauuacugcaaggaaagccaacaacuuaguuaauaaacuuugugaaccagguaauuaaauaacugccaggcuccccucuauuuuuucuuaaacuaugaagauucuagggguuuauaguauauaguauaucuuuauauauaggccuagcuaaucugggacuaucuauauagaccaggcuggauuugaacuuagagaucugccaaccuuugccuccugagugcuggaauuaaagauguaugcuaauacaacuggaaaaguaugaagagauuuaaguaaaaagaauauagcuuacuacaaaagccuaggguuuuguuuguuuguuuguuuguuuguuuguuuauuuugguuuuucgagacaggguuucuccuuguagcccuggcugucauggaacucacuuuguagaccaggcuggccucgaacucagaaauccgccugccuccgccucccgagugcugggauuaaaggcgugugccaccacacccggcuucaaaagccuaguuuuaaguaauaaaaaguaaaauccagauaguaaauaaaaaauauuaaauauaaaauguacugaaugagcaaggaacacucuuacuucaggugucuaaagauugacgacaauuaauggaaagaauaccauggagcucaguguacauagcaaguuuauagugagugaucuucccaagacgugaugcaguacugcguucuuugaugugagaacagaccuguugccaaagacucuaagaugguaaccugcccugggauuuaaaccaugcccugauugcagagcccuuauuccuuucuauauggagauaccagucacagauuauguuaaauauaggcagauauaaauugucuuuggaaauucaaaaacuguggcauaagauugcauaauaugucaucagcccgugauaugguugucaacagucagaaacacuugaguacgaauuagcauauucuauugagguuauguagagugugaauuuagaaagguuuuaaaaagaucgaaucugagcauucugauuaacuuuuguaaauacuggauuuuauuugcugaaguuauuuuuuuuaaauguaguuagaaaugagaccuauuuaauugaaacaaaaauuaauuuccuugcugacaaggauaaaaucuuaaaauuuuuucuuuuugaggucccccuaauagggauagaaguuccccuccuccaggauacauuccagacgagcuacaccagauugcccggaaugggucauucacuagcaucaacagugaaggagaguucauuccagagagcauggaccaaguaagccagacuggaugcugcuuuucacuguauguuaagauacacuggucaggugaccaaugugauuuggcagacaccaaggacgguguguguguguguauguguacauuuucucuaaucaaucuaucuuaagucaaaaaguuauuauaaacugcccauuaauuuauauauagcuuuuuguauuggugcaucaaaauuacuagaacaagcugguuuuuuuuguacuguuugucuuuagugcauuuggcuuauaaucuuaaauuaacuaacauucagauuucuuauuuauuuauuuauuuauuuaaguuuuuuugaguuaggguuucucuguguaguacugacuguccaggaacucacucaguagaucagguuggccuugaggucuagagugcugauauugaaggcauugcuggcuuaauaaauacuuuaaagauaggguaaaauuauaaccacuuuaugaagugcgguuugugaacugucuguaauacuuaaaggugcuucugcuuuguaguacucagguaauuuuuuuggggagguagcuguuagguccuuccacugucucagugcccacgugggcacugugacacuuuacauauccuaguguagcauggucacucgauggaugguuugucucuaucgacauugcuuagcuuucaguaagcaaauuacuuuaucuucaauuacuugacuuuagaaaaguauauuuuucucucauaagauuucuguaaucccagcuuguuuauauaggauguuuagaaaugaguaauucuggacaguagcugcuauugguuacuguuccuuuugaagacucuaaaauaauuauaaaauuguggggaaagucauauucauuucuugauaugcuaguagagaccauugcauuauauacuuuaaacguaugaaguuuauguuacaucaugucucaaacaguucuguuuuuguuuuauacaaaggacagaauuuaauuggggcuggcucacaggcucagagguucagucuaguauuauccaggcaggaucacagcagcauccaggaaggcacggugcaggaguugagacuuuugguuauugucaggcugagucauggugggcucuuuguuuucccagaugcuggauccauugucuuuaagcagcccugaaaauucuggcucaggaagcuguccgucacuugauaguccuuuggauggguaaugaugauuuuaguucugccuuuuguacauauugauaaaaaugcauacauauagaauauggaguuaucaauaauucuuuuauucuacauuaugaagaguguaauucaaugauauugucuacacugacagcaaguaaaguuuuuuauacugugaauaaaucuuuuaauuucauggauucaaugucuuuauuaguuguugcauuaugguuuuuuccuacuguuucugcuugucugaaauguguuugaagcaagugcaaacagauaugauuacauaugauuacauaugauuguuuuaugacagcucuugaaacuuuuauaaaacucaugauugguuuuggcaguuucauuuuuuaaaaaauuguuuauuuugugugccuaauaugcauuugucagggcgccuucuacuguucuaaggacauugcgguuuugcugucuuucuguagcacagaguugguaucugacgcuuuacuugucugucugcucugggaugcuucaugaaaagagaaacaccuuugacgauucacguccauuuuccucuuuuccacaccucucugacagugucuuggaaaaucuacucugcccaccucuuuaaaaaaaaaaaaauuggaaauuuuuagugaacucuccugaauauuugacauuaauguuugauaaguuaaaauuaugucuuuaguguugauugagaaacaguuucaggaaagaaaugauuuuccaacacugagccaauguacaggugcuucaugcuucaugcuuccgugcuucagaaucuaucauccuuaccccguacuugauuuacaagcuaggcuuuugucuguaugcuccaaaugaguguugcaaaacagguuuuucuuuuuaaaaaauuauguuaguauuuaagugaacucuuuuauacacacacacauacacacaaacacgaacacauguagaaauacagauauuacuuaaaauuuuuuuuguuuuauugcauacccuccuucaauuuaauuuuacauuuucuauuuauagagaaagcuacccaaaaucacggaugccuagggcacagagcuacccagauaaucaucaggaguuuacagguuagacuauaaauucuacaugcuugaauguuuaugucaugguuugguuaggaggggaaauuuuuugaaagaauuaaaaaugauaacaugcuuuuuauuauuaaaaagauuugacuuuugaugauaguauuuuuuaugacuuaacagacuaugauaaccccauuuuugagaaauuuggaaaaggaggaacauauccaagaagguaccacguuuccuaucaucaccaggaguauaaugacgguaaguguugaacuuacauucagacuguaggaacagauuaacacuaagcaaacauuacaagaugagcaaacaucugaaaagccucauacuuaugauaaccaaauaauuuguuuuugagucacuuaauuuucugguuaaaaaaaagcagauaaacuuuuuccaggaaugguaaggaguacauagucuuagcacucaagaggcagaggcagguggaucucuaugaguucagggccagcuuggucuacauuguaccaggacagcuagcuauaagguuucaaacaaaacaaaaaaauaggacaagagacuuuuuuacugguaacugacugguaacagagugugugcugcuuaagcacaggaaccugaauucaggcccucagagcccauauagaggcugggcacagcagugugcaccccuuaccugaguguggaagagaggguguggaauaaguaggccccgaagcuuggccaguguagcuggaucagugaaccucagguucagugagaggcccaaaauuuguaugccaaaaaauaaugauggcagcugggcacauggcccaugccuuuaauccuagcacuugaaaggccacccuggucuacauuguggguuccaggccaaucagaauuacagaauuacauaguuagauacccugucuuaaauaaaugaaauuaauaaauaaauuacaugauuaugccauagauagguagauagauaauaaaggugacagugauugaagaagauacccaauguugaccuggaucucuguaugcauguauauguaccagacauaucuuaguguucuauugcugugaagagacaccacgaucaugguaacucucuuaaaggaaacaccuaauuggggcugacuuaaaguuucugagauucaguucauuauggucgugguggaagcauggcagacauggugcuggagagauagcugagaguucuacauuuggauuagagggcagcaggaaagggagacacugggccuagcuuggacauuugaaaucucaaagcccacccccagugacacacugccucccauaaagccacaccauauuucccaaauagugcaucacuggaguccaagcuuucaaaucuauaagccuggggggccauuccuauucaacccgcuacaguauguggaucacauuuucaugauccauaucuuguuggauaucuagacuguuuccauuucuucgcuguuguggaugaauguagaugugccagugucuuaguuugcuaucugcuacuaugauaaacaucaugaccaaaaacaacuuggggauaaaaggguuuauuuugccuagcagguuauaguccaucaugaaaagaggucaagguaggaacugaagcagaagccauggaaaaaugcugcuuacugguuugcucucauggccugcucagacagcuuucauacacagcucaggaucaucugucuagggguggccccaccuacagugagcuggacccucccacaucugucauuaauccagaaaguguuccacagacuugccuacaagccagucugaugaagguaguuccucaguugagauuuccucuucccagaugacuuuagcuugugucaaguugacaaaacaagaccaaccagaacagagaguaucucucugcuacugguaacuuucuaauuuguuuuuauguuuauuuuaaagccauuauuggaaaugaaaauuuuuuuucugugaaagugaaggguuuuuuucuguguuuuucaugugcacaugaguauaugugcacuuuccauaacagaguacuugaauuuauauccacuaccaccuucacacacauaaucacuguuauuucagccuagauuaucaaggcaguuuuauuucccauacuauagauguuuaaguuucuuuaaaguguaguacacggggagucaguuaauuauguuuucucuuuguaggucggaagacuuuuccaagagcuagaaggacccagggcaccaguuuccggucuccugugagcuucaguccuacugaucacuccuuaagcacuaguaguggaagcagugucuuuaccccagaguaugacgacagucgaauaagaagacgggggagugacauagacaauccuacuuugacugucacagacaucagcccacccagccguuguaaguaauagaaaugucuagcagaaacauuacauaguuuugugucaccaggaguaaaugguaagucagaacucagggaaaaaugacucucuucauaagagauaguaauauguuuuuuaaagguggcuauccuauuagauguguguguuauugcuaauuagcuuagcuaauugcucuucuuuuuuuuuuaaggaaaauuguuacuaauuguucuuacccauucuagucuacaugucuguuaagcacugagacauugcaugagacuuguaagagauagccuaaugaggagauugguuuguggagaaaaaaauuacaguauagcauuuaaucuagaucauaaauaugcuuagagauuuacuagauguguguguucauuacugauucaauaucuuaccaaaacaacuuaagggaaagguuuauuuuggugcaagguuuuagucuacgguccuuggcuccauugauucuuggucugugccgaggcagaguaccauggugguagaagcacugguugaggagacacaguaggacaaagagaggacauacguaccucauaggagaugacaaguaggacuagauacguagaacuugguucuuggauggcuuaggcuuagacucaagcuuagguuuagacuuaggcuuagggaggugagauaaaaccuucagaggcacccuccugaccagugauaaacuuucucuaccaaggcuccacuuacucaaguuuccagaacuuuccaaaauaguuccaucaacauugaguugccaucuuucuaguuccauucuuauuuuugaguauaucaguuuguauguucaugugucugucuguacgugcauguguguguauauguguguguguguauuuuuacgugugugaauuugugguguggaggaguuaguguuacaccuguaacacuuguuaagaauauacauuagcuuguuucuuguugcuguggcaaaauacuugaccagaccgacuuuagaguuuguuuugacugaugagcuuugggguagaguccaucguagaaggaaaggcauggugguggagcacagagaggcuggucauguuuagucuguggucaggaagcuugaugguccugguucauuuuguuuuauuuauccuuuuugggauucccagcccaagggagaacgauccaacauuccaguuuugaacuuuacccccagcaucuucaucacuggccugaagauagagacuguaacaaauuuugugugguccaaagccguguuuugguuacuaccuugcauuuacuuuguucuucaccacugucuuuaaugaguuugaaaacaaggagagaagggucuggagcaguggcucagcagguaagaacucuggcuacuuuuccagaggaccugggcucaguucccagcucacaacuguccgucacuccaguuccagaggauucagugccuucuucuggguuccgagggcaguaggcaaacauaaggugcauagauauacauacaggcaaaacacccauacacauaaacaaagaaaaaaaggaggaaagaaaaucuuucauauguguuuugugcauaccuucaguuuauuuagagucaagauucaguaagguauaauagucuugcuugaagaagugaauuuacccuuuuuuugguaauacaagucuauuggcaaugcauuaauuuaacauuuauuuguuugaaagguguuuuucccuucauuuucugaaagauauuuuucugcauauaaauuuucuaaagaaauagaauauaaggggcuggaaagauggcucagugguuaagagcacugacugcucuuccaaagguccugaguucaaaucccagcaaccacaugguggcucacggccaucuguaaugagaucugaugcccucuuccggagugucugaggacagcuacaguguacuuaaauauaauaaauaaauaagucuuaaaaaaauagaauauaaaaaccagugcuuuuaaauuaucccuugucuucuggccuauauauuuuucaaggaggaauucacuuucagucuuugucuucuucagcaaauaguaugcucuuucucucuggcugccucucagaccuccucgugguccugugcuuguguugcugcuccacccugugcccucauuuuguucucuuuauugcucuccuuugagaaaucccucuuuugugaggcagaaucuugacauguauucuagacuggccucaaaucccauggguauuggaaggugaccaagaugaccuugaacuguugaucuucaugucuucaccucccaagugcugggacuuaaggguuuaccuguuuaugaucuuauugagaggacauauucauuccagcaguuucauuugacuguacaucuggucuugcauguugucuaccauccagaccuuuaauauguugaucacuuuuuaaaaugauuuuaauuuuaguggcguguaugugugcaugugugugguagguagugguguggagagagacagagacagagagagagagauagagagagagagagagagagagagagagagagagagagagagagagaguuguguguguauuaacuagaauaaugugugccuuuauuccuagcacuugggaagcagaggcugguagaucucugaguuugaggcuaaccuggucuacagagugaguucuaggauagccaggguuuacacagagaaacccugucucaaaaaaucaaccaaccaaccagccaaccaaccaaccaaacucucagaaaacaauguuuugugcacuguucuacuaagccauauccucugccuauugaaaacuauuuuaaauuuucugacuuaucuugaaucugguuauguugauugcuuccuuuguaauccccccccccccccagguucauucuauguggccuuggcuguccuguaacuuccucuauagaugaggcuggccuugaacucauagagaucuuucuaccucugccuccugagugcugggauaaauggugugcuccacuaugccugggguaugugugugcuguuugugugcauuuguguauuuguuuguugguuuguuuguguuuuaaguuugcuuuuaugugucuuacaguuuuacauggagugccagacaucauuuguaggaucaugaagacugagauaaauaagguucaugcccaggcauaugcacaaugcuucugccuuguugacuuccagagaguuugagucaguguagucccauuuuacgggguugguuauuuuguuugcuccuguaccugugcaccuuggacuucgaauuccccuagagcuuugcagagaugaucuucuagaugauagugcucuagccccagcauuuggugcuuuuguuguucuugcuucucagagaaggaagcuguauccucauccugcucucugagcaggagguuguugcuucuuuucaaagccuagcauaagggagacagugugccugccuucacuccugagcagaccccauuucuucguuuucagagaucggcuuuaucccagauccuucccacuuuucuggaguggagaaacucuugauggccagggccauagguuuucaucucuuaaucugagaagguguugguuuugugucuuuuccuuuuccacugcucuaacauggugguaacaugcuuuucacucuucuucaagaaguuuaagacaguuuuuguuuugggguacagcucucacuuuauagcccuggugcccuggaacuguuacgggagauccaccugccucugccuucuuaguuauaggauuaaaauuaaguguuacugcugggcguaacaucuuuaaucccagcacuugggaggcagaggcaggcgaauuucugaguucaagacuagccuggucuacaaagugaguucuaggacagccagggcuacacagagaaacucugucuugaaaaaccaaaaaaaaaaaauaaaaaaauaaaaaaauaaaaaauaugugucaccaugguuagcuaucacaggaccauuccauucucuaaccuugaccaccaagugugguucucugugaucucucacuucuaugaguucaaggaagagauaaacagcagauauugugcaaguaggaccccauguauauuugcuuuuccugggguucagugcugucaugguagccacauguuguagugaggcuuggcguuccuuacuugcuggaauggacuuuucucugugauucaccauuucuuuuucaucuugguuuagagugccuccuuuuccuuagauuuuagguuaauuggguauccuguacucugugaucaaaaauguucaguaaaaguuaugauuuuuuucuccaggcagagugguacacaacuauaauuucaauucuugagagcaggcauaccaaaaguucaaggccagccugaacaauguagcaaguuguaaggaagccagggcuacauaauuuuuuuuuuuuaaguuauagggucuggagagagaugguucaguaguuagaaguacuggcugcucuuucagaggaucuagguuugauuuuuagcgcucaagaggcagcuuauaaccauuuguaaauccacuucuggguaagucugugucccuuucuggcuucuuugggcacuguaugcauauggugcacaauaugcacacaugcagggaaaacacucauauacauaagauaaaguuguaauuuuauauauugccuggauucuccuauagagagcggaaaugauaccuuuuccacacuucuuuguuauagaugggucugacaagacuauuuauaaauauuuguaauuuucuguaauaaaauauggaaaaauagggcaucauauagucgauguauuuuauuuuagauugagugaaagauggcugucacauuugcauuugggaaacaggaaucaugagaucaaacguugaguuagaauucuuagaauaaggagaccauuuuugaaagauuugaguggucaucauuuccccuuguaucuagaauguucagggaucugagugaaucacauuuuauuuuaggaauguguucuuuuucagcaccucgagcuccgaccaacuggagacugggcaagcugcuuggccaaggagcuuuugguagggucuaccucugcuaugauguugauaccggaagagagcuggcuguuaagcaaguucaguuuaacccugagagcccagagaccagcaagguaaaaaggccucuugcagaucaccuggccacuguaaaagcuuuuucuucuuuggaggggaaacaaagcaagaacaaaagcaggacuagucagauugcuucaaccagagagacgucuuucauuacccagagcccacauggcagaagaggagagccaacuccuacauauucucugacagccacaguugugcuguggaugugugugcaccccucccuaagacugccugaauguagauacgaaguuuuaaaauguaacauaacaacauaugguggaauuuggggauugugggaaacggccagcuguguuagugcuucguuguguuucuaggcugaccugcuguuaccuuagcaugcaaccguggcucuuaaauaaaaggcauugaggucuggagacauggcuugcaguugagaacauugacugcucuuaggaaagacccaggcucaguuugcaauacccacauagaggcucacaacucucucuuaacuucauauccagggcugguggaacacccucuucuggccucugagggcacugcauacaugugguccagacauauucacauauguuaaaaaauuaaaauuaaaaaaauacauugguuagagacuaaaauguuguauguaacaguaaccauuucauaaugaaaucaccaugauaguccaugagcuaagaguguuuugcuuuuauuaugcuuuaaagacuuaacacagggucagugaaauuguuuagcagguaaagaugcuugccacccaguacccagaauccaccucccagggacccacgugguugaaggagagaacugauuccugcaaguugucucugcccucugcaugguuuucauggugccuguacagacaacacacacacagaguagacauucagagacauacacacacauagaguagacauucagaggcauacacacacauagacauucagagacauacacacacauagacauucagaggcauacacauggaguagacguucagagacacacacacauagaauucagagaaauguaguaaauguuuuuuuaaaaaagacuuagcaggaguucugucuuucaggaaguaaaugcacuugagugugaaauucaguuguugaaaaacuuguugcaugagcgaauuguucaguauuauggcuguuugagggauccucaggagaaaacacuuuccaucuuuauggaguauaugccagggguaaguucacauuccuuuuaaaaauaaggugaagagauuucaguucagucuuuugaucugcugugucacagaugaacuuuuguacugacauugccugccuaccguagaacugcugaucaucgucuaguguaaaguuucgguuuuucuuguagauaagaaaguaucugagauguaauacugguacauaggaauauucaauuuuaaacauuaccaauuuaaaguauauauuauauacuauuauacauauauaguauguauauuaaacaaauauguauauacacauguauuaugcauaucauacacauauauguauguauguguguauauauguuauauauacauacauauguguguguguauauauauuuuuuuuuuuaauuuuuuauuuuuaauccagcaacauggcuacucugaccacauccuaaggccuucuaggucuguauucucugccuggaauacagacacacacauggcaccuuuaaucccucugguuggaauacagauacacccuuaguacacaucuuuuguaucaagcaaugaauguaaaguuaauauauagaaggaagcagccauguuugaaagugauaucuaauugaggggcaaagugacgaaucagagaaagaacuggcagaaugagucagagauaggaugugcccaacucacaugggaacaggcgaacagacagcaaggagaggcaaguugagggagggagggagggagggagggagggagggagggagggagggagggagggagggagagagagagagagagagagagagagagagagagagagagagagaaugagugagagagcgagcgcgugcgagcgagcacaguuuuacugggacaguuauagagagacaagugagaacaagcuagaacagaccagagaaugagaaggagccaaaagauuagaacagauugccaaaguuaguuugaggccaaguagagcaauucagucagaagcucagagaagccaauuugaaucagucagcuuggagaggaguagaguugaaccaccugaguugaaccagccagccagagacuagaaagaacuagaaagggugagcuuauucagcaguaagucucagaggcugaaaacauucuaggccuagguuagauugucuggagauuagaagcuuacaggaauaggccuagcuuacagacagagucccuggagacaacaauuauugcuggagaauguggcagugauuucauucguaauuguaaaaugaaauugugaccacuguauauuccuuuuguauguauagaguaaauuuuaauucuaauaaaauuucaagauggcaguuagcaucuuuacucauuaagagaugggugccuuacuccaggcaugguggcacacuucugugaucacagcacucaggagguagagguaggaggauuucaaguucaaagccaaccuagacuugacaaaaauaauuuuuaaaaaacuaaaaagaaaaaaaacaauauucuuauaauuuaguagagugaguuaggaaggagaaauuugauuuauaggucuuuaugguaguagauggcuagaguuccauguugaagguggaagguugccuuucgagccugccgaucaguaccuggcagugcuguuguagacaguguugaugucacacaagcaucaguaacucuuaccguucguuaugcaucguuguuauagugaccucacugcuacucacuagauuuguaugcuacuauuauguuuucagauauucugcuuccaguguaaguuagcuuaaacguuauuuuuugaaaacaaauugugguuguauuaaagguucuacaaauauggaaaccuuauaauuuguuaaucucaaagaaauuaguucaacauaaguaaucugaaagaacagaaacuaugcaguuauuuuccugagaacuccugucuucuccacuaagaaucucucagacaugaaguaggauucucuuaaaaauaaggauuuagcagcaguuuuuauuuuaaacugaagguuuaguuauuuucuuuuauucuaggguucaauuaaggaccaacuaaaagccuacggagcucuuacugagaacgugacgaggaaguacacccgucagauucuggaggggguccauuauuugcauaguaauaugauuguccauagagauaucaaagguaagccacgauuuacuuuuauuuuaaauacaguuugguucgaaugaagacaugucauuauggcauuggacauuuaacauaauguaucuaccuguaaacugccauaggaaaacgcuucuauaacuuucucaugaauucugucaguguccagucagacuaguucugcaguucagauuuuucuuggacgauagcuuugcuguaaggacccauagaaugaauuucauucagaaacccuagaauaauguuuguguguguguguuaacuagaauaaugugggcauguuuguguguguguuaacuaggccuagaauaaugugggcauguuuguguguguuaacuaggccuagaauaaugugggcauguuuguguguguuaacuaggccuagaauaaugugggcauguuuguguguguuaacuaggccuagaauaaugugggcauguuuguguguguuaacuaggccuagaauaaugugggcauguuuguauguguuaacuaggccuagaauaaugugggcauguuuguguguguuaacuaggccuagaauaaugugggcauguuuguguguguuaacuaggccuagaauaaugugggcauguuuguguguguuaacuaggccuagaauaaugugggcauguuuguguguguuaacuaggcuuagaauaaugugggcauguuuguauguguuaacuaggccuagaauaaugugggcauguuuguguguguguuaacuaggccuagaaugcugaguagaggcucugccaccccagaguugaauucaaacuuggacuuuaucugauacuaacuauaaccuuggacauacuaaucuuucuauauccucauuaaucuuuccauccccuuuucuucuuuauccuucauuuuucuucccuccccauguugaaaccccuagugucuagauauggaacccaggaaauugcauauacuggcccaaguucucuaccccugugauguaccuaugucuccucauuauuuauucuuaagugagagucaauaguauucaauuuaugggauuuuuuuuucucuaucucgagacaggcuuucucuguguagcccuggcuguccugaaacucacucuguagaccaggcuggccucaaacucagaaaucugccugccucugccuccggagugcuggaauugaaggugugugcuaccauugcucaacaauuuauaggauucuugaaaggaucaaauauguuaacauguugcaauauuuaaaacaauuuuggugcucacuacuuaaaauuuagcuacugugaugacauacuuuguguugcaguuuaugcagagucuugggaauagaugucaugaaagaauaaagaggagggagggaggauuccccagacugagcacuaaugagcuccagccagggggaauucacauuuccccuaagggucagauacagaaaugaguaugcgaagugagcuaaugguagggauguguuaaacuugagagugcucaaaucucuguacuguuaagccuauuugaguauguaaaaacuggguaugacccaacauuuagaauuaauuacugaauuaaaaucacugaauuaaaaaaguaaaugugcccauauaauauuuagucauuaaucuuuguuggcacuuuuacaaguucccgacuucugcuuuccuauaugugugguacguccugacuguccagaugagauaggccaagaggaaaauugcccaucguuccuggugauugaacacuaauuucuaguaugagucuaguuaguaugcagaguuccugaggcagauggcaugcaccagacuggggcuucuuacguauaaaaccugauagcuuaaagaacccuuuaaagaaauuauucaguuaggaaaaucuauucuuugucaagcgagccucucuuuggcuuucauaaugagguaggaaaagaaacagagggagccaucuucuuuauacauagaucuucuaaucuucccaggauguauaaugaccugccuuggucaggugagggggaaggaagcaagcugauaaagaaauaaauauuacaagacaaauagauggauaaaggagaaaauagccccucaagcuuguaaauuuaagcaagacagaaggaaaaugguggccaccaaaaggcaauguauuuguuuucuagaauauacuuuuuaauuguucugugucuucuaauuuuaaugcacaacuuauaaguggcaaaaggaaagguaaagauaauugauuuuacauaauuucagaccugugggacauuacuguuaggaaacacacucauuucuaaagucuauuccugccuccccuaucauccucccucuucucucccucucccacuccuuccuucuccuuuucucucugaauucaucacauuuuauuuauguguguguggaacacaugcaagcuagugccacagugcaugcacagaggguagagaacaacuugaaggaguucucuuccaccauauaugucacaggcacaguacuuuuacucauugagccaucucucuggcccuguucuauauccuuuuuucccuuucaggcaucuauacuguugacagacaugguaugguggugguacaugccuuuaggcaacagaggugugugcaucucuaugaguuuaaagccagccugaucuauauauugaaaaagcaaaggaacuauacuaucgaugguuuuauuuguguguagggguggguggugggugagugcacagaggcuagaagaggacaggaaauguccugcucuguuucugucuuguuuucuugggucaggaucuuucacugaaucuagaucucaccauuuuucagcuaagcuggcuggcaaaaagcaccauucaaccuccugucuguguccuggaugcaugcagacacauacggcuuuuacauguguguuugggaucugaaugcagguugucaaccuugaauaacaagccuccuuacccauccuuaaugucuuuuguuuugcuuugguuugggucuucuguuguuuugaggcaguaucucuuuauagucuagguuggugaucuggaaguuugccuuuggcucuugaguacuaagauuauagauguuugccugcaaaaccagguagggcauacacaugcacacauacaugcacacacacaucacuauuugucuguauaucgcugacagacagcagauuauaaugacuccuugggaugcaauuagcaaaaucuaaacugugagaaagguuuaaauuuuucuuucuaacugcaaaugaaaagaauauuugagagauuuagauuacacagucucacuauguggaucuuacuuggauggauuuuuuaaaucauuuauuuaauuuuauuauaugugcauuggugugagggugucauucccuggaacugggguuacagauaguugugaacugccaugugguugcugggauuugaacccagguccucuggaagagcagccagugcacuuaacaacugagccccuggaugguucuuuuuugcuguaaaaaauugcaaauauuuuugauaauauuaaauacuguucaugcuuuuagaugugauaagaggcuuuaucuuuuaaagaugugcacuuaguuuaguucuuuauugaucucacugccuugaguuugccucagauacuaugugaaaagaggggaaguaugugacaauaauuugggacaguugucugcuuggauguuggaucuggguaaugggaauacaagcaauucuuucuauuuuuguauaugcuugaaaagucugauuuuuacuuuacuaaaauauaaguaguuuuaaaaaauacaaacuauauuggcagccuggcuaccuauuccccccccccccagcuccuggugugggugagcauuguuucaguauugaugccaccuuccuagagaugacucuucuugucuguggguuaugugagugugugugugugugugugugugagugaagggaaggugucuuuuucugcuuguaggcacuaaaaccuggcuuauuaagcacguguagucucagcuccugaggaaaagugggauaaguuugggaaagucacuugagcccaagcguuguaguugccagccugaacaacauggcaagaccacaucucaagcaaacaagucuguuuugcuucuuugucguuaaauacucuagagaugguuggguauuuuuuuuuccuugagucccuuuuuauauacuagaugguaggagaccauaaacagcggaguuacagcugcauuagaggauuacugguaggucagacauuuaaacuuaaugguuuugaugagaggcauuguaaacuccuguggagaagcacugcuggugaggcugggggauuuucugagauacagaagcucauugugaagauggagaauacacauucuccauggcuuguaauguagauuaucugcacuguccugccugccuuccccauagaaauccuuaaaacaaaaguguagcauggugguguguaccugucaccccaaggcugaggugguugagucagaaaguuugaggcaagucugagcuauagaguaaaaggaacuccuuuaagauacagugaacuacugcuuagaugauauuggagcaggcaugugauccuaguuuugaugaugaagguacuuuuagaaguucuugaggagaagcuggcuuaugaagagaauagucucagaauauauuucaacuaguaagaaagacacaugcuccacuauguucauagcagccuuauuuauaauagccagaagcuggaaagaacccagaugccccucaauagaggaauggauaaaaaaaugugguacauuuacacaauggaguacuacucaauuauuaaaaagaaugaauuuaucaucauccugagugagguaacccaaucacaaaagaacucauacaauauguacucacugauaaguggauauuagcccagaaacuuagaauacccaagauauaagauacaauuugcaaaacacaugaaacucaagaagaacgaagaccaaaguguggacacuuugccccuucuuagaauugggaacaaaacacccauggaaggaguuacagagacaaaguuuggagcugagacaaaaggauggaccaucuagagacugccauauccagggauccaucccauaaucagccuccaaacgcugacaccauugcauacacuagcaagauuuugcugaaaggacccagauauagcugucucuugugagacuaugccggggccuagcaaacacagaaguggaugaucacagucagcuauuggauggaucacagggcccccaauggaggagcuagagaaaguacccaaggagcuaaagggaucugcaacccuauagguggaacaacaauaugaacuaaccaguaccccggagcucuugacucuagcugcauauguaucaaaagaugaccuagucggccaucaguggaaagagaggcccauugguuauguaaacuuuauaugccucaguacaggggaacgccagggccaaaaagugggaguggguggguaggggaguaggggggaggguaugggggacuuuugggauagcauuggaaauguaaaugaggaaaauaccuaauaaaaauauuaaaaaaagaaaaagaaaaaaaaaagaauagucuucagccauggguuucuugcuuuauagcaaacaaauggagccgagccugucuuggugcuuuaccaagcuuuagucuuagcccguucuccuuucuuuucacuucaccugccccugucccguccuuuauaggggaaacucauuagcuucugaaacauaccuggcuaaguaauguacaaacagcaggugcuuaauguaagauacauacaguuuucaaggcacugcucagaguggacaagcagccuaauuuggagacagauuagcaucuacaaaguaauucucuugucaccuacauacauucuaggauaucaauaaaaucauugaaauaagacuauuucuuauuuuuuaggagcaaauaucuuaagggauuccacaggcaauaucaaguuaggagacuuuggggcuaguaaacggcuucagaccaucugucucucaggcacaggaaugaagucugucacaggcacgccauacuggaugaguccugaggucaucaguggagaaggcuauggaagaaaagcagacaucugguaaguuuggacaucagagucaccuggaaaguuaccuuauuuuccuccacauuuaaaauugccaguuaaauuauccuuuguaccuuggaaguagaauauaugaauuguaaguauuaaugccauuucaguuauaccuugucaaggcaaacuugacuaaauauuugagccuuugaaccuauuuuuccuucuuuggaaggauuuugucuuaagcaaaucucaacauuaaaaagcucuuauuucccugaauaacuuuuaaaguacucuugguuaucagugucuuaaaaaaauacaaaucauaaaaugaugcaugauuuuuuuucuaaacuucaaagguauguauaaacuuuugaaacagauaacagcuaccuguacgaugguugaacuuagaaauaaugacuggggugaaaauggguucugagaucacccgaggagauuaccucaccuccugcccacuccugcccagccuaacacagagcuuggcuccucacacugauaugggacuucccacuaugcgggguauuuacuuacggauuuuaaaacacacagugaagcgaugcaguucugauaggucuucauguaauuucuguuuauguguuugaagaacaaggacauuuccaucaauagcugaguuauguuuugauugcaccaucagauuuuccaaggauuuugaaugucagcucauauaauuauuuauaauaaauugaugauugcuuuacagaaauaaaaacuguugcugugguggugauuugaugugguauuuucauaauaugcuuagcucuguuguuuuuggaaaauacauuuuauuggauucugcaugauuuaagguaucugcgagugucccagguaaggaagaagagaaauuaugcuggugacuauacccuggcagggcugugucauggcagggcugugucauggcagggcugugcguuuguuuaguuauuagugccuuaaaauggaauugauaaauuacauaauaguuuuuaguuagaucauaaaauagccauuuccuacuucccaaucagaaaagaaaauacacauuuuaggaacucaaaggcaaauaauuuauaaugcuuguauucuuuguaggauggagacacaauuguuaauguuagaaaaugaucgaaaacaauaaaaguuuuuugccuaacccuauacuuaugaucauagauaauuaugauauauuuucauugaaauguuuauagcuucagccuuucauugauauucauguuugaauuacaguuuuauuugauuaaccuuugagugaaacuuuauauuuguaguaaauaauauugaaauauauguggacuucaugccagcuucucauuuuucuggcuaaccagauuucuuuccugaagauacuguuuggguaaugguccuuuuuauuuuguuuuaggaguguagcauguacugugguagaaaugcuaacugaaaagccaccuugggcugaauuugaagcaauggcugccaucuuuaagaucgccacucagccaacgaacccaaagcugccaccucaugucucagacuauacucgggacuuccucaaacggauuuuuguagaggccaaacuucgaccuucagcggaggagcucuugcggcacauguuugugcauuaucacuagcagcggcggcuucgguccuccaccagcuccauccucgcggccaccuucucucuuacugcacuuuccuuuuuuauaaaaaagagagauggggagaaaaagacaagagggaaaauauuucucuugauucuugguuaaauuuguuuaauaauaauaguaaacuaaau

SEQ ID NO: 8855 - RNA, 7904 nt, Mus musculus
uuagauccuaaccucuaccuaucaagcuuuuuugcucaguaggaaucuugaauagaagauacgaaucucuaagagguauguuuguuaauccuaaucaguauacuagguaaauacacuauauuagagcuguguuacugggcucuauaaaccuugagagacagcuuucugcuuuaaaacauuguuguauuuggaagcagacaugugaagccaaugaaugaauucagcuaaaacacagacgacugcucauuaaauguaugagcaguagaagagacaacauuugccagucaguagaaaaauguggaaaaacagaauuaguguuauguaguauauuuuaaacauuauuuacuugaggugaaagucccaaaauggagggaacugagaaauaauaaaaauuguguuuauauauuagcuuccuauuucuaaccccugauuucccguuagauaacagucuuuagcucaaauacccaccuguuaacgcuccugucaugaagucaaaaccuuguucuuggggucuuggaguacuaaacuagaggcuccucagaagaguaaacaucagggaaaacaaugagguuugugguggggagucauuuuccuucacuuggcauuuggcaaugccuggagacacuuuguugccauaacuggcaagguacuacuagcauccagugggcagggguugcaggugcugcuaaguagacuguagugcacaaggacuccccacccaggaguucuccugccacaugacaaaagugccuaggauggaaaccaagcagccauucacagagcagucagagcagcggucagagggacgguguagggcggaugagggcuucauaagagcagacgaugagucaggugagcagucucagcucauaacagaugaugguccucugacagcuguugguugcacuugaaucauuaacucaccuuagaaauaaugaauuuaaguauucaacuguuugaauuuagcaucucuguauauucuucccuuaaaaguagcuccuccuccuaggucaagaaaaguacaccaaaacauaguguuuacuagcaguggggagguuaaaacacugccagguauuuccaguguaagcaucucuuuggagccaugucauuaaacggaaagacugugcugggcaggauccugccaucucuaguacaguuaugaaacuuaaaacaugaaggugucaguaauuuggccacuugcaaauuuuucaacauuaaaccaagugcuaaguauuuuauuuuuccaaagccuagaagauaacaaguuuuccaggagacccugaacgugaugcuucaucagaagagacuaaauaagauauucagauuuuguuguuguuauuacaggguauguuuauuuagauaauuuuuaaguacuuugcuuuugaauuuauguagauaugguuuuaauguaucaagauccuacccggcagacccuguaauaauuuuugaaauuccaguagucugagagucaaagcacaaacaauuaguuaacucuucucuuguacacuguaaaucaaacgaagccccuugcaaugaccacagaucaggggccuccacccuuagcaaaucacuugccuaaucuuaggccggagaccuaaugcauaggccuauuguaauuucuuuaucuuuuaugagugagggcaucucuucuacuugagcaagaucaugguaccuggauugcuggguucuuuuguuccuuuauuguguuguuucuuugucucuuagugugguugugguucccuuuggcucacuuuugguccaucaggguaaugugcaguacagaagagauacaaacacucuucagaaagauaccugcacacuggaacgcaaagcaaauuguucgcuuucuaagucuccuuuuucuuuucuaaacucacuaguaaauaacugcaucagaauacuuuugcuuuauaaaaaacuuauaaagacuuagaaauagacuaauaguuuacagagcuauuauauuaaauaugaugugaauuuauuucacaccaguugugaagguaccaaaaaaugcaaugaaaguuaauauauauaaacccugcuagagcaaaaaagcuugaaguagguagggguauggaaggccaauaguaaauguaaaaaaguaaguuuuugaaaggaaacaauguugucaaaggaaguaaaauacuacacuccguguuuuuuucugcuuaauuguauggauuaacagaagaaguuuaaauuguaaaaaauuguucuaaauuuuuuuuuaauauacaacugauucuuugguacugcaauguuucuuuguggcuagaaaacggccagacugcugacuuugugccuuuaaaugcguucugcguugccaguagcaacuuccuuccggugcuggagcagauccacuagcagugccaggcgugcucucaggacgcaccuucugcauggguccugagagaguccaaggcaggcuggggcugagucaaggggaagaccucucauagggcaaacaaaaguaguugaauaaaagaguuaaggcguaacugauagcauuuuaauggauugguauuuaaaccuuuugagguuucagaaugaauaccuugaaaauuuucagcacuuuuccuuguuuacaaaaauauauuuuuaacuuuaaaaacaucuaugacuauugccuuagaaaguauuaagaggcacaaucuacagcauaugagaaguugaguauugcacaugcuggacuguaaaagguaaagcuuuuauuucagaauaaauguaauuggcuuucauuugagucucaccuuacuccauuagaaguuacauaaaaagaguaaaaauauaucuuuagaguagcucucugcuacuaaguucugacguaggucaggccggaucugcacuauucugaaaugguguuguuagaagauugggaaaucacuaaaauaaaaucaaaccugaauagauuggcagaugacccaguaugcugcagacuccuugauuaauggcagaguucacaccagugguuucauuuggggucugaaaaccuuuauauaaauucagcuggaaacaaccagguauacaaaucugucagucuuauuuuaguuuguuuuuggagucaggguucucacuauguguuucaggcuggccuggaacuuaaaugcuccugucucugccuccugggugcugggaaaacaggcaugugccaccacacccagcuuugcccauuuaaaaaaaaaauagggucaaucuuuuucauuuucuuacucaacaguugugauguacuguguuacauuaaauuaauauucuucaggaaauuacaguuguggaacaugggcagacaguuacuuaauggcauacccuaacucugaaaguuuagcagugaugcuuaaaaugcuaggauuuuuauaugaaaaaauaaggaagaaauuuuagauaauuuuggccauaauuauggacuccaaagauaugaacaagaggauuagaguacaaguaucuauaucccacgucagaaccugcucuuccgauacaacacagucccagauuguuuugggacaauggaacauuuauuccuuagcacacuguauugggauucucccucaccccagccguuguuguuauuuuuguuuuaaggaaaaaaaaaaaauacccaaaaccuuauuuugguuuuuagguguugaaauaccaagaacucuuugauagagguugaacuugucuagugucacuuaugcuaaggucagauucuuuugauagccuauuaaauuuagcauuuacuuuuagaugugacauucauauuuauuugauuuuaacacugguuaaaguucaaugaaaaaaauuuguuaauuuuuaguagugccuuuuucucuguaugccuuaauuuuauuuuauauuuguaauucagauuaccuaacaaaaugaagaguuuuccaaaaugcuaggccucaagagugucucuggccuuggucuguguguuggccccuaugucuuucuuaaugcuuauuucuuccucuuacccuuucuaccuccuuuuuaagaaaaguuaggagagaacaguagcauuuaacugacugcaaucuccacuagaugugaauuccuaaaauaaauauagaaagguauucucauucaaaaagacacagcaaauugauuuuuggguugaguacuugauuuucagucauacuggcacuguccaaguucuuuguguauuauuguuugguuaugguuuucauagaacuagagcaguuguuuuguccuuaagagcuccuuuaaguauuuuaugaagguugaggcaaugagcaagaaauccauuaguauguaacauuugaccaauacucuagcuuacuguucugugaaguaugugcgcgugcaugugugcgugcgugcgugcguguaugcguguguggcauuggggcagggguaggaacguguaguuguucaguuagaucuguuuuuguucuuggaagaacaacugaaaaaugucuauguacuacuauaggaugagaaggaucauucccaaguaggcaugccaggacauuuuccauaaguagcuaguacaaaugauuguuuaauaaagauauuuauuguaaguugccaagcucuuaauugcuaaaaauagauuaaaauuccauuucuguuuguaucuguaauaauuagcuuauauauaauucuuuaauagaaaguaugugaucuuagguauuucuucaugaacuuuuuggaguagaaauucugccagauauuaucagacaagcuuccuuaguuuaccaggucaucaaaaugaaaaguucuuauaccucuuguugguugcuggggaaggugugcugugagccacucuuugcuucugucaucguuagugcugcuuccacuccucccauugucuaaccgacaccaugagugcugugggguccaggguuguccucucugugcucgcucucagagcuggagauggguagcucuagggaaccaagucauuucucagagguacuaaaaguggucaagguugagcuucuggaagacaaggggggagucauagcuauagugaaaaaagcauaugcuguauccauugccuguauacagucucauauaauucuucaugguuuauguguuuguguauuuuaauagacagugauaagguauuacguucccaacagcaaagacauuaaacgagagaaugcuccuguccuucugccuggugguguuuguuuguaccucagucuguauuaccagaaucacuuuaaaccaaagcuuuuuuauucccugcacacauagccaaaaugauuagcccugauaaauuugcccaugugugagcuaauaguaucuaaaugguagagcagaugcuaguagaacuuguuugccaaucuaucuuauccuucaaagaaaaggacaggugcucaguugcucgaauuuagacaugcagaauacuuacuauuauggagcuauauagacacugcagacauacguucuuaugugugccaaucuuauuaacgucauuuggccacugauguguguagauuuguguugacaucugaugcucagguugguggcuuauuuucuuucuagugucuuaacauuuaugaguuucuguuugacuuaagggacauuucaacaaugcugugaagaaaaguagguuaugaacuagucugcuuugugccauagacauuuuggaauguacagaaggaagcaucugcucucuauucuuuaaagcuuacagaauuugauccccacuaaggauuuaugaaucuuauaaugccaguugagaaaaguuuaugacuauucugaaaagcacuuuguauucauuuauuuguauguuuuagaacuuuuuaaaaauccuguauaaucaaugauuuuagcacuagcauuacuuagagcagaagauaaauaauuacauguuaaacucuagcaguugcauugaauccagaauauauuugacauguucucaguuauccaaagacuuuuuuccuccuugcaguaaggagaguagacuagugugggacucugcaagccuaaaaggauuaugggcaaaaggaagugggccaaacccuugucaaucaaaaccauauugucuagggaugagaauacuucuuuauagacaguuuuuuuuuauaauuaguaaguaaaagguuuacauuucuuccauugcuguugguuuuaaaauuuagccugcauucugaaauauccuaacaaaguuaauaccaaaaaacaccuuuaaugucugacaucucuuauauuucaugugguuguuuuuacucauuguaaauaaaacuuggauaaauuugaaaauaaacuuuuaucuugcagacuaugauuaucaauuuguaaauuuacccuuugacuuauguacauuuaaaauguauccauuaaauucucuauauuuaauguauuauuuuuggcaaauguuuuuaaucucaguugaauacugggcaguuucuaauuauguacaaauauuuuucguuuucuaucaaugcugacuuuugcacauuuucaaacauuuaauuuguacacugauuuauaugaccaauacuuguugagugucugagagucaugagugugugcauugaacuacugucucuguguuugcacuucucccuagauguagcccucccucaguuucugugcugcugugaccuucguaggaugaccuucuugcuuuugcaaagucaccugugugugguucuguguuuguuggagaacucaggaguucaguguugcagucuaauuuuguccuguauucugaauccauuccucgguugaaaguauucuguguguaucaagagauauguguucauguggagauguccuuuucuuuguguagacacguguauauaucuuaguaaauucuuauuuucauuuaauuucuacaauuuuaagaacuuuaugauaauuaaauauguguaaaggcuuucugaaagauuauuuacuauauauauauacacuauauuuucagcuggcuggucaaauuauuuuuuaaauuuugguuuuaaccauuugagcagaauuggauacaaauuuugcuuagagcucaguuaaaaugcucuugcagcuaacagcuuuugggguggggggagauuguuaagcaguagcaaaacacauuguccacuaacacggccuuuggccucucagagcuguuaaaacaugugagcaacuaaaucgucuugaagacauguggagacuuuuauaucuccaguugucugacuguguuuuugaauauuuccuuuauuuccaaaguguucauuuuucucuuacugagcaaagguagaccgaguuguugaaccaaugccuggcauauugugauucuucacaguugcugacuguuguguuaggacucuccaaaugcacagcgucuguauucuguacuguguguucugagcagcuggcaggaaguguaggaaacuagguuucugucugacaauguuacuguacucaauggaaaccuucuaaaaggaugugguggcguaaaguuauuuguguuaggaauaaagucuacaguugacguugacuauccuaaguuuaucauguugagaggaacccaugugauuagaaccuacccagaagccagacacaguggaguauguaccgcaucucacacacauuugggucuguuguucauucaaaauugugcuuguaaaaauguguaaaauuucuugaguuuuauaauuucuauguauuuuuucuugcugguaaauagcuuuuaaauuuuuuaauauaaaagaaaccauguuuauauuuuguuagcaaugaugacuuuguuauauggcaauuugugaauuauugacacaucuuuauuuagauuugucaugcaugaaggccugcgauauucaguacagugagacauacuucguuccuagucaucuuccgacagacuguggugcagaggguuacucucaguaacccucugaacuguggaauggacauaaaugaaugguaauuggaguguuaauaaagcugguauuuauucccacugugau

SEQ ID NO: 8856 - RNA, 29912 nt, Mus musculus
cuguauuuccgguauguaccggaaguucauuagcaaguaacuccugcggagaggagguggugcggugugccggccugccugcaucuagagcuguuaugggcaaaagagaucgaguggaccgcgguaagcacuacuuguaacugucauugucgugggguuuucucuggccuguuguguccgggagaugcggaacuuagccgggugggaggcguuugccggacgccgguaugcggguggcgcugguuuaggaguucuugccagaagucuccuuggguggugaaaaaggaacccuagaauccugcugggcucacuucugugucuucggucgcagacaaaaagaaauccaagaagaggcaguaugaagaggaagaggaagacgaagacgacauuccugggaacgagucucaggaggcggugcccuccgccgcugggaaacagguggacgaguccagcaccaaaguggaugaguauggagcaaaggacuacagacagcagaugccacuaaagggugaccauaccuccaggccccucugggugguaagcauggccaaaaagccugcgcggcagcuaaaucuuggacauucuuacaccuccaaaauucaaacgugagaaaugcugcucuuucugaagcagccgggagagacggcugucauggggcacacuggaguagcuggugugaucugguguucuccacuucaccccagccccccauaugaugacaagccagauaacucaggagguaaaggcucuugcugucauaggaggaggagaggcccgacucuggcaagucacuuuagagcggugacaugcaugcacucacauacacgcacauaccccacauacagucaguaaaugacauuuaucuguuugggugguauaugugcauacccugugcagagagacgugcagggauuguuuacagagcccagagacugaugugagaugcuuuucccagucacucuucacauaucugcccagcucccuguuuuggcuaaacuuacuggccagcgaugccccccaccucccaccccaacuuaaucugccugcccgcccacccaccuaucuccagccaucacagcucugugguuguaggcaugcauuccugguuuuauacuuaagugcuggagaucgcaacugagguccucaugcgagcgagcacuuuauacaccaagguagcuccccagccacuaaauaguuguuuuagaugacaauugauuuacacuucuuaaaaaagauuuuuaacauuuuauauguauguguguguguauacuuguuuccagaggaggcccgaagagggcguaagaucccccaagccuggaaugacaggcuguuaugagcugucugaugugggugcuggaaauggaaccuguguguucugcaggagcagccagugcucuuaaccacugauccaucucuuagguucuuuucaaauugaugguagauaauguuuugguagcuaaguuuccuuggcuuaaaauacaucaugaucuguacucaauuugcauucuagccaaaaggccuuuugagaauaguauguuggaagauuuccauauauggaacauugggaaccuuuucugccuacucuucucuaauuauaggagcagggucccugcaguuuccugaaggauugauugcaagaauauccuucccauuggacacucacccuucuugauagugaugugacagucuagugguguaagagucaccuuauucaccugacauaauuguugucuggaggcuuacugcgccugucugcuaaccuaggccuaguccuggaagcuucuagucucuguguaaucuaaccuaggccuggaauguuuucccuccucugagacuugaagcugaauaagcucgcccuuucuaguucuuugugagcucugacuggccaguuuaacucagcugcucuggcucagacuccucuucaagcugacugcuucaaucuggcuucucucuuggcuuuuccugaauugcacugcuuggcuucauauuaacuuuaggaaucucuucuaaucuucuggcuccuucucauucucugacuuguucuguucucacuguaucuagcuugcacucucucuauaacugucccaguaaaacugccuccuucucccucuuugugcugcuccacucucaacucuacuguacugcucuccaugaacuccgcuguaugcuguacuggacucucuccuccuguacugccugucucucccuuaaguagcuucccuuuccucucucaccuuugagaguugggcguauccuuuccuaucaagucucucugauuugucacuuuuucugccacucaguuaaacaucacuuucaaacauggguacuuccuucugcaaacuaacuuuaccucuauuguuugggauuaaaggugugaacuaaaggcaugccuguauucuggccagagggauuaaaggugugugcugaaggcugagccauacaacuaggagaagguuuuuucuuuucuuuucuuuucuuuucuuuucuuuucuuuucuuuucuuuucuuuccuuuccuuuccuuuccuuuccuuuccuuuccuuuccuuuuuuuuuuuuuaguaaauaacacagucucagguucgcagugugaucagaaauccugugacauagucucugcagcucauugauauucuugccuguuguguucccuugaugccuuuuaggcuccugauggccacauuuucuuggaagccuucucuccaguuuacaaauaugcccaagacuuccugguggcaauugcagagccggugugccggccuacucauguacaugaauacaagcuaaccgccuacucccucuaugcagcggucaguguugggcugcaaaccagugacauuacugaguaccucagaaagcucaguaagacuggaguuccugauggaauuauccaguuuauuaaggugaguuacuagcaacucuugugcucaggugcguacuuacuauauguugucauugaaaugucugauuuguguuuccuuugauagcaaaauagcuucgugccuagcugcugccacuuuagauccagccaugguucuggcugagaucauguguuuugugggcugcuccaagccaugggaguagaaguucagguccacuauggccaggguuacuugagaauccagcucuggauagauggaacuauagccugcauguacauaucagaauccuaaccccaaauaccuguguguuaguaagacuaaaugaggucauaaaugucuccccauucagaaggugcuugucuuuauuaggaauuauacaguugucauaagucccuucuuuaugggacuguguagagagaaggugacucucuucuagccaggagaccuuaccacagccugaauuagcugguccugguccauugauccugaguaguuagaacucugagaacauaagcuuuuguuguggaguuuuuuuggugguuagcuguuacaggaagugagcuccauguaagguaaauacuuaagauccaugguaaauuaaguguauuaggguaagacaaaacuugaaauguugaccugaagaggguuucaugggaacagcaguugaauauagguguauauuauucacagaagauaggagaacaguuuuuguuaguauuggcuaaucugaaaggacuucaaauuagauuucagucuggaagcagaagagugugccaugagcagaagccugggagcacgacagaguucucuguucugugaugcagaaggaugcugacgaagaaagcaccagggcuaggccuuuggucuacauggucuaaaggacgguagucgugcuggggcagugcuguugugcucugaggggcagcucacaaucucaguagcaaguuauggcgaacacacaaacgaccugcucccuuccagcagauuggggacuuaaacucuauucccugucccucagaggcuuacacugugcuggcaagguggcacgcgccccuuagugccagaugucuagggaggaggauuguaagguuaauuucuaacuugucucaaaacuuaaaaauagaggugguggugguucgggauauagcuucauggucuugaguucacuugccaauacaaugaagaaaagauggcauucuuuagguuguggaaauggagaacauuggugugaaggucuaaacauuugugguauuugaacuuacuguguguagcagguccugccagcacucacugugccuggugacuucuggggaagcaggaugggcuuccaggucgggaugggggcuguggccaugcaggggaaaggaaaacggaaaacacagcagagguuguaaauagugguuuguaaauaaaaagcuaggcauaugaauuaggcaaaggauggguuuaucccaaaacuauggaggucaacggacaaaagcccccuugaggcagcuguggcuguggcugauguuuuccgaaaguacacccaccggucccuuggccgggugcugagccugguggaguagcaugcucugagcgcugacguagccugucucuugcuguuccucugcuuacagcugugcacugucagcuaugggaaggucaagcugguccucaagcacaacaggugagcacugcccucugugugccagccgggagggagggagggagggagggagggagggagggagggaaggcugggagggcaggagggaggggagagagggagggaggaagggcagagagggcgggagggagggcgggcucacaccguuccugagacauagauggggaguugaggggaccccggaaggagaaggaggcccugcagcggagugaccgucaagcgucuggaaguuaacauuggcagugaugaugaugcacacaggcaguaggguuuccuuuuuacauacagaugcuuuaaagaagagcgugaaucgcagcgaccacacucaagcugagagcauuucugaccuuugaguuuaacucugcuccuuucccgggugcaaccagguuuaggagaguucacaaggaagggcguuuucacuccugcugcugacaugcugacuuaacuucagggugccguucuccucugacccucagccuguuagagcuuugcccauagcuccucucucugauuugacaaagguguggggagagucauuacgaggcuguaauuuucagaucacccaacugaguuacaauugcagaauguucuagaaaugcagugcuggccagcagggacucccuuccucuccugcuuguagguacuuuguugaaaguucccacccugauguuauccagcaucuucuucaagacccagugauccgggaaugucgcuugaggaacgccgagggcgaggccaccgaacucaucacagagacuuuuacaagcaaaucugcugugcgugagcuccuggguuuccugggggcugggcacuuaggaccucaguuuuccugguccccagcacagcuucaguucaugguugguaacaaggugcagagucuggauuccuaccuuucucucacagauuucuaagacggcggcggaaggcaguggcgggccuucuacuucgcaggggguagaugcacaggccacgucugacauacccaaagaccuguuugauuuuuaugagcaaauggacaaggaugaggaggaggaggaagagacacagacaguguccuuugaaguuaagcagguuagugacugcuuccugguuaccagucuugccuugugucagcacccuccacugugagguaaagaaagggaccccuguauguuucuguuuggguucuacacaaguauaagccauggcauucuccuggugggaguuaugggcugagaguccuuccguggccuaggaagcugcucuccauaggauccauuuugguucagauuaaaguucauuuugaggagaccaggaauacggaucugcugguagaauaacuuucuucguagcuguaagucccuggguucaaucucuagcaccucguaaacuacgcacgguagugugugucacagccugaaagugggaggggaggagggaucagcaguugacggucauccuccaccagacagaacuuaagguuggccuggaauagaugggacuugacucacaaaaaccaaaacaacaagaaaaaaaaucaacuagccaaauaguacauugauuuugacuggguuacuaguuugugcugccuuucugugcaaaccuaguuguuagcaagcaaggucugaaauuguauacauccagauaaaaggccagguuucgaucaugcggcccuuuugaauauugucucggacacucuggaguugagaucgucacacguccuuccugcuggcuacuaggaaaugaucgaggagcugcagaagcgcugcaucugcuuagaguacccgcugcuggcagaguaugacuuccggaaugacacucucaauccugacaucaacauugaccugaagcccacagccguacucagacccuaucaggagaagagccugcggaagauguuugggaacggacgagcacgcucaggagucauuguucuucccugugguaagugaggaaggcuccaucuuugucugccagcugccuccucccugcucgguguguuucccuguguagcacuuugccuuuaaguggccaaggucacuuccucauuugguaguugacugacgcuuauugaaguacuugcuuugugaagcucuuggucuaggccaguggcccucaaugucccuaaugcugggacccuuuaauacaguuccuuauguuauggcgacucccacccauaaacuuauuucauugcuacuucauaacuguaauuuugcuauuguuaugaauuguaauguaaauaugauauucagaaugacuuuaugugaccccugugaaagggucauucaaucucaaaagggguugagacccagagguuacgauccauuggucuagacccuguggguaucagaucucauucagcuuggguagcgaaugacugaaauagcucugcuaagacacuuaugaagagucuuccugauaaugcaggcgucagagaaccggagcacaguguaggaggggcagcagugcugcuggggagcugcugggcauagagcgagacucuuccucugaccucagcugcaacaagagugaaugugguguggagacucuagauggcaagacugaggaaagaugugcacaugcacacgcgcgcaugcgcacacacacagacagacagacagacagacagacaaagggcacgcacaugcauacacuaccgcacuuccuucugucacacuucacaguuaguucuaaguggugucaggucuagcuagguucaaagccacaacagauucaucugggaacgccacuccagacaguuugcagagauggccucugccuugaguucacuucauaaagcuucaaggcacaguuauuguugagcaguuugauuauuuucaccuuaaucuucaaguagaaggugauaggaaaguaagaaacuacaggaguuuuaucaucuucucuaacuuugccaggagcaugcacacuuuguguaugccugagccuugauuguccugucaguuagaagcugccacuugccgggaguguaugcugggcacaugugaccauggguaaaaggcuccuugcuccagccuucuuuaaaaugaugcuagcaggaauaucuuucucauuguugguucugacaugucaccauuuuaaguaagaugcccauaagagacugcagucgggucugcuucuacuaagcucaugaacacgugccaggugggucauuucuuuauaaagaaagagccugagacaguaagugcuucacacgcugggugugaggaccagugugugaccuuuguccacuuucuggugcaguugagccauucuguacaucccuaagcuguguuucagccugcuuuuggguagcaugacccccugcuugcuuguaggugcugggaagucccuggucggcgugacugccgcaugcacugucagaaagcgcugucucguccugggcaacucggcugugucuguggagcaguggaaagcccaguuuaagauguggucaaccaucgaugacagccagaucugccgcuucaccucagaugccaaggacaagcccaucggcugcuccguugccauuagcacuuacucuaugcugggccacaccaccaaaagguccugggaagcugagagagucauggaguggcucaaaacccaggaguggggccucaugauccuugacgaggugcacaccauuccagguaaggagggagaggccggccgugcuguguagauuaaagcugacuucuaccugguggguugcagguggcuucugaacauugcucccccuggcuagcaaggcucugaaaucauuaagcaugaugggauggaagugugagguagccucacuugcgucacugggcaacucggcugugucuguggagcaguggaaagcccggcuucuagagaaugauauuuucuuccuuccuacaucuucuaauucuugaaacuuaacucuuaacccauuuuuaugguccugugaaagugagccaagaacacugcguaaccccaggugauauguuguguuuuauuuaaaugaaggcuaaaguaugaguugucaguaucuaagucccacuucucuaauugcaggcauaucuuuuuuaaaaaacagccuuaguguuauaauuuaucugccacaaaagucaccccuuagaagaguauaaccuagcagguuuuaauaaauuccuagagauuuacaacccucaccaugaucuaguuuuagaauagcucuuucauuucuauuuguagucaguccuuaucuuccucugcguuuagccaugagcugcuuucugacucuguagauguacucuuucugggaguuuucauguaaaagaagcaauacaguauuuccuugugucugucaucuuucacuuuguguagcagaucgccucuguccuaaccuucaucagugaugcgcuccuuuuacugaugcauagucgucuaagcaaaugguucucuuggguucugcugguggugguacguuguccugguuuuuuugauuuugagggaugugauuuuauuguguugccagggcugguaucagacuccuaagcugacauggccccucccccucagccuccugaguaacugugacuauuaggucugagucaacaugccaaauuaggcagcucuuccuugaaaagagaaacuaaggagguucuaaggcagagauucuuccacuuuagagaggugguuuuuacagagagcacucagacauugagcaugggcuuacuguuuggcucuuccugggucugucgaugucugaggauaacugcaggugcuaccggggguguacauagacggucagguagagaugggaugucuuugaggaaggaaaacgucacgguaauggcccugugguggcaaagaacuuggcaugcucagacaacucgaggcauccaaguauccauagcaguucugagagagcagucaagaccagcacugcugcgggugucagcaucguggagaccucauaggcaugguggagaugugacuuauacucuucagccacugagugagaagccaucugcauaaaggacagacacaggcaguaaccugagcugaauugcaauagagaucacucuagccgcugagcacuuugggaacaguggagggagacccaagaagaggcuugacccaggcaggacacaguaagaugaagacagccugauuggacagacuacggaacuaugagcagguuagaugugagaucaggaaaaaagcugagaucaaggaugaggcgaaggcuuugguuugugugcaggaggggcagcaggaucuucuuugaaauggggaagcucuggaaacagcauggagucugucagacuuuagacauacgucagaugaauucaggcaauggccagaacguuaggaaaugcgcaaaugaacagacauuagcaaggcuagacacgugcuacgucagcauuugaagagugcuaagcaucauuagccaucagagacauggcuauuaaaacacaagaugccacaucuaucccauauagaguggcuaaaauggaauacuggcauuacuaguccagaggagguucuagaacaguuugccgagugaugguugcucuguaggacauauugacauucacuguaaaaucacaguaugacucgucugucccaauccuggccaucuuaggagaugaaaacauuuacuuaaaaauauacacaaaugcuuccauagcuacucuauucauaauuuucuuaauucagugguccccuggggauguuuagcuaggcagacaguggcacaccuaacacagcuuagcaguaaagaggagcgagcgcuccauagcuugagguucugggcauggggcugaaagaaacauggucagacuuauuugacauucucaagaagauagcaugcuggugagcuggccagcacccaaggacacacuaacggacagcuuuaggcagauuugagggaguggcggauugaucuaugugaugcaggcauacaaaucuguacgugcauuaaauucaucgcacugaucccccucucugcaguguuacuuuuacuuugugauaacuuagaaacucaacuuuaaagaguguagagaucaggucugccaggauuaaagcugcugguguagaaagucacauccugaaaaugaauuucagauuguucugcggugaagccugggaaggcugagagugaugcugcuauucaggcgauaaguuagagcucauaguguggucuccgcucucuggucugguucacaaccuuccugggucuaaagcugaaaccgagaucugaguucagaccucugcucuggcuugaguguguugccuaagaguucauauuuuggaggcauuucugagaaaugguggaguguuuaagacaaagguuuuggccauguguaucaccacagaagggcuuaguucugcucugggaugccaaguagugccugcaagaagagccaguagcuauaaagcgcaagauuggcuuccaaaguccauggaacuuuucagcaugugugcuaccuuccacugugaggcuuacaaaagcccacacagguggggcucucugaucuuggauuuuaaugugcauuuuguuaugacgacagaggaugaguuagucacacuguaagcccuauugacugacaauccagcuccaagagcugcucuuaaguagagaugacagcaaagugguuaauugccugacaucugacauuuacuacauuggauccaggagugugcuacaucucugagauucaaaagauagauauugcuauccuuuuacaggucuuuucaaaaaaacccuguuagggcauuuauuaauacauuuguguuguaaugaacuggagagauagcucaguuagcuugccuaacacacauggaccucugcguuucauccccagcaucacagaagcaagucaugguggcacacgucucuaagccuggaaugaggugggaggaucaggguuccaggucauccuuggcuacacagagaguucuaguccagccugagcuacaugacacacccccccaccccaaucucaaaaaagaaacugauauuguagcacucauguauauuaauucuuccuauguggaaggugcuuugcuaggucuacuacugucuuaacaagaauuuauugaacacugugcacuguguuuaugcacuaugauugaccuuagagauacagagguacaauugagucaucccaaauggacuuuagacuuugcuuuauguaacagugagugagcacauaccuucauuuaugugaaguugaaggagaaggcagacuuuucuuugacuucagaagucaggguaauggucuccucuaggaggagugcugccauugacagaggggugacggaugggagacucgugggaugcuuagugcucccuaagugacugaaguuguccucugcacagcaucuucccuuagcugggacagucguggucacugucggaaauggacuaagggaaugcagaagugacuggauccuacuuugucccugaucccugaucugucucccaugcccaugguguguuguucuuguugccugggccucugaugcuccucuuacuaagggaaaccugggguccccugguguugcccuucugggccagcaaucuuugcucagagauaaccuugacauuaacuuuucauuugcuuguaccuuguuuuguguuugguauaguuauuguuguauuugcagauguuguaaguuuucuaaguuguuaagcaucagugugugugaaauuuaaaauuagccauuuacucagagugugacugcccuguuauucuauggcucugguguuugauuugucuuuuggaauauucuggacuuucaucuucucauuggguuucuuuuugacguaucacuggccucaucuuuaauucuaagauaagcaugacucaugugugugagagagggguggugaaaacugaagccaggguuucaugcaugugaaguguguguucuuccacugagcugcacccacagcuccaugccucagaccuuucucccacauuuggaaaggcaggcaagccagguguuacugagaaguagagcaguagagcucccugcagggugggcauggagcuggcugucuccagaaugcuugaagcuuuuauauuuccuuauuuucagggagggcaugugcaugccgugucaggaguguggaggucagcaggaguugguucucuuggaccgcauggauggcagacuuugaauugaggucaucaggcuuggcagcagguaucuuugccugcugagccaucacacuagucccccaacucaaagccugcuaaccuuccaaaguguugcagaucucuaaagcuguggcaaaccuacaguugggggaccaguucaagucccgaggccacacauaagcuggcuugcuagggugccaucuguuaccuuagcacuccugugggaagguggggaagacagcauaagccugcaugcugcugcucauguaaccuggccugugcagccgugcaccuacaaaggacccugccccaaacauggugagggccgaugcugagcaugcgggugccuacguucacacacacaagcacacacauuacaugcccacacaagaguuuucaaagguuguaucucgucuauguguuuauuugauaaucaggaauuauaacaaucagcaaaggaagaaaaugaaagguggcucuugaugaaagaaaguaaugacaggggucucacuccguaguccuggcugaacuggcacuaacuauagagcaggcuugcccugagcugucuucccugcuucugcuuccagagugcugagauuaaaggccugugccaccaugccuguuuaacuggugacuuuaggaggggaacagguacacagcaugcuuaggcagacuggaggcugagcuuugucauugccacgggcucuuugcucuccgcuuugaguggcgaugguaggaagcagagcagagcagagcagagcagagcugggcucucuguccccucaucccagcuuccuuagcugugaccugugcauaggcuucagccugagugauuuguguggcuuggaaucaagucauauuugcuccuggugccuggacucuugacauguugacaagugcugguauuugugagcuuggaacucccugaggucauuuguccuuuauucuuucugucuuuugaacaggucuaaaagccauggugaaauauucuugccuuguucuucucuggaaccagauuucagcucucuaguagcaaggcuaccauaugguacugcagaccagugccaaguugcgggcugcguggccccuucucaguguagaaggugaugaugcgaacauuucuugucuucuugcagccaggauguuccggcggguucugacuauugugcaggcgcacuguaagcuugguuugacugcaacccuuguccgggaagaugacaaaauuguugacuuaaauuuccugauugggcccaagcucuaugaagccaacuggauggagcugcagaacaauggguacaucgcuaaaguccagugugcugagguauuugcucccugggugggaugugaaguaagggcaacucccgugggaacagaagggaucuucugauaaacugggcagaccagcaggucaggacccagucuaagcgaccguggcguagugcaguagucacccugguaggugagccacacuucauagcagaccgcacuggaauucucugccucugucaugugguuaaggcagcaagcucauacagaccaugacucccugcugcccgcccucacccugaaggauugcugcuguaaccucucagggcaaccacucaggcuauuccagugccaaagucccagaagaaauuggucuuuaugguguuauuucuuagaacacauuuuucuaauacuguuguuuaguggaugccuguacagguauguguuaaaaucgacagucaaagauaagucugaaagaaagacagaacaguucaucuuagugcuuuaaaaugacugccacucaguagcuagaguggggugaccucuggaaaguggucguugguugagaugagugugucuguuagcagcgcaguguugcugcucauugcuugacagcacuucccuucuuuccucuucugccccguaggguagucacugguauggaacuuguguuauaccugucaaucacccuacccacugggccauccugcuagcccugcagaauuuucuugaucaugcauguagcuguaguucauuccuuuaaauuauucaaagaucccauugaaucuuucauaugauaauccccaguuugauacauagcaauagaaaacuuuaauauugacagauauuauuuuauuuacauuauaauaauuauaauauuuaaucuuauacuuaaaguauuuuuuguaaguguuuuguuacuuguuuagugacaaaaacucuuaccuagcauguguaagagagacucuggguucaucuccugcacacacacaaacaaauuacagacauauuuauuagaguauaauuuguggguggggauugggguucagggaacagggaggaaugagagcuccuagcaccaggaugcugccugggaacauagacgcuguaugcaggggaacaugguagcagaggacuuugcacuuccuggagagucugaugugcugcuagcccuccaagaagaggaguacuggaacaauacuggucuguguguggugauguggccuaaauggagggguugcuggcuucucacucuagcagcucgaugaaaauuauuaccauuuaaaaaucauuguuaaguuaguuccaguucaauauggaguauuaauuuuucauuuuuaaacuacuugguguguaugaguggcugucuguaugugugucuguauaucacaugcaugcagugcucuuggaggccaaaagggaacacuggagucugggacugaaguuagacagugguuagcugccaugugggugcuggagaucaaacucaggaccucugggagagcaggaaguagucuuaccugcugagccaucucuccagccacuauuuuauuuuuaauuaaaauauaauuauaucauucuuucccucuuuuucucugaacccuucuaaucccucuacuccaugcuucucccucuaaaauuaacggccucuuuuuagguuuuuauacaacucuggauaguaaccagagcuuucaaaaauucucucccacucagcaguccuccuucucacuccacugaugacuucucagccugccagaagcucuuuaguuuuaugaagacccacuuguccauuguuggaccuaaguuuuaggcaaauggaguccuauugggaaaguccuuucuugccgacuguccuguggugcgcugccuguguuucagguuucacgcuuaggccuuugguccuuuuggaguuaaguuccgugcagggugguggaugcaggucuaauuucauucuucugcauguggacaucgauuucccuagugcuguuuauugaagauguuauuuuuccuucaucauguuuuuggcaucuucaucuaauaugagauggcuguaguugugccuucucuucuuugguuuuguuacauuggucugcaugucugcuucggugccaguaccaugcuaucuuuauuacuauugcugugaugugucuugaagucugggauggugaguucuucggcacugcucuuuuugcucaggauuauugggguaaucuggggucucuucugguucuauaugaaagaaacauagguuaccuuuuuugaagaaauguuguggggauuuuaauugggauuacauugacucuguucauugcuuuugguagaaauggccauuuuuacagcauuaauucucucagcucaugagcacaggauggucuucccguuuucacugucuuccuugaccucauccuucagugaucuaaagcgcucuuuguguaggucuuucaccucccuggugagguuucucccuagguacuguuugucuuugaaucuguggugaaugggagugugucuguccacugucucucucuguauguugguggugugcagagcagcuguugauuuuugcaaguugauucuguauccugccacuuugcugaaguuguugguuauucauagauguuuucugguagaauuaugggaucccuuauauguaauaaggguaguuugucuucuuuuccuagcaggacauuuguguuucuuuaauuuccuucucucgccuucuuccugugugugccugugaagggugaggacagccucugggaauuguuucucucuugcuaccuguggaguccaaggaucaaacucggggcaguagaccuuuugcagacggaagcaccucugcuuguugagccauuacacugacacuugauuuuuuuuccuaagcuaauucugcuaaaugaaagagcaucaaaaguccuuaaugcugugauguuuuguuuuguaacgugaucccuauucccuauucuuguugcaucucagguuuggugcccgaugucucccgaguucuaccgagaguauguggcaaucaaaacaaagaaacggauccuguuguacaccaugaaucccaacaaauucagagccugccaguuucugaucaaguuucaugaaaggaggaaugacaagauuauugucuuugcugacaacguauuugccuugaaggaauaugccauucggcugaacaagugaguggugccuucucaucuucuggucaaguaugccacggccugucugugcacucuccaacacucccugggaucuaacgcgcucuguucccugcccucgucccaggaacuugugaggcagagaagcaaagaggcagggucagaggcuagaagauguacaccagaggagccuggccacccugcacugacugcaaaggccacucagucaacauuucaggcuaagugagaguggguggagcugaggccagacuuauggcccagggaaaguggguggaggcggagaggcuagugucgggguacuugcuuuucucauuacagugaccaaacaccugacagaaucggcauaagggacaacaggcuugguugggccaagggacguagucuguugugacagugaacagcucccugaaccuguuucccuaccugguucccuggaacgggccacuggcuuuuguuuacuuuuuacucuuuagcugguagcuuugugacaguuuuuggauugucacuguagaaagccuguuaacucccugcugugggagcugagguuuugcuuucucacuugcacuggccacuccuccucacagggugacaguccaagcuguggguuagcuacuagccaguauucagaaccacuagucacagugccacugugguccaggcagccuuacaguagucugugauuacaguuuccuuuauggauagauuuugguuuuccuggagacuucccuugcuuugguuuccuguauguuaaugugagcaucgauuccucucacugacaucauggaaacuccgguuucuuuucuuuccuuuuccuguuagccucacgcacaucauucucugcucuccucugccugacucggguuagccaugucccugcuccaucggggagcucucuguggacgccgucuauaauaaaucuccccggccgcucucuugaguuggaguguugcgguaaaucuccucccaaauaugcccuggcagugaaaacacaacacaguuaauaugauuacaugcugugcgccuagacugagcagaucuaccgcuacacuaccaucuuccacaucaaugggaccccuuagaacuugcgguuucuucaggccaugugcuucugcucagcggagggacuucguccucaagcuagcugauaauaaaaccucuugcaguuugcaucaggugugguuuucucucaggucacuggggugcuggccagcucaucccgggauuugagcggaggcccagcuucuggggucuuacaauacuaccaugcaggagagugaugggcuaugcggcagagaaaacgggggaaucugacagaucacauucccagcugugugaccuuaggaaaggaauuugcuacucugaaccucuuuugucuccuggucacguugaccugcaccacuuacugcagacagugcuugugccuggcgucuuauguguucuccaaaggaccagugcucgucaugaaggguuggcacucuuucauuccauuuccuguguaggagaagcccuagaauguggggccugcaacuguaugagcagcuuuccagaugacaaagcaauugccaaaggaacuccuaaagccugugucuucccagccguuuucccagcaugcuguauagaaaaugauaggggucuacaggguccuggcuucucauggugccagggagagacugcugacaucugggccggccaaaggccaccugucugaaugugcagcugucgcagccuccccacagaugagacacuugaucacaggcaugcaaaggggcaugcuacaauggcaaugcugcgcagaacagaagcagcagugggcuguggcccgggcuuuggaugcuacucugggcuccuggucuucaguuucaggguauaaacugggaaccugcagucuaccuuuuacauuuuuaaugaaauauccagcuucaugguguguccggaguaccugugcuuuuccuaguuauugguguugucagacagaaaacaaggaaauggcucccaucugcauggggaaguggucagcaagguuaucagauagccuuugcccucugguggaaagcugaaaacaaaagaggguguugaacuagacguugagggagaguagagugcugggcagcagcgaggcuggugagaggaugccugcaagugucguucucaguggcagucagcuggggcugggaugcagcaggguuucucggaugcucucacugucuuugugaaaucaaggauucugcuugcuguagauucugccuagagccacaggcauugaggcaggaaaaaacaaggcugagaaacaguaagugccaggccuugcaaugcucguggguaguuuugguaccaagaagucaggcaagagaaucugagugggaggcuagccuggcuacauuguaauuccuaggccagccugugcuaccuaugaagcccugucguaaaacaaacacaaccaaaccaaccagaaaaaucccagaagaaaagaaacaaaagaaggaauuguuaaggcagaugagccugugccgagacugugccgagccugugccgagacugugccgagggugaugagaggaagaguguguagcauucaguguggaggcuucugauaguccugacagggcagggcucucucgggggcuuuacagcuggacauuaagggcagaaggccagacuucaguagcccugacaggugaggaaugugaaaaggagagacagacuuauuuaaucggugugcuuuggcaagagaaacaggguccacuagggccaggagguaugcauaauugagcuguucuggccaaggucuucuccaucauccuuauaauaguuuggguguauucuacaagguggucugauagguuguugauagcuggcaugucuggcuccuacaagcugaccagcucuagggcguaucuagucuucauuuguagacuuuguauuguguccucaugugguguguggguuguuugucuugccugaaggcuuugcccuugaauacgaggugacuggauauagggcagaaacacuuggugccuuuuggugguggugguuugguuugguuuucuuucuugagguuuuuuguuuguuuguuuguuugucugucuguauuuauaggaaauagauucuucucucaaacaguauaucuugauuaccauuucaccucccucugcugcucccagucccucccuaucucccuuccccuccagauccacucccuuuuugucugucauuggaaaagaacagacuucugagagauaauaaucaaacaugacuaugcaguauaauaagauaaaacagaacccaucacaucaaggcuggacaagugugucuuccuccuuagguaaggaugagacaagucagguaggcagacauccuaagugacggucaugcugucuuaguuacuuuucuauugcugugauaagaugcugugaauuauagaacuagaauuuaauuggggcuaaugguuucagagaguuagcauucaugauggcggagccaaaggcauggcagcaggaacagcugagaguucgcucacaucuugauccucaaguaggagggagggagggagaacgagugagcgagagugagcacugggaguaguaggagucuucugaagccucaaagugcccuuagugacacaccuccucugacaaggacauuucccaauucuucuccaacaauuucaccaacugucaaucaaguauucaagcguauguaccuguggccauuuucauucaaaccagacucacgcaggagucuauccuuaagaaaggacacagacacaaacucaggcaaagaugccaagcuugcacccugcuuuaguggccuuguaggcccaggugagaagucagcgcuuuguagcagaagcaguuucuaauugcgcaugugugguucuuugugugucugaaaccuccugcucuucuuuagaccuuauaucuacgggcccacgucccagggagaacguaugcagauucuccagaacuucaagcacaaccccaaaaucaacaccaucuucaucuccaagguaugcgcugcaggcuggaggagccgugccucgcuccuccuggggccugggaggugcaccugagcucggggaugguggcucguuaugugaaggccgccugugugugccugggguaggucgugugagagauaacuuaggguucuugugccuugcagauuagcucuaagggcuuucugcuucucaggauugucccaccguucccuggaauauagggauuuaaauuuuauuuccuuuacagaagacacuacauguguuuucugcucuggcaaaagcggguauuagaugaggcuuccuuuuuggagcuggagaugccaagcauuugggaagcuucuguccugagcccugaugugccuagauggugggcgaccagugccacaauggccgugggcgaccagugccacaauggccguggguaggcccagcuugagcaugacgucacugucaccaguaaagucucguuuucaaaugugggugccgaugcauuucagguguaugagcucagaauugagacuucagcuugguugguuuuuccuuagacaaguaugaagaauucucccuaucucuuuugauuuccuuugguugaaaguauauuuuauuggauauuagaauggcuacuccggccuaauguuucuugggacuguuuguuuggaaaaccuuuuuccagcccuuuacucugagguagugucugucuuuguugcugaaguauguuuuuuguaugcagcagaaugauggauccuguuuauguauccaguuuguuagccuauguccuuuuauuggggaauugaguccauugauguugagagauauuaaugaccaaugauuguuaauuccuguuauuuuguuguugauggugguguauguuauucuauucuuuugaguuuguugugagaugauuaauuauguuuuauuguguguaguuacccuccuuggguugggguuuuccuucuaguagccucuguagggauggauuaguagauauuauuuaaauuugguuuugucauggaauaucuugguuucuccaucuauggugauugagaguuuugcuggguauaguagucugggcuggcaacuguggucucuuagggucugucugcaagacaucugucugggaucuucuggcuuuuagagucucuguugagaagucagauguaauucugauaggucugccuuuauauguuacuuggccuuucccccuuacagcuuuuaauguucuuucuuuguucugugcauuuaauguuuuaaguaucauguggugguaggauuuucuuuucuggcccaaucuauuugguguucuauaggcuucuuguacauuuguagacaccucuuucuuuaaguuaggaaaguuuucuucuaugguuuuguugaagauguuuucuggcccuuugagcuaggaaucuucacccucuuauauucuucuuauuuggccuuuucauuguguccucaauuuccuggauauuuuggguuaagaaugcuuuacacuuggcauucucuuugacugauguaucauuuucuccaauagaauuuucuacaucuaagauucucucaucucucuuguauucuguuggugaugcuugugucuguggcuccugaucucuucuuaguuuuuuucaucuccagguuugccuccauuuguauuuucuuuauugcuucuauuuccauuuuuaguucuugcaccguuuuauucaauuccuucaccuguuugauuguauuuuccuguguuucuuuaugggaauuauuuacauccucuuuaaaggccucuaucaucuucaugagaugggauuuaaggucacaaucuugcucuucagguguguuaggacaucuagggcuugcuggaguaggagagcuggguucugaagugccacgcuggauuggccucuguugauuauguuugugcccuugucuuuuguuugccaucugauugucucugguguuggcuguccugugugucccggguuagagcaggucccuugagagguaggucaagcugugcggugggaguggggggacaaauugccgaucugagagugcaggugaaggugagauggagcucugacaucugcugggcucuguggggucccaguaggcgguguauuggguggggaucucaccuguaucucuggcuagagcaaaccuccugggagacaggcagggcuaugagguggggcuugacuacgugagugcagaccagaagggagagggagccccaaaagucucuuuugucaugauuaaaucauuagauaagagcagaaaaguuuguaugugcaacugagguguguuaagcagcauuuauuuguguugcaagggcuguggaagcauagugccaaguguauguguuguguguuuagaaccaaggcuauagugagauuauacauuugauuaaacauucagauaagauuguuuaauuacacucaucuauuugagggaggggcgacacaagugugccguauuguauguguggagaugagaggacaauuugugggaauuacuucauggguucccagggauucaauuuaggacuuucggcuuggaagccggcccccucaucugccgagucaccucagaugcuguaccccauagucuaagaagcugguguuuauugucagcugagguagaacuggagucuagaagacaugaauauuacuaugccugggaguuguggcugggaaagugaacauggugagaaaggccuucacuucaccuuugugcuggccuccucuacaggcugagaugaaagcugggggcuggccagcagggaggggcuuuguggcagggcccugcuuugcaugcaauguccuaccugugcuguggcaugucuuagugggcaucaaguaagacagguuuuuauauagacccauugcuguagcaaaaaggaaaaaguugaggcuggguucugcagaggccauucuaagguccacaguguccccucugccugcaguggcagguccuugcuaagaggaggaagaggggguguuuccuuaaaugauccccagagcuacuguagacucucaggcacggauggggagggaacuuagcgagggaacacaugugagagcaugccugaagcccuaauccuauccuagaacuacagaaauuuaaaauguauauucuggacuaaaacucugaaacuuguagcugcuuuuuuucuguagguuggugacacauccuuugaucugccagaagccaauguccucauucagaucucuucccaugguggcucccgacggcaggaagcccagagacugggacggguacucagagccaagaaagguaaggcugccuuuccucugcugcccaccacagccucucaucucuuacagcacuggggucggcugccacugugugcagucacaguuugcucugccucagcgucagggaggccuugcugagaaggucuuuauuccuucucacaccacagggauccaugucuucaugguagcuuugcaugacaguuuuuaccauuaacucagccgcacuggaucugaaggugcgugcacacugcauauacucccacaaacaagcagccaugcucauuaaauaagaaucaagucuggagaugagcacugcucugaagagacuccuggccucuacacugccaauccucugcacgacagcugucucugauccccacucucauagaacuacuucuccaggcuuuaagggaggccgcaucuucccucuagguguuucugucagcacagauuggagccuuucugugugagugcucucccuuccuccugcagacccaguccaggccuugcagcucucucauuauaauaccccucauugcugaaaggagcuuaugcggcuccuucccucugcagaccaaucacugcagcuuugaucguccuucuaacggggccuucaggaucaaacucgggucaccaggcuuagcagcaugugccaguggccacucaaccauuuugcuuguccucuuuguuucuuuuuaaguguguuuguuuuuaugucugggauguuggggaucaagccagguccuccuugcgagugcuagggcaagucugugcaguccagcaggauccucagcucagcucuuuuucuagacucucagauaggacagugaaucugaugggccccccaugcaggcagggugacugcacgcugggugaagagcuuguccucugcagugcuugcuucucaccaggguccugguuggucaggggccgguguggauuuucuugucuuuucuccuguuuuccuauagggauggucgcagaggaauacaaugccuuuuucuacucccugguaucucaggacacacaggaaauggcuuauucuaccaagcgacagagauuccuaguggaucaagguuacagcuuuaagguauguauucauuuaccuuugguuaagcuaugacagagguggaggcaccagccugggucagcauucaggcaggcuucaugaccauuuggcucuguaaauugcugggauaacacugugcuagccugggaguucugaggugcuaaaagggaaacuacaguuaggauguauuguggaagaaggugugugugcacaugugugugugugugugugugugugugugugugugugugugugugugugugcaggagugcccagcagcuugccuuuuaguugauuccagaucacauguccuuaaugccaugcuuaccuucuaaugagucacuccaccugacaugacaggcuaucccguguacgaccacaaacacauuaugucuuuuaacauggguggcagucccuuaggauugcugaguguuucugggucucauaacuuaaauaugcuguuacagauuugcagcacuuauccgcugcuguuauaucaguugauguuacauugcaugauaaagaaacgggaaagaagacaccacuguccgccuaguauguguguccgugugcucuuaacaccauaggacagaaacagccacuguugagauacauuuuccauugaucucuguaaacaguggugagauuuucauuauucaccuugguuagagcagcccugccacgcuuuuuagcuucaaaguuaguuccuuagucagaguuagugcaagcaggccuaucuucagguuccugccuugacuucccucgguaguggacuguagcuuagacaugaaagucagauaaacccauccuccccgauaguccuccuugacaguugccuuuggucaggguacuuuaucauagcaacagaaaggaaacuagaacaucuugcugcugauagaaaaucuggucaauuauuuuuaauuuuuuacuuuaugugugugaguguuuugcuugcauguuugucuguguaguauacaugugccuagugcccacagaggccggaagaggaugcuagauucccugggacuggaguuagaggugguugugagccacugugugagugcugggaacugaauccagguccucuggaagagcagccagugcucuugccugcugaaccaucucuaacccgugcucaauaaguucuugaucucuugugugaagaaaguauuccuugcuggaagcccaggaugccagggaguguguuggaacucuuguguaugcuuuuguguaauuuccuuccccccauggugcaauuguaaagauaggaggaguuguuuuacaacucacagagcccucaucugaugugcucauucagagguccuuagucucugucuauaaccgguagccaggcucuggguggaccaggaggugggaagagauuacuggagcaggugcagaggggauuuggaggcgagaacaaugggcuugcuuuacuguuguuguagguaaucacaaagcuagcuggcauggaggaagaggagcuggcguucuccaccaaagaggagcagcagcagcuccugcagaaggugcuggcagccaccgacuuggaugcagaggaggaagugguggcuggagaguuuggcucuagaucuggccaggugcgugaaaagagauccuccuguaggacacccacuguaugugggcacauguacgcagacacgccuaugagcaugugagcaagugggauucgaggaaaacugaaguuuuuugaagaaacaacccaauuaucuuuuaguguggguuucuuauaaauguauuguaaggcagagaggcucaugugacagugacgggguccugcuugcccauaaugacagccugccaauguuggggcccaggaugagaaccauacaggcucuggagcuaguagguacuuuaucuauuggucugggguuagcuggcucaccugcuuuccuccucagugagagagcucagccuucaaggugaguuuguugaugaacucaaaguaguuguaaguauguugaaaacccuagagguuucuaaaaagacccagccuuucacauguauuuggugaaggccugcugugccccagacaugaccauguaguguaaucagugagugcauacggagauuaugauugucaggcccuucaaggagagacgugaaauugaaucagguguuccaagaauuccaauuucugaaacucagugguauuaaagcugaaaggugaucauuagcuagagcaagacaggaaggaagcagcaguugccacuugggcagugccaguacccugcagcuaagaccuuucucuugucaggccaucugcauguuaguccaggggugccaaagugaccuuugagaucaagcugugaccuggcaugagucaggugccuguuucucccacaucugucugguucaggugcaagcugcucugggccagucuccuugcuuauguggaugcuguucaaacucaccuugggcuuuauuuuguuuggcuugagauggguauuaucauguaacucacccacuugccucucugcgccucugccucugccuccgccucucaugggcugggauuaaagguguucaccuugcucccccagcuccacauccaucuuuggagcaucuuggccacgcccaguuuacauacacucagcacgugcucauggcuuuggugcugagucaagccaggguuuccuggaucucccauuggcucaaagccuuguaucaagucuuaggagauuuuaagagacuccccacccuaucuuuuuuaauuaucuguuuauuuuauauguauggguguuugccugcacgugugccacuguguacacgcaggccagaagagugcuugggguccuuggaacuggaguugcaggugguccugagccacuagaauugaaaccacaguucucuggaagggcagccagugcucuucacugcugagccaccucuccagcuccaguccacccuaauaacuuuuuauaaaaaaaaaaaaaaggaaagauguauuuauuuuauguauaugaguacaguguugcaaucuucagacacaccagaaaaggacauuggaucccauuacagauguuugugagccaccauaugaugguugggaauugaacucaggaccucuggaagaacagucaguacucuuacccucugagccauuucuccugccccccugauaacuuguaagaauuugugcaggggcugaggguaucauuuggugacagaaugucugccuugcauguguaguaccaggcccuggauucuuacuucagaaucacagaagaaagaguaaguucucuugagcaguugucaucaaggcagaccuuguacuggccuguuaaucagagugccugggugauguucuagucucuuuuuucuuaugaacuggaguaggugagucaaguucuugugccucagucuccuguuuuguagguuaagauuauaguuguugugagggucgggggagguaggauauaggcaaugucuaagacacagaaaguggucagaaggauaucuuaaaguuuacguuguguauccaucugugugauaagugugugcgugucagggggcagguuuguggaagucagaggacaacuuggaggggugcuuguccaccaaggccuuuuguggguucuggggcucaaacucaggaugcuaugcuugcguuguaaauacaacucagcaguccaaaaauaguaauuaauuuauuuuuauuuucauguguuuuguccauuuauguaugugugggaguguuggauccccaggaacuggacagacaguugugagcugccaugcaggugcuaggaauugaaccugaguccucuggaagagcagccacugcuccuaacagccaggccaucucucuagccugagagcguuuaaacacgguguaucucccguauaucuccgggcugggguuaucuugguggccgaaugcuggccuagcaugagcaagacacuggguucaaucccuagcagcacacacacacacucaccccacacaacuguauuugauuccgaguguugugagauuguuuggagaugagcuuagccuggcuccccccucuccccacaggcaucccgacgcuguggcaccaugagcucccugucaggcgcagacgacaccguguacauggaguaccacuccucccgaagcaaggccuccagcaagcacgugcacccgcuuuucaaacgcuucaggaagugacgcccacccugugcucaggugaagacuggcugccuggauccguguugaagagagacuucuuucuucaccggugugaucguuucuauccaagacuguguccuuuccuauugacugacugcugaaaaccagucagugugaggccuuaacugccuucguggguccuagguuuaaaaaggaaagaaaagcuacuguuguuuuuuauucaaacuuguuaagagugaaucauuucuguauauaaaaauuauaccacuuaauuauaccacauuugucucuauuuuauugaaugaauuaaacaauggaauuuggggagcucuagagcuu

SEQ ID NO: 8857 - RNA, 30793 nt, Mus musculus
gggagcucguuuuguguuacaccgaaggcgguccguuccuguaccaucggcuccggaucccggaagcacgccucgcucuccugcuccggcacgggcucuuccuggggcguguugcggcucuccuggcacgcacucgccaccgggccgcgagcugaguggaaucccgucuauggcggagauggagagcgcuguggaaggccgcacggccagcgugcuguucgcgggguuccgggccuuggggcuguucagcaacgagguuccacacguggugcgguacagcgcgcucaagcgccgcuucuacgugacgacuugcgugggcaagagcuuccacacauaugacgugagugauuuccuccacccgcuucccgggaaccagagcugccccgguauagucccacuuucgccucccaccuaccuaggguuucccuuuuugcgcccugucuuacguaauccuucccugucgcucucugcucacggcauccuugugcccuugcacuuaguucaccuggaggcgaguuucggaggaaucuucuggcccaggagcaaacuacuggagaacguucaguuugggggcaguauaucuguuuacauaccccuaagcaugugaacaaauaaagcaagacccuauccucccucggucauaauuuuuuuuucccacaagacgacgacuucuuagacauuacuauuguauaauuggcaaaaaaaaaaaggcuggaaauuaagacugaaacaguaaaagaagugaagauggugagauaaagguugagggacccccuucauauuugcucgcuauccaauuugccuacguguuugaguauuauagcgcgguucuuaaacuguagacacucaaagguugauugcauuaucugauagcaaccuugaguaaacuuagaagaauuacguuucgugccaaggccuuucgucuuagagaugguguguaacuuguaauagccuauucauuauugcagucauuaagaaggaccgcuggaggcugggaggcaggugaauuggauugagggcagguguggcugaagagcuguuggguuucugaaagccuggugugguaacuuugagaagaguggguuagaaugugcuucuucgcccuguagaagcaggucuugaugcguccucccugcuugcaaacuuugggcuauguugaaguuucuagcugaaguguaacuucuuuuucucaguuaaaaguuauugaaauugucuccagucaggugcuuucuagcuacucuguuacacagaaacacuuucccacccaucugcuuccagauucacccugugauuagaaaaguggcacagccuuuugcuugucuguguauugaaguuuaaagaaaaaucaguuaagaucucuuuuuguccuaacuuguggugcgcuuuuauauuuacucuuacacaacaacauugcauguuugaagacccugugcuggucaaaccaaucagugcauuguucgaaacuggaaauagcuuaagagugaaaacaugaaccuuuuguguacaagucacugauaugcucagggcauuugcaagcuugcuuggucuaccauuucuccuccugcuuuuacugugccuucagacuuccuacagauuagcuuauuauacaagaacuuaagacagaguuuuggauaggacauacuuuggauagcuaauauuuauuggacauuuacuguauaauuggcuccauucuguuuuacacaugucuauucagaaucuauuugaaugacccuauaaugugcauaugcauuuuaguccccaaccccacuccuccaaggauugaauucaaggguguacaguaguuaaguaaaauuccagaugucacacagcuggauuacuacccauauacuaagaugcuugaguuauagugugcaaacuagucaugcccacuguuuuucuaugauccaggaaucacaagugguuuucauguuuuuauaaaaguuggaggaagaucaaaauguuuuaugauauaaaaacuauguaaagauuaaacuuuaauguccauacaauauuggauucuacccagggccauuuaugacuucugacuaauucacaagcaugcugaauaguaaaaagaguuagggucagucucagaaaggauaguguagcaaaguuauauaggagguaaugacuuaauuugggggucuuagguauuauaguuguuuuuguuaaugaaaauguguuuaauucuucuuuuucuuuuguaaaaacagguucagaaacuuagucugguugcaguaaguaaguguacuuucuugugaauuuguccauguuugcuugauugauaguuuuuauuuugucuuaaauaauaaugauaagggcaggacagggucaugucacucagguguaguccaucagaacuuauuuuuaugaucuacaugacuuuuuaaauggcugauucuuuucuuucugugcugggaauuaaaccccuugggccuugcacacacuaaguaauauuauacaacuaaaauucaucuucauugcuuaugacaaauuuaguuguuuauuuauuuuuucuuguuuaauaauuuucacucagaguauuguggacucaggcacuuugucagaaauaacaaugaaugacauguucuguauuguagcacuuaaaauuaccuuucccuuuguugcuacuacuuauucugugguacugugcacuuagagacugauugucccuuuauccuuuagaaugucucuuuuagcacuuaaugugauacuugccuaaaugaauuauuaacaugguaauuuacaugugcacaggagugugcccgcacaaauaaagaaaauuagagaacuguagucacuguaugaucaggauaaggggaacaaauuauccccugauccagggagacaucaggguguaugagcuguggggcaacugaccacuccuugggccaaaggaccaaggcaaagaauuguguuguuggauggaagaccuggaggagaaaggaauuuaguuguagaaggacagcuacuguguuucucaauuuaguuuguugcuugcagugagaaauauauuuacuuuucugaaagauguuuaauagacuaaagggcuuggaagcucagagagacuggcuuuauguucaaauacaguccuugugagaugcaagacuuaaggaguucauugcauaugucugaaaagcccuguguguuuuguuuuaaguaaauaagcagaagagaguaaacuaaguugaguaaaaaagugaauugauaguucuacagaaaauacuguuguggaguguaaauuccaaauggaacacucaagacgaaaaguacuuaagacuauccucuauguaguaaacucuuuagccuuaagagaggaacgagaaagaaagggcaguaugauccuguucaugaaagaggacuuaggaaauuguaucagugagcguggcuagagguaauaggcauauuuacuucgggaaagacuugaguagaaacagucuuguuaaguaauuauuguagggugagcauauagaauacuguauggaguuucucagagucugaguuacaauuuacuuuuaaauuuuucuuguaguaauaaacuuuauauuguuuaagauguucacagugauaucuacuagauguccaaaugccaauuuauauauuaagugcugauuuuuuucccaauuucuuaaaaagcuucucuuucuuuuaaauucuauuauuucuguacaagauacauauuuaugauauugacgucaaaaguuuuauacugauucucauuuuuauuuaaauauauauuuuugaauuauaguuaugaaaguauuuuauguauauuuaagauuuccaaucauaacgacaaaccuuucuuuucuauuuuucccuagguaacucuguuccacaggauaucuguugcauggcagccgaugggaggcuagucuucgcugcauaugggaacguuuucucugcauuugcccggaauaaagagguucguauuaugaacuacuuaacuuucuuuauuuuuccuauuauggcaguuucuagaggaagagaagauggguuucauguaagagagacaguguguucacagaugaugaagaaaacucaauaaaauaacuguaguccuuguauguuuaggguuuaggggaacaaauuagagucaggggccaucaggggcuguuagcuguggggaaacugacugccucuugagccaaaggaccaagguagaaacuagaguuauugcauccuaguggugacuaaagcccuggaggagaaaggaauuuagcuguggaaggacagcuacuauaaagaauuucuuugucaaagcagaaagauaaaaggcaaaaauagucuguccuuauuuugcccauaucuacuagaaaccccuaauggaggugucuggaggccaaccuucugagcagacuguguuuagggugcacagcauugcucugguagcauuggggagaguggaggaggccuguguuucuaacugcagcagagagcucuagcucucauuucugaugucuuccuacugcauacuucacuuccauaucauugaguggccugagggagcagcuaaacaggccugguuccuuauuaugucaucauuuuagucucaggcaagagcuggaguauauuucuaacaugaguaguguaauuguuagcaugcuuucuggauaauuggauagcauuucaugauggucuaaguaacauggaucucuuuuacacuuugacauuguagauaguacauacuuuuaagggccauaaggcagaaauacaucuuuugcaacccuuuggggaucacguuaucucaguggauacugacagcguucuuauuauuuggcacauuuauucagaagguaagacuuucuuucuuuaccuugagauauuauauguacuuauaaauguagcuaaaaauauuaugagaaccguaaguucucuacgagaguuuucacauguacacauuaacacacugagacugucuagcaugucuggagaaagguucugaguaagccuuuuucuuagauugugaacuacuuucagugcguuaaaugugcuugucucgucuaauacauucuccauuguccucucccagccggcgauguguuaggaugugguuuucucugugaaguguuuuggauacacauucacacuugagucaaucuuagguaauaucuuuaucuuuaaguaaaguaaauugugguacuuggagauccuguaaucugaaagaaaauacucauccuuuuuuaaaggaugugacucagugccauuuaccuaauauuccuuugcaguagcacuguguacucuuuguaguagaguguguaauuuucaaugguuaggagucuaccuaccaccaggauagcucuagcuuuccuuaauaagguaugguggcuccauccugaauuguuauggaguugcccauuuguguuuuaaguuacuguucccucugugauccauggcacaguaaguguguuugcuuuuaguaacugucuuucucuagagaguccccuuagaggugcacuaaguccucauugaauuaguaauccuugguuuucucuugguucauggaagagaaaguauuuccuaugaagacagguuacaacagcacaaugaaauagguucuucauggagcuauuuuuagugacucaguaaaccugcugguacagaaaggcagggaucucuuaaaguaguacuccaaaguuuggacaccaaccccuguauuucuccuuuuccauugugucuucuuugauacuaaauuuuugugacguuaauugaaacauuguuuuaaucauaaacuaaaauaaaaagacaaaauaaagaggaauuuugaguguaguaagcauacgguuucuaagaggcuuuugguuguacagcagaugacuguggcugugccgcucucccacugcgcaggcucagcuugccgccugcuguauggggagccucugaggaagugugugcucauuacuguugggcuugaugaagugugccucuuugcauuuuguuucaguggcugguagagcugcucagaaagcagauacuuugauucauuuggaacauccuauccuacuucuuuauggaguuacagaaauccccauguccaacccccaagguuauuuuuaauccuuucuguaaacugacuuggcaguauaauuuugaguaguauuuacacuagaacuuguugaucauuuuugauacgcuaaaugacauuuacaaguugcccuaucacauuuuuuagaaauauuuauugaauaacuuuuucuuagauaaauagaaaaauaaauauuuauuggauaaagggcuggugagauggcucaucagauaaaggcauuugcugccagacccaguguuuugcauuaguccugcaugguggauuaagagaaucaauuccugugggcugucuucugacuuccacaugcacacuguguauacgugugccaucacauacacaaaauaaauaauucuuaaaaguguuauagguuaauauguaagucuuuuauuuauauuacgucucugguguauuauauuuacuugcauguaguagauauaaguauaugaaaauguguaacacaauuucauaaauaauguuaauaacuuuuacuuuuguagaagaauaccuucagcugacuuuugacaagucaguuuuuaaaaucucuacaauuuugcauccaagcaccuauuugaauaaaguccuacugggcagugagcagggaagccuacaguuauggaauauaaaguccaaguaagcacuuacacuaaaugcuuuuacucucauguugucuuuuaccuacuacucccucaaagguugggaagccucuguucacugcauuaaccuucuauuaccuuugcaguaugccccugacagcauaugugagagcuggcugacguauuguccugggacaugauggguggcauuggaaauggccauugaacaguauuuacuaauggcucaauaguuauagugaagguuuccauaguguaauuggacagugucuaguagaaaugcuuuuuauacaaauuacuuuacuuacuaccaaugugaugacuacccacuauuaguagagauggaagacugccuaaaugauuuuaaauauauauuuaucuguuauuugaaaacuuauccaaagaggagggaaggcagcucaaccuuuauguaguauuucaaaaagcaaacaagggacuggcgagauggcucaguaguuaagagcauuuucugcucuuacagaggaccuggguaugguucccagaacccacaucagguggcucacaacugccuguaacuacaguuccagggaaugugucucccucuucucagguaccaagugugaaugugguguacauacauacguggggcacucaccaugugcacauaaaauacuggaguccuccccaguuguccuucugaagccuucauacauuugcaaagggaagguuugauguucauccuaguucauaguucucagucaguauucaguucgguucaauaccauugacugccgacccugugcuagguucagaguuauugaccaagaucuguuucuguccguaaaguuauuuccuuagacuuuucuuuugcauuauuugcuguacuuuaaguauuauugcauaauuauugaauaaucuaaacucugcagauuucuacuuugaaauaugugcuuuaauacuucagugaucauuauguuuucagguaucuuuguuucaugaccuuauuuuauuauugguuagaauuugaaaccuagggcagcauuagaauugcccuauauaaucaugcaauauacaaauccuacucccaucagugguaauguuucuagaaauaaugaaauuauaaugaaaaugaaauucuuaccuuauuuuuguuacuguacugugaaguggcucuugcucaucauguuauuuuaagaguaauaagcuacagguuauggggcuaacauccaucuggacuccauuacuuacuggauaugcugcugccuuagcuucaucagugcacuucucuuuuguuuucuggaaaauggugaauguugauagcauuuauuuuaugugauuucauuuuaaauacuaaguaaauuagcauauguucugagaacagugagugacacaagaauucaauaaauagcaccugggugcuggagagauggcaccgggguuaagagcauuggcuacuuuuuccagaagcaaccacaugacagcucacagucuuuaacuccagcuacagggugcucuucuggacucuaaaggcacugcacacaugggguacacauagagauauauauaacgugcaggcaaaacaccuacauacuuaagaguaaaguauccuuuaaaaaaaggauaguaucccuugaucaaaaaguaaaaaugauaaaacagcaccuguuacuuuuauuaaauacguaguugauuuuguuuuucuuaaaaauguuuucucucuuucuccuuuauaguaagcuucuauauacauuuccaggguggaaaguuggagugacagcucuucaacagguuaguacuuuuuaacuaaggaagaaagaaggcuagaaggagacacucuuacuuuccuagaauaucaauguuuuuagacuuaaauaagcauuaacacuuagcuuuguuuccuuuaaacuauuacccagaaugaaauaguguucuagaaacuuaacugaaaauaagaaaugccuuugcuagaaagguuuguguaaucuuacgugcuuggaauuuccuagugauuuuauuugugagcaugucauugagugccuuauguagaacagaaauaacuaugguagaagugagacugugggccauacagaggaauuuaucaggauauugaacuuuccuauugaaauaauugggaccaaauucugaugucuauuagaugguagauguccauaaacagcugcuuuuguuuccguguuuagucagccaagugugugcauggugugcaucugcagacuaucugcugguauagcuuucguuuuuuaaaauaugcacugcuugccccaguucaguuuauuugcguuccaccauuuaauuuguucuguucugaugauauccccugaagacuccaggaaguaucaggagggcaaggauccuguuuguuuuguuauccuuaguuucuagagucuagcguguaguaggcacuuaauagacuauuaaagaaauguauggccugacucauugcauaauuauacugaauauucaucugugcuaagaccaaaacuuguaagugaagccuucucuguuagaccauuauaaucauuggcuguuaauguuggaacagacuaauuaugaaacauuagcauguuuucuagguuuuuccuauuuucuuuugauaaagcuggcuacucagguuuccauguuuguggcaaggcuuuccauguuuuuaagauuugaccuuucuccccagcucuuguagucagaaacgguagugaauucacguacaguccucuuuacuguguaauuguuuucuaaaccaagucagcauuguuuaaggggugggaagagacugauuagcagaaugaaagcuggggaguaauuuggagaacacacuguuaaauacuugaauguuaauaacugguagugccagaaucacuggguuuuuccuucucccuuuuagaagguaugucauuucuuuugaugcaucauuaauaaguuauuuaggaaaauaaggggcugagucauuugauuuucaggcaccagcuguggauguuguugccauuggucuugugucuggucaaguugucauucacaacauuaaguaugaugaaacauuaaugaaguuccaucaggacuggggacccauuacuuccauuucauuucgcacagguaacauuuaacuuacuuaauaauuagaauuaagaauacuuaauuggucauuagaaagauaagggaauuuuuaaaaacauauuuguacuuuaauaaaaauuaaaauacugaagaaaaggacacagaaauguaggcagugucuugagauguuuuuguuaauguuuuuguuuuauuaacagauggucauccaauaauggcagcuggaagcccguguggccauauuggacucugggaucuggaagacaaaaaauuaauuaaucaaaugagaaaugcacacucuacagcaauaucugggcugacauuucuccauagagagccguugcuuguuacaaauggcgcugauaaugcucuuaggguauugugauuauugcuguccuccucuaagugcauguggccuauuggaguuuguuuugguagcucacccuuggcuguaugacugagggagugugggaugagauugguauacaggaaacagaagcuuauuagcaggguacaugacugccucgaaguggcuaagaguuacagcuuagccuucaaugcagcacugcuaauguguugaggagggugacucagguaccugcagauggcacaugguugaagcaauucaccacuguauuuucuuguagauauggaucuuugacggccccgcgggugaaggacgguuguugagauucagaauggggcauagugcuucucuuaccaagauuagauauuauggacaaaauggacagcagauuuuaagugcaagugaguuucugcuuucuagcauuaauuuugcaucaacauuaagagcuaggaauuaaguauuccguugguuugguauuuacaaacuuuuucuucuuuuuaaauggcucuuugaaguguuucaaauuguagcuuuucagagaaccuagcuugccaacuuccaggauuggcacuguuuaccccucuaguugguggcaugaaccugggagagugaagccuaaaaaugagaccaacaaaagucucaugcaguagacagauucacucagagcucaggcaacuuauacucugaggguuaagaagacucacaugaguaagguguuuaaccacaagaacaagacacacaugcaaaagcauuuucucauagcggcaccugaauaacaucuguugagcuaaacucacuccuguaccuuggaggagcaggaaaacacaugccaugaacaguccuuuguuuugaaaagaccgaguucacaaguuuucuuagaguuuucucacaagcacucaguucucacacgacuucauuuugaccuauuuucugacauggucugcuguuuugaugaucugacuuuggguuuucuguucacguuaauaggucaagaugggacucuacagucauuuucuacaguucaugaaaaauucaacaagagcuugggucaugguaagugguuuacaagauagaaaacaaguugcuggucagaaaacagaaagacagaaaagaaaaccaaguucaagauucugaaggaaguucuuauuaguucaccucucuuggauaacacugugaaaaguggguggaggaggcguuacuagacggugcccgugcccugccuguguucauauccacaucucucagggagaugaagugaaguggagagggguuucuucacagcucucucaccuaggacaguguggucuucagagaaggauuggaguucucaaggugcugcuauacuuaguguugcucaguggcauaucacaggcuuuuuugcuaauaugcauggcacgaaacauuuuuaucugauugcugcuauaguguuggccacuuaaauugguauuguucuguacccuuuguauugguucuguaauaucggaggaaaacuaugccggcacuauuucuuuugguucauucgacucugaccauaguaucuuugaaaaguaauaguguuuuaucuuuacuauuucauacaauuuauuuucaugacugaauuuagaaauuauuuacugauagugguaaugucagcugugauuugccuccaacuuaauugggaauaucuuguuguaacaaaauaucuuuauuguaacaauaaaaauauuuucuuaacauaauuuuucauuaaggaacuuuccuauugucccuuucauccauccuuaggauuaguaaacaaaaagauaguuaaacggaaaggacuucagaacaccaugucaguaaggcucccaccuaucacacaguuugcugcuggugaguuccuagaaauccuuugcuuuuaugccuucauagccucuauuuuaauaaacuuuucuguuuauuaaauguucaggugaccuuaagugaaugcugaccuugugugaacacugaaaaaguuacuuuuagcaagaauuguuuuguauuaaucuccuuuuuuuuuauaacacccauuaguaacauuuggugucauagucccugucuuaguuagggguucuauugcugugacgagacaccgugaccauggcaagucuuauaaaggcaaacauuuaauugcagguggcuuacaguuucagacguucaguccauuguuaucauggugggaaacuuggcaacaugcaggcacacauggugcuggagagggagcugagaggucuacaucuugauccauaggcaucaggagacugugucacaaugaguauagcuugaguauauaugagaccucagagcccacccccgcaguaacacacuuccuccaacaaggccacaccuccaguagugccaguuccuaugugccaagcuuucaaacacaugggucuaugggggccauuccuguucagaccauuacaucuucuaaaugugauuaucaagaucccuguauuuuggcuaguuuuuuuuuuuuuuuucuuccaccuauuucaagaaaauacuuuaccuacuugcucucuucaguuuuucuuagucauuguuuuuauuguuuaaaaauguuaauucauuuuuaaauggguauuauuguuuuaccugcacguguauauguguaccacaaaugugcuggguacccauggaggcuagaaauaggucuuggaucccuuggaacuagaguuacaggugguugugagucaccaugugggugcugggaaucaaaccuggguccucugcaaaggcagccagggcucuucaccacugcuccaucacuccaaccccuacuuacucacuccugggcccccuaccucuagggccucuaucuugccugcuaauuucuguuuacuaccacucugaguaagcuauuaucuuuauucuaaaauuucaguaaauucuucuugaguccccuuagaaaacacugucaugguaucauacuuuauuauuauaauuuuuuuuagccuguuuguuuuacuauugugucuugguaccauaugugcaugugggcuccuugccaccuagcucagaggugaaugcauuucucccaaacaagcauuuugauuuuugacuuuacuguguuuucagaggaagcucgucaaagugacugggaugguaucauugcuugccaucaagggaagcggucuugcucaaccuggaauuaccaaaggucuacaauaggugcuuauuuucucaagcccagagguguaaagacaaauagcaaccucacugcaacaguaagugaccuuguugauuaugguauguucuccuuaaaauacccuacacgagccgggcgagguggcgcacgccuuuaaucccagcacucgggaggcagaggcaggcggauuucugaguuugaggccagccuggucuacagagugaguuccaggacagccagagcuacacacacacacacacacagacacacacacacacacacacacacacacaaagcccaaaaacaaagauaaaacaaaaaaagaaaacaaaccacccuacgcuaguuuuguuuuaaguuuacuaauacuacuaauggaaaaaacaaaagcaaaagaaccaggguuuggcgcuauaaugccuuaacacugucaacuuuucuaacuuguagaguuuauuuaauuugagauuugauauaaaguacugucucccuguggcguugauuuccuguagggcuggugaagucaaacauguuuucauguggucuugggcuauuuguaugagcucagaacagcuccugcccugccucguuaugccuuaggaaguaugguuccuccagaccugcucugcucugaggaugaacuuggcucuuuuguuccuaugaauuuuacagaaacagcaauuaggauuuuguuuuuuaaauuuuugcuauuauaaguggaauugcuuuuaaauauacugauuacugauauaucaagauagaauuuacauuugcauauccauuuugcaaccuugauaaauuuauucagucuaaugauccuuaguggauaucucuuguuuugaaaaugcuuauuacuguauaguuuagcauuucacccuauuuugugcagauugcuuuauaaguauguauguaguauuuuccuguaugaaaagcaaaucguaagcuuuuuauggauuucuaaaccucagaaaucuuaagcuucuuuaggaaguuuaccuggauaguuuuauauaacaguucucauacaaggaguaaaaguguuccagccucuuucagaugauuuucucuuuuucuccuuccucccucccucccucccucuucccucccuuccuuccuuccuuuuccccucuuuuucuuuuccuggguuuuugaaacaauguuugucuguauagcccuggcuguccuggaacucucuuuauagaccagguuggccucaaacucagagaccggccugcccucuuccugcugagugcuggaauaaagucgugugccaccaccacccagcccuucuuagauaaauuucuucauacuaauuuaaaauggaaauagaauuguacacuguaauauauacauuacauuuaagaaaacuaguaaaucaagaugagacaaauaauugaaagaacuuuggaaacuaugauauauguauaauaaaagcaauauuauuuucugugugauuuuaaacguaccccccuauuauuuuauuauuuauuuauuuguuuguuuguuuauuuauuuugauuaaaggcaguagauauaacuuccuguggaaacuuugcaauaauuggccucucuucaggagcuguagauguguauaacaugcagucugguauacaucgaggaaauuuuggagaugauaaagguauugaauuuuuuguucuuuuaaauauaagguuuaaauggguuucuccgugugacucauacuguugcauaugauucaaacuccauuuuaaaauauucaaagggggaaagucaugaagagauuagagggacguagauauaaauuauuuuguuucuuugcuuuaggcaaauauuaacuauuuuauuaaauucucugucauggcaucaacugguuuugccuucacauccuaauagcuagaguugucucccugcuuuguaauucgguuuaauuucaagauuuuagguuuuaucaauaaugggacaucagguauucagauaaagggaucucucuugcuauauuguuuggccagagacugacuucucuuuuucuuucaauguguauuuaaaaagcucacaccggcucuguuagagguguugccguggauggauuaaaccagcuggugguuacagcuggaagugaacgguuacucaaauucuggaacuuuaaaagcaaaguuuugauccacucucugggccuugauucgucuccaaauaugaugcugcuacacagggacagguaaacugcuucuuauacuagcaaagauugccauugugauguuagugagaccuucuaacuaacgcacgcacacugccaggugggaugaaagcaagagcauuuuaguaaauaacuguauaguuuaauuucgucagagauauauucaauucacacaauuaacaaugucacaguuguuugucucuguuuaugagaacgugcacguugucuucccagcggcauccugggccuugcuauggaugacuucuccauugcuguccucgacauagagacuaggaagaucgucagagaguuuucuggacaccacggccaaauaaaugacaugguaaaacaaacagcuuuucagaucagcucacucaucuccuguuuaggagaaagauguuuaaauaauugaaucgguuauuuuuaauauccuuauucccauuguaagaagguuuucagaaugaaugauaauuugcaggcuaauuuucacagagauuuuaagaaaaauuuaggaaauaguuuauuuaaaaaaaaauugguacuaucagauugaaguauuaaugccagaauuuauuuuugucuuuaaauaaaguuaaauauacuuuguggagugaauguuucauuuuguuuuaaacuaagcugagagaauuuauuugucuuuucuauuuguaauggauuuaugauagcuaacauauaagcuggcucuaaaguauauuuuaguuaaauaaaucuaaacaccuugaaauuguuaacugagggcucuguuaaguauaugguaucauuuaguacugauugcaaguccacuauuuggaaagagaaaaaaauaagaaaacuacuggaugauaaauccaguaguuuacaaccaugucccuuaucagaaguaaauguaggugucagaauugacagucccuuaccucuuccuuuacaaguaggagaaauugaucaguguuuacauuguaugacuuggagauugucaaaauuagcuuuggauagauuuuguuuugaugguauauggaggaaccaggguggggcugggguguuauguugaaguaacauuuuaaaaaccaucaguccuagucagcucgcucuuccuguucccgcccuucguagcuuuuaauucuccacuugugucuuuccuuuguccuacucagaggccuucacuucuguugaacaguguaaaacaaauguguuagcauuuguaauacaagccuaucucugagagccaguuuuucccauccugugcugucugcaacccccuuccccaauugagcugucuauacccugaaguuugaguuuaaguaaucuugcuacagccugcgaauaaauuagcacugaauuuacugcaguaacauuugcuaguaaguaacccugugggguguguguguguguaaaucuuguguuaucugcugccauaaccuuacaguuuugggucuuucuuauguaagcuaagguucucagcacuccauggaagaggaucccuuguccaaccuuuuauagcuaguaacagauacuuaaaguagcaucaggaaucccuuaucucaguguuugaaauauuuuugaucauuguugcauuaaauuauuuuggaaauaaaauuuucauuaagggagaaaagguuauuuuuaaauaaagcaacaaguaaaauaggauuuccuuauuaauauuuuuuaacagaauuugcauucccuauuuucagacuguagugauuuagauaauuucccgcagugugaauauaguagaagagacagcuuucagagacauaguauuagcuucauuucuauguaaauuacagcuaaaauuagacugcagaguauuguuaacuauauauucucagaauauaugaauauuuuuaaaauuuacuuuuaauaaugauguguagucacggccuauuccuuagguaaauacacagugcugcaaaaauugacacaaucuuuuuaauuucaugagcuaguaauucacuuaaaaaccuaauacugacguaagucccagggaaguaauauaggaaacauauuuuuauuuauauaauuccuacuuauauuuugcauagucacauuuaccauuucaugaagccuaaaaucuuguuaaguuuuguauacuuuagguguucauguauauacguguauucauauacuuacuaaugcauauauuauagacguucaguccugauggccgcugguugauaagcgcugcgauggauugcucuguuaggacuugggaccuuccuucuggguggugaguucacuuuuaagucccacagaugauuucucagucauugugugaacaugugacuuuuaccuguuauuuauagcuaugaaguuggcacuguuuuguuuguggaguguugugggucucuuaaguaucaggcacuaacaugauaaaaaauagcaaggaaaaugcaaaucucuccuauucauuccugcaaaauagagacccagaggugguuuguguaagucuuaagaaaacccaucaugugguuugacacauuaguagagcccagacacauuuuauuuuaaggcuuugugcuauaguucauaguugaguuuaauuacaaggucaaaagcccuggauuuccucaauacugcuuuucucucuucuuucaguaaugggacagugucagaaauguguuucaagauugaaagucacuguuacuccggcucauucucaggaauuaguucacuacacauguacaagcaguuugaccuuuaaaaaggaaaacccguauuucucaauucccaguaacuuugcuauaggcagaaagcacacccaccuuccagcaugugcaacugauuuagaguaagcacagcugaagaacccaggagugagcccagcccuaaucaugagggacuuuugucacaggugugucauuuuccacuuaacaugacugaaguaaaaugcagauagcccucagcuucaaaauuugaagauauuuagaaauauuggcaguuuauuaccccugaacuuuuguuguugcagcuuucuaaaagcuaguauuacagaauuggaauuuagugauguuuuggguagcaaguuuaucuuuggaauggaaaacuaggaucugaaaguagcauuuaaagcuuugaaguuuugauucagcaguaacauuuuugcugaacuuuuuguuucaguaacuacuugaguagauuuaacugugguagguuuucaacuuuaaguauguauuuuuuagaugaacacuaagguuaaugcaagagcaagacauacuaagacaucaaguuguuacaagaaagugaaaucaccaguugaacaaaguauauuuuuauuaaaaacaaguaauucuuugauuuaaauuuggaguggagcaaauaacuugccaaacaguaucaaacagcugaugcugucuagucuccuccaacccgcacuguuacugggcacuucucacccuguacuuccuugguauccuaauaagcaugcuacuguuagugguucuauuggacaagcuaggaaaacgaaccuuaaagagauuugucagucauuuguccaaguggauuguacuguaaacgcugagcauaagcacaggaggaagggccuucaugucagcccuggucccuuuguguugugcugucucgggcagagccagugucuuccucuagaagacagguaacagggcaguauuaguauuuaauuggagaaccuuagggaacuguuaaauuguuuagguucccccuuuuaaaaucguaccgggagguuccuuguuguuccuuuauuaagcauuuucaucauuuauuuaccaugcucgguauuugaugaaugagagaugggucagcaguugaagcacccucucuucuuguagaggaccucgcuucaguucccagcacccacuuggugauuuacacuuguccaaaacuccaguuucagggccucagcagacaaaacauccauacacguaaaguauccucaauuaaaaauuaaaaugagggcuggagagguagcucagugguuaagaguacugacugaucuuccagagguccugaguucaauucccagcauccacauggucacucaaacaucugcaaugggaucugaugcucccuucugguguguuuaaagacagugacaguguacucauauacauaaaguaaauaaauaaaaauuuuaaaagauauuaaaaaguuuuuuaaaaauccaacgaguagguuuauuguguaagcuaaacaaugagugaugugugaguaagcaugugaauguggucccacacagcuguacccauguggagugguuccucuuuaaagcacauaccaggcuuaccgagugcguguauaaguaggguucauaaucccugaagucuugccagcuggcuaaugcagacugcuuuguuuuauucugguuuccaaucaauuggaaauucaggcugaacuucauagggggugagaaauacacaaaauuaaaugguuuuacugaaguuugcauuuuguuuuaucucaauccuuccucagcuuuagucuauggaacuuuaacaugagaaaaauuggaaaagccagcacuuaacauuucucauaaguuagaaccuuucauugguucuccuuagggaagauucuuguagaaaguggucccaucacuuuggcaaugaacaacauacccgggacuccuaauuuuauaggauuauccuagcuucacucuggauuaagcuugcacauugaagccauaugauuuaggugacaggaaaauaugcuguauauguggaaacugucuuccucaauuuggugcugucacacaguggaaggccagccuacccacacagcacagcuguagaaaugaaguugcacaaggaaauuaacaaaauugaguucuugaguagacaaguuugcucaagcaguuaauucucugaacggguggauuagaacaugguaggaaguuugauccuacaugcuuaaaccucugcuuugcaucaagacaaaggagagaaguuaaaaugaggaaauuuguguuuuauauacugggaagauacugucugcucuggguaguuuagaugaagggaaguaaacuuuuuggcaguuuacucaucccugacuuuggagugguucagcauuuugcuuccuuuuccucuguccccuaacacaauguuucucgugagcuucccaugcagacauaagcagaaaccagacugcuuauugcucuuccuuucccacaucugagacacacuuugccauuuguuaguuuccagaacuccuaauuguaaucuuuuuuuuuuuuuuuuuuuuaaucucauuuuggguuuuccacuuaagguuuauuuaaguuguuaaugagucuuucagcaaacaugucacuuacugucuuaccugaaggaagagcugucauggacaguuacacugcuuauaguguguaacuauaagauaguauacacugccugcuguaucuuuaauuccaguuaugguuaaaagugcagucuucuugggcacuauuccugcuucaguugauuucuaucuuaaacaaguuuuuaaaucuuacugaaacuuggcuuucugaucuauaugauaaugaugauuguaugucauggguuauaaaaauuaaauuagucauuucaagugcuuggauugggacacuuauaagcauaaaguacaggagcagagaagaguuaaaaauugcuauuauuucuuuguuaagucacuuguaugagacuagagccugaauuuagauauuuguuauauguucccaugaaaaaugcauugucuuugacacagugacuuuuuuuuuuaaacagcugaguuuaaaacuaacgagucuacucuggggcuggagauguggcucagcugcugagagcacuuguugcuauugcagaagaccaggguuggauucccagcacacacaguaguagcuccaucacaaccacccauaaccucauuccaggguuccagcaggcacacacauggugcacauacacgcaugccuguaagacaugcacagaguaagacacagauacagaacacgacaaaacccagucuacuuuucugaagguauucuauuccuccuccugccgcccugugcucccgucagucucuugcucccuagccugcuuccacuuccugcagccacuaaccaccugcugagguucuuuacugcuaagugauuacuaccguacgcgguucucccuguucaaauaaggucugcauucuguuggaaaauuucuuuauuaaauagaagguucuaccauuaucugcucagaaacgcucaguggcuuacuaucaagauguacguagauuguugguguacuuugugcaguggucccucccuccucuaagugugugcuaucauuaaaauuguucccaauaaguauaccaaacuggggugagaaaaacauuguuuccucuaguuuccuuacuggugaauccagguaauuagucuguuuaauguauccaacuuuccccuuaagguaauuguuuucacacaggagcugaguugacaaagcagugguuagugguaacugguuguaauuuguaaaaacaaaaacaaacaaacaaaaaaacuucuauugcuuauuccuuuuaguaaaagauauguguauaccaccaccaccccuuuucaaaguauaccuuuaugaugaauaaagcuuaaguacuuacaccucuuuuuguagccuuaucgacugcuuuuuguuggacucagcgccucuaaauguuacuauguccccaacuggagacuuucuagcaacuucccauguggaucaccuuggaauuuaucuauggugaguucuucguacaucucuuucauuuggggcaagaggaggaagaugacaguggucaagauugguggugguuaaaaugaccacuuggaguguuuuuauacaguggaacuaucacacagccuaauucaucuaccaugaaucuaggacugauacuugauaauuuagauagcuugguucaagugcaugcucuaaauuauauaauuuuugucugcuauuuagcauauuuacauauuuagguauagauuguauaucuagaacguaagauuguugcuaaucacuucugaacuucagugugcuuugugaaguaaggcacacaugagcagagaccucaguaagaugcauccugguugcauggcuuucuaacacauuuaaaaaugugugugcuucuucagacucugcuggguugagccuguaagacuguaguuagugguaaauaaccugcaccuagagaaauuauaucucuuuccugaguuuauauauccacuucuuuuagcugccuugaaaucuuuguauuuaucgaaugcugaucuuaagucuguaaccauccugucucagguugaugaguguuggggcaauaccauucuuccuuaccagucuuuuauaacuuuaauuauaaaguaucuucuaguuuauuuuaaggggaaaaaguaaauuugauuuaugauuuugcccaucuuaaaaagcaaaauguguugucaucuagagucaguaaagcuuuagcccuuaauggaugacuaagcaguugugaggccuggauagaggaguguggugcuucucuguagguacugcuguuaauaugacucgggaccuuaguucccaacuuucuuuuccucugaaauucauauuaggaauguagggaaaguaguuccccucguuggaacagguauuuauauccugaauacucacccauggcugcuuugcagaaguguguuuacuuagccauuucagaaaaggccaagugaugacugcuuauugccuccaagaauauaauuaggauguucacuuuaacuugcuuucucaaccucucuuuuuguuaugcuguuugguuuuuuguuuguuugguuuuuuuuuuuugaguaaacauugguauuugucaaacacuuuaugaaaauuauuuuauuuauaaaaguauuauguaugacuaguuucucuucaaguuuuuguacuauguuaaaaacaaacucaggccugguaugguuguacaggccauagaggcagguggauuucuauaaguucaagaccagccuacucuauacauaauggauuccaagucagccaaggaugcauggugacacccugucucaaaaaauuggaaacucaaguuauuuuaugccuguguguuuggccugcaugcaugcaacaccugcagagaccagaggcgggcauuggaucugcuagaacuagaguuacaggcaguugugaaacaaccauauuggugcuaggaauugaucccaguccucuugaagaucagucaguacucuugacugcugggcuauuucuccagccccauccauguuuuuauauagccuuuuuuauuuuagcauuuuucagaaucucucuuugaggucuuaacuaguuaaugauuauagucucuggccagauucaagauagggaccauuagcagguauuaaaauuucucuaaugauaaugcuucugcaguaauguauuuuuauaaaauacuugguuuuugcuugcucaggucgaauauuucccucuauucaguugucucccugcgaccacuuccuccagauuaugucccuuccauagugaugcuuccugguacuugucaaacccaagguaaucaaaauaauauuuuuuugagauguauuguaaaucuauuaguuuauugcugaaaaaaaauaaucaaaguuaauugaagucaaucaaaguuuuuaaaacugaguuaaaauauauuuaguggcuucaauuauagaacaccauaacuaauggcauaucuuuaacacauaaaauaauagucugugugaaguauuugaagucuauugaugggaauuauaaggaaaucagagaaagggaaaagcaaaggaaaggggugcgaagaguuacaaagcugugcugguugaguguugugaggcagaugaauggaggugggaucacuucuuuccaugacagaacuucuguugccuucauccucguuccugaauaucuguuuuaagguauggaagacuuggaagaaaagacugagccaagugaugaaaugauagaguaugagucgccagaacaguugagugagcaacuggugacucucucccuucucccugagucacgcuggaaaaaccuucugaaucuugauguuaucaagguacugcucuaguguucuugacaccgcgugccccacgagccuaugccccacgagccuaugccccacgagccuaugccccacgagccuaugccccacgagcauucccugcuucgaggauauuugggaaaugauaguuaagaugcugcuguuuaauugagugguguuucacgugguacuaucacagagguccuguguccauguaacagcacuacagguguuuggauauaccagaaacacuguacuauagagcuuucagacugggcuguuuugguauccagucuaauuaguuguauuucuaaauuucaaaacgaaagaaaagcuauuaucuauuugugccuuaauguuaagaaaauuuuacuagguuuuuuguuuuuguuuuguuuuauuuuuuuagugccacaauuaaccuuuuauuguugcauuuucuuucuuuugcuaaguagacuuucagagcuugcuauaucagggucagcaagugaguuuacuagauagggcagagguaauguaauaugaggcuauaguguugaaaacaaagugagcccccuuuuccuggggacaguacaauuuugagacuuguguuccagcuggagagauggcuccaugguuaugagcugcuacugcuuugcagaggaccugaguuagguccucaacacccacauuggaugacuugauacuaacaguaguucccgaggaucucacagccucuuguggccucuguggucacuauacucaagugcacagagcuacagacacacaauuuaaaaaauaaaaauaaaauuuuguauaaaaaauuuaacagaauuuccaguggaauuuuacugacaucaaauauuuuauaaauugacaauaguauuuucuuuuuaaauaucuaaggaaaaguuaaaauucaaaaaaaaaaagaaauaaggucauacuucuccaaaauauuaaauuauuucuaaugggggagucugcacuucuggauaugauuuuccuucuggagauaagccgcuuuagguuguuuccaucuuguuuuguuuaugagauacugacugaggguucauuuugugaagcugaguauaucuuagggcugcuccucuaccuggcacauugggaagccugggggaaagacagcuacagcauugcucaugaggacuuuaauucagcauucuaguaugaaaagguuuuauuccuacaguccauuuugaugguguuuucgguuucauuuguaauaaaaucuggaaagugucgggagagugaguacucaccacucauuccccuuguucucucucaaucagaaaaagaauaaacccaaagagccgcccaagguuccccagucagcuccguuuuucaucccaacaguuccugggcuuguccccagguuugcuguacccgaacccagcagugacccccagcagguaagaaccagaugaggcugagucugugggucuguuucuccccguuacugaggcaauucaugcucauuuaaguuauaugguguauuuugagugauguuuauauuuguuaaguaacauauauuuguuuuuauuuaagucuaaggugguaaaccuugggauuuuggcucaaaagucaaauuucuaccugaaacuugaagaaggauuacuaaauaaucaguguaaguuaaauuauaaaauauuucaacaaguaucuucauuuaugguuuacuuuauugaaaaaaaauugcagaguucauaauagagaaaaagaaauauaguaaaaacuaaagguacaccaacuucgcuuuuaaauuacguugacugauagcagugcauuuagauaauguuagugguaaaccucuuaagacucuuuccagacuucuggauggagauuuggauuguauuuggagauggaggacgugucacaacagucccauguggcuugucaguugcuucauugccagaguuuuguccagcaggaaccucaagcuucuuguuuucauuugaaaaucugguuaguuacacagcagagacaggugucuuagguaauuuuuauauucccaaaucaucuuuuagaaaugcaauuuuaaaagaaaaaaaaaauuuuuuuuuuuuuuuuuugagacaggguuucucuguauagcucuggcuguccuggaacucacucuguagaccaggcuggccucgaacucagaaguccgcccgccucugccucccaagugcugggauuaaaggcaugugccaucaacaccuggcgaaaaauuaauuuuuaauuuaguuucauuuagacuuuucagguuacuguguagcauauacuaagcauaugcaauuuuuuaaaacuguuacucuguugagacauucuacugcuuuugguuuaugacugaaaugugcuuaucagugugucacuugguccaugugggcaaagucugcgugcuucuuguuugcugaggaauguagaguaaacacauagcuuaagauauacuaaaggacagaaaacgagugaugagucuugucgugccuccaaagcuaagaucguagccauugccgcugcaguggcaagggacugauuagcugcguuggugugucuagugugucuccgugggcugcagggugaacaguagugcagagcucuggggagugucgggauugguagaggaggggcuagaggcuccccacacgcuucuauauccaugagucucaacaaccacaacaguucuauuuuuuauaacaauaaaaguggagaauaaaagcugacucuccaccucauccuauuccuggagguagucucauuuaauauauugugcaguguauuccuugaugaccuaauggugcagucucuuuguucuaauugaaguuuaaauuccugacagugcaaaacuuuaagaacuuuuacugguaucaaaauuuuuacugcuuaauuuaucuuggcauucauugugcuauaaugugaaaaaauaaugcauguaaagaaagucuaaugccauuuacauaaauauugcuugguuauaaagaaauauggcuucuuaaguaauaguaagaaauaacuagauucauuuuacaauaauuuagaugaagcugcucuuaaccuucugaaagaauugggcccaucugggauugaaacagagcugcgaaaccuguccccugaugacggugggucgguagaagucaugcggagcuuuuuaagcaugauuggaaugauguuggacagaaagcgugauuucgaguuggcccaggcauaccuugcauuguuuuugaaggugagugagauacgauacuuuccuuuauauguggcaguguuaucaaacaagucugcaaagaugggcauguuuugcaucuacaguauugaauaagccaaugaauacuuggaauauggcuaacuauagcugaacaauagcugccuggccuggugucuacccugacauggcuggggauuuuggacuuucuagucuuuauuuuuguuacuacucaguggcauaauuuugacuuuaucccaauuugucauuucuuuguuaccugugcugaaccuuaacuuuuuaaauuuacauuuucuuuuuuaaguuuucugugaucauaagggaaaguuggguucuuuguuuguucauuuuugucugcugcugaaaucaaaauauucacccccgccaguuucaaguaacuucaaguacaacuugcgcuuuugaguaacaaaaccaagauguucuguauaggugcacugcauggugugaugugaugaaggcguggcuaacacuagcucaguaguuagugccuguucuccaucuagcucgggcugucugaaggaagucuuuaaacuuauuuaaaagcuggaucuugaggccuuacuaaagagcuguuuuuugguuuuuggcuuuugguuuuuguuuuuguuuuuuuuaauaaugccaacuguuuguaucgguuuucauauguuuacuaaauguuagucccuaaacaaauuuacauaaauguuuacaaaauaaaugacugccauuaaucaucaguggguuagagaaaaagggaaccuggaggcacaggaaccuggucuagaggaaccugguguagaggaaugaagguuacaucaguucaauuuaagcucauaauuuaaagaaaacuugauauaaaaugauuugggacagugggaaaucagagaacaauaaccuaccacugaggaaagaaauaucuagaugcucuuuuucuuaaguuccuugguaaggaaaaaaaaguuuaguauuuugaaauaaaauguccagcuuaaccaucgucucuccuccucaguuacaccucagaacgcuuccuucggagccagcgcuuuuagaggagcuggugaaguugucaucacagguagaaaaagauuggacucacuuacagucccucuucaaucaaagcaugugugucuuaaauuacaucaaaagugcuuucuuguaaagaauaaacuuaagugauuacagaaaucaaagcuaugugccaagugugcuguuuaacuugucuucacucucagcucagagugggagugaccagcucguguauuuuaaguucaaaagccuuuguagaugugaaauuguaccuucuuucuuuuuuuuuuuuuuuuuuuuccuguaccuucuuucuagaagcucugcacaucgagagaacuuaaaaccaccugagaucaucagacaagucacauacaugggacuuuuugaauuauugccauuuuguauuuuuaucauguuauguguaaaagacagugccuauucuguguuuuacugaauuaaauugacaaugucagauaaagcguaucuguaauauacuuauaaaaaugcauuucugauauuaaaaagaaaucaguggguucuuuuuuucuagguggcuuuugaugaaacagauuguugauucuugagcuguguuugugucuggugccuuugguccagccccacccccacccucccuuuguuauagaggagucaaagaaagguuggcugggaucugugguggccuggcuuuauagcacagagccuagagcuuucucaguugcccacuuccuagauaagguuucauuagauggaagugagaggugcuugcuccaggaagaagugcagcaagugucugcacagggagaccccaggcuccagcaagggcuguucuuuucugacagugguuuauuugggaagagacugcuaacuacgcuugucaucaucuucuuucuuaauggcccagugcuuuagcaaaacagcaauuaauauuaaacaguuggggcuggagagagcacaaaucccguauaaaccaggcuugguggucuaaaaccugcaauuucaguacuccagagguaaagacuagaggacaaaaaagaugcugaaaauaauagcuggaggcuagccugagaccaggucuaauaaaaauaaugaaaaauaagcaaucauuagggccuugugcuccaaaaacuaccccucaaguguaucuagguguucuugcucaacauuagcuuagagaguuuuacagacuccagaaaagaacagucuguacaaaaaggguugaugaaguggcucagcgauuagaggagcuugccaucaagccuagaggccagaguucaauucccaggacccaugugguggaaggcuagaaauaauucuuucaaguugucucuaauuuauacauacauacauguacauacacacacacacccacauauauauauacucaaauauagaagcaaacuuacuaagaagaaccaaugagaaauuuauuauggaagugauuuuuaauuuacuagugugagauagaauuugucaguuaugacaggaaaacgaagcccaccuuucuauugacuuuguacuugacuguauauuaauuugucaacagcagugacucauauguuaguaaugacuuaaauucugauuuucauagacaguagcuuaaacaugagugcauauaaucaccuacuuauaaaaacuguaaaauuaaagcaaaaugauaggagcugucaacuccuguuuuuucuuauuuuucuguaaucacaaacuaaguuuuguuuucaagugaaaguacaaaguuuguccuguugucauuuuuauuagagaugucuuuagacaguaccacauuauuuugucaauaaccuaaaaucuuugauacuaccaaaaaggaagagaagaaaaacaaaauacaagauauuauuuuguguacauauuuuucuuaacauguuaccagucucugcauacuuuacuuucgaauuuuaaauuauaugugucauauaugacuacauucuacuuauaaaaauaucugauuugguuuugacaacaguuuauaauucuaguacauagccacagaaaauaaaguguagcauuuuaauuuuuuguuuacauaaagagagguagucuguaacuuaaaaugucuuuacuuguacauuaugucuuaaaaucuucucugccuuaucacacaccuaaauuuggagaauuuuc

SEQ ID NO: 8858 - RNA, 1100 nt, Mus musculus
cuuucuaugcucgcacgcagcgcggagcauggcguccccgggagcuggggcaugggaggcgguuguggcgugggaucuagggugucugcagcggacucggcggccgugugaggcgcucggcccgccggaccccgccugaagcgggucgguguggaaaccgagcgccguuuggauguagaucuucgccguaggcccagaacugggcgggaauaaagcgaagacccaggucacacgguaggauugauggcccgcugccugacgcccuauucauguagccuuuguguugcccguucacuuuggucgcuagugaauguggugucagaaaaggcauaaauaaaugcuuugcggccuuugcuugcccuggaguucgguaucucggguguaggagcugcauaaguuacagaaaguuuacucuagccugugugugcaagugauauugcuguccagcccagggaauguaguuucuuuaacugguucuucuucguuuggcaggugaguaccugaagcuuacggauauuuccugaacgacacgugggagcacagaguggguuaaagguaggaugacuccaaagcacuacgcgauuuccuuguagguuggaaugccgaauccuuagucuuacugguucgcuuguguugccacuacuuaucugaaguaaugcagacuaugaaguaacucauaagagacagccuuuacccauuggcuaacuuuuaugacuguuuggguuuuuucuuuuuuuuuccugacuacguaguauugaacagaaguaggaaauguacauuuacauugguggcuuggaaaaucuguuuagaucaguauuagcuagaaaaacugccagaccucuaagucaaaaaaauuguguaguuuuaccaacacuaaaacuaaaggcuuugcuggggguuuauguuaccagauaacuuuucugagaaaggcacuuuuaaagcguuuuuaucuuuucuuuuaggguguccuugaugauuuggaaauuugaucuacagaagcacgagugauuuaaauuuucuaggggccgugucaaaacuccauagaugaaugcucauuuguaacaagacuaugaauaaaugcuucgaugugcuguucugac

SEQ ID NO: 8859 - RNA, 2474 nt, Mus musculus
cuuuuuuuuuuuccucagaaaacacaagacaaggacacuuaaauucaaaucaacacuuaacagcuuuuuacauuauuuguagauaaccguugggacuuagugccacgggauacaauauuagaaacaguuuugugggaauaaaagucaccagucugaugcaggcccagaguccaggggcucaucggaaguugcuggucuugacuggguggagaguuggauggucagaauuucaggaaauagauggugguauccagugaguuuauaagguuguccucccaaaggcccagagcacaagaaugcuguacauaaauccuuagacgaugcuaaagacacauguccagggugcauggauaaugaccuaauucacaguuucagaaguaccaguggcacggcacgaauuucccuuccuaccccgcacccagcccgucaagucucugccuugaggcgagcagccuggaugguuuuuaugguuuuugcuguagguuucccagccggguugauuguagauagcugagacuuuucuucaaucaagcugucuuuagacccauuucuccucuaggaaaaaaaaaaaaaaaaacucauagcagucauaagaaaauaaccaaaucaaguacuuagaaauaacagaagcugggcauagagggacacacuuguuaccccaggaagagccaauccagccugagcuacauggugugaccacccuaaaauguauucauuuaugacacugcaugugguaauuacucggagaaaacuaauacugugugagagcccucuaguuaacugcaaaaccaaaugugccuaaucuuggccugauaauuggguacacaucaguucucauaaaaauuggacauaauuuaccuucauagcauuacuuaagagacuuuccuuaaggcuuuuucuucuaaagaccagagaggaaacuaaacgccuccccugguuuuauucuggggagccacccuaugaaaugguucaugugcagugugauagcauggaguuucugucaucugggacaugucacugccuaccugaccuguacaccaggaguccuggaguugggacuugucugauggaaacacugagaacaccacccacagggccucacaacagcugcccagaccucccagggaugaccgagguugcuauggcuucauauguauaaacauaucugagaauaaggacuugcuacugcauccaaagggauuccuguaagcacaagauguuucuaaaaagucucauaggcuacuuaccuauggcacacaccuuugaccccagcacgagggaggcagaggcagacagauucugugaguucaggaucugccugaucaacaacaaaggggaagguuccaggccagacaggcuuacaaagugagacccuaccucacuaaaaauuaacuuuuuuuuuuuuuaauggcaucuguugggcuggcaagauggcucagugggcaaaagccuuguagcucguuccucacuaccugaguucaaaccccagagcccauguaaaacaguccugaaaacaguucucagaccacacaggccaugcccauacaugacgcacacgcaugaucaauaagaugccuuaaaccuuuacuaaccugaugaacugucgagccuccagaccccugagcaucugaggaacgggugaccggaaguggugguacaagaucugucuuugagcugccaaagagaaaaggucagaguuuaugaacaagacagaacucaggucuuaugcgccucuggggcaggcuguguggucugggggcacaggaccgacucacuucacuuccgagagaacggaucguucuccgucugaacacugggaucuucgguacugccgguaacuccgcggggaaugagaaugccggaugcggaccgggucacccugaguccugcgaggaagccagacaaagcaaggagacaaacacagucaaaaccgcaccacgauacgcaguuuuccugaugcuaaacuguaagcaaaacuuucagacugcuuuuaacuugacucucagguuuacuuuguaaggugucuuuuuguuuuuauacagggucucgugaaguccaggcuggcuucagacugaagaugacuuaaaacuccugacccucaaguuccacaucgcacacugaauuaaaagcauguuccuccgcaccuagcucagacgggguuggguuguuuuuuuuguuuguuuguuuguuuuuuuuggggggggguguuuuuguuuguuuguuuuuguuuuguuuuuaagaacuuaauuuuuaugaucucugaaagcaguaaauuucacagcauuuuacaaaagaaaaugguuucuuguucacucaugcaaauggagcucuuuauagugugugagagugugcgugugugagagugugcaugugugagagugugcgugugugagagugugcagguguaugcacgagagggauaaggagagggagaucacaguuuuuuguuacuguuguuuggagacagggucuca

SEQ ID NO: 8860 - RNA, 103730 nt, Mus musculus
aauauauguaaguuuuuaauaaaaauacaaaaauuuaaaaacaagaaaugauaaaaugagugagugcuccuccugucuaagaggagagaauggcagcuuuuucagucaggagcccagggaggauccacacaagagcagcauaggauggacagugguucagguggcuaaaggaagccacaacacagcugagugccaaagacgcugccuccacaucccuucccuaaauggaaggacaggccuggacucugggucagcacuaucuugaaaaguuuucuuggucaagugacauaaucacuucauacaaugugaggauggcaggcaaccuaggagggcuaugguaaggacuaaggaucuaccucaguacaauggacauacaauagccaucucaguaauuuaaauuuuuccuuugcucaccucuacacauacagauaauauaaucucuaucuacugauccauugccccugacauauaugaaaagugauuuacauuucauuuaaagagccaguaggugaaaaacaauauaauacaccacuaacugcuuagguucaaauguccgcauucauuaauucaacagguauuuauugaguaaccccccuugucagucaugguguuaaaaaugaaacaucguccugcucuuagggaguuuacugcuuagugaggagacaauaagucaacaaugaauauauaauuuaaaaucauagucagacacuguagcacaugucuguaauucuagcacuugggagguagaagcaagacgaucugaggugcaucugaggacaggcuggggaaucugaggcccucucuuaaaaaugaaauaaaaauugaagggccaauuacagcaaugcacaccuauaauacuggggaacuaaggugggaggaucaaggucagccuggguuacagcgauauggagaggacacucaaaaacauccucugguggaagaaaugacaaggugugguggugaugcucaugcccagggcagggcagauuuaguuaggaaagaggacugaggggccugucugaaguggcaauuaaaccaaaacgugauggaugacaagaagucaggcauguauaagacacagggaggucuuguggcaagucaacuuuccauguacaaaggcagucaggaguuaaugcauuugagcugucgaggggagguucagcaggcuggagggacuacucugaguucugcccagucucauacccuggccuggaggcucuuucaacauggccucuaccauucuagcaccgucuucgaacuuuacuucuauuuguccgucuucccucacaaacucauuccgccuaaacuuccuguguuccuguccccuugacaugcuccguuccaguaucuucccagggcaucuggucagucagucuuagggucauauguuaccugugggaagagauugcgcaacaccgucccuugguuuguucuuuuucuauuccuuaucacuaccaucauuuuuaguuuuacuuuuuuuuuuuuuugucuauuccuucauacuagagugugaauuccaugcguuuauauuccccaaugcuguaacccuagaagcgggaucaguuuguauaauaaguguuaacacccaaagaaaauuaugauagacagguaaugcaagcugucugauagcuguuugagacaaacuggggauguccggagcagguagguuuggaauuaaaucgggagaggacggacggcuggaggggcaccuacagaacaaaaaccgauuucugucuucuccaccgggcuagggacucccuuugcucuaggauccauauucacucauuuaucuauuaucagugcgcuagcccaggacguggcaauugguggaugcuugauaugagcagaugcucacgauuagcuguagugugcgcaggaaaagucuaccaauuugguuucaguucaauugagaaaggugagcagguuagagacucaggauccccggagcaaagaccagaagagaggaacgaaauaccgcagaggcagggcauaggcugcugcggcugcgcaguccaaucccucauuccggagcagcgggacgccggccagccgcucccaucgcgcgugcgcacugcccgcuucccgccuccaacaagauggcgaaggcccugugcugagggggcggaguguggcugccggaaacccggccgcuaccuugggggagcuucgggcgaaggcccgggagcagcggaccgaggcuggcgcgaugcuguucccggggagcgcagucggcuaccguugaggaagguggagugaggaguggcccuuccagcgcccccuauguacgccuuccugcgcucggggccggucgccgcguugcccgccuccguaccgcccgugacucucggggcccggagcuccggcggcggccggggucgagucccgggggaggggaggcgcccgggcggcgcccgagcuugcggccgcggagcgagcgucuggcaggugagugcggcugcgcgugccggcgacucccacccggggcggcugcgcugggacucgaccccagccgcccgguuccgccgcccuccggucugcacgcuccugacuugccccgucuccggccuucugcuggccacgggcucgcagguuucccuccccaguccgcggacggaggucgcgacucccgccgcccucgcaccuuuccuuaccucgcaggcagccucgcccuuacuagcagucuucuguccgcucuaggugcgugggucguccagcccauuucuuuucgcguucaaccuuuaaaaaaacaaaaaaccaaaaccugaguucugggaggauugucugagccugacuuaugggguugcagaggaaaggcugguuguucagaggcggaugugaucugguuuugaguagagucccgguaggcugggauggguagguuaagagcccgacuccugccugccuaguggagucuacgauggcaaaccgauuguucgcuuuuaaaucauuuaucucugucauaggcuuuggacucagcuuuugagacggaagcguuagguuuuguagauccauugaaagaauuggggaguguuauauuccuuaaaaaacaaagaagaccuuauaaauguaagauaaugccuacuggcacaagggaggauuacuuucuuuagguauuagccuaaggagcgcauagaggcuuuaaaauccuaaugugcaagcccuuuguuguuuugcuuuguuuuuaaagaaaggacugauggaaaaagcguuuuaaauucaaaacuacucaaaugucuuguaugcucgguuguuacuagugcuuaacagcacucgcagcacuugcuagccucuauaacgugggguugugccaaucucagcugccccucaaggguagucgcgauuuccaguguggaaaaacuguccugaguaacuuaggagccuugccaaaguuugcaagugcaaacugccccuucagaguggcaguggaggaagucaucugguaguuugucgccucugacucggaugugucaagagccccaacgugggauuaaaaauacauagaaaaugcccaaugagauugcaaaugagugggguuuugaaagcugguuuagaagacugaagcauuagcucagugguagaguacuuguaagacggacucuguucauucuccaggauuguuuaaaaaaaaaaguuaugggggcuggagagauggcucagagguuaagagcacggacugaccuuccagcaguccugaguucaguucccagcaaccacaugguggcucacaaccaucucuaauggguucugaugcccccuucuggugugucugaagacagcgacagugugugugugugugugugugugugugugugugugucuuuuuuaaaaaguuacgaauuaaaguuuuagaaauagaauugcccaccuuaaaagaagaacucuuuuugaguuuuauaucucauuuauuuguugucaguuucucucuucuagcacugaagacugcaugcucuuaggucugccugucccuccagugcugugcuuuccuuucaguuuugaagggacaagggggaaguggagccuucuaaacuuaguggcugagagaaucccagcugucugagguguaccucuuccaucagcugucugaggucuaccuccugcguuucccagacaagagggaaguggagccuuguaaacucaguggcugagagaaucucagcugucuggggguguacuccuguguuucccagggcuuuuuuuguuuucauuacuaccuccuuaauugcucauauuucagagcugugugccuuugcaagagcaacccucuccaucucucucuauucagaucuguccauuaucacuauuuggaggccucucccaguuucucccucucugugcuguaugcauguuacuguuuucuacugagcugccagauacaaaucuggaggcacuuccagauuccaaauuucccuucaggauucucccauccagggacucagauguaguuagacucuuuccuucaguuuuggcuuugacuuguguuaaaauuauuuacuaguagcuguggucauguuaccacuuagacuucuguaucuguaauaccuugcacgguggaucuagagggagugaauguguuaaauguccaugucagugcuugccacauccuuaucgccaucuuuuguuuucacugugaugucacugugaaguggaagucccuuagcguuccacugugcuuggggccaucuugacagggggucaguagguaaacgggccgucuuggaaccugacagcuggaguuagcucuccaggacccaugugguugaaggagauaaccaauuccugcauguuguccucugaccuacaucauacacaauaaacguaauuaaaaaaaaacauuuaaaaaaaucacuagagaacacuaagcaccaaaccuaauggcaguuucucugucaucguugguuacuauaggcaauuguaaauuacauaauacucuguaguaguaaaugacguauucuuaguguucuccaguguacuuccugguuuccugguccucguaaguucuuugcauguccugcccucuuucaacuuuauucuuuccuuaucccuguaucagcuaggcugcgaauagauucacaaacaaagggaauguaauuggccgaugcauauuuagaagucacaugaagugugguuuguuuagagaucauguagucaguacuaaaaguccauuuuucuccuuuuuuuuuuuuuuaaacauuaucuuccuguuugaguucuuugcucaaacuugcuucucuccuguuaacaguguucauguuauggccuucauuuacugccguaggaaguuggaagacuccuagacacagcccagaguccucagcucuucugugauagggcgagcacagaucgauguuaagucuggagcaguauccguuuguccugagggcggaaggacugcagcacagcauggggcggagugggucccagacagggaauucaagucaucgagccuuuguauguucuuugguguguuuucuugauagaucaugccauucuuuuucuugaugauauaaaucauuucuguguggauuguccugauuucuggaucucuauucccacuaccacuguuugcuggguauuccuaucuuagaugugcggcuaaaauucacaugacaacaaaccgaaucaguuucgugggcaugcaucucuguccuaugguguguucauauguguuuguacguuuggcauucucuuccucccuauuucuuguuguaacugcuuucucuaguccccagucuugaaccuuauagucagguaggcucuucuccacugccggguagucaucagcucuuaaccacggguuaguuaggcuccaaguuacagaauacuuaacugggugauuuaaucaguaucucacauaaaaagaugaucagaguuagacggccucguggcuagucaauguagcugcacggaagguucucgagggcccaucucucugacugacucgucuuaguguauuaaccuuugaacauaggcauaugccgucaugguucuucauggcucccuuuuuccagguaucacuuaauugucuuugguagccaaaggcaaaggccucuuaucucuuaauuagguaaguaaaucucccacaaaaggccuguaucaaucaggugccucuccuaacuguaauauuuguagcugaagagagacagaguguccacggcauacuucuacauuguucuguggagagauaaauuuuaaaaagagaauuugcuaaugacaguagcagcguaaagcacuguuuagcugugcauuguuauaaaccauacauagacuauuugccaaacauuuugauaaccauaaauaacuguuuaaaguagauucuuauggaaaauuugcaagaaucaaauagccuguacucucccugagcuuacauuuuaguugaggacauggccagcaaacagcguacaucuauguacaggucauacuuaggcuuugaaguaaaucaaauggguuccagugauaaaacucaguacucuggauaagucuuaaaaggacuugaacggaggaaguaguggcagagucauggaaggggcuacuugggugauggucuguauuguccuugccaccucagucccuguuaauguacuuauuuauuaauguacauuaauaauauauauuuuaauguaugcuauauauuauaucaauauuauuuagaguacugcauauauuuacugaaucuuacauuuccuaugaacuuucuauguaggaucauuuuuacuaaucauaaagaauaugaagcucauacuuuaaauguucuccuggcugcuugaaaggucuuuguuuuccauucuucgguuuuucgagacggcuucucuguguagcccuggcuguccuggaacucauucuguagaccaggcuggccucaaacucagaaaucugcccaacucugccucucaagugcugggauuaaaggcguggucacaaugccuggcuaacgccauggcucuuaacauuuucuuuuaaaauaauuuuguuauguccuuuuaaggaaggaaaccuuuuuuaacuuuguuuuccacuuuauuguucugugauacaguauucuuuggacuucgugaauguauggaucaguucuuaucagucccacacauuugccagccaaaggugauucagauaaucaccuucaauucaguauucuccuuuguuaauuagguucuucauugugaugauuucugccucuuaugugcccugcccccucuuauuuucucuuaaaggcuuuauucuggacaguuuuguccuuaaaguaucuauuuuucaucuauaucuaauauuugaucacucauccgauaagugcuuaaguuauuuuuuccaaauguauguaacuuuuuauagucugcaguuccauguauauauaugucauauaugacauaugugauauauauuauaugucauaugugugugugugaaacuuaguuuggccauuauccucgugaguauaauaauuaggaguuaauuauaauaucugucaguuauaauaaucugcaaacuccagaguuuacaaaucucuacaucuguuggagaacuaauuugauauauaggaugaaaauaaucuuuuugugaagauuuuuaugugguaguaucaagaguuuggggcugcaagaccaccuuaaccaaauuucacauuguuaacucugccagacuaccugcuugacuuacaugugaucaaaggucacgaucucugcuaugaugugaauguggggaguggccugaagaggucauuauuaaaggcuugguccccaaggugcugcuguuaggcgcuguaaugugagauguugguauugguagugucuccucaaaggucacuuugcuuuuggggcucaugugaugagcugcuugcuuugacuuauguacacccaccaucuugugcugcucaccagcguuccagaguaguggagucaagagguuaugggaagcucuucucuuugugcuaacuucucaggugauuguuggaauggcaaagcuccguggucuccuaguucuuuguuaucuuaaaauggagggacccuugagaaccucggucccagagccaaaguuguuuuuacuauucuuggcagcugugucugggacucuuaguuugguuagcccccagucuugcagugaaagcaacauuaaguguuuguuuguuuguuuuuaauaaacucaccaaaagcaaaaguugagaucacuuuucugaguugcagcuuucaguggguuugaacuguuuacuucucauuauguuagugguuacuuggugcuuugaaggagauuguuuaguaucuaacuuaaaguuauuuucagagcaaguuggucugaauugcuuguuguucaauuuccaaagaaguccagacauuugacaacauguuccaagaagaccaaacauucuuuagucaucucuuuguguuaaucccucuuuguggcauacaugagagacucaggaaacauaaaaacuaacaugcaguuguuuucuuaauacucuauguuuguuuuuugagacaggcucucucgauaucccuggcugccucuaacuuggagauuccccugccucuguaauuagagaucugagcugagccacucccagcucugauauauguuauuugccagccuaguuccucugcagagcccaaggaagggaggcaggauacuguauuggauuguggucuaaccccugcagacaugaugugaacauuguaaagcgggacuuugcagggauggagaggacgagcgcugaguuaccagggcuugcaaacaaauugcccuuuaggguuuuuuuuguuuuguuuuguuuuuguuuuuuuguuuguuuguuuguuuuccgagacaggguuucucuguguagcccuggcuguccuggaacucacucucuagaucaggcuggccuugaacucagaaauccaccagccucugccucccaagugcugggauuaaaggcaugugccaccacugcccggcccuuuaguaguuuugcuagcacuuggguguauuuucaauaauuauugugagaacucuuaugcuaugugauauuuugauuuuuuuaaaaaacuuuuuaagauuuauuuauuuauuuuauguauaugaguacacuguagcuguacagaugguuguaagccuucaugugguuguugggaauugaauuuuaggaccucugcuugcucagucccugcucccucuggcccaaagauuuauuuauuauuauacauaagaacacuguagcugucuucggaugcaccagaagagggcgucagaucucauuaugggugguugugagccacuaugugguugcugggguuugaacucaggaccuuuggaagagcaguaagugcucuuaauagcugagccaucucaccagcccugauauuuugacuuuuaaaaucacauuuauguugggguguggguguccaccugugucacagcaugcauguggagggucaaggacuguguggggggccucaguacucuccuucccccauguaugucccugggaucaagugcaggcugucaggcuuggaggucagcaccucuauccacucaggcaucuugccagcccagggaguugugaauuuuacucucucagggacaaaauaggaguuuuaaaucuuacaugucuauaaaaugcauaauuuguauuugaauucugaguuugauuaaaaguagaagucaagcuuggaaauucuggacuuuacauuagugggcugucuuccuuguuuggaagguuauguuggaaauuuagaauaacauugguauuuuaaaauuauuugagaugccauccauaucugcaaucagauugaugcaucaaaaacauacaaaagcagcccucucgguaggaaaacuagaauugcuggguuuugcuugcuucuuuuuuguccucugccaaaugaauaacuaaagggaagagccgugccguguugguuauggcgccuuugcuuccugcguugucuuuccuuugcccacuugccuucagagcacuggaugauaaaguaagaagcgauuuuuagacucagaagaggcccugcaagcauggagucuguugggcucucccaacuugccaccuguguagacugugacguaggaaugcccuugucauuguuuccucacgugcuuucugcuucgcaccuaguccuaggcaaggccaggaugguaucuuaucagaucuguugaauggcuaaugcaccuugauuacuuacauacuuguugccagagcaguuaaucuuaggcuucaugaauuaaagaguaaauuuuuauuugaaacagucuuagcccaugguauagggagcuguuaauuuuugugccaauccugagccuggccugucuuaacuauuacuuacccaaaaugcuugagacgagaaguguuuuggauuuuuauccuuccuggauuuugcaauauuuauauaugcauaauuugggagugggacccaaguccaaguaugaacuagcuuauauuccucacacaccucaagcugugcauguguggacauagucauauagucuucugguugugccaggaccagacccagggccuaaugacaugaugagcacagacuguauuacucuuauuuuguacaucaguuuguauuuugacucuggccuguuacaugagacuugaguguucauuuuccggucauguugguacuuaccaaguacuuaauuaugggaaguuagauuugugguuuucagauuagaagugcucaagcuguuuauuuucugaagaguuuuacuuaaauuguaaucucaguaaagcaauuguguuagauuauguaccccagacaaggaacaaaugauacuauuugauacuguuccacagucauagcauuuaauagauuuaauuagugauuuuauuaccuuauuuccaaaaucucauucugcuugacugacaaauacuacgcucaguuuuuccuguuguauucuuuugugugcauuggaguguaguuucaguuccuuuaaccucagaccuucuacccaccucggucuuuuaauuucuucauaguuuuauuucagaaaaaucuuccauagguuuuauaaauuuccggcagccuuuccuuaguuucucacuucaaauacauuucuccugugucuucucuaacauuaauuuacauauugauagcauuuaagaauauauuagcuaucuguugaaacaaacuuaaggguuggaaaggguuacuguggacagguaucuuaaaauuuuuauuguuuaaauaguuuauccccuuaauuuuguguguauguaucugagucuaucuaaguguacaggagcuggaggaggucagaagaggcaucagaucccagaauggaguugcaggcaguugugagcagucaugugggugcugggaaccaaaccuguguucucugcaagagcagcaggugcucuuagucaccgagccaugucucuagccccuaaaaauuguuuuggucucuguacuucuuugguugaauacuuaccagcuagcugcauguauguccuaaucauacaucauauugaguugaaauuaaguuaugacuuucauagaaauuuaauacucacuuaaaaaccaagucauuccgggcgugguggcgcacgccuuugaucccagcacucgggaggcagaggcaggcggauuucugaguucgaggccagcuuggucuacaaagugaguuccaggccagccaggacuacacagagaaauccugucucaaaaauaaaaaaacaaaaaacaaaacaaaaaacaaaaaaacccaagucauauuauagaaaaaugaagucaguuacaacaauauaaugucuaugccaacaucaaaauuuagauauuccuucacuuucauaaaaaaauuauguauuuuugguauugguagaauuuuucucacaacuuaauauuuaauaaggaguugucauguuacaauuucccauuaguuuauauugagcuagugaguuuuuugauucagaauagaauuaggucuuugauagaaaguuauauuccaguguagccaagaacuuguucauuaaauauuauaaaggugcugagggcugaauuugaaccaugaaaggaauggcuuuucaccuguaaccaguggugagcacuuggcuuucugugccuggaaaguagcuggcuguaugcuuaggguuuuucuccuagucuguuucacuuuuguugaguuuccaguuaaaauguuuugucuuguagcugcuaaaggccuaugauucuaggagcagaggcuuccuguuuacugcuugaucuguaccugucauuuacuuugaguauuuuauauaauuuaauucuuacauaguagauguaaacugucauuuuauugaaauuaagcucucaucauugguauaagaaaaaucuguugagaauuaauugccuuuaguucuuagagaaagcaaacuuggauucaaauuuggcaauugucuuaguguucuauugcugugaagagauaccaugaccaccacagcaauucuuuuuuuucccucuuuccagacaggguuucccuguguggccuuggaacucuccuguugacuaggcuggccucagacuuacagaggugcacuugccuuccaagugcugggauuaaaggcaucuuacagcaaccccuguaauaaaagaaagcauuuaguuggggcuugcuuccaguuucagugggucaguccauucucaugcagggagcaucguggcacaccuacauggugcuggagaaguagcugagaguuguacaucuggauccccaggcagcaggaagagagagacaugggccugacuuaggcuuuuggagccucaagagccaccuuaagugacauacauaacucuccccaccaaugccucaucuacuccagccaggccacaccuccuaguccuucucuaauaguaccacucccugaugacuaagcuuucaaauacacgagccuuuggaggccauucuucaaacgaccaucacagcuuuaauuugaucaggaaaacccauugaacgucuaugugguucacuuguaagucuacaagaugaaggcauaacauauuuuaugcuuuuuaaauacauuuucugagcuuauaauauggagccaccucuuuuauacaaaagauaacuuauacagagacauuuaaaacucauaucccacuuagaugaacaaacauagaucguuucuugucauaucaccuugggugcucucagauuguaacacuugcuuauucaccuuaaccauagcugccccucccccucccaccaaggaguaaaugucuagacgguggaggagagcuugucuggcaggcacaaggccguggcuucaacccuuagcacuaagauggagggaggaguggugaugagcauaauuuuaggcuaaaaguaguugacuaaaguaguuugaaguuucucccacuguuuguguacaccuguucacguguguugguacacguauguacauguggagaccagauuacaaccucaggugucauuucuuaggugccauugaugguuuguagcuugccaaauaggcugaguuggcaggccagugaguuucagggaucuacuuguccugucuccaacagcugggauuauaagugcaucaccacacccagcuuuuuagaugucaguucugggguugagcuugggugcuuguugcuuacaagaaaagcacucuaccaacugagccauuguuuguuuuuuguuuguuuguuuagguuuuuguuuuugagacaggguuucucuguguagucuuggcuguucuggaacucacucuguagaccaggcuggccuugaacucacagacauccaccugccucggccuucuaagagcugggauuaaaaggaugcacuaccacugaccagcuaucguucccauuuuaaacauaaaagaaaucagcuuugucaagaaacagacuugaacauuuuuuuaucuuugaauagguauugcaugcaugcaguccacauuucagaacugcaacuauuuguauauaaaacgaaaguaaaucuccuauuuugccucucagacauccauagaagcagagauaaccaguuaccaguuucuuauuugucuuuucaaguucuaucccacagaaagacaaauuucaauaaauugcucuggauaguccuuuggagggcagaaauguauauuauuagaguauuauauucaggaacuugauguacuuaagaauuuucauugauaacuuguucacacuacaacaaacuuuucaucucaaacacuauaaagcaaauauuagccaacaguaaacagccuuugaucacaaagcacuucaguuuggaaauccuacuguuuggaguuuaaaaguggcuccaugaucagagguuacaggaaaauguggcuggggcagcucaguuuguagccacugggcaggggauuucaaggaauguccacugggaauuaccaggcuaaggggagagaaucagagucuugugcuaauugcuuaccuauauaaacaauuuuugucaccuugacuggagcuagaaaauucacuuccaaguugacuugcacacucaccugacuuuagguuaguguugaucugggccccucauguaagccucucuccaggguuccuuaaguauccuguggacagugggauugguucuagagucaggaaaccaaggcaggagcuaucaugguuucugucaccuagcuguggaggucccuaacccuuacagcaucuccuucaucacacagcucugccuuacucaauauagaguuuuaaagucucuagggaucaucuuggaaaguggucgucgucccucaacauaaccucuacacauaaggauuacaauaacuuuccuggcuuggugucuguaguuaccucaaggauaagacuuucagaguacuuucuacuaugcaugcauugaucacuuacuguuuggaauaaugcuugcuggucaaacuugaggccuugcccuuuaccauuugagcuaccuccccggcucuugcuuaguagcacaggcuaccugcccuugaauucccuguguaacccagguugaccucaccuucacuuccuuuguguugggauuacuauuacaggugccccaccaugccuggcuugguuuacuuugaugacuuucucuuugauauuguaggacacauguauuagauaugguucuccagaggaagagaacccagacagaggggugugcugggagggugugcuggccaucuaaaggguggagaggaagggaagaagcaggugugaugcagucugagucagaaggccugugggggcggggcugaggaaugaggggcugccugauacccuggagacagagccaaggagcuaugcugccuuaacccaagaagacagagcucauccuuccgucuuuuuuuuuuuuuuucugucuagaucucaacaggcuacaggaugucuguccacaugggugaggauagucuacugguugagaugcuaaucucuuucagaaguggucucucauagguacacuaauaacacgagauacaccagauauuugggugucuauuaacagucaaguuucaucacuauuggcaaaucuuguguuacucugcuauagcuguuacuccuuaaucuagccaauggauugucauccagauuuuaaugggcauaggguaucuuuuauucauaaagguaugaauuuuuacuauauucugcauuaauuuaagaugcugaaauaauuaugcugcuugaauaguguggaagaauaagugucacacuauaagauggaacuggaaaauuaucuguuauuguuuaaagagagcuuuugaugggcucgggagaugacugucagcacgcuugccacauaagcaugaggaucugaguuagauuccagcacccauguaaagagccaggcguggcagcaugcgucugugaucccacaccuacucacaguagggagguagacagacagaggauacauacacauacagugcggcuugcugacccaccaggucaaacugguaagcuccagguucacugagagacuccaucucaaaaacgaggaaaggagcaguugaagaagauuuuacacauuaaccuuggccuucagacacacugcacacauauguucacccaaaguaguaaaaauacccaagguaauuuuuagaaaugaccuugaaauauuuaguugcaagaggguguaaggacagaaaagucuguaaaucacauauuuauuuaauucaugugucucgugcauccaaguuaaaugucagguagguaguugaauauucaggggauaagguuaagauagaaauaccaguuugagauuagcaaauauaguugaguacuaacuagguaagaaaaugauaauguaaguggacaauccuagaauaaacuaucccuuagauaacuagugaagauuguuagugcuuuuaaguaaaaguuuuguugcaguuuuccucuuaacccagauagcucccaaauaauugagucuggacuaugauauuuauuucaagcuuuaagggcacaacaacugaacaguauuacucuaucuuaauccucuaaacuaaucuugcuaccucucagucagaaucccagugauacuugcauuuuaguuuugcugugguucuccgggcuccagguguuucacaugaugucuccuggacucuugucuuucuccuucccuccucccuuggcugggaagaagucuaucccuguucucuccccugcucagucauuggcugaucagcucuuauugacaaagcagagaauaaauggggagcaguguuuacauaacauugagauaggaaauucucaggauaaaaauugcaaccagauaugggggacacagaaaucaacacuuggauaaucuucacacagugcccgauaacauuauaccuacaaaagaggcagggcuauucagugaaauuagaaggaggaggaaaaccauuagaacaugaaauagaagcucaaaguugaaguaugucuaagaagaaagggaguagucauagucaaauauuacuaagcagauggaauuugaccaugucuuugacagaaauuaauaucaaggagggauuuguacagauuaguaauacuagggugugugugagugagaaugguccacuagaaaaggagagauuauguagagagaaaagacuaaguaaaacgauaaagaguggcuagguaaaaucuauugcauagguguuaaccuuugauagccgcaagggaaccuuagaggggguaagguuaacccacacuuauggcaccagaucggaaagauggggacuugugcuuggaauugcagcacuugauaggcugaaguauggggauuucugugaaaucagaucagccuagagacaagaauuggaacaaaagagacaaacaacaguagggugggcagcuggaucugugauggucauaaugaaguugcuugccuaggguuccagucaccagccacuaccgcccagcugcauauaccuugagaugugcuggaguaugcaggagguggaaggcugacuuugaguugucggcaguggaagaauuccccaggucagagcagaaugggaaaggcagguuuauuaaaaauacugcaagggagcugccgccauaggaagacagcgagcuguguguguaugcuaguggccuuuguuugcuguucuuaacauacaugguugguugguguuugacucaggggugggggucggggcaggguuuguaggguagaaguucuguguuggaaguucaugggauaguuaauuuugauuggcugugcucagucauagccuuucuguagugcccaucaaccuaacuugucccccacagcuaggacucuucagugguccagcugccugacuuucuuguuacccuuucuccuguaagcaacaugguaaacucauugguacccuuagcuggucuuggauggaaucuuuuuucuggucuucaauguccucugaauaugaguaaaguagacauucauuuaugucuucucaggaaaaggcaugcuacagauauaauuauaaaucuguguguuauacuugacaggguauguaaauaguuuuucuuuaguaguuuuuauauuguuaaauaauuguauugauucccugagaaucuaguacaauauacuuugaacguauucgacccugccagcacucccaucccuucccacccaacuguaugauuacuucuccuuuuccucugucuccaucaaauccagcuugugguccagcuagugcaguaguaguaggauuggggccugcucuaguggguuacguuauuaaaccaacaaacaacugacucucccucucccagcagcuauuagguauuaacacacacacacacacacccucacccucgcacacccuuccucugccaagauuuagucuggcuagagcguguucaggucuuguacaugcuguccuguuguacauagaaauccaggcgcuuuuauuguaucagugaaguuggucuuuaacugagcacaucauagguaguaaaaauagauuuguuccagguuugaggagacaugcaaagcuuagaggagggaagcaaacuguguaggaaagaguagcucugcuaggcagugucgagugcccugacaugucuauacguuaaauggaaaggaaagugaacuagccagcugucccugaacaguaagagugccacuuaguucuguccccagcgugcagaggaccuacuucauuugugcuuucagaacuuugcaggcagcguacuguucuuagggccagaacaguguuguuuguuucccccucuuuuagaagauagggugccaacccucuacuugcaggcugaugaguucuuauauagucagcuucugugagacaguuaccaaauucccccagaguguuuaucacuucaguggauuugucucucucucucuguguauucacuugcguguaugucuguuugucuguaaaaaagaacuuuguacucucagucaugaaagacuacuuacuuagaaagguacucuccugccccacuuauuuuauuuuauuuuauuuuauuuuauuuuauuuugguuuuucaagacaggauuucucuguguagaccaagcuggccucgaacucagaaaucugccugccucuaccucccgagugcugggaucaaaggcgugcaccaccacgcccagcuucccacuuauuuuauugaaaaaauuuuuuuaacauuaaauagcagaauucugaggaaagacuaagaaaaggcccuuuucauguucuaugggauauaguauggcuuaacaucaagagacuuuuugauaguugauaccaguugagaaagguauuugaaugugagaugaaauuuaguucaguuuuugaaucuuacuuuugguuucuauaaaagaaccugugugcuauuucuaccuaaccuuggauacuuuuacaaaagacauucuuaaagacuuaugaaauuauauguuuccauucuaaauacauuagcuggacugggaguguauuuagugguagagaauguacuuugcauucagacgcacuuguccccagaaccaggaaaaggccaccacaucugaucugagggagggaggucucauguguauucugugcauugaauucauuccucucaucucucuaaauguaguagagacauucuuuaugaauccauugauuagcgacucguuuucuuacugaaauaaagugaaaucuguguguuaagugcuaccuguaguagcccagaaacccaguuuucuguucugagugacaacauuguguuacauuaaggaagguuuauaauuuguuuuccacguagcaaacuuggauuauuuggccuguaauaacaagcuuuucuuuuccgauauacagacauuauuguuuaaagugcaagagaaagcaaaaggaagauacucaaaagaagaaaucggccuaucagcagaagaugcugccgucucuaauugcuauagaguaauagaaaaaggacaugugggcagggccuuguuuguuuuguuuuuguuuuugaaaguacaagcuuagggauauugccagguaucuagcacuugguucagggacccagucugggcuacaugagauauugucucaaaaaaccccaaaacaacaacaacagaaagcaaacagacagacaaauagaacuaggacguauugguaugaaaaucaaucuuuugagccaagaauuugguuuaaaguucuaaucauagcauucaucaagcacuauauugauucuuuucuaaucuagguuugggauuuaaaaguuaaauuauaauugauuuuucuuugcaaguucugauauagucaagggcuaauuuauauuacaaaguaauaaauaucucaucagguaaccuagacauuuuaugguaacuggaauauuaaugagaaaauugaguccuguuuuacuaggauaaauaauuucugaaaagcaggauucugugugcucuucucuccuauagcccucccuuuauauucaugucagauagacagacagauagauagauuuugcaugagaggaaacauguuugucuucccucauuguccuuccaucccaaauaaucuuccuuguuaugcccacacauguacacacacacacacacucacacauguacacacacacacacacacacacacacauguacacacacacacacucuuuguacuuuucguaugagugagaacaaagugcuugucugagucugguuuauuuugaguuugccaauuucccugcauaugauauauccccuccucauccucccaugucuaaauaaaauuccuuucuuguauuuuuauuacauuuaucugagauggacagcuaggcuccuuccacauagacugaauauugccacaguaaauaugaacguugaaguaucuugguauauuugcucagguuccuuugguuguauagcuaaguccuuuggugguacuaguguuaguuuugugagaaacuuccauguugauuuuuguagugacuugcuaguuuaauuuacagucucaccagcaguauguuggaaucuauuggagucugcugcauccccaccucuucacuagcauuuguuguugauuuuuuuuuucauucugaauagggugagauguaaucuggugguguguguguggugaaguaagggguguguggggugguguguguguggugaaguaaggggugugugggaugguguguguguguggugaaguaagggguguguggggugguguguguguggugaaguaaggaguauguggggugguguguguguggugagguaagggguauguggggugguguguguggugagguaagggguauguggggugguguguguguggugaaguaagggguaugugggaugguacaugugggugggguaagggguguguggggugguguguguguggugaaguaagggguauguggggugguguguguguggugaaguaagggguauguggggugguguguguguggugaaguaagggguguguggaaugguacaugugggugggguaagggguauguggggugguguguguguggugaacuaagggguaugugggaugguacauaugggugggguaagggguauguggggugguguguguguggugaaguaaggggugugugggaugguacauaugggugggguaagggguauguggggugguguguguguggugaacuaaggggugugugggauggugcaugugggugggguaagggguguguggggugguguguguguguggugaaguaagggguauguggggugguguguguguggugaaguaaggggugugugggauggugcaugugggugggguaagggguauguggggugguguguguguggugaacuaagggguaugugggauggugcauguggguaggguaaggggugugugguguguguguggugaaguaagggguauguggggugguguguguguggugaaguaagggguauguggggugguguguguguggugaaguaagggguaugugggguggugcauguggaggccagaggagaacauugagaagcuuuuauuuuuuuucucccccaagcccacuccaugccuuuuuguuggaccuggggucuaacugaacauggaacuugccaagacagauugccugguccagcaaagcaaggcccuggggugguccugucuacucccuaaugacagaccaaccgauggcacucugccuuugcugugggcacugguguccagcccaggcccuggggcucaugcacaggcgcgcucuaccuguggagccaugcgugcagcaggcgcucuauccagcucccagcugaguguuuauccgaauuuuccacauagcuaaggaggcugauuuuaaauguuuuuuuuaauauguauuuuagcuguucagcccuugccuaguguauaguaggcagacuuuuucuucuucuguaagcuguucuuuguuguguggaaucuuuuuaauuuccuggaacccacccaucagcccuugcuguuaucuccugagcgcuugaugaucuugucagaaagaccuugucccugcuucucucuugaagggcuuuuuuuucucuagcucuucuuaauuuccaaguccuacauuaaagucuuuggcucauuuugcauuuauuuuucugcaggguaggguaggcaauuggucuagauccauccuuguacaagugacugcacaguuucccagaaccauuugagaauaucuuuuauccagggcacuuuuuuuuuugacaccuuugucaaaacuaagauguuuauuuucugcuuguuauucuguccaguggacauacugccugugccuauacuguccugguuuuguggucugaagucuauuuugugauuuuuuuuuuuuaguuguuuuucuguuccugcuaauaaugucauuagauccucuagauuauccagagaaacagaaaauagcucuaaaagucguaccgaagcacaaaagaccccagagagcuaaaauacucaaacagaaugugcagugguagagggaucauaauaccaaauuacaaaauauauuuuagacuuuaguaacagauuuuguuccuuaagaaagagcaguuuauuaugugccuugacucuggggcuuuaacagcuuacuauaguaagaauuuaggaaaaagaauuuaaagguugauaaauaaaauuccuauuauagucacacuauauucuuuuucuuaagguuuuuuuuuuuuuuuuuuuuuuuuuuuuuuuuuugagacaggguuucucuguguagcccuggcuguccuggaacucacucuguagaccagguuggccuugaacucagaaauccuccugccucugccucccgagugcugggaucaaaggcgggcgucaccacgcccggcuauucuuuuucuuauaaacauguuuuuccaguugaaaauacuuucaagcauuacacuuagcuguaaauuuuaaggauauaauuucuuaucauuuuuccuuuugaguaggaagagacgcuaguccuguugccuuuuguagauuuuacucuaaucuuacauucuucucuauuuaaaaauauguauuccauugccuguagaaggaagcuuaaaguugaaccuaauagguaagaugaaccucucagcccucagcaccuucagggcugcuucugucacugucacucucuagucuccucuugauaagcuaggcguguucugaccugccaucuuuuaaccauauaaaacuugaaucagcuaaugauuaaagcuucuauuacacaugccccaguccuucccagguucaccagcugaugcugucuguguuuaucauuauguccuguaugcucacacacuuaacaaaacacgugagacauuaccgugcagacugagaagcagcaaggacaggaacaucaaggcuccaguccgggaaacaacgagaggacaguuuaauaaauguauagagagggccuuuucuaguucagaugcugcgagcacauauagaacaccauggugugugauagaaagcuggaggaccagagugguggugaggcuaucauggagugucuuuaaaaauggagggcaugaagaaacaggcauuaagauuuggggagcagaguucuuugauuacuggggacugaaucaaagguuuucuucaugguagguaaguacucuuauacugggcuggacccucaguucuuuuuuguaagcacauacacauauccauacacagacuuacacacauacacauaauuaaaaauagaguuguuggcuggugagauggcucagcaguuaagagcacugagugcucuuccagagguccugaguucaaaucccagcaaccacaugguggcucacaaccaucuguaaugagaucugaugcccucuucuggugugugugaagacagcuacaguguacuuuauguguaauaauaaaucuuugggcuggagcaaguggggccgaagcgagcagaggaccugaguucaguucccagcaacugcacgauggcucacaaccaucuguacagcuacaguguacucauauacauaaaauaaauaaauaaaucuuuaaaaaaaaguugcuuuuuaaaauguuaagagaaaaugcauagccuagguuauaacucagugaugcacugcaucguacacaaggccuugguucacucuccaacccccgacucccaaaguuaguuggcauuguauauaaaauuuaaauggucuauauuuuuauuauaucacaugaauuauguaauuguuacuuucuacaauauucuaaucuuggaaagguuucagaaguacaguuaaccaaccuguuguuaacauucguaaaguuuuuaacaucuuaguaauaaugcugaauauuuuuuuacaauauaaauauuucucucucuuguuuguuugguuuuuuuuuucucauuuguauuuuguugauacuaggauugaacccagggauaagcacuaucauugaacuguaucccuuccucuuguuuuuaauuuuuuuuaugugcaugaguaguuugccuacauguaugugucuguaucauguguauguuuggugccugccagaggacagaaaggggcaucuuauacccuggaaauauaucucuuuguaggcagaaaucuguucuuuuuuaauucuguaaagagaugguugaauuuaccauuaaaagcaagagucaacuaagcuucucaaagaggaguauugauucuuacucacuucaaaaaugaauuaauaucauuaauguccuugucaguucuuuaaacugucaaguuuuuuaaaaagauguaguauguacuggucugguaugaaauugaacgguacucugagggaggagugaggaugauuguaggaaagauggaaaaagaugcaagagacagacaugggagggcugcagguccuuaccacgccagccccgaguauauuucucauacacuucuuauacuacaguacuguaggaagcaaagccauaagccaacagaaacaguuuugcugaaauguauguauaagacauuuguucucaccuaaaaaccucccuguuccuuccaucaaggucaauagaaucuucguccccucgccuugagcuucaagugcaccuccucuuaucaugccaucccucuacaggcugggaaaucugccaacagacgaugaccugccuugacucugccugacaggcagacuuucuuuuuuucucugcuucagagaagcggcaaacagcugcugacagaugugugugcgcgugcgugcgugcgugcgugcguguacuguguuugaaugggugcccucugaggccagaauagggcaugggaucacccagagauggaguuagagacagugugaacuuucuuaugugagaaccgaacuuggguccucuggaaaagcauucuuuaacugcugagccaucucucuagccccuaauugugagucuuaaauugggcuugaugaauauauagaacauagaacauacaguugaagacuaaaaaugucuauuaaucuuauuugguuguguguguauauuaaauauauuuguaaaaagccuaucugucuauugguuauuuguuugcuuguuuguuuguuuuugagucaggguuucucugugcagcccugucugucuuggaacuugauuuguagaccaggcugggcucaaauucagaggucugccuacaucugccuccugaguguugggauuaagguguaaacuacuaccauccagcauggucauaaauuuuuuaagguucaaauuuucaaagauaaauuuaauucgcuaucuaauagcacuuacaaaugaagccauuuauuaaaaacaaacauaaaaaugaacagauauuuaaaauuagaaguauuucugaaaaaaaaugaaaucuuaaaagucuugauauaaaacuuauuucaguguuauaauuuggauaaaaguuaucuuuaugcaggggcaggcggauuucugaguucgaggccagccuggucuacaaagugaguuccaggacagccagggcuauacagagaaacccuaucucgaaaaaaaucaaccuucccccuaaaaaaguuaucuuuauuuuuuauuacuucauccauuugugugagagagugucccuauguguaggugaggggcccaaaagaugguguccuugaaguuggaguugcaaguuauugugagcuaugcaagaauacuggaauccagcccucagcccucaugauagagcaucaaaugaucuugacagcugagaugucucuguagcccccaaauacuaucuuuaauucauguauauguaaugcagucauagcauagaauauagauauaggagcucuauucuuauauauguaucgccugguacuuauauaucaauucacacuuagcaaaagguaucaucauuguuuaaguuguuaauuggaguuuuaaaaaaacaguaaguuuaaaagagaauucagucuugaggaagcuggcuuaaaaaggcuuuuauuggauaauugagguuuuuguuuuggcuuguuuuuuuaauaauccagauggccgcaugauuacaguauaaaaagucuuuggguuucuuguacuugaacuguagugguucagcagcauauaccgagcauagcuuucauugaaauguagucauuuggugaaccaugucuaagaaggcaguggguucauucuccagcgccccucggucauugaaccacucaccacuaguagugcaugugguaaaaauguugacagguuuugaaugucaacugauuucuuaaagucuaaguuacuuuuaacucauagccugagucaaaguauuaggcuuaauuguuucauagacuauuagaaaauuguuuugaggaacuuuuaaaguacauucuugauuuuacaagaugauuuuucuuucuggaaggucagucauguaugagaaauucugagugugucacagaugaugacuguacagugagugaguccuacagagugagugcgacucuuccaguuagaagaucuuaaaagccuuuguaaaaccaagccauuucaugaaaggcacuuaggauccagucaaggcgauucacagguuuccuuuguucaguaugacuuuuuuucuaaauauguuaagacuuuaguguauaauucuaguuacaguuacaguguggucagucuacagaaaaagaaaaaagaacuuauuuuccacaaucucaacuucaaaagaauaacucuauuuuuguuguguuuuaucucuaagauuuaauuuuuauuuuauuuguguauuuguguguggguuugugcguaugagugcauugcugguugaagucuggagagggagucagcugcccuuggcuauggaguuacaggcauaagguugcaggcagugugugcaggagcaguagaguucuucaccaccacacccucuccagcccucauuuucuauuacuauauauaaaaugucuuaggaaguagaauugccucuuaaaugcuacuuaacagcuucuugucauauuugaaaaaauacaagaaguuauaaugaaucuaauucauuuaaaaaccuaaaauuucguuuaucuuuaacacauaaguagauaggggcuagggcagagauacagcuuauuugguagaugcgugccuagcauauaacaaguccuggcuucagugccuagguccucauaaacuaugagugguggcauacaccuuuaauuaauaccaauuaauaccuuuaauuaacugauaccaaaucauggaggcgaaguccagggucauucuugguucucuuaagugugaggccagccugguugcacaaggcccugucucaaaaucaguuuuaaaaaauuuccucuuuuaaaccgagcuuaaauuaaacuuuuacacuagaacuuaaugugacucuuguccuuuuaacucagaaaucaguaaaugaaauguaacuaugcauuaggauugguaguaauuaacagcauguauuguaugcccgggggugcuuuaaauaugcucugcauauaccaauuccuauuuuaugcuuguucucauuuuauaaaagaagaaaucuaaucaccaagaggucaagugacuaguuagagggugggaggagcaaaagcauuuaguucaggcuggaacucugaggucagacacaagucacucugcucugucaucauggcuuuucuaguagcuguccgaaauacaguuguaauuagaguuaauuuaccgaauaaguuaaugauuugcaaugucaaguuauucguugucauucgcggacuagaauuauguuucucugcugcaucugaaucaugggaaugaaaccuauuuacugccccucccaccgucaguauccugcaucccgcgcggggcuuuccacccugcggagcuccugguuaugagagucaguccgcgucaggcucucuggguuugccgagguagagguuugaaggugcacaagaggcuugguguuccucuggacagugcagugcgguggagucgggggggggggggggucucuguccugcugugaagcgcggucagaagugugaagcagcuguguaauccgcuggaugcugaccagggcgcuccccauuccagucaggagccugcagauuggcugggcguaggcacacgugaccgacauguggcuguauuggcgcagcuugccggggugucacuggagacagaauggaggugcugccgggcucgaaaaugggguaggugcugggcugugauggccagguuugcuacaggggagagggaggaggugauuuuuccguggacugccuuaaaccguugaccuuuccuuggcucaggcucugcugccacaugccaagccugggaggcaggggcgucgucccacuccucucccccaccccccacugcaguacaggagaugaauuuccugugcuucugauccugggauuuugacagaagaggaagaaagggggagggguagaagugguaaggggaggcuggggagaaagccguuuuguuuuuuauaaugccuguugacaguggaguggaauaacaguaucuaaggaaacgaguagaggacaacaaagaauggagcauagucauggcgaggagagaaagcccuagcccuuugaaaggcagcuuuuccuccuuggccacaaggacacaggcagugguagccaagagugggcauucaaagcugcagcugauggcucauguggaaucuagcagaaaggacucccaaggaugggaggaaaaaaggacaugcacugcggagcccaagugaucauuugguugacuggcgaaauauuguucaguaguaauaugccgcuuuuguacaacauauaagugaacucgccgagaauaggguggcaaagagauaccagugucuuuguuagcuccagaaugcaguggucgaggcuuucuguggugacugcagcagggcuuugcuguagacaacugcagagcucugaguaagugccccugagcacuuacucaguagcagaccgccgcguacaagacgauggcucagagcuucuccccaaauaggagaaaacacauauuuugcuuuuuaaaggaggagauauaucagauuaugaauauuuuggcaguaaaauguaucaaacgcuuugauuuuauaucacaagagagaugccagaugguuugauuuaauauaaauccuauaggaaaucuuaaugcauuauguauggaaguggaucuuucccuuuguuagucuagcuuuuaugcuguuaauuagaucauccgagaucaaaucacuuuagaauguaaauuacuuugugggcaguaaauuuuuuauaaauccugguacuugaaaccuauauuuauuaaguaaauuuguauuucucuuuuguuuuuuugaauuuaauguaauaaaaucuacagauaacuacuuuagauguacgucaauuuacugaguauccauaagauauacucaguauaaaguauuuuaaugacauugaauuguacuuuuacuuagauguuuaaaaguguccaucugcaggucgagucuucgccuuauuucuguguaugucuauggcaaccuccugcacuccugaugcccugaacuagacuagcaguggcuuuguggagcccucuaggagcaguguccaaaacagucccuuuuaaauuuaugugguuaucuuaagagaauuuccaauuuugucucaguaguuuuucaaaauaauaaagaauuauuacuugaguaaauaauaugacauaaaauuuucauugacaaguuagaacaguuuauucauuucugcuuugcucuuuguugcuguuuugagacagucucauugucuaguucagacugacuuccaacuuacuguguaccccagagcaaauucaaacuuucagccuuccaagugcuaggauuauaagacuaucccaguaugccaggccuaacuuuauuccugaauuuuguuuuguuuuauguuaugugauuguuaauaucaggauuaaaagugcuuaggauagccuuugaaucugauagaaaccauagcuaggaguaaagcuaucacacagagcugacaagugaauuaguagcuaacauuagccaauccccagaaucugaguguaguucuugagcuuaucaaauucucauuuucacagauauugccucauuuaaucaacuagcgaauguagcauuauuuucaauuuauguguuucccaguucucuuacucggguguguguaaggauaaauacuucaguguauuucacuucuauaaaauuacuauuaaugucucaguguagagcauacaaaauaguauauggcaauugauuugaaaagcagugucaugccuguggacaagaacccccacaugaaugacuugaauguuuucuuuuuugagacaggguuucucugugucccggcuguccuauaacucacuaugcagaccaggcugccuagaacucacagaaaccaccugccucugccucccaagugcugggauuaaagacuuacaccaccagugccuugugaauuuuaacuaugagagcgcuuuagaaaagauuuuauagcuuaaguuacauuuaucuguucauuugcuuauguauuuccugugugugucgguacaugacagccuaacuggacuugauucucuccuaccauguggguuccagggaucaaacucauuuuaucaggcaugaugacaaacacuguuaccuguggaaccaucuugacagccccauucacuagcauauuuaaaaaucaggcuucuaaacauuucuacauuagguugcaguaucuuucgaaguuaaauaaauagaagacuaauuaaaaaaagaucacuccuauuuaguguaacauucaguauuucacugggcuuuuguaaucuuuaaaauuacuuauugcuaauuacuguaucuagaauuaugugaccuguuuagaaauucauaaauuaaauaaucaaaaguauguuuugugaacugaaucaaagcuauucacgauuuuguuugcaugaauuacaauguagguuuuuaucucccuguuuuucuccuuuacugauuuuccgugcugugacuaguaucacaguuguacauguuuaaacgcuuugugacucuaaacucguuucccguuggagggugacucugagcgaagcccucuacaccagcgccugcagugcgcuagcacuugauuuaggaugacaggagcaccugaggaaguauaugagcuacauacucaccagcgugccagccacaugccagaccucgggaaggaaaugaagagccaaauaaagccugggaacgcaccuuucugagacacaaagcgaaccguuacauugaaggcgcacugaacacugguagcuuuagcuagccuugggcaccuuuuuuuuuaaaguugauauuaucugaaaugugcugugauuugcagggaaaggguagaguguucuuugaggauguuauauagggagagcuuccuccucucuguuuccacuucuccuuccauucuuccgucaaagugugugucuugguuuuguacugcuggggauugaaccccacagccuucaugcuacacgagccucuguggugggggccaggagccuuuugaaguguacaguucuugguguugaaugcaucgugcauccacagcugcugucaucuccagaauuucuucuuguuguggaaacuuuugagaacauugaagccccauuucccuuuuuucuugucaccuagcagucagcucacuacuuuauaccuuugugaauuuaccuguugaaggaacuuguuacaaaaagauucauauauuugaccucuugugacuggcucaguucauuuagcauaaugucuucauauaucguuuaaguuauaccaugcuuuaaucuccuagguuuuagcuucuuuccuuuugaagcuaaggaauacuguuacgugcacacuaccuguuguuuauucguccaccuucauucaggugugcucccaacuguccccaguagugcuggguaaucaugugugcucugagagcuguugucuuugcuuucauguccugugugugcuacccaaauguuuuaacucacugccauuuugaaagaccuacccauuuuacuuccugcccacugauuuugugcugcuaacaguuguaugccagccuguaggguuccuuuuuccuaauucuucuucgcucagacugcaguggucuauacucgcucacgacugcucacuggcugucuuagguaugcuacuaucuuacacagcacacaacacuuacuggcuugagguggcguugugcuuagguuauaagcaugugacuguuucuaugaagaggaguucaggagcaucuugcuugugugagaaaacucuuaauuucucgggaagcuucagucaagauuuuggucaucuuggcagucauggggucuugacuagacccgaggcucauuccaagauggcucccucauagccucagcuuccucguggcuguugucaagcagucucaguggcuuguuuuguggaucuccauggaacuucaaugucuugauggcauagcagcuggcuuuccccaagugaacagagccagagagaggaaaacaggaaagcacuugugacuuggucucagaaugucuguacaccauauuucuguuguuucccuuuauuaagagcuacugagucuagccuuaaaaaaaaaaaaaaaaaaaaaaaaaaaaaaaaagaccaguuaggccucuuaccggaguagagucagagaaucugcauaaacauuugaggguuguugcaugaaccaagaaaaugucacuggaauuuaguccuaagagaaguacguugucaucauauuggcaguguacuguuguaaaaaauuaccacaaacuuaguagguuuguuauguauuugugaggauuaguugguugguugaauuuuuuguuuguuugguuuuuagacagggucuuuauagcucagguuacccuugaacugugcauguagcugaggauaaccuugagcagucacugauuuucucacucuacugcugaguuucuggauguauauccaguuuuauuugguggugggaucaaauccagggcuuuaugugugcuaggcaagcacccucccaacugagccacagccgcagcccacugcaugguuuaaaacaaaauuuacuauugaccuuucuugggggucagaaguugacaugguucucccuguacagugaagaggcacuucagaggcacugcguguccuaaaagcuggagagaagcagucaucuuugcccuucuuuccccuggcuucacucccuuucuucauccucacuguuauaaucugucucccucugaaccugaugccuugcuucuguugucacgcccuuuccugacugacccuuugucuuauucugaggacauaugugguaacauugguucugccagaguucagaagaauuugcugcacaggccuuacuaaucaccucugcaaaguccucguagccaaggacggccaugugguuaugggcuugggagaugacggugcgcacagcuuccuggauugccauuguguugccacagguguccuaacacagcuuuuuuuccuugaagcauuuuaaaaauuaauuuugaaaaucauucuuuugugaaugaguguuuuucuguauauuaacuacuuaggacuuagucuaugauagaaacugaaagacuuuuugcagcaccuuuuauggacuuuccaaucaacuccagccucuuuauacuaucuaaccacaugcacagugguguuuauaucucucccucccugguuuccgugauuccucuauaugugagguaggugugugugugugugugugugcguguguguguaugucugugucuaugucugugugacugauguguguguguguguguguguguguguguguguguguguguguacacacacacauauauaguauuccuguuauugaacuugggagucacaaccggugccccagguugggucuggucacccauccuuagugauuaaaagccaauugaaagaaccaaauugaaaguggaagcagaagacuucuucaguguggccacauugggaagagagagaugugacucccucccccauccaucuucucuguccuggauugacacaaggacaggucacccaugaugguaggauuuguacaucuaagcaguucaggucaguuaugugaccacuaccaucaugggugaccugucuuugucuggacuuuagucucauucuguaaucugaaaaguuuuuacaacuauguggaaucucuuuccaggggacaaguuucccucugcuucuuccaucaugagauucuugagaaauuucuauuucuuugaggaucccuauuucaauaguaugauagucagacggaaagacauggguaucccuuuuguaauauccucauuucugccacaucuguugccuuucuuuccuggaauacauuuguauugaugucugcuguggucugacagaugaagcaguugugagccaagagaacaguagguggcgcacacagucugauagguccuuuucaaggaguagucuccugccccccaaauuccaguugaccagaacaagggacauauuagcuuaucuuuuauaauauuuucccagagcuauuuuaacaaagugccacagacuggugguuuagaacauuaggaaucccugauuuuacucuuuuggagaccagaauauuagaaagauucuuucugaagacuccaaggaagaaccugucucuuucuuaguuuuugaugcuugcugacauccauuaccucacagcugaguccucagccugucuccauugucagacaguaucccuacugugugucuacuuguaucuguuuagucacauggccuugaauugcaucagucauucauuuagaucccuuuuuaauacaauaucuuagcuuuauuacuaugcagagacccugucuccaaaagguucauaucuauagauuccuaugacucaagcacaacccaaaccauuguuggaaaugaaaguuagcaacacauaaaagaacacacaaagcagaaauaguuuuccaaggugauuuuuuuucuuuuuguaaaaaggguagguaccagagcccaaccccugcuagccaucguacucugaaagugaaaaccagcagcugggcuugccccugacuuagauggagacugcaucucuucccacugauggagcuuggcuuuguagucugacaugauuggugcugucagcacagaguggaaggggcguaacuacuuuugauaggaaaagguuucuuauaccacuaacccccacccccuuauaauacuaguugauaguguauggauaagaaguuaucagauauuuuuuauuccauuauguagccacagagaggaauccauuaugcuuuaauggaagauaaucuuuuuguuuuucuuugacuuugucuugcuuucuguuuguuugcuucuguaacugaaagggcauuucaugucuguuuuucucaugcauuuaucuucugugugacuagaauugggaagauuuuuuguggaauuacagaagcuguguguuacauacaggccucuccuaaagaugugugugugcgugugugugugcacgugugugcguaugugugcacgagcgcgugugcuugcgcuugccuuagcuggggagacaaaacaugucaaaguaaaauagagugcaguuaggccaagguuugucauauuuaccacuccuuuggcaggagugugcaguguggacuacaauugucaggaaggcuuugugugaggcagcugaucuggaccuaaaagaauaagaugcauccuaacaaagcagaggaggaaacagccuggcauccacagaggacguuaaaguacauacaugcauacaugcacacacacacuccaaagguacucucaauucuuuucuagacuuaugaaaauuagucagguuccugaauaccaagcaaacuuuaaaaaagcuaauaccagugguuuccacacacagucuguggccagucucaaaggcagcagucagugacaguaaaaggacugguucuuuguaccuuguagagaagucauugaaggaacaaaagaccagacaaacaugaaggagaaaaaaggaugaagaaguuuaaaauggcagaauauguguaguguugacagugugcuuagacagcuagaggagacaaguuggcauaaagcacaagaaggccgaccucugaagacauuucuacaacaguuuaaagagucuuucuucccagagggaacuuuccgauuucaagccuggcugaguuucacagcuuaguauucaaacuguuucagaccacauuaaaaaaugagacaugcaccacuucauuuuauggauguagcauaaucuucauucaaaaucuuaaggcacacauacauacaugcaugcauacauacauacaugcauacagggucucauaaaauacugaaauacuaaaaauugaagagaaaagagcaugaacaagugggguuuguuucaguaauggaggauggcucagcauuagaaaaacauacaccauaagaggaaaaacacccagcaacugucuuaguuaggguuucauugcugugaacagacaccaugacaccaugacaaggugucucuuaaaggacaacauuucauuucgccuggcuuacaguuucagagguucaguucauuaucagcauggcaggaagcauggcagugugcaggcagaccuggugcuggacgagccaagaguucuccaucuugauccaagggcaaccaggaaagacugucuucuucaggcagccaggagggggcucucgucuuguacuggguggagcugaguauaggaccucaaagcccacgcccacagugacacaccuggcuccaacaaagccacacuuacuccaacaaggcauaccuccuaagagugccacuucccuugggcuaaggauagucaaaccacuauagcaaccucuuguaaaacuuuuaaauggaaggaaagucccuaaauaugcuuaaauauuuauuauaaaauuuaaggauuuuaaaugcugaacuuguaaauugucccucuuaaaaucaggaauaagauaauuuauguaacacuuuguacguucaagguaauaauacgauaaaaagaaaugcgauguaaauauucaaacaagaggauaaauguguccuuaguuuauacaauuguauugcaguaaaugugcuagaaaaacuuaaaauuaauaguauuaauaauccgaaaagguuagcugcauaaaggauacaugauauagugcgauauuuuaugcauauaaacuuaaauuggggaaaagagaauaaauggcucugaaagcauauguucuuucuugguagauaauuuagggaauuuuacuuagggugcuagauggagaguccugagacauaguaugauuuagugucauagaaauuuaagucucccaaguuaauauaaauaaaguacaguuggguuauaauuacauuucuguucaaugaaaaauaagugguugaauauuaaaaauaauugauuuccuacacagaagaccacuauacucuuuugauauacaguucuauauaaaauggaauuuuugauucaagccuucucugauaguauucacuacagauucuuguugaccaaucuuucauuccugaaauaaacaccacuuauucaugcuuuauucuuuucuaguauugggaauuuccugucuccuaggacacuauuaaagugauaguauaguuuugaaagugugaacuuauaaucucaaaagagagaagcaaccaaauggaagacaaggaaauuaagggacugaaaaacaaacaaacaaacaaaaaacucagguagcuugagaugagccuccucaucacaguuccuuucggcaugguagacugccucuaauuauaaauuggcauuauuaaagauagucaugccuucucguuuuugugguuuugaggauccuuucugcuggaaagacuaggugcaacagaaacuguguuggccuacaaaggguuauaauauugguuguuuucccguacagaaaagggcgugcagcuuggcauggcggugcacaccuuuaaucccagccccugggaggcugagcgggaggagcucagagagugugaggucagcacacagaccuagggaggucuagaccagccagggcuacagugagacccugauccccaaaaaauggucgugcccuccccgccccauaauuuaacugcgauggccaccuuagaauuuaccacacuugguccagacaacauauauagucguugcagggaguaaggaaggaggguggagaaagaagacaacagacaagagcgaaugucacuggcugaggccuagaaaagaggggggggggggggagaggaugggguugcaagguugcauugguuguuacagugaaugagauauauucuucuuggaauuaaauccguuguaaaaaucagcauaucacuuggaaucugacaguguuacaucuucacauugaagaucucucuuguuuuguuucuucauuucccagucauuauucuaagaucucuaggcugugguaaaaaguggcaaaaguagacaaacaccugugguucucuguauuuuguuguuuguuuuuuggaaagaggcugaaugccuuuuuaugugaggagugugugcauagguucaaccugaugugucauuccucaagugucauccacucuguuuuugggcaaaggcucucacuguccugauuaggcugggcugggaagccaggccugcugaguuccagggaccuuccugucucugcucccccucccccaugcuggcauuacaagcagacacugccuuuaaaacaaagcgaaagcuuggguguugggcaucugcugggauccucagguuugcuugcaccgugccuggcuguauuguacaucuucuuagaaaaguaucucaucuuuuuauggggucaguuugguaaauuauauuuucuggcauguugucugucucauugaaauuuuuaaaauucuuggacuaauggucuuuuaugauuugccugguuuucaguugguauuaauuccauuaucaucuaaaaguauugauggauaugucuauuuuuaaaaaacuaaaacucuauuacuuaaaaaaacagcacccccagacuuaaaauaguaaugaauucuccacauuuaauccuaauuauguaucuuuuacauuuacauuuucugucuuguuuauugaaugcuguguuuuucaguaagccuuuggagaagagucucuagauaauugcuugcuuucacccuaccucaaauauuucuggcacaaacagagaucuauauuggcucuuaacuauagaaaacuaaguugaggugugugcaugcucucaguaaagucagguuuugagaguauuuucccaucucacaaggcauggugccauugugugaucucaucuuuccugugcuugugugggugcuggggacugaacccagaaccuugcacacucaaggcaagaagucuaccacugagcaauaccuccaaacccccaguuaaaacaaaaaaguuguugaaugacuuucuauuuacacugucugauaagaaauucuuaggauugcaugaaauguauucccaaaguaaugcaugagcucacaaguuuugugaagagcagcugcaggugagggagugaccucaccugcagcugcagcauccgaggaggguugcaagguagagaauuccugcuucaugcggcuuacuguuuccuuuuccauuguuggagcagaaggacuucagugacugagguuguuuaggggaguagaggucacgaaagucacuaaagauugccauucaaaacaaaucuggggguucagccauuaagagugcaugcuguggcuuccagaggaagccaggguugguucucaugcugacugacauuaagcagaucacagccaccuggaacuccagcuccgaggaucugaugcccucuucuggccucucugggcaucgcacuccugugcacaaacugacccaacaucaacccccaucugaacacuuguaauaguugcugccugcugugcacauuugcucuuuuugugauuguguaauaaguguagccuaaguacacuucauuuuucauuguccuuguuuguguguugcuuuagaguagcaucuguuauuguauaugaaauaaaugacuuugaaacuuaauuauuagagcuuggucagacccccacuugucaggugauuucaaugugcucuguauuucuggccugcuuauuauuggcgugucuaaaacagagaaaugguuaaucccgugaguccuccuccgucucuaggagcucgcauugcccugcagaagugguuuacuucuguacucaucuguugguguagagaaggacggcuucccuguuaggucuuguuaagaagcuaugcuacauauguguuuuuauaguuuauuuacuuacacauuuuuguuuuucagucuguacugugugcugacuccuaacaguguuccuguaaguuauauuaaagcaguugguaaauguccagcugcaaguugaaguaauaaaggggcaaauguuagcugacaagugaugaccccgagccuaagacccguggguccaagugcaagugcuuguccuuugugcuuuggagacuuccuguagaugcccagguucgccagugacuuguagaacugacuagauccaagucccuugauguguuguuaaggucccugagucgcaccauucccauauaucaugaguagccagaauaauauucuuguguuacauaauccagaauuguuauuuuuaauuuuuauuccaaagugaguugacauuaaacugcagagagaaugugggcuuccugacucuuucuugauccauccuaguguaccuuguaucauucugugugugcccagucaugccaagggccucuuaguacugagcuggucucuccugucuccuguauuuucucuccuuucuuugaagucuuucuucugagggcauccaccuuaaccuuucuaucuuuuagucucaguuuaaauacugaccacuuagaggaugggcugccuaccccaucaggauuuuauguuuuccuuugugcugacuuugugaauggcugcacuucuguggcaucguaaaucuucagaacuacuuugccauagauuaaauuaaaugaaugugguagggaugaacucuggucucauucauguauucuacuuccgaaggccuauaggccauguccaaaucagaagcuaaagugcagcauuacucacacaaauucuuuaucagugguuguauucuguaaguuugacauacaggaggaguuaggucaucuuuaaccuugaaacagucucaccagauagagagcuuaccuguagcacugcagaucucuuccgaugggacugaggcucugccuuuugcuugaacccuguuucucuucagcucagaccccauguuccauccucuuaggaacuguugcugcugggaccauggcguuuggagcccaagccugcgaauaagcaccacuccuccugucuggagagcuuugcugccuuugucucuuucuucaaaacaaaacaagcagcuacuccauucuuaguggugaauuucaaaauccuuuuuaaccuuauagguccaaggguagccaaggauggcugcagcuucauaugaucaguuguuaaagcaaguugaggcacugaagauggagaacucaaaucuucgacaagagcuagaagauaauuccaaucaucuuacaaaacuggaaacugaggcaucuaauaugaagguaucaagacugcaacuucuaauuguagcuuauccacuuucaguguuuccucuuguaaacuuggaauagcuaagacacuuuauuuacuuaaaauuauacauaauaaacucuuagaaaaguuaacauauucuuagaaaaugcauuaaguuaaucuacugagucaugcaaagaaaauaaauuaaccuugguguugguucauucuuagucuuuaauccuagaaauaagauuccccccaacuuuaucauuagacuugauuuaauggaaagguuuucugugcacguauagagacuagcuuuauuuuacaguguaucucaaguauuacauugucuucuuuagaaaauacagguaucaccaagccuaggugauaauuuccaugguacuuccaagcccugaaguuggcuuuccagguagcaaagacaguuggagaguauuuaguguguagaggugaaagccuucugucuucaaagcaacugauuuaaauuucaguuacuuuaaucuccaguuaggcagcuucccacuacauuuaauaacuucauagaauuggagauugucaauagaaauguuuauuuccuuccuuuaaaaaaaucuguuuguguuguuucuguugcuuggcuauuuuaacaucuuaauucuagcuuccuccuucugaacacucuacuuugcauaucuucacauauuuccuagucugucuaguucuuucucugucauuucaaagucuccuuucuuuucuagacuucccuaucacugaggaagcugaucuucucuuuccuacuuauucuuuagcuccaacaucccauccuaacaggucagccuuuugaucucacaacucucuuaccuaacuuucuaucgaucucuuuuuccauucuaauugccauaaaacacuuuggcaauaaaaucuccaaaauauucacuucauaacccuuuggaaauagguaaacuauaaaaacaaacacuuauuucuccuuaucauuagcuacauaucagugacuuaaaauaccugagucaguuaucuaauagguuaaaaaggccaucuguuaccuuaacacuccccaacacgguguacuuuaacugcuggacagggcugugcgggagaguuggaggaaaccgcguacagagaaaugucugcuggacugggauacuuggcagaccuccuccuagagggccuguuuagauaguacagaucuaauuuguagugcagaacucagaucuugauuuaaauuuuuauuuaauuacuuaugaauucaaaaauaguuuuuaaagaaacacuuuggacaagacaggcauuuuaauuaacacuuuaaucuccacucugcugaaguagagugucuuuucagagugauuguacaagucacaaaaacuuguacaaugggauaucaggauguauguuuaaaaacuugucccagucuauaucaggagaaauagaaucuaagguaucccuggauuuggugauuacccaacugguuaugcacacauccuggcagaucuauccauguaugucauuaguauugggccuaugguaaaauagcaauuacagccuucauugaaguuauugauguauuacuuucuuaacaugcucugcuguuaaagagcagaaccguggccuguuuagucuuccacugauguauaaaaugaugcaauugaacccauuggugcuuuccauuuuggguuauaauuaaguauagccguucuucucccuaaaaccauguuaguagacucugggacacauacaaucucaguuuuccugaccuuuauuaaccuaggcaucacagagaaagccaagacacagcuucagauuaaauuagggaagccuaaaacuuaagcaauaguaccaccugcuggcaaaagaggguacauccagcugucaguuacaugacaucacuauaaaauacaaaaauacugugagguaacagccaggagaauguauauaaagaguuagggaaauaugagcagaccacauauuugaggaaauugaggaaauacuugguauacauaugauauuguggcuguguucagaaagaauaccuauuuaaauauaccuauuaaaauauuguaaaagaaaugauaugcccacuccccagaaucaugaaaagcaaagcaaggcugagauuauugugauuuuucucucuggggacacugaauaaguacaagccaggcuuauucuggucaccagcaggcaacucugcuggaagguaucaucccugaaggcaggcaagaagagcucuagagaccgcugccuugaauaggaggaggucagggaaaggcauguguuagcuuguaaggccugccacagagagagaaacuuugguuucauaaaguauuugccaaguuuugaacucuuuggaccagauuaaaaaccucagcuccaggauggacuuucagugcuaagaagacaagcaccaucagaaaauaagcagaaguggaaagccauagugagauccucaagagaugcaucugcugugccuggugucggaugugaguuuacgaaaaguaggaaguuaaaggccaaggaagccaauuugccauauuuucaauauaaguaaaaaaggacacacucaagaaacaaaaucaguuuuaaauuaccugaaaacuaaguuagguuuaaaccauucacuguuacuaauagaauggaaacuagcaaccccaacagugggaaggauaaguucuggaagaagaaugcacccaccaccuuaagccuuucuucuucuuacauacauuccauuggcauacugucaaguuugaagaauaagaaaaugguaaucaagaaaacagaauauaggugguaauucagagcaauccagguguugguguuaguuagcaauucuuuacauaaauauaagaaugucuugaaaaaaaaggauauuugauaaaaugcuagaaauacuauagauuuuuugacagggaauuguauuacaauaaaaacaaaucagguguggcucacaggaagcacaaaaguuuucaccucagcaauguugggcucuucuuaauuacugguaauuucucagcucuagccaaccagcaucaaguaucccaagcaaagcaaagguuucgcuugaguaggucuagacuuguuaaucacaacugacucuucauccgcaguuaaccagaaccacagaaucuuaauucaaaauaacaaaugaccuccauagagucuuuaaacuucccucuggaacaucacaagccaggccuccaucuuuugcacugcccucaacauucuuaccuuccaagcuccacagaacagccuaccaagcuuugaauacccaauggcuuuuuaccucaaaguuccaaaauccuuccauagucuuccccaaaacauagucaggucugccacagcagaccucaccauccuggcaccagcuugucuuaguuacaguuguauugcuauaaugaaacaccaggagcaaagcaacuugaggaggaaaggguuaucaggcuuacacuuccauaucacagugcaucuucaaagaaagucagaacaggaguucaggcagggcaggacucuggaggcaggagcugaugcggaggccauggaagggugcugcuuacuagcuugcuccccauggcuuucucagccugcugucuuacagaacucaggaccaccagcccagggauggcaccacccacaguggacuaaucaaucacuaguuaaccaaaugccuuacagucugaucuaauggaagcauuuucucaacugaacuuuccuccucucagauaacucuagcuugugucaaguugacauuuaaaacaaaacaacaacaacaacaaaacccagccagaaaaggcuucaucaaaauuagaaacaugucuucuagaaggcuucaauaaaaaaaguuugaaaaaacaauucgucuuucacuauugaaaaccaccuaccauacuacaaaaaaauucaacaaaagaacuuauuucaaaauauaaaaggauuucuucuauaaacacuaagauagugaauuuguucggcagguaaaggcacaaacauggugagaacaagcagggugagcccagaagaaaaugaugugcugcugacaucuucagucccagcacuccuaagagcugcgagaggagaggcagagagagacaggagaaucauuucccagaagguccuguuagccugggagucucuggcuuagcagcagccucagcaaaauagaugagaacugacuccccaaauuuuucugacccccacaaguguaauacacacuugaguagacagacagauaaguuuaacuauccagguuuuuuugcuuuuguuuuuguuuuuuugcaacauggccucaaaaauuaaaaagauaauuagaaaaggaagauaaaugaccggguaugggccgaagaguuggcucagugguuaagagcaccaucugcuuuuccagagguccugaguucaauucccagcaaccacaugguagcucacaaccaucuauaaugggauccaauacucucuucugaugugucugacagcuacaguguacucauauaagaaaaaaaccuguccagguacacuacuggaaaauaucucaguaucaccugucaucaguaagacauuugacuccgacucagaugacuaagauuuaaaagacagauucacacugauuggaauauugaaauguucacacugcccgugagccuauuguaaacacaugcacacgggcacagaggcacacaggcacucacauacucuacagcauuuucuuuucaagguaaacccugugauugaagcauuggaauucugagaaauuaccccaagagaaguaaguacuucuguccacuagcugucuguacagagcgaucauauuagcacucuuccuagcagccuucaugaaugcaugugcuaacauggaggugucuugaagauaauuauguuaaaguagaaacacagagacucaaaggacucucuacugucuaguucuuucugggaacugaagaugcauugaccagaacuugaggggaccaaagcuggaaaggcuaagccaccaaggacugaagaucuguaccugugcacagugagcuucaaaacaaaacacaauugagcuuacguuuguuagcaggcguagaguauucauuacguaauguaagucaugcuagauguugucgucguaaggcaaaguaacuggaagugagugaguuggcuuguccggcuuugcuuggugaaguucguaauuaaaagcacuucacaaagauagccuagcagacacauuggaauaagcuaauacuuuauaaaauugcuacucuuaaaacccuugaaaauuguagccuuaaauuucauuuguuuuaucuacauggcugcuuuuaucaguagauuucuaacagcuguacagaagcuuugguauuggccuugagaauuaagccuaaggugacacagguucucaacaaaaagcauucuacugcugagcugugccuagccacggagacuuccuguucaguuauuuacuugcuauguccgugcauguccaugugugucccugugucugugugcauguguguuggcacauguggaagucaggacaauuggugggagucaguucuuuccaccaugaguuccaugacucaaauucagauacuaagucuucccuuagagcaauaaucucauuacaguuguggauguucacuaauuuuaagauuagaaaaugugagcacuuaucagaaucacucaguuuuuacagggauuuggagagggacuaauuaaugcucuccaacuaggaccugaguguccuaccuaagcacucuaccagcuugcccacugauuuagauuguaauucugucacuaaagggagagggaaguuuucucuuuguuuauucaauauaaacacauuuaaugggauuuuuuuuugcauacuuuguuuuucuguaugauacacuguggcccucuuggcauaagaugauaggauuggucaaagacugcugcagcuguuagcuauggcuggaagagcuagaacccuggaaaaagaagucauagucugcaguguuagucugaagcuaaggaagagaagugaccugcagcucaguuaugcauuugggcaugcucugcacccgcugaggcgaggucuccccaucccacagugaggauucaccuggagaggauuuucagcgugaauauccuugaccuucacauugccacaccuaucaaagccguucaaaugacagcacagucugcugugugaaggguacaugcuaagaccacaggucauuuguuuucaaugcauacugugacagaccaaggcaggaccuggagcugucccucuagcaucagcucgccuucugcuagguucccuuucagugcuuccaagaucaccuuaccauacagugacauggccuuaaguuucaggguugcagauguucagugcauuuuccuggacugccaaaaacaaaucggugaaacaaggacaugccggaagcucccauggcaugcgucacuacauaggaaguaugaaaguuauuaaggagcacuaauuuaaaaaaaaagauuuauagguagccaggcagaaaaauuggauagaaaauuauuucaaacuuaaaaaaaaaaaucaagaaguacuuucugugaggagaaagacagugacauaagggcggcaggcagcuagcaugcaguuacaugagugccugcagaaugaacccaggcuccggcggcucuccucgggugugccuggcugagugguaagucacuaaacagcagacuuggcuccugcucaugcagauacaggccuaagaagugugucuucuaacagccacuuuucuauggcuuaagcaagucuguaggugucagcugauggaaaaugguaauaauucuaguuucuuaaaaguaauuagcccauauuguaaaacauaauggguuuguuuuacuaugccuuuuaauguaugcauauaaucacacaccuuuaccuuccuuuuaagugugccaugaagugucuugcauggagacuccucaaaucaccauuaucacaaaauaccacuauuauuuuuguugggauauaacagugaauaauagguaauauguuuaauauacacuauagccuauggcauguugucagugugaacugaaauagcuuucucaagaacccagucagaucuaaaugccaagaaacacagaaucauguguugcaaagguuauuuggcauuucaugcugaugcacugugcucucucaauaggaaguacuuaagcagcuacagggaaguauugaagaugagacuaugacuucuggacagauugacuuacuagagcgucuuaaagguacguuuuuaaaagcacuuuaaaauacugugugaagcucaguguccaggucagcugcucucacuggaugcugggcucagcuugcucuucuuccccaccucccccuggguuguagcuguugaauacaaauagauaaaaagcuguuugcuuguuucugugucacaucguugguuuuagcuuauccccucaauucugaucuguuuauaagacuuguuucauucuaccagucacuaaauacgcuucaguaggccgugugccgcacggcuucuguggcagauggguucaaagggguagagucuuuuugccugucuuucuaugccguuucuaguaacaucugucuucaaaugucuuucuuacucuguugccuaaaaaucccagugccaaacaggggccuugcucaguaauaagugaaaccagacaaauucguuuugaguugcuaauauuaucucccgggaaucuuaggauuuuguaugauuucccuuuaacacacuuguuuucuguaugacucaugcugacuuugcagggcaaguuuuaacuauucuaaaucauuauucaacuacguauauuuguaauuaaaauacaaaccugaggacucacuuuuaaaauaauguaauaacauuaggaauauuuuacauggcauaaagcaguuacuacauaagaacuuguuucuguuuagaauuuaacuuagauaguaauuuccccggagugaaacuacgcucaaaaaugucccuucgcuccuacggaagucgggaaggaucuguauccagccguucaggagaaugcaguccuguccccauggggucauucccaagaagaacauuuguaaauggaagcagagagaguacuggguaucuagaagagcuugaaaaagaaagguaacaggggaguggggguggguggguaugggggacuuuugguauagcauuggaaauguaaaugaccuaaauaccuaauaaaaaauggaaaaaaaaaaagaaaaagguaacauguguuccuugugcaguaaguacugugugugcgugggaguuuuacagugcaagaaacugacaggugauagccugcaccaucguucuugcuuuauaaaccaggcuggccucgaacucaagagaugccaaugccucugccucugccucucucugccucugccucccaagugcuggaauuaaaggugugugccaccacaaucuacuuguucuaaaaauauaaaugauugugcuugcaauaauucuaaaaguagaaauaaggaauuuucuugaaauucuaaagucuuauauuugacuacuuagguauuuuaaauauucuacacauggugaauccuugguauaguggugagcauagcuaccuuucaaauaauuuguacauugaguaaaacccuaaaucauaauauuuauaucuaguugaauuaucagugacauaguagaauuucagguuaucuuuugaaugaaguucaauagcuacuagauccuuuaugaggaaccccuucuagaaagcagaggaggaggaagcacagugagaggaugguucuuuacaugucauuuuccacuuagccugggcucugagcugaguucuugcaaugagcuauucuccucgcaaguuagaauucucucaccacacauggcagaaccaucaagauauuuucaaguauuuuaggacucagugccagguggcgacgcucuucuguaaaacacuuguaaaagcggaguguuaaguuuacauauaaagagcaaagccuggagcccugcagagauggcucagcucugccagugguccugaguucaauucccagcaaccacgugguggcucacaagcaucuguaaugggauccgaugcccucuucugaugugucugaagacagagacugugugcucacauacauaaaguaaauaaauaagccuuggccugggggagaggcagccuggaaagacagcuuagcuguuaggagcauauagugcuuuugcaaaggacccagguucaguucccagcacucauaugguggcuuacagcuggcuguaaaccuaguuccagggacuccauaggcagcaugcauaugauacacacacauacaagcaggcucacauucacauaaaauaaaaagauaaauaaguaaaaugacauauagaacguaaugcagcaugcuucacugggagacaaaggcauuguuauuauuuuggcuugggguaaggccauugguaacagucaggcuggccauguagacuaggaggguguugcgcucucuuuaaucccuuaccuaugcuggucuuuauuuuuacccugggcuacccaaacaccguccugauccaaaaggagagugcucaggcccagggucuuuguucccuuucauucuguaaagcagcaaaggccaugugagcaggccagacuucccaggcacuuacuuuggugcugauauuauuaguagagagcuuuagcgaaaagaauuuuuuaaauggauuuuacugccagugcuagguuucauaacagcucuugguaaugaagacuugcaguggccgugcuccuuuuaucucagccucucugacacguagggggaugugcucugggcuccugcugcggcaucauuuaucucuugccagauccuaccuacccauuuauuuucucacaauugagggugcuuaacuuugaaauuauuucucaggaaaggucuucuacauacauuuguacucauuacaaauauuucccaaggaaauaccaaacagaauuuuuaaaauaauguaucaucagagaggggagcaucauugcauggccaaauuccagaccauaauagaaaauuuucacagaucugauuacaugaaaauccagauuuuccaaauaacaaaauuaucuuaagugauaaauugaaaagaaaagaaugcauaugcagccuagugaguaagguguacccuccccagucuagaaguccccuaaaugagaagcagagguuacagaaaggaguggguugcagaccuggaagagugcuucgucucauucacaucagaagaaaugagcucaagucauggugauauccuggagguuuauaaaucuguacucuaaaagugugucauacacuuaaauuuguaaaaauuauagcucauacaauugauacaacaccuuacuaggacacuuaaguucaaauucauguacccucaaauuuuaucaugugugcaugcaugaacauguauagagugaaguacauaaagacauucacauaaaaauauauauuuugauuauauauuauaucaaaauacuuaaaaguccccaagugcccccagcaaagaauuggccauaguauuucucuuucaugaguuuaugaauauuaugagguacacagaguauuaggcagcuaucaagaaguauguagcaagucuuuuguucucauauggaauaaccuccaagauagaugaaaaaaacauguauaggacaacauauauauuaauaaaucuaguauuuauguuuuuaaguauacauguaauuaugcagauuauuauauuauuauuguucacauuuuauagaaaaucucuggaaacaacacaagaaaauuauaccguacauugcuuggggaaaggagccacacagaacaacagugagcguguacuuguuaguccuauugagcuuuaucucaguaacagccuucuauuauauguuuauguuuauaauggucagauguguagugggacugguuccuagggaauuacguaaauucauccugagauuccaagauuuaagucucugccucaggguagcacccucuggcuguggaugugaaguuuauuuacagaguugcugcacaguggccugccucagcauagcauccucccucagaugcagcgccaggcuucucucuuccccagcgucagugcaguguuccuucucuuucuggcugugaguucuguugucgccuuaccuuucacuugguacucagaagucagugguuguaauacccaagugcuacuucaaaacccaagucagugcguucucacugguucauuauugucuuccagcagcagcugcugagagcuaccaggcaauauguauuagcuuguguaaauuuaccuuucuucuaaacagaucauuacuccuugcugaucuugacaaagaagagaaggaaaaggacugguauuaugcucaacuucagaaccucacaaaaagaauagauagccugccuuuaacugaaaauguaaguaacuugacagugcagcuuuuagauuugguaacuugaccuuugaguacucagauuaucuaggaagaauucaagagaacugaauuuguaaugauauaaaauguaaugugucuuaaucagcuauuaaccuaaauacaugauuaaugaguauuuucguuguuguuguucuugcuuugguuuguuuguuuucaugggguuuuguuucuguuuuugaucagauacagaauuugauguauccugggcugacuucagacucccaaauacuaggauuacaggccuccuuuacuguacccacuuguuaguuaauuuuuaauagaagaaaaaauuauuguguaccaacagauacuuauuuuaauuccacauguguuuggaucugaaucccacuuagacaacuauauuuuuaauggguagaaacauuauacuaucugcuugcaguuucuguacaaugcaggaaucaugccagaugguuuuuacaacuaaaauguccuugacaauaauuugaaucuuacucuuuguaguauaaaugucacuggcuauaggcccggauccuacuguguuuguaaacucugugcccuuuaacaaauacacugagguuuaaauugucuaagucucaggaauacacagaaguaccauagaagaaaaccaacuuacugcaacuuccacauucauguugugccgugcacauggcucugaguuaagccagaucaccucacaaaguggauacaugauacgugccuguaauggcuguguccagaacagcuuuagagaugggcaugacugagagagacagugggggaaugaagaaaagacagacaagacagacacauggacggacgcacaugcacacacacacacauacacacacagaaacagcagauuggguucugauggagaaacagcacccuggaugcucaguguuuauaguguuaaacgaggaggugaaguuauugcauacagaaaaacaaggaggcaggcuuagcuaaucucaguaggaacagucucuguaggagagcugucuucaagccauaaacaucaggccagagggagaaagcuguggugggcauucucuauacauaccaucagaauucacacuuagaccaggagaaaggcugugccauucuccauggguccuuggcauaggcuugcccauguuagcagcacacauucacucuggccuuccucugcuccucacauggagucuuagcacccaggaauuugaagagaaguaucagaaauucaaacugugauggcucaacaguuagaacacucacugcuccucagcggaucugaguuuaguucccagcacccacauggacauucacagucaucuguaacuccaauuucaggggauccagugcccucuucugaccucuguggacaccaggcacucauguggagugcauauauaugugcaggcaaaacacuugugcaugaaaaauaaaaauaagucuuguuuuaacaaauggaaggccauccuuaguugucuauaauuugacaccagugugggauauaugagguccuaucuaaaaguaaaggaaaaaagaaaacuuagaaaaacguucauaaucucaagacuauauguuucaucgauauuuuguacaguauuuaaaagggaaaauaagacagguguauguggcuuauuaucuuauccaccagacuucggaggcugacccuggggguaguagugaguccagggccagccugggcugcaggaaagugcuuucucaguauaaccuucauucuuagcuuagauuuucacguucuuauaguaguuuuaagagaacccaauaggcagaaauugaaaauagaaggaagaaaagccuuccagaauauaguuaccugggcuuccugagaguaggagcuauaacucaaggcuuaaagugcucacuucacuuguuacaacucaagagcagugggucaguaccagagaucaaaaggaaagagcaggugucagauaaauuuauuauuugcuauuuaugaaguaaccauguuugauagaauacacaaaaauacacgaucaucgugggccauuaguaacacuaauaaauuuaaaccugcuuguauuuuauagucacuauacuuugcuuucugauugggaaaucaaguuaacaagcaucuccauauagaaauauuuaucugugccauauccagggauccaccccauaaucagcauccaaacgcugacaccauugcauacccuagcaagauuuuauugaaaggacccagauguagcuaucucuugugagacuaugcuggggccuggcaaacacagaaguggaugcucacagucagcuaauggauggaucacagggcucccaauggaggagcuagagaaagaacccaaggagcuaaagggaucugcaacccuauagguggaacaacauuaugaacuaaccaguaccccggagcucuugacucuagaugcauauguaacaaaagauggccuaaucggccaucacuggaaagagaggcccauuggacacguaaacuuuguaugccccaguacaggggaacgccagggccaaaaagggggaguggguggguaggggaguggggguggguggguaugggggacuuuugguauagcauuggaaauguaaaugagcuaaauaccuaauaaaaaauggaaaaaaaaaagaaauauuuaucugcauaucagaauaucauaccacuuaucagcucuaaaccauauuauuauaacacucugugacauauucagcauuuugauuuuuguggagugguugggaaauggaggacaaaugauaaaaauaacaguacaggcucaaagagaacaaaugacgugcaggggagcauggugaugcuugucuucaguccccaaagcccagcacuuagccgacagguaggcagguucugugagaugaguccagccaaguagugcacuucaggcuuaaggcugcauagugaagcucugucuuuaaauaaaugaacagcgugcaggcuguuucaucugucaugugcuccuaacuuuggugugccuucaagagugcauuauguguauguuuuguuugagggcaacuuaaaaguuuggaguucuugaacccagacugccaggagcaguuuccuacaagagggugaggagcgugaagagcacgcccuccugcucuccauggcucccagugucuccugacaguuaccucaguacaccugugagggugucagagccacugggauugcguuuacuacagcagugaacggcuuugugggcacugugaguugaaccccagucgucugaaaugggggcagucagugcucuaaaccauugagccaacucuccagauccaguguuuaauauauagacaguuuucuuacuccauuuucuucauauggcacguggaauuuuucucucuguuuagccuguacacguaagcccuaguuaaaucagaaggguaaggguagugaacaucugguguauacuaggcuuuuguuugugauagaaucucacguggcccaguucuccugaacucccaguguagccaagaaugaccuuggacucuugacccuccugccucugcuuccuaagugcuaggauugcaggcaugugccaucacaccaagcuuuauguggcacagguugggugagcacuguaacaacugagcugugucugcugucuaaaauacuaauuuuaauaauuagagauaguuccucgggguucugacuuguaauucaaugguacuguaucugccuagaguguucaaggcucuaguugauuccuaauaccacaaaaauuaaucaggugccccagaaguucagcucacccuaacuggaccaguugcuuauuuucaucaacacagucuaaguuaaagccagcuuuuaccuugggcaguucccuguguagucagggaccccaguuaagccugcugccaugcucaugauuuuggguuucucaagcauggugacuuucauaguuguuuacucaauuucuuaacugauacuuaugugcuuuuuggcuuuacuaguaaacugagaaauuaaugugcuguuuguggucuuaguuuuccuuacagacagacaugacaagacggcagcuggaguaugaagcaaggcagaucagggcugcaauggaggagcagcuuggcaccugccaggacauggagaagcgugcacaggugauucucccacugcacacuacagcucugcugaugguucuguuacuccauugccuguguggcgggcggggcuguaguuagugaugcagcgguuaccucgcuuagaugaggccgucaguugggccuccagcaccaucaaggagaacauucagagucugccuugaauuggcuucaggauaacagucucucguggcuguuggacauuauaaccaguacugacauaauucugccucugcuaugacacuuggguauuaaucuuucugcauagaauuacagggaagaaauauugauucucccacagauaauaacuagcuucaauuccuuugagauugcuguuucuugugcucuaaguuuauguagcaacauucagaaguucuuucaaaaaauaaaaaaggcagcaacggcacguguuugagacacaaaggaggcguaaggaguaccuaagggaagggagcaggagggaugagggagacgauaacccacaggaaggucgagaaagaacaagaacugccuugauuguagagcacugccuuguguacagcucucugaguggcuaggguggcccuguagaagacagguguaauuacucccuuaccuugcuuuucuggccauucuguuaccuggaaaugacauaguucauuuugguugcuaagauuaacauuuuaggaaauuuaacuuuguauuuugaguaacacacacauuuucuacuugguaauaacugugugaaaauuaaguuuaaaaaccacaaacaagacaaaaagccagcugguggaagggcuggcauucagugacagcagugcaaauggugucuccuuuguaagaacagaagagaaaugacaguggcaggagugguggccccaagaguacaccagagcuagcacagugcaggagucauagaaaaucaguuauucuguaagaguuuccauacuuauaaggacgucagcaaaggaugcuacagccccuccccugcucaaucuaaaugggcuuuauuuuguguaguuguaaauguucuagauucaucucauagaccucaaauacuauacaugauacuauuucuuugcuuguuuauaauauguaacuuacacuauaaugaguuaaaaggugaguauacaaauguuuauaacauaucugagaguaauuuucuguauaguacagugaaugccuacaaaugagugacaacagaaagcagacaccaaaauagugagauauaguucagccacugugugugcacaccucuguaagccagcacucaggaggcuggagcaggaaggugggauuggagaccagccugagcuacgugcugauuccgcucugaagaagaggggcuuggauguggacagcuccacccuaaaacaaauucaguuggcuaauagcugugaacaaugauggcacucuuagucuuaacauaaagaagcuacaauuaauagaagaaaauguaaaacauuugaguccuuaagauagaauggaaacucaaaaaagcaauaaaagucauuuucauaaaaauuuaaagcaccuguccuacaaaaaugaaaacgaaaaauauuuuuaacaguauaaagaaaaacaguuauuaucccugaaauguaagaggauuaauccugagggcuaauucuuuuuugguuugguuugguuugguuugguuugguuugguuugguuugguuugguuugguuugguuugguuugguuuugguuuugguuuuuucgagacaggguuucucuuuguagcccuggcugucuuggaacucacuuuguagaccaggcugaccucgaacucagaaaucugccugccucugccucccaagugcugggauuaaaggcgugcgccaccaccgcccagcugaggacuaauccuuaaagacugccuuuguuuuuaaaugaccaaggauuggccaacagucuguuuaaaggauggagauguccaguauaacauguagagaucacugguaaauaauucgaggaaauuuaaaguagaacccagcccugcuccugccuuugugaccuuuaucucuguuacuaguuugguuauuuacuuagcuuccucuuucaauggcaucuggucccacguuagcauguuaguaaaggcuaagaaaaugcccaucagguguaacagagccuacuucugggccagugcgguguacacaccuuuaauuccaguccuggggaggcagaggcaagucgaccucuugaguuccaggacugcauaaggucaucuccaaaacaaaagcagaaagcaaucucagaucauguguuugagcagacaugccuuucaguaguuccuucacaguuugaauguagaauugugccaucuuugugguucuuauauugcaaauagaaguaauguucauuuggaaagcagaagacagagaaacacaauucuaggcuacccucaaccacacagcaagcucuaggcaaagugugcuagacaaagagacugggggucaugggggagcagggccagcaaucagauguaaaguaaauaagcuaaaaaaaauacacccaugucaagacacuccagggguaccacauauuaauaugcacacuacacauaaaaaucaaugaauaucugacuuguucucgucuucuauuucagcgaagaauagccaggauccagcaaauagaaaaggacauacugcgcgugcgccagcuuuuacagucccaggcggcggaagcggagguuaguaaagcccccuucugguacaagucauguaaggagcucucccagaaaagaagauguguguagucaauggggcaucauugagauauggaccuuuuagagagaaaggcgguugucauuguuuuaauuuaugcauuuuuauaugcauugguguucugccugcacauaugugaggguuccagaucccccuugaguuagaguuacaaacaguugugagcugccauaugggugcugggaguugaaccuagauuuccucuccagcccuaaaacauuuuauacuuuucagcaauuaaaauuuagucuuuaaaugaauuuauaaaauucuuuggcaaaugguuggaccuggagggcauuauccugaguuagguaacccaaucacaaaagaacucaaaugauauguacucacugauaaguggauauuagcccagaaacuuagaauacccaagauauaaguuacaauuugcaaaauacaugaaacucaagaagaacgaagaccaaaguguggacacuuugccccuuagaauugggaacagaacacccauggaaggaguuacagagacaaaguuuggagcugagagaaaaggauggaccaucuagagacugccauauccagggauccaucccauaaucagccuccaaacgcugacaccauugcauacacuagcaagauuuugcugaaaggacccagauguagcugucucuugugagacuaugccggggccuagcaaacacagaaguggaugcucacagucagcuauuggauggaucacagggcccccaguggaggagcuagagaaaguacccaaggagcuaaagggaucugcagcccuauagguggaacaacauuaugaacuaaccaguaccccggagcucuugacucuagcugcauuuguaucaaaagauggccuagucggccaucacuggaaagagaggcccauuggacuugcaaacuuuauaugccccaguacaggggaacgccagggccaaaauugggaguggguggguaggggaguuggggggaggguaugggggacuuuugggauagcacuagaaauguaaaugaggaaaauaccuaauaaaaaaauuuuuaaaaagaagaauaaagagcaaucaaaagaaaaaaaauuuagucuuuagcauaaacugucaguuuguauaaucaaaucaccacuugagcuaucauuacccuuuaagugggcuuuuucuuauauguaauucauaaugagaaauuugaucagacauguuuauuugugguuaucccacaguccuuacugaaauguaguaaaagcauuaaaugaagagucacaaauaccaaggaaagugacaggaguaaaaaugggggcucuggaaaaaaguucgacagacuuaacuuuuauagcauauuaagggcaccaaggaaggcugugacagagcuugguguguaucauggaagcuuaaaggguucccaacuggcuaugcaggucaccugugaauauaaguauuagaagggacugaaaugagcauuggcugcacuuccagaagaaccaggcccagcaccugcauggcagcucacaagcauccauaacuccauuucugugggaucuggcgcccucuccccuccuccauggguagcacacuuguacgcaguacacauauauguacaugaggcaacacccauacagagaaaaauaaauguaauaaaagaagcagaugagccccugacauugcuccacauuuucagcacaacuguugcuguuucucuuuucaguccuaacagaaaauaaguuguccccacacaccacccccuucgaaaaggauagggauuuuugacuagauuacaguaaacuagcacaaugaauugaagcuggagauaaguguauagaaagcugacuugguuggaaaucuacucaguggugagaucccugcuguccuccagccuugucaucucucggaagcuucucuaaggaacgcagcuuacccaagaaaaggcucaagagcuaccagcaaaccacaccagccauucucuggucacuguagcugcaaaccuucauuuaauuuuccuguagcuagcccacucuucagucuguguggacacuaacgacugacugcuaggcauuuuaauaauguucugauaagaacgaucauagaaggagagucccuuguugcaggcagaaggaaagcucaacacuacagcugaccuucauaccccagcagaagcagggugugauuguacacgcaugccugaaccucagcuuauggaagcagagcaggccagccugggauacauaagagccuguuacagucauucacucaggagaauuguuuuuaaaagaucucaugagaguuaaauuuaaaaccaugauugaaaauuaaaagauuauuuuuuuuauaaaguagaacaagacaaugaaacacaaaauagaaugguaggcaggcaggauacucagcaaaugcagguguccaccauagcuugcuggccugagcucacugccccagccaaggacccauguguugaaaggagagaaccgguuucugcagucuuucucugagcuccauaggcgugaauacggagaacgugcacacagauuaaacaaguaguaaugaaaagggguuguuuuuaaaggaaaacucuaaagccuagaaaaggaagagaaaugccaauaaagccaauaaagcgaguuccuguagauuucucagcagccaacaaccuaggaauccagggaacaagacuuguuuuauuuauuuauuuauuuuuuaaucuuaagaaaauuuucaguuccuuugacaccaaguauuugaacucauucuuugucccacaauucaguucaguuaccucaaguugguauuagaucccacaagcaaaauucauaguuauuugcaagacuuuucccauuuaacaacaggguuuggcugugcccacuauaacuguuucugccuggcuaggaaucccacugaaguggaugcacuguagaccuuugccaucuugacccuaccugaccccacaugacaaaaaccaaguccuuuauccuuuaagagcccugacaauaugcuacccaauugacauaacgcuuccuguuagcugugauaauacccugguggagaagucacagcagcuggaaucaaggacaguggacacuauuuauuugaccaacuuucuccuuuuauucagucuaggaucccagcccaggaaaugaagucauccaugggggcaugucuuuccaacucaaucacaguuguuguauagcaauuuagaaauucaagccuuuccaaacuuccagagugcucagaauucacuaaaagcucuaaacuuaagugauucuacuuuuauuaaauggggacacgacaaaagccaaaugggagacacauugcaaaguccacggaugaggugaggugguggcaggugaaaauaucaaguguucuccucuugggaucuagguuuguaaucccucauuuuccaucugaguugaagacuuacagguuuugacuuguguuuaggaugcaccugaaaauacuuggcaguuccucaaaacauuaaauguaaaauugccacauaacccagcaguucuagucucagguaucuagcagaaagucacauaaugaucuuaaugcuauuaaugaucuauucaaacagccuuauucauuguagcccaaaaggaaagaugggacaaaugugacacuguuaggugcacuuaaauuuggguacuauaaguaaaauguggauaacuuuugaaaacucguuaaguaaaauagaccacauaaguccauuuauaaaauugucagaagacuggggaaacggcuuaguggacaaagugcuugcugugcagugugaguuaggaugcccagagccuacaagcucgcuagugacaccagcuacacacugagcucuggggucaguauguaaaguagaaggugaucucacagaagaugcccagugucagcuuugggccuucacaucugcguacaugugugcacauacuuuuaauuaaaugucuagaaaaaauuuauuuugaagauacaacucaagcaugguagcacuugauagguaaagggaauugggaguuucaagggccaaccuaggcaacauagugagacugucucucccugacaaaaacucaaaacgaaacaaaggagaugagcucuugccugguacacugaguggaaauguggauuaacuguaagcaggugggagagaauuuacuuaaugauaaaaauacucgguaaauuuaucaacaucauuaaauugaacaccucacggguauauuuuguggcacucagcugcuuaaacaaaacugcuuuuauuuauuucauuaaaccaguaauguacucuuauuacccagcacucagaaggcagaggcaggaggaucaguaauucagugcccaucucagcuacagaacaaauucaagaccagccugaacuauauaagauccugccucaaacggcaucuuucuuccuagucugccaccuaggguagaagccuggcccuguuuuacagcagguauaggauuguuguuacuagaagucaguaacagccacccucucucccagcagaagaguagugaugaggacagggacccaggagugcaguguucaacucuaggauuggugggaagaaaagagacggaggaggaaaaggaggaggaggaggaggaggaggaggaggaggaggaggagaggugguguuaguuaucaugagugggcuuggcaguugcucugugaccuucauagacuugucuuucuuuuuuuuuuuuuuuuuuuuuuuuuuuuuuuuagauuuauuuauuuauuauauguaaguacacuguagcugucuucagacacaccagaagagggcaucagaucucuguuacaggugguugugagccaccaugugguugcugggauuugaacuuuggaccuuuggaagagcagucgggugcucuuacccccugagccaucucaccagccccaaucuuucuuuuuuuuuuaccugagugucaguuacaagucuuaagguuucucugugucucucucucucucucucucucucucucucucucucucucucucucucucucucucucucucuuccucuuccucucucucccuuccuuccuuccuucccucuucucucucuccuuucuuucuuucuuucuuucuuucuuucuuucuuucucuccucuuucuuucuuucuuucuuucuuucuuucuuucuuucgcucucucucuuccucucuuucuuuuuccuuccuuccuuccuuccuuccuuccuuccuuccuuccuuccuuccuuccuuccuucuuccccuucucuguaucuucucuuccuuagacaaucucauuaauguuuuaaggcuuuagguaucaucuauaugcuguuuguucuugauuuuuuuuuaauccccuugagguccagauucuuaauccuguguuccuaccauguaucaccacuuaggauuugucauagauuuuaaauucaaccuacuuaacacuugggugacgcaccccuuuaauccuagcacuuggggaggcagagucaggcaaaucucugaguuugaagccagcuaggguccacacagugaguuccacuucagccauggcugcauagcgagaccucucucaaaaaacaaaacaaccaaagcccgucuaccgucuuuaccagcccccuucuuucucccuuuuaguccccaucuuuccucuccauagacugugugagcaaaaggucaucagaauaauccugcacgcccuuuugccacuguuaguaacugcuuacgcugccguagcaaauaccagacacaaagcaugugaagagagcagacaguuugagagguuccagucugccuuguggguagggcauggaagcaugagcuugggguuacagucaggaaaggagaggcaagcgcuggugcucugugccuucucccaccucacuguuuuauucggucuagaacccagcugcugagugaguggcaccacccacauucaggguagguuuucccuccuugguuaagccaacgcacccaggguuguaucugcuaggugaguucagauccagucaaguuauaacugugaugaagauuaacccucacaagguccacccaccccuugucaaccugacacccaaacacauccuuuuuaaaucauaaaaucccaccaucacugucaaauauucauggucuuuucauaagacagugcauuuaauccaucucuacacauuucuguugcugucuggaaauugccacucaaaccauacaaacucugaucucaguuaagcaagaguaguuuauugaauacauaccuuaauccuggacugcccaguggucagugagucaguuguaaacauaacaguucauauugaccuuugaauugaaggguccuacauaaagcuuuguggaauuucuuacgauuagcaaaccucauacagaacaaaacgggacgugugaucagcauguccuugagccaagccuucuccgagucagugacuggcaggccgguuacagcaacaauaugaaguagcuggcaggcuuggaacaaaauggcuacagcuacuggggagggaggucagacguaacaauuucauauggucaucagggcuaacauuguucaaaaccccagucucuuaacugaguaaaauagaauaaaaaaauagcuguaacauuuuuaaaacauggugauaacaguggcgcaauaauacugacugauggaccagaaaagcuuauugucauaaugauaaaaauacucuaaaacuggauugugaugagacugguaaauuuauugaaaauaacuuaauggaacacuuaguagguauguucuguagcacuugacuacuuaagcagaauugcuuuuaaguuuuuacuuuuuuuuuuuuuuuagccaagccaguaaugcacuccuguuacccagcacucagaaggcagaggcagggggaucaguaguucaaggcucaccucagcuacauagcaaacauucccauuccaacaugaaagacugagaggauagcaaggacagaugagaccaaaaugagaacgacagcauggcagauccggaugcugcccgccucucuaguucugccuccugccaugcaugcagccucucuguuaggcugcuucuaucccaugugugcgacucucugcgguuuggccaucucugaucuacugagcuuuuacugcagugaggcuuuaccuucacagccucaugaaguggucucucggggccucccugcagggacucugccucugccucaugccccagcagcuuccuagacucuuggcacaaguuucccugagcuauaaaucuuaaaguuugcacagcugcaagaccacuugagcaacucuguccaguuuugcugccagcgugaacaguagucugaccaguuuuuaucuaucuaucuguugugcaccuuggcagcagagccagggaacuuuccaugauggauuucaagcaaggcaacauuguuauuucaguuucuccccuucccuaugaauugcacuuuuccagccuggagucuucaguggcuggagucuugccuguaaggcaccuuuccuccugagugugaguuucuagccuuuaucagccagccucuaaccuuuaucauuugucugcaucaguccuuaaucagcuucagacuccccuccugcuccuuuguuugccagacuccacauuuucccaauauuuuaguucucucuuacuguaaaucuaagagcaguacacgagaccauaccacagccuguaugguaugcucucgaaauuuccucuauaacuuaguguauuaccuuugaauuaugccaguuuuucaggaugcaggguuuuuuuuuuuuuugguuuguuuguuuguuuguuuguuuguuuguuuuugccagauguaacacagcuggcuucuagcccagcuccuaucgucuuuguuacccugggaagccugagagcauaguuacuacugugugcccuucucccagugcucccaccagaacgguucaucaagcucugccuaggguagucuacaaccuguagguuucaaccucuuugggggaggaagacugucagaaaacucagauauuuacauuaagauucauaacaguagcaaaguuaaagaguagcaauaaaauaauuuuauggcuggggagucaguaggacacaggaacuguguaaaaggguaacagcauuaggaggguugagaacccguggcuuacugcauuccaggcuucuguagccacagacuagucccgaagccuaucuccacaugggcaggggcgccacagcagcagcccugcuccucaugccacuucugugagacguacuuuccucauugcugugaaaaauuaccucccaaaguugaagaaggguuugaggggacacagcaucuuguccugggaaggcauggggucgggauugugaggugggcaacuacagcacccccuacagugagaaacaggagagugaaugugggugcucagccacuuuuucuuuccuuucgucccauccaucggguagugaugcccacaucuagcauggccuuucuuccuuguuacuguccauagcacucccucucucauguccaggagaguguccaucaaguuagccagaguuaaccaaggucacaccaguccagcaccaaauccugucaggguucucucuauagcugugcuuacaucuccacuuacccuucugugacauaccagccucuucuuacuaaugcuacugcauuagccucccaacugcuacuuaagucacuuagguuugacccguugguuuguuaguguugaccacaugaggcagcagguggcauguaguguagcuggcagaguacugaccuagcaugcacaaaacccuagguuuuaucccuaguaccacauaaaaccagggauagggucacacaucuguuaucccagcauuuccagagaugaggaccagaagaaguucaagacauccucggcuacacagcaaguuugaggccagucugaguuacaugagacuaucugaguaguuaaaauggauggauaaugugguagccucagaauaacauaggcaaauccagcaacaucagaacauuuuaaaaacuagcauauaaaauuauuuuuauucuauauguaugaaugccuuuuugccugcaucuguaucuauguaccacauguguaacuggugccaacagaagccaaaagaggucaucagauccccugggauuggaguuccaccaugaggauucuggagcucaaacguggguggucuggaagagcagccagugcacucaccacugagccgucuguccucuccuguagccaccuuaauucugcucaucacuuuccuugugcuugagcaaguuugugaccuuuuguucugcuacaagaagucauguuccccugcugcagcucuuuccgugugacccucuguuuaccauccugguuaucagguccucuuugcagugccacuuccuaagaaagcgcucugcugcuucagacagcucccagcuuucuucaugaggagcucuuggcuuuccuuugacacacuugucaaaguuuugacuuuauuguuauagcuuugguuuuuugaaaguguguucccucgcuaggacaagcagacagugguguuugcugugagcaugcuggcaucuuccccuaugcuucugcuauguauugugcucaccggaauccuugacuaguuuuaucaugggugacuguauuccuacucugcuugauuggagucucucuccugcuucugagucccuucccuuuugcuuagcuacagcuguuacuaguuuugggugaaaaugauacaugucacauuuuuaacuggucuagaaaggcuucggggaaggcguuuuuaaaauauaaugguacuuuuuuaugucagacuguuaaagcauaaucuuuacauuagauuaugauaauugcauuuuccuaaagcaaacagauaggaguuucuguagaagauaugggagauuauuuuaguucuugugucugugcuacugguuuacaaaguacccgauuuguauauccuguucuaaaauuacuacuuuuacuagguauaauaugucacuuuuauuucauauaacagaggguagguacauuagcaaaauuuucuguuuuauuuaucaccuucaaagagcuuaucacuugguuucauaugacauuugcagaagaugugcauauauucuccguaaaaauguaacuacggggagcuauuuguaacccuugguguuaguuuaacugcuagauuugcaguucuauuaaaugccaaagucaugugaccuugcacccaaggacuguuauuuucuguagguggauuguguuccugauaaugagagagcacaucugguggagaauggcuuuacugugagccucugaaauccuuugucaguacagcccaagugcucaggggauacuuagccaggcuggaggucggacgugcagcaugcacuucugugccguugucagccuguauaauugauucaucgagaguuuugaagcaaaaaauaagcagugagcucuaaaagcaugcuguuucuguauguaaugauacuaacuccauguuaacagaggucaucucagagcaggcaugaugcugccucccaugaagcuggccggcagcacgaaggccacggaguggcagaaagcaacaccgcagccuccaguaguggucagguaugaauauuuucaaacugacaaguccugucuguuuccuuagaaugugugccucuagagacauucaguaucaaagcacucucgauucuuauuacauuuagagacacuuucugaacguguuggaacauuuccugcucggaucgcaugugcguggccuucaacugcugccgugcgcauucuggagagaguuuacuuccgaggggcugacccugguguugcauguuagcacacaguucugcucuccuuaaggccucaggacaaagacaugcuucugauucuuaacugucacaaaggcucuuuuagcucuuacuuucugguauacuuuaaguuuacacaaauugagaaauaaaucuuaauuggaaaagauuuuucugaugcuuauaaauaaaaagcuccguacugcaucauguuuagcugggacuguguccauuuuuaccaucucuacacugugccaccaguuuucaacaaaugguuuauugagauacauucauguauccuauauuuuucaaauuuccuucaacagacaguuuuauguuauaagggaaugauauuuuaaaacuaaaauuuuauuaaauugauuuuuacuaucaacacagaagauuggucuuucuaaguugcuuuagauauacuguuuauaucuuuaaaaaagggacuauucuguuaauccacuaauauauaaagcuuaaaauacuaucaaaauauuuccuuguacugaaguuaaagcagauacuuuauuccgcaucgcuaguuaguauuguacaggaaaguuauuuaauggugaauuaggauaaaauagugagguuuaaauagaagguuugaguucuuucucuguguuacuguuccaggaauuccuugagaacuguauauuccuacaguguaggagaaagaagauaaguuucauuugacaguuaguuguugaggcuucauugagaucauauucuaauuacuguauacuuuaaagucuuauucauaugguagacaguaucuauacaaaucugugauacuacaugaaaaucaucuuuaaguugauuauacucgauagcagaaauggagacuguugcaaauauaaaaggauaagaaggaacuuuuuauaaugaagugggugggaaaaccacaaaagaaggaucaguaggugucagaagaauuugaauacuuuguaucugaggaaacggaaacaagauagguagacacagaagaucgggauggagaggcucugcaguuaacagacuggacagucucccagaggacccagccuccagacgcagcacccacauggcagagcacuccagucccagggcauccaguuuccuuuucuggcuuccaagagccagccacucaaguagaacacagacauacaugcagacagaacacccauacauguaaaauucauuauucaauuacauuuuuaacaagaaauuauuuuuuuacuuuuaccuuuuuuaauugaaauauaauuacaucauuuucccucugcccuucagucccuccuguguccaucugucugugcccucuccugaaauucauugccucuuuuucuuauuauugcuacacacacacacacacauaacauauaaguauauaacauacuuauacguuuauguuaaauguauauguaacauauaaguauauaaacaaaaccugcugagucugucuaguguuugaguguccaugauuucagggcugaccacuugauauuggauaaccaguaaagggacucauuucuggagaagacuacuuuucaguugccuguaguucuuugucuaggcaugccucccuccccaccacacccuaaauaucccccuuccacacuggcaugucuguugguauuguccuuguucaucagguccuguuuaggugccggaucgugggugaaacuucccugucauuuuaagagacauaauuucacagcagauuuccugguccucuggcuuuugcaguuuucugacccacuucagagauguucccugugguuuacguacaagaguuguguuguacacacgcacaggcaguuguucuaucuacauucuuacuuuucuguaauggccuccaccucuuucagagagaagcuucuuugaugaggggugggagcagcacugagcugugggugugaggauaggauuuagaauggaguuaggaggaugcugcuuuaauaaaguauuggugauagucuccucuaagagccgugaccucacucacucgcccuggguggcuggcuagacuuccagcuccaagcauaguuucaguuucuuccuguuuagcaggccuaguucuaguuaggcaacugcugguuaaccgccagcuauguaugaggaccacugugcacccuuagggguauuuaauauuuuucuuccuucccucccucccucccucccucccucccucccccucucucucuuucuuucucucucucucucucccucccccuuucucccuuccucccuuccuuccuuccuuucuuccuuucuauauuuauuuauagguuuuuaguuuguuugaguuuuucuauuuguuuuugaggcagggucucuguaagccugguuguccuggagcuugcuggcuggccuugaacucagagauccuuuugccucccaaguacugggauaaaggcauaugucacuacugcccagcucccuuagggcuaucuuacaugcuggguuuuguuaaugguuccuagguguccuagcuggguagggcucuuaguuguuccccucccuugucagcuugcauaacaucuuccaaugcuaugaaagcuagucgucagggaggaggcuugacuuggaaaagucaagaucaaagcuggacauaauggccuguaccuagaauccugugauuugggauguagaagcaauaaaauuuuggaguucauggcuacccuuggcuauagagccaauuagaggccagccuggguuacaagagaaucugucccagaacaacagcaaaaaagucaagauuauguuacuugcaaacauuuauagaaaacaaaaaauuuaaaauauaaagauauuuacaagucagguauuuaauaaagaugcuucagaauuggccagugagauaauucauuacauguguuuguaugcaacugcauaaggaaugucggggucaguguuacaguagcugucauugugugcugaggucuuuagagcuuuuguuuuauugcuuauauauuuguauauuuuaacuuuccuagaacucacucuguagaccaggcuggucuugaacucagaaauccaccugccucugccucccaggugcugggauuaaaggcgugcacuaccaugcccaguuauuuuaacguuuuuaauaagucaaguuuuuacauuguguaacaacuauaaggucauuuuuauuuugggaaaauggaagaaaaauguacuguuuuccauuccucugucacuuaggguguccccagaggccugauugaaauuguuggggucuaggaaucaccccacaaaccaucagacacugaucucagucaaacagggauaguuuacugaacacacacacacacacacacgacugaucaaucagggaugcagucagacucaggagcugagacugcaacccugacuguuuuccagggguagcuaauaaaggcaaaaaccacagaaacucauagcaaccauaaaagcucacacacagcuacaggaaauacugccgagugguugggcagaugguucaagucuaaggacgacaaggaaggaguucaacauagacaagcaguauaguuacuguuguuagcuauacaaagcuguucugaccuuuauugcaauugccccuagaggagggcgagggucugggcaauuuccaagaauaccaaagcauauccaaacaggauuugcggugguuaauaguuaccuuggacaugaaaaagguccucgcaacaguauuaagauggcugaccacagauauaaaacaaaauggcuaugguaaugucagaaggcagcagccuucuuacagagaccucauguuauuuagugugaggauggcagaagagggaaucauugaaaggagucgaucagucaugguagccuugucaguaaucccagcacugugaaaacugagguagaaaggugggcggugguggcgcacgccuuuaaugccugcacuugggaggcagaggcaggcagauuucugaguucgaggccagccugaucuacaaagugaguuccaggacagccagggcuacacagagaaacccugucucgaaaaaaaacaaacaaacgaacaaaaaaaaaaaaaaagaagaagaagaaagaaaaggaagaaaaagaaaacagagguaggauggccaguucaaguccaaccuggguuacauaguguggccagccaugagccacauguagaaacacugucucaagaaaaagaaagaaagaaauugguaauucagaaccaaauauuauucccucucuaaauaaauucuuuuguuuuacauuaauuccaccaacauuguauacauaguuauuaucaguccucucucaaaucuucauguacaugaacagucaacaucaaugaguccaagauuccuuagacaccagucccagguaugugaaaggcugaugcagaauuaucacuuuagucaauuuugugccuccaggguacugagauuaaaaggcguaucucccuacaauuggcucuucaaccuaucuugauaggauguguauacaagauaucuuuuauuauuauuauuuauuauuauuauuauucucucauuuauauuacauacuuaacugaaguuuccccucccucccagacccauacuccuccucuguuucccuucagaaaagagcaggccucccagggauaucagcugcacauggcauaucaagauacaguaagacuaggcacaaagccagauaaggcaacccauuaagaggaaaggguccuagagcagagauacccccucccaagaacauugagcuacacagccguaacuauacaugcagaggucgcggucagccccauacaggcucugugauuaucacgucagucucaacaacagcaagaggagcgcucgcuaucuaguuuuuuguuuuaugcaccacagucucugauaaaugauuggugguuaaauaauugagcgaaaaacuagugguuuuaaaggagaacgauacauccuugcuaggaaaaggauuucuugaucuguaguaauuucuuuaggaagcuaagugaaguaaauuauucaggcaagucccugcuuauuuauguuagacuucuuccuuaauggguucucagcuuugcaguuugaagaucuuugauaaugccuuuggcagugaugaugaagcucaagcacaaguuagggagagguggaccaguggggaaagccaugcaccgcugcuggucucuaggauuccuuccuuugggcuguuagagauggcauaagacaagaguaaccugguuccguguggaucauauccacugugacuacccauuguauuucugaaaauuaucuaucauuuguucuauaaauauuucacuauucauuuccaagauaagaaugcuuuucaaaaaugaauaccuacugucauuaucuccccagugaaacaaaugauuuuuuaauagcauaguauagccuaucaugauucguuugcuauuguuucauaaauguauuuauaauauuuuguuucacuuuaggccuagauaaagaccaugaaucagaauauuggcuuauaucuaaaaucuuugccaccaguaauuuucccauccuguccucuguucuuuuuaaaacauaauuuagauuuugccagucucccaccuaaaguccacagcuuaaauauaacaucuuuaaagccuccucagauacuuaauuauuuaauccaaccuauguccacauuagaauacaccgugcucuccauauuugucuuuagagcuaccuuaaguuuuauuuacugcagcuuuucuguccagagcaggucaucgccucuuucuguuuuccucugguaucuugugcagccugcuauaguuuuguuauacugcaguuauuuaucucaucuuuccccaauagaaucucagcuucuucuaaauugggagcuucagaguggccuauauuuauaaucuaaauugcacugccuauaauuugcuuaacuucuagaguccagcuacacguguggaucacgaaacagccaguguuuugaguucuagcggcacgcacucugcuccucgaagguugacaagucaucuggggacaaagguaacagcagauuacaaacccucuugcuagugcuagggguauuuugcuaagauggucuucaugaacauuuaaagaauucucgcucagucucuuaaaaagaaaaaugacauuuuuauacaaagaagcauaaaugagaggaaaugggaauuauaaaaacuacagacuuguugccuguuaauuucguuuucagcucauuauccauuuaccugcaagcauccuaagcuccagccaggcugacuucuucaucaccccugugccuucccaccucaguguugugucugcagcagugcacauguuugccccaccuugaagggcugucagucuuuccgcagcucaggcgucugagcugugucuccaaaagacaguuucuuaacuccacagucgggaugaaacgcccucuuaaaaaucagauuguuuuucucugucuuuaggaucucaccaaggcuacaaaugaguguuaauauuuauugaaauggacagaaaaauauucauugaaacugaauuagccaauauggcaaauaucuuacaguuaugggaaaaaauguaugagaagaaaaucauuuuaguauuuuacuauggugaaauuaugagcaauaugucuucagucaaaacugaagaauuacugucuucauagcauauucugugcuuuguaaauaauaugggaauucuuaggaaacauuaaaguaacauuaauuuaagacaugaauuuuagggcuaaagaugaaaaucauugauagaaugcuugugaaauaugcucaaagcucugagcucaauugauuaagaaaaaacaguuaauuaaagaaauggcuagucagugguagcucacaccuuuaaucucagcauugagaaggcagaggcagguggaucucuggguuugaggucuacacagugauagcuagggcuaaccacagaaacccugucucgggagucgggguauuaaagagauggauuugagugaucagugguagcucaccauaguuucuguugggaccucucuaagcugggccaauaaguaauuaucucugcauugucaccaguucucuagauucuuacugaaaaggaagacgcugcuucaggccaucaggccuagagcugaugagauuggcucagcaucaauacaggguugacucaggcaggaugcauuuccuuuagcagugauuugugcauaauaaucuucaggccugguuuccuguguaauguaaaucccuucauuuuguagcucagaaaauugaugcucaagagaaaucacauaaguacuaguaccgugcugcuugcuuaaaagugauggagccaaacuuuggaacuaagccugaugaaaacacauuuaucuucaggccuguugcugccauaauagaacuagcaucaguggaaaguguuguguuuacacauuccaagcaguguuuggcaaccucagcaacauggacuaagucauucuguuucuauaggauauuaaguagcgccccuggcuucugccuucaaaacccccuaacacuuaugugccgcuguuguuaggaccaaaauuaugucucagcguacagccagauguguccuugugaaucucugacuuacacaggugaugcgcucuuccuaugugcccucuccuuucauggagcauccucugacuuggaagagaagcugguaacaccccaugcuaacuggaugcuguuuuucuguuugacuugcuucuaagcuaauccucccaaucugucaaagcaacuaaugcuuaccacuugcuucucagaaagaacaugauucugugauugugguauuuuucuuuuuaauggcaaaauaauuuuauauaacagauuauauaaguuuaaaugucauuauaaccugaugaaauguaaugauugcagagaauuagaauuuaguagauuauaauuguugcaaauguuuucuauuccuuagaaguaaaaaaaaguuuuaaauuauuugaagaauuuaauuaaacaaauugcagagagagagagagagagaauaugaaugugaauggaguaucugagagaagaaaaauuauuuucauucauaauaaucaauuaccuuuagcugauacaggcaaauagcaauuucagugcugugagaaucacagucugcacuauuacuauuacuuauucacauaaaccaacuguggauguaauuuuuaaauagcugucaucucuucauccagaaaaguuuucuuuugcuuuauuuuaauuuuuauugaauauaguaaauaaucccauucaucacuucauuagaucuaguuuuggguauuaaaguuauaauuuuguuucuaaacucauuuggcccacagguggaaaugguguauuccuuguugucaaugcuugguacucaugauaaggacgauaugucacgaacuuugcuagcuauguccagcucccaagacagcuguauauccaugcggcagucuggaugucuuccucuccucauccagcuuuuacauggcaaugacaaagacucuguauuguugggaaauucccggggcaguaaagaggcucgggccagggccagugcagcacuccacaacaucauucacucacagccugaugacaagagaggcaggcgugaaauccgaguccuucaucuuuuggaacagauacgagcuuacugugaaaccuguugggaguggcaggaagcccacgaacaaggcauggaccaggacaaaaacccaaguauguucuuuauagugugcaucucaaugcauguuucaaaagcuuucgguuagagauucuuuuuaaguuaguaugcugucuuuaugaauagaaggaauuugcauuagcuaacuaaugcugcuaaaaaauuuuaaggcuuaaaucugcauuucccugaaaaauuuuuacaaaggaaacuguuauguaugguacuguguaagcaggucagauauaaagguaaucugggugggcaggcuugccuuccuuccuuccucagugcaccauugcucccaccccacccccaaagccaaguacucaguuaaagaggacagccuuccccagaagacaaggaccauccagucagggauauaugagaaguccugcuagaacuucaggcaagcuuucaagaagaaaaaacaaacaaacaaaaaauuuaaagguagcugcuuugaugaugugugugugaucucugcauuugggagauggaaacaugagaaccaagaguucaaggucaucuuggacuacacagauuucaggaucagccugugucaugagacccuguuauaaagaagcacaaaaaagaggacucuacuuauuagagcuagagucagugugagcaguuagguugccuuuggaugaacauuucuuucuugauggggguacccacaauuauuuaauaauuuacauuauugcuucugaaaaaauacuuucugucaaauaaugacuuuugaaacuuacauauaauauuuaauauguaggugcauauucuuggauacuauuuucuuuaaauuuuuacaauaucuguuuguauaggaagcuuucugcuggguaucacauuuguaugcagccauaugcuuuuaauuuaugaccauaauaguuguuuacacugaaauuagaaacaaaaaucuaacaguauuauaccaacguauguuuaugauuagcucagcaaaccuaggagagauuuaguccacaguccugguuaaggcuaagcaugcuuauggaaccaaggaaagcccuccgcgcagcugcuauucugcagcugugguauauacucagccguaagcagaugaucuacuaaccuucuauacaugagggaugugucaauaacgucugcuuauuuaaaaauguaacgacaucuuuuuuaagauaacaaagcauuaugacucagguaacuuuauuuuucagugccagcuccuguugagcaucagaucuguccugcuguguguguucuaaugaagcuuucauuugaugaagagcauaggcaugcaaugaaugaacuugguaagauaaaagcuuuccuaacgccacaaauacaugcugcugaguguuuaaaacacaaaagaaauugauuauuacuacaaguuuagacagagaaguugaacuaaugugaggcugcuaacuuugaucagcuguuuccaucccuauaggaaaaagaaaaaccacuauucccuguccccaugggagacagaaacaucuauccuccuaugaaccaacuucaguauuuaaaaucuuaacuaaagauuggaaaaauuaccaaguggaccaccugggucccuguugcccaaguagauccuguguugugucugaugacaguuugaaucauuguucuugcaaucugucgggcaucuuagaugaacaccaagaaguuauuaagauuuuaauuucucuuaaagguuaucaguauuuuacuggauuuuaacaaugguugaaacuaguguauauagaaagacauguucuaacugaaguuagaagcacgugguuaauuuuguagaaauuacuccuuuagguauacauccuuuaaacccuauguaaucauugagcacccauuuuuucauguugguuuuucuuuaauuucuagguuuauuuuacacauguauucauaaauugcaucaugcugagccaugucaugugaacuggauaucucuagucucgccacacagcaagagccgcacacugaguucugucuuaguguggcuggcccgcuuuugugauguucguuccaucacacccagccccugccuugcauccucaccaccucauuguuauucaucaguuacuguaagcgugguacaguugugagccuuaaauacgacagacugcacugcaggaagggaguguuguccccuucagagacaucacuuugggaagcucuggucugugguuugaggccugcccuccauucgugcuuuucuucccacaggcccaccugguccucuuuccaauguccugugaaaccucacuuaaucuuuuggguuuuccccauuucgguucagucucagcauuugugaauuuuuuaccuaaugccaauaauuaagaaaagggauaaaacuaacagccaggaaaacucaguuuuaagauauuggagagguuuuucuauaaauguucauauguuccaauggacuguagacuaggacugacacauuaauuaucugaauuugagaauaaaacuuagacucaguauuuguuccucuucuucuucagguaggaaggcuacccggggcauuucaucccaggagcuaggucaggggcuuucaggugaggagcaggauggggccucugggggcguggcugugggacgcagccacagggugaccuuccucucacuccucgccuucacauucgcacuggggcaaaggagaguugggcuuugugagucagugagcgaguacaggauagcacagggacuuggcagaagggggaagggaggaaggaaggaagaguucuuaggccuagucagugagcucugucccuuggaugugugugaggguccuagacaguuugcuuugggcacuggaguuuucagaugauuaagacacacucuggcuuccaaaaaaauuuacauuaauauuuuacaauauuucuaggucauaacagucaguagaaguauuugccaggccagauauguccagcccuguagcaaacagacuucccaaaguagcccaggaaucccauuaaauaucagucugaaugaugcuuaugauuguggaaccagaauaucagucugcagaauauugauauggaccccaauacucaucaugcuaaugauggcuagccaagccauguuauaaaaauuaaauaucuuaaucuuguuuugacuaagucuaaauuacggguucuguuuaauaucauuugacacaguugaagugcaucauauuucagugaauccuuuuacaguuuuaaccugugaauuacguuuuuugccucggaauucacugauuuuuuuuuuuuaccugccucaaauuagaaagggaucuuuuucucuaaaaauugaaguuuuauuaauguuucaucagucauaguauuguugacguccaguauauucuccuuuccucuuugcuuaaaaucagguccgaaaacugauacaaguucucugacaauugaaugccauccuagcaccuucuuuagaccauuuuaucuuucuuaggaggcagucuauuacuauaccaggcaagauuucaugcaaaugcaaagcauaguguuuuacuuggcaacugagacccugcuucucaaugcucuacaucuugaguaaacaucaguauccugggccacagucuucaggucuacagugacuugcugguugacaagagugucagcuauggugcuggcuccuccuuugcucaaguguacaaauacuggucuucauuuacgcugggccugccugaugcucuguucucccucucuguguuguagcauccaucccuagugcuucacuuaauguaucggucacgguugagcugguguucuugagauucacgucucaaucuaacuuucccuucuucaguuuuaugugugcaggcaaacacucuaccaccaagccccuggacauguuccuacugcuuaucugacauuucucuugacaaugguauucuagacacuuguagcugaacucucacaaacagaucuuguuagcuccauccccaaaucugucuuuuucagcauuccuuuuggaguucuaauaacccagcugcucaaauaaaacucuuagaaaaaucauacaggacuucauuuaaaucuccuacaguuagaaacugagcacuuucauccuuuuucuuaaguguaucucaauccaggcgugguagcacaccuguaacauaguacucgggaggcaaacaagauugaucucuauggucuacauaggguguuccaagucagucagggaugcauagugagacccugucucagaaucagcaguguguguguaugugcauauguacauguaauuguuauuucucauccugaggcaaagcaccauugucucucugguucuacauauguuuuuccuacuuucagucauaagccauucugcacauugugcccaccguacuguauuuacaguauagcucuacuuacacuuuccucugccuaacauccuuaguauagcauguagagucucugugcucuggcaccacccaccucuguagugucagugccccgccucacugaguucuuacacacacugucuuuucuaccuagaauaacucuuccuccuccuugucccacccuguuagcugcucagucagccauuagauuccaccuucaggguuguuucucagacccuuuccuuggggcucugcccacuccagaucucggugcuucacaucguucauaaguuucaugaaggcggggacugaauccggcucacugacuguacuucucuauuauugcaaauagauggaggaaagucuucauaaaugugguuuggauuuucuuuauacaaauuugcuugccuauguucagagaauugccugucaucucuucuugccauaagggucuguaugagucuucauauagucaagacaccuuaucuuacaguucuuaggucagcauagaacuugauuuuguaaaugugcagauucugccaaugaucuuuuuaugccauucacaaaacguuagugcacuggccuuucagguuagcagcuuacugagacuuacaagcaugguugguauuguuuuaaugccugagccaccucuggagcaguacaauacccaagucccaugugacugauguugaugauggugaucuaucaauaguucgugugcauuuuuaucuuucuuuuauucucauccucaccauuuugcuucgcuuuuuuuuuaaucuccucccuuuacugucuucccucucccuuuauguucccaguccucaccuccuacuguugacggcgugugauucagcacaccugcuaguuagguaguaggaagaagggaaauacugaaaccugguacacuugguuauuuuagaguaucaaagaaaauuaagauuauuuuuuaaagaaacuugauaaaacuuuguaguagguuaaacauaucguucuuuucaugaaguaaguuuuacuucaagcaaaauuucauuuaaaaguuucauuauuccuaaggaucauuauuugacacauuaaaaaaguauuagaccacaggauaugacaaauggaaaguaauuuuaaagcccuuauaauagcaguaaguuaauuuuucuguuuagguuuagaaagaccaguguuaacaaauagccuucauuguuggcaagguacaguguacgucagugaauagaaaauaauguuuauuucauucaguaaagcaaguggugggagggucgagacauugacagagaaugacaucauugucaguuguaauuauguuacacaaaaauuauuuacaacaguuuuguggcuuuuaauuuuaaaggcaaauuuaaaccauguauucucagucuuagcguucuuuccccucugguuuuaaauuaccaaauuauaccaguguauuugauucuagauuauucuauguuuccuuuugcccuuguuaaauuagggggacugcaggccauugcagaguuauugcagguggacugugagauguaugggcuuacuaaugaccacuacaguguuacuuuaagacgguaugcuggaauggcuuugacaaacuugaccuuuggagauguugccaacaagguaugucuuuuauaagguuuacuucuuaaaguagcucaguuagaacuaaagaaagaauuacuuauaacuaguuuuuuggcgucucccacagcagcccaguugaacagugacuccuggaagcaccuuucucauggugacugcauagcccuacuuaguggguugucuuuugcccaaacaaagcaaaagcacaccugaagauggagcccuacacugaaauuauauuggugcuccaacagcauugcucauacuaggaaugcagcuaaaaaggauaguaccuuuaccuagcaaguauaggugaccagcacuguagaaaaggauaauuaauaaaacacuguucccaggagugagauuaaaacccugugacagggcuggagagauggcucagcagguaagagcacccgacugcucuuccgaaggucuggaguucaaauccccgcaaccacaugguggcucacaaccaucguaacgagaucugacuccccucuucuggagugucugaagacagcuacaguguacuuacauauaauaaauaauaaauaaaucuuaaaaaaaaaaaacccugugacaaacaauauacacacugaggccaucagacagaacgccgugcucugguuuuugcuuaucauuucucagaauuuugcuuggguuuccuaguuagauaacaaaaauacauaacagaaauaggaggcaucuauccuucauuuaggcaaucuuguucugguucuugugcagguaaaauaacauuuaugacugaaauaaaagcaggucugaaauuuaguagcuagaaauacggccauuucaggcagauuccuugaugacucuacuccgcuucuacuguuacaggcuacgcuguguucuaugaaaggcugcaugagagcacuuguggcccaguuaaaaucugagagugaagacuuacagcagguacuacuuagaauuuuagcaaguuaauguacuaauuuauauuaagcuuugguuuaguauuuaguggcuuguguuaaaguauggcuuuacuaacacuaaaguaaaguaaauaauuauauugaaguaauucuuucugucauccaaguaacauuuuugaaaaauuuacuauaggcagagcauuccuauuuuuauuacuauaaucaaucauauuuguugugcaaauuagugggcuucaccugugaccucucaguacaugcgaauaccaugcuuuggucuuagcgauggggcauuccuaaccuaaaaccuaaaccagacaccacauguggaaaaucuguuauaaagcugcuuuguguacuaaguuauuaauauacuauagaaaguuaccgucagguuauacauguaaggaguauauauguguggaguauuaucucauacccaggguaucucacacauacuuaaauauucaaaaagccaaauuuaaaaucaaagcacuuacgcauuuagauaggaugaauuuaaacugcaacagauucuacucuuaccucuagcauuagaaacaaaaagacaauuagucuuacucauuuuacauguaaauuguucuaaacuugauuauuuccagguuauugcaaguguuuugaggaauuugucuuggcgagcagauguaaauagcaaaaagacguugagagaaguuggaagugugaaagcauugauggaaugugcuuuggaaguuaaaaagguaauguuaaaauguugggugcuggaauaggagacccacuagccucugacucuuuagagcugguauuaaaggcacacuccaccagagagacccugucuaaaacaaggagggaggcaagggccagcauccgagguuguccucguuaacuugagcgugguggcaggcacacacuauacacaacucacacaagcaguuacaugcucuucauacacacgcacauagacagauccauauuaaaugugcauaggcucuauauaaagauaccuuugagauuacuaaauacaugauuaggacugauacuuaaggaaagauaccaauagccacuaagugcuggcaaggguacaugauguuauuugccacuaaaacuacagugaaaugcuauuauacauaccauacuggauuaaaguuaaaagauuaaccacacgucaagguugcugaaccuauauuaucauugggaauaugaaauuguauacguacuugggaagacauuuagagauuuuuuguuaaacauacaccugccauacuaccuugccauuacacucuuaagaauuaacuaguguucucacagauuuauacaugauguucuucauaauuuuguaauggccagaaguuagaagaaacuauaauuacuguuguuacauuuacauauacgugugugcguauacauacauacauacauauacauacauacauacauacauacauacauacauauauauauauauauauauauauauauauauauauauauauauauauauauauaugaaugaacaaugaaauucuucacagccauaaaaagaaugaacugguuaaaacggaaaaaaaaaaaaguauugcaugcuaccgccccagccuacccaacaaguuauggcggaguucaagaccucccugggcaucauagugggguacuggcuuuaaaaaaugagaguagugugggggggggggugguguuuuuucauaagugcacaugcaaacuagagcuauguguaggaugucuuccuccauccccgccccugguugguugguugguuguuuucaagagcaggccucagggugggacuuacuauucagccagggcugacguacaacuucugauccucaugcuuccaccaacugcuaggaucacagacaugggucucagcucuuguuuuacacggucccagggcucaaacucaggguuuuauucgugcugagcaggcacucuuaccugcugaggcaaauauguagcucuccgucuuuuuuuuuuuuucuuauguauggguguuuugucuguguguaugucuauguaucagaugcguaccugauauccucagagguguugggcccucuggaagcaaccaguugcucugaacucccgagccuucacucucagccgauuuuugguaggguccucucagugaacauagaacaccucuauucagcaagacugacuagacaucuuccugucuuugccuuccaagcugccuuguccagcuuuuuacauggauuuugggaaaaucaaacucagguauucguguuuguguagcaagcauuuuaccagaugagcuaucuuccagcccaaagaacaaauuauugaaaaauaaaucaggccgagcgugguggcgcacgccuuuaaucccagcacucgggaggcagaggcaggcggauuucugaguuugaggccagccuggucuacaaagugagcuccaggacagccagggcuacacagagaaacccugucucgaaaaaccaaaaaaaaaaaaaaagaaagaaagaaaaauaaaucaguaagauguauuuaaagacacuucuccgguugguuuuuguuuuuguuggugugaaugcaugcaugucuguguaucugcuggcaucugcaggcacguguggaggucagagaaaacucucaggaguugauucuuuucccacugugggcuugaacucagguccucaggcuuguguggcaggugcuucuuguugacugucuccucgccagcccaccggguaucgugugaguggucuuaguaguuaccuguaacccuauaucuaguuucuuugguuccuggaguuuucuuuaccuuguacuuuuugaaacuuagacaguagcaccagcuagaaagccauggaggggagguguuaauuaacccuuugcucauugaggagggugcuaguguugaaagcaagucagugcuugucuaggcccugggguaaaaugaaaagauggguuuggaggcaugugaagaaaccuugagagguguaaauguuuguccauugauuggagugaggaguagcuacauuuaaagugauaagaauguauaugugaaagauguacaguuuauuucucuucaauaauaauuccauaaaauuguaccaggaaauuagugccguggcucccacuugcugcucacuuagagcccucaguccuuccuucccucugcuuugucuuuagauccuuuuuguuucagcuguguauuuaaaaguagaaaguccuccauggcuucuaauuacuagaggauuucuuuuccuauaaugacuaaaguccuggcuggucacuccuuaguuccuccuaaucugauuucagauaaccuuuuccuuugucucagaaucuacagagguuuacuucacuaggguuuucuuuugaauuuccuuguacauuguauuuuuugaucagccacuuauuacagcuccuugccuccuuucuaaucuccagccauuucuuuuccuucuccugcccugcacaucaucacccaucccaucccguguguacugugucuauagcugugcuccucagcuacaccccagcuugcaaucacuucaugccuccuguaauuucaacuguaaaacuugucuaauacagacuuuugguccuuagccuguaaucucuggagcauccuacacuuaaaucacauuguaauuaaaauugaacucaggaccuucucauuugugugcguguguauguguguguguguguuuuagguguuuuguuguugcuguuguuguuguuguuauuguuguuguuguuguuguuguuguuguuguugugagacugggucuuguggagagaggcuggccuugauuuuguaccaauccuucuaucuuagccuuccaagugcuggauuucagacaugaacuagcuagcugaugaguuacauaaaacuggccauuuauguaaggcucugugugucugcauaagacccuggaguugagacuucaaguaguuccuggugggaauuuuguuucugguguuuucucucuuacauuaucugcguuauccuccuauacaguguugucuccuuugugagguauuuguuuuaaauucagacugcagcagccuccuuuuugcuguuuugcaucuggauugucugccucuuguucugacaggaacauuccuaauaaagagucuuugaugaugucauaagaagaaacacugacauuuggaguaugacaaauuguaaccaaauaucacuaauaucagaguuuuucugcaacaauuagaauuuuuauaugugagggagcuugggccuuuuuguaauuuguaguuucuuuaggaguuuuaaggauuugugggcuggagagauggcucagcaauuuagaacacugacugcucuuccagagguccugaguucaguucccagcaaccacgugguggcucacaaccaucuguaaugagaccugaugcccucuucaggugugucugaagagaacaacaguauacucacauauauaaaauaaauaauuuuuuaaaaugaauuuguauguuagccaggugaugguagugcacaccuuuaaucccuucucaggaagcagaggcaggcagaugucuuuaugaguuugaggccagccuggucuacagagugaguuccaggacagccaggguuacacagagaaacccugucucgaaaaaaaaaaaaaaggauuuguauguuuucuaguacuuuucagacgucauguuauuuuuuacucaauaacacaugaauacauaaauuuguuuuuaauacaaauaaaguauuauauaaccuguucugcaguauguuaucauucaguacuuagauaucuuuccauauccacacauaguauaugaagauguuuugaguuucuguuauccugauaauauuauauugugauagugaauaucaguucuguaucauggaaagauagguggucauuaguuuaauccuguguugacucauagaaacagcacugacccaaauuucauuuugugugaaacuguaaaugaaagguuccugauuuacuagugaggaaugucagaagggagaccaaaagaaaaaagacucuuaacuaaauggcacauacuguguuucaaucgugacuaggaaucaacccucaaaagcguuuugagugccuuauggaaccugucugcacacugcacugagaauaaggcugacaucugugcuguggauggagcacuggcauuucugguuggcacccucacuuaccggagccagacaaauacuuuagccauuauugaaaguggaggugggauauuacggaauguguccagcuugauagcuacaaacgaagaccacagguauauaccaaguucuauauuauucucuauucuuuuaugugaauuauuauaguuuauuucuuuagaaaaaccuaauucuaaauuguuuuauauuauuaugaaagcucuaagcaaagaggccucauuguagugcaaagauaacuaucaacuccaaaaauaacucauuucaauguuguugcuaauaaaguucaaaauauccuauaggaaucuacaaauaugguaguugagaaauccagccaugcuguagaaaaaagaaauaaaaauucauucuccccuacuuagauggcauaaagaaacacaaaacuaauuuuuaaacaaaggaaaacuucugaguaugauggaggaaauauaaaggcucagcguuuuccuaaugaugucuuaaccaguuuugaagcuuauuuauacccuuggcaaucaguuuuaaacuaaaauagaguauguuauuacuagauguuaauuuuuuuauauuuaaaagacugcagaucucuccaaggcccagagcucauuauauugacuguuagcccuuauauuuauaugcuuuuuguauuuuuaaaaccuauacuucauguuauuucuuaaaauaaugcuuauauacacagucugccaaagugugcuuuggacuuggugucuucacugagacagagaccccguacucuguaaaguaaguuugcugcucuagaagcguacugggugcucccagacuacagacccaucugccagucacuugucuucugcuuccaagauaccucaguagucauuucaugauguauguauaauguuaaauuagagaauuauuacuauguaaauguagaaaauguaucugcucaaaaaauaaaaauccuuucucuuauaguggaucagaauaggacacagaauaaaugaaacauaacaaacacuguuaccacuuuuggaaugauagaugauacuuggaaaaaauaaacauugacuggaccaagagagcaggaagagaggagauggcugaugugcucauaacgugcuuuguaaucaucccuguguuaaaacucuuuucugccccuuuacuuguugucacuaaucacauuuuccccuuaaucucauguguuuuuguuuuaauucaggcaaauccuaagagagaacaauugccuacaaacuuuauuacagcacuugaaaucucacagcuugacaauagucaguaaugcauguggaacuuuguggaaucucucagcaagaaauccuaaagaccaggaagccuugugggacaugggggcagugagcaugcucaagaaccucauucauuccaagcacaaaaugauugccaugggaagugcagcagcuuuaaggaaucucauggcaaacagaccugcaaaguauaaggaugccaauaucaugucucccggcucaagucugccaucccuucacguuaggaaacagaaagcucuagaagcugagcuagaugcucagcauuuaucagaaaccuucgacaacauugacaaccuaagucccaaggccucucaccggaguaagcagagacacaagcagaaucuuuauggugacuaugcuuuugacgccaaucgacaugaugauaguaggucagacaauuucaauacuggaaacaugacuguucuuucaccauauuuaaauacuacgguauugcccagcucuucuuccucaaggggaaguuuagacaguucucguucugagaaagacagaaguuuggagagagagcgagguauuggccucagugcuuaccauccaacaacagaaaaugcaggaaccucaucaaaacgaggucugcagaucacuaccacugcagcccagauagccaaaguuauggaagaaguaucagccauucauaccucccaggacgacagaaguucugcuucuaccaccgaguuccauuguguggcagacgacaggagugcggcacgaagaagcucugccucccacacacacucaaacacauacaacuucacuaagucggaaaauucaaauaggacaugcucuaugccuuaugccaaaguggaauauaaacgaucuucaaaugacaguuuaaauagugucacuaguagugauggauaugguaaaagaggccaaaugaaacccucaguugaauccuauucugaagaugaugaaaguaaauuuugcaguuauggucaguauccagcugaccuagcccauaagauacacagugcaaaucauauggaugauaaugauggagaacuggauacaccaauaaauuacagucuuaaauauucagaugagcaguugaacucaggaaggcagagucccucacagaaugaaaggugggcaagaccaaagcaugugauagaagaugaaauaaagcaaaacgagcaaagacaagcaagaagccagaacaccaguuauccugucuauucugagaauaccgaugacaaacaccucaaauuccaaccacauuuuggacaacaagaauguguuuccccauauaggucaaggggaaccagugguucagaaacaaaucgaauggguucuagucaugcaauuaaucaaaauguaaaccagucucugugucaggaagaugauuaugaagaugauaaaccuaccaacuacagugaacguuauucugaggaagaacaacaugaagaagaagaagagagaccgacaaauuauagcauaaaauauaaugaagagaaacaucauguggaucagccuauugauuauaguuuaaaauaugccacugacauuucuuccucacaaaaaccaucauuuucauucucaaagaauucaucagcacaaagcacuaaaccugaacaucucucuccaagcagcgagaauacagcuguaccuccaucuaaugccaaaaggcagaaucagcugcguccaaguucagcacaaagaaauggccagacucaaaaaggcacuacuugcaaaguccccuccaucaaccaagaaacaauacagacuuacugcguagaagacaccccaauauguuuuucaaggugcaguucauuaucaucacugucaucagcugacgaugaaauaggaugugaucagacaacacaggaagcagauucugcuaauacucugcagacagcagaaguaaaagagaaugauguaacucggucagcugaagauccugcaacugaaguuccagcagugucccagaaugcuagagccaaacccagccgacuccaggcuucuggcuuaucuucagaaucaaccaggcauaauaaagcuguugaguuuucuucaggagccaagucucccuccaaaaguggugcucagacacccaaaagucccccagaacacuauguccaggagacuccgcucguauucagcagguguacuucugucagcucccuugacaguuuugagagucgcuccauugccagcucuguucagagugagccauguaguggaauggugaguggcaucauaagccccagugaccuuccagauaguccugggcagaccaugccaccaagcagaagcaaaaccccuccaccuccuccacagacagugcaggccaagagagaggugccaaaaaguaaagucccugcugcugagaagagagagagugggccuaagcagacugcuguaaaugcugccgugcagagggugcagguccuuccagacguggauacuuuguuacacuucgccacagaaaguacuccagacggguuuucuuguuccuccagccuaagugcucugagccuggaugagccauuuauacagaaagauguagaauuaagaaucaugccuccaguucaggaaaacgacaaugggaaugaaacugaaucagaacagccugaggaaucaaaugaaaaccaggauaaagagguagaaaagccugacucugaaaaagacuuauuagaugauucugaugacgaugauauugaaauauuagaagaauguauuauuucagccaugccaacaaagucaucacgcaaagccaaaaaacuagcccagacugcuucaaaauuaccuccaccuguggcaaggaaaccaagucagcuaccuguguauaaacuucugccagcacagaauaggcugcaggcacaaaaacauguuagcuuuacaccaggggaugaugugccccggguguacuguguagaagggacaccuauaaacuuuuccacagcaacgucucuaagugaucugacaauagaguccccuccaaaugaauuggcuacuggagauggggucagagcggguauacagucaggugaauuugaaaaacgagauaccauuccuacagaaggcagaaguacagaugaugcucagcgaggaaaaaucucaucuauaguuacaccagaccuggaugacaacaaagcagaggaaggagauauucuugcagaauguaucaauucugcuaugcccaaaggaaaaagccacaagccuuuccgagugaaaaagauaauggaccaaguccaacaagcauccucgacuucaucuggagcuaacaaaaaucaaguagacacuaagaaaaagaagccuacuucaccaguaaagcccaugccacaaaauacugaauauagaacgcgugugagaaagaauacagacucaaaaguuaauguaaauacugaagaaacuuucucagacaacaaagacucaaagaaaccaagcuuacaaaccaaugccaaggccuucaaugaaaagcuaccuaacaaugaagacagagugcgggggagcuucgccuuggacucaccgcaucacuacaccccuauugaggggacgccguacugcuuuucccgaaaugacuccuugaguucucuggauuuugaugaugacgauguugaccuuuccagggaaaaggccgaguuaagaaagggcaaagaaagcaaggauuccgaagccaaaguuaccugccgcccagaaccaaacucaagccagcaggcagcuaguaagucacaagccaguauaaaacauccagcaaacagagcacaguccaaaccagugcugcagaaacagcccacuuucccccaguccuccaaagacggaccagauagaggggcagcaacugacgaaaaacugcagaauuuugcuauugaaaauacuccaguuugcuuuucucgaaauuccucucugaguucccuuagugacauugaccaggaaaacaacaauaacaaagaaagugaaccaaucaaagaagcugaaccugccaacucacaaggagagcccaguaagccucaggcauccggguaugcucccaaguccuuccacgucgaagacaccccugucuguuucucaagaaacagcucucucaguucucuuagcauugacucugaggacgaccuguuacaggaguguauaaguucugccaugccaaaaaagaaaaggccuucaagacucaagagugagagcgaaaagcagagcccuagaaaaguggguggcauauuagcugaagaccugacgcuugauuugaaagaucuacagaggccagauucagaacacgcuuucucccccgacucagaaaauuuugacuggaaagcuauucaggaaggcgcaaacuccauaguaaguaguuugcaccaagcugcugcagccgccgcgugcuuaucuagacaagcgucauccgacucagauuccauucugucacuaaaguccggcauuucucugggaucgccuuuucaucuuacaccugaucaagaggaaaagccauucacaagcaauaaaggcccaagaauucucaaaccuggagagaaaagcacauuagaagcaaaaaaaauagaaucugaaaacaaaggaaucaaaggcgggaaaaagguuuauaaaagcuugauuacgggaaagauucgcuccaauucagaaauuuccagccaaaugaaacaaccccucccgacaaacaugccuucaaucucaagaggcaggacgaugauucacaucccagggcuucggaauagcuccucuaguacaagcccugucucuaagaaaggcccaccccucaagacuccagccucuaaaagccccagugaagggccgggagcuaccacuucuccucgaggaacuaagccagcaggaaagucagagcuuagcccuaucaccaggcaaacuucccaaaucagugggucaaauaaggggucuucuagaucaggaucuagagacuccacucccucaagaccuacacagcaaccauuaaguaggccaaugcagucuccagggcgaaacucaauuuccccugguagaaauggaauaagcccuccuaacaaacugucucagcugcccagaacaucaucucccaguacugcuucaacuaaguccuccgguucugggaaaaugucauauacauccccagguagacagcugagccaacaaaaucuuaccaaacaagcaaguuuauccaagaaugccagcaguauccccagaagugagucggcaucuaaaggacugaaucagaugaguaacggcaaugggucaaauaaaaagguagaacuuucuagaaugucuucaacuaaaucaaguggaagugaaucagacagaucagaaaggccugcauuaguacgccagucuacuuucaucaaagaagccccaagcccaacccugaggaggaaacuggaggaaucugccucauuugaaucccuuucuccaucuucuagaccagauucucccaccaggucgcaggcacagaccccaguuuuaagcccuucccuuccugauaugucucuguccacacauccaucuguucaggcagguggguggcgaaagcucccgccuaaucucagccccacuaucgaguauaaugacggaaggcccacaaaacggcaugauauugcacgcucccauucugaaaguccuuccagacuaccaaucaaccgggcgggaaccuggaagcgugaacacagcaaacauuccucgucccuuccucgagugaguacuuggagaagaacuggaagcucaucuucuauucuuucugcuucaucagaguccagugaaaaagcaaaaagugaggaugaaaggcaugugagcuccaugccagcacccagacagaugaaggaaaaccaggugcccaccaaaggaacauggaggaaaaucaaggaaagugacauuucucccacaggcauggcuucucagagcgcuuccucaggugcugccaguggugcugaauccaagccucugaucuaucagauggcaccuccugucucuaaaacagaggauguuugggugagaauugaggacugccccauuaacaacccuagaucuggacggucccccacaggcaacacccccccagugauugacaguguuucagagaagggaaguucaagcauuaaagauucaaaagacacccaugggaaacagagugugggcaguggcaguccugugcaaaccgugggucuggaaacccgccucaacuccuuuguucagguagaggccccagaacagaaaggaacugaggcaaaaccaggacagaguaacccagucucuauagcagagacugcugagacguguauagcagagcguaccccuuucaguuccaguagcuccagcaagcacagcucaccuagcgggacuguugcugccagagugacaccuuuuaauuacaacccuagcccuaggaagagcagcgcagacagcacuucagcccggccgucucagaucccuacgccagugagcaccaacacgaagaagagagauucgaagacugacagcacagaauccaguggagcccaaaguccuaaacgccauuccgggucuuaccucgugacgucuguuuaaaagagcuagaaggacaaacguagaaaagcugguguuaaucacuacugcuguauagagacuuuauuucaaagaaaacuuuaaagguugaaaauuuuuguaaauagguuugauucuuguuagagggguuuuguucuggaaaccauauuugauaguacacuuuguccucacuggucauuuugggaggcacucuuauuagguaggaaaaaaugguaaagccaaguauauuuguacaguguguuuuacauguauuuaaguagcauccaucccauuguccuuuaauuaucaccugucuuaaaaauaacacuacagauagaaacuauaugauauauugcugucaucaaucacuuuuagauuauaaauuaaacuuacaucagggagaaauugguauuuaugcaaaaaaaauuaguccuugugaauccaucuaaugucauaauuaaucauguggcugugaaauucacaguaaugugguuccccaugaauauguuuacccagccugcuuugcuuuacugcaugaaugaagcugacgguucaauuucagaaguaacaauuaaugauucugugaucacauggugugcagagagauagcuacaguguaacgauucacacuauuuugugcucaaaucuguguaacuguaaagcauugaaugaaacuauuuuaacugaacuagauuuuaucaaaaguagguagaauuuuugcuaugcuguaacuguuguauauucugguauuugaggugaguuggcugcucuuuuauuaaugagacacgaauugugucucaaacuaaaugaacauuucagaauaaauuauugcuguauguaaacuauuacugaaauugguauuuguuugagggucuuauuucacauuuguauuaauaacugucaaaagggccucuuuuaaaagcuaaauguaauuuuuuuucuucagauucuaugcauuaagaguaaaauuuccucuugcuguaauaaagacaauugaagaagauuguugacacuuaaccauuccuaaaauuuauuuuuauguaauuagcaccucucaaugcuugguauuuuuccacuuuuuuucuuacuccuuggggguuugauuaaaacaaaugccuauaauagcacaagacuaggcacuggacauaagggcccacauagaauaucuccuuuuccuuaauagaauccauacuugaaaaccauugauucuugacaguuaccaguuuugucuuucaggcuuuccagugcaacugucuuaccccgucaucuucuccguauugauacugggucugaaauaaaugccuacuaccacucuguauaguaaggcagauuuuuuuuugcaaucaggcauaaucaguauuuucucauacucaaaaaauacaagucagugaaacaucagagauauguaaugcuguuaugauaauauuucaagaaagauucaaaagugggccaggucaguagguaaaggugaugccucaaagccugaaggcccaguucacaucacaggaugcacauggcagaaggaaagaaccagcccccuaaagucauccucugaccuccacucgccugucuuggcacauuugcaugugugcacacacagacuucuuacguuguccaugaggacauucagggcuaacgagaaggcucagcagguaaagccuggugacaugaagucuguccccagaauccuccaaccuccacacacgcuccauaauuagaaagucacaaguuuuuuuuuaauuccuacccgcuaaagacaacuucauuuuuaauggguccggugguugggauguuauuaagugcccacugcccauaugaaugagaauacacugacauacuuaauagccaagaguuucaguucuugucaaauguuaugugaaguuguuuuauaucaguauuccauauuguucuccaagguugccauaagcaaugggagaugggaauauaggucacagcugguucucuuucauuccuaguuuuccauuagaauuacugcacgucaguuuuuauaaggcacuucaaguaguuuuguggaaagagaugagguuuuaguuagaauacaauugccuuuuaauucauguuuuaagaaauuaauguuagaaguaaaagaagaguccauuccaccuauuggagacgaaauucccaugggcagcccugcugggaagggucugucuuguguugucccuugaagauggaguugcuggauuaaacccuuuggcuagagauaauggcugugaaagcaaagggguugaccuuaguugugcuuucagaaguucacuggaugauuccuuaacugguagcaggccaaguacuccuggauuuugcuuguuucagauggcacacuaagcccagucaguguuggggcuugguuacugggcuggaugcuuauuaaaagggcaaggaccuacuuagcuuuggacugcagcaaagaaagccuaagguagcaauuucaaacaggugugguuggaucaccagaaguguuuguuagaucauuucugggcacacacccgcaguuugauaagaguugaucuggagagggcuacaagaauuugcaucuguaauguauuuagggauggugggugguaugugggcuucugguguggggaccguacuuggaaaaguacuguccuaaguguguacagcacagcucuuaauaagcaaaugaguuccugaucuaccaaguaaaugcuccuuggcaugggagaccugaauauugacuuguccagucuccuagccuaugucgacucauuguagggaggaaacucaccauacuuaggaauacgaaagucaagauguccacugccucugagugcaucacucuugucccuuugaaauaacuacuguuaaaagagggugugugugguggggggggggguacuuaaaauacuuaguuucgaugggcaguaagaggcuauggaaagggaaauucaggaugagggaagauugguuguaagugaaaggaaacuaaucaauuuguuaguacacaguagaagugauuaauuggugaaaaaaauuauauuugauaaugaacuuuacaaauuaccaggguacuaacuagguaaauaaauaaaagauaagcccuguagguaucaaccagcaauaaguaauguuagaguuuucuuuauaguguaaaauguggaucauguuaccacaaaguuaauugaaagaugacuuugucacugaaaaugggagaugguugccaggguuucuuugcagcuaagaaaaugaaaaaauuaaacuguccaaagcuaaaggguuuacauggucagauaauucagauauaccuaacaacuuuucaggagucaaggcuaaaauacaguguauauucuuucucauuuucuagugagccuaucuauuucccuguguacuaaccuuagaaaacgacuuuguaauguggaauucuaugaaccgugacuucuguaaacccaggucauuuuccuccuguucuaacucugcuuuuuguuaggccauugaugcaucuuuccgacuguauguucuguguauaaugcuguucuuggugcuaaauagacuuucuuuccucugauauucaggauaauuuuucucuauacuucuguucacuuguuuucuugaaguuaucugauuguuauuuuuaauuaaaaauacuuaaauguauacuagugaagguugccauugaauauaagcauugaauacuaguaagaaaugucuguugaaagaaauugccugcccauuaacacauucccaugggaccuaaacacuaccccacugaugaaccacucaacuauguacccagucuuuccccuagucauggcuauaucugaagaccuauauggucugccuuagauuaaaacuaaauugacgccggcagugguggcgcacaccuuuagucccagcacuggggaggcagaggcagguggauuucugaguucgaggccagccuggucuacagagugagcuccaggacagccagggcuacacauacagagaaacccugucucgaaaaaaacaacaaaaaacaaaaaaac

SEQ ID NO: 8861 - RNA, 29196 nt, Mus musculus
aaggaguguucugaagaaauucggguaaaagaccauuagagccuagguuuauguggaagaaccuggacaccaucguucacacucaucuucccgguaacugugcauuuagggaagugaagauugccacuucgcugguagcugcuaggaaacacuucccuucucuuagaucucaagguaacaauagcccaccaggaggcuagacuaccuugcuugaaaaauagugugcccuagaggagggcaugugagcuuucuccaggggaauuuucaaaacuacccugaguccuggcacaggagggaagcaggccugcucacagacuugcucagggccggucacacauuuccauuuuuagguuaaauaugucuucguagguuuagcacagcaggguguccaucagacuagucuuacgcgguuguaggcauuuaaggucacccgccccuuucugucuaggugcaccgauuggauuuaaaaagucaggcggacuccgggcagguccagcugcuuacagcgggggggggggggggggggggggggggcagcgcagugagccggguaugggcguggcagcugaggugagcgcucggcuggggcagggcgggguccgcgccaacagggcgaaggcgagcgcggggcgcgcucccggaaaccucgugcacgagccgcggcaccgcccgcccccgccccgccccggucagcuggguuccgcguccagccggcugcggagcaucccgggcggcgcgaacggcccagccauguccgcagccaugagggagagguucgaccgguuccugcacgagaagaacugcaugacugaucuccucgccaagcucgaggccaagaccggagugaaccggagcuucaucgcgcucggugggcggcggguccccgggagcggcgccggggcagggacagaggacgggcgggaggcuccucgcgcguggagcggggccugggagccgcagacugcgggacgcgcggacgcugacgugucgccucugccggccgcgagugucccaggacccacagcuuugggcgcagugucuagcggggugaagcucgccuucacgucccagaccccacccccacuccggcagccgggccucgcgugcacaguccucgcgugcgcccgcgcgcgggagccaggucuagccaagcggggcuuccgaggaggggggaaccgcgggccagccagcaggaaggagaagcaggggacugcugggugugcccaaaccagccgggcccuccuccauaggguguugaggccgggguugcucgguaugcucagcucagaccgacccucucccagggaguugaggcaggggacugcucagaauacccagcccagggucgcucugccuacggaggagaggcagaggacucuccaguguccccaaccaaaacggcguccagacgaugggcaggcccgaccgaccuccuuguaguuguuucucugauguauucgaggcaggagaaaaccgccuaggaaaggccuagccgcgaaguaugggugugggcggggacugucccuuuagaauaucugcccugccacccaacccacuucucuccugucuccaggugucaucggacugguggcuuuguaucugguguucgguuauggagccucucuccucugcaaccugauagguuucggauacccagccuacaucucguaagugacucacccugcggccgcacuuucccuuccacaaccauauccccaauucagggcuuguuuugggcuguuuaguccuggucccugacauagaagucgaagcaccuuaaaguuaaggaacugacugccuaagguuacacauuugggaagccuuaacuuguucccugaucucuaucagcuagccuaauguguuuuauauuagauuauacugacguggaguugacuuuaucuuggcugcacaaaauguggggcuuagcagcuauugcgagugaauugcaucccauuggugacuugguuauuuccaccauaugguuuuguucaguuaaacccaaucaguuagaacuuaauucauucugaguuacaaugagggccugauuggcugggaacucgauuuguaucaaagacugaccucaccuugccuucgcgguucuaguacugggaugucagacaugagucaccagccuggauuaauuuuuugauuuuaaaaaggcuaacuguugggccagugagauggcucagugguuugaugauugccccaagucugacaaccugaguuccauucccagccagccacacgguugagagcaggcuccaacaaguuguccucugaguuccaaaggccuccaugccaccugaggaaagguaauggcaaaaaauuaaggcuauucuuuuuuuaauuaaaaaaaaaaagugugugaaaaaaaaaaagugguguguguguguguguuaugccaugccaaugucuggguaccauaugugugccuggugcuggaggaggccagaagaggauuguuagaccccuuggaacuggaguaauagacaguugugagucaucacaggguucugggaaucaauuuuggccccucuggaagugcagccagcccucuuaaccgcugagccaucugucugagcccaagggccaaauaucaaaagcaaauuuggaaacacuguaacaaaucuuauaaaauaccuucauaacaaaacuccuuuguaauauaaauuauucauguaauuaaauuuaaaaaauguauccuaagauuaggaucuacugauauuuauuuuauaacuuaauuucuguucaaaucagaauuguauaucuccauuaaugaauucuguuuuauauuauaacuaaguugguggguuucauccuuguuuucugaaucuucuuaaccauagugauaaaaauaaaggguuaaaaacauuucaguuggaggcuaagacacaagauaauauucuuauaccaccugacuaucauuggccagauuggaauuuagcauauacuagaagggaaaaaaggauuuuauuuguguuuuguuucuuuuuuucuuuucuuuuuuuuuuuuuuuuuuuuuuuuuuuggagucagucucaaguagcccaggcuggccuuaaacuugcuguguagccaaggauauccuuaaacuucugucuccaccucgaucuccuucagugcuaagguuauaggcagugucacccuggcuagucuuccagauuuguuuuuagaaguuuguuguucuggaaaaaggccagcugcugacaugaugcgcuugcuugugacauuggagaucccucaggcuucaaguugacaaggguuuuuacucucccgguguuaccugcaccaucuggguuuuguaauuguaccuaggaucacuaagguagacugggaacaguugguuuggcuuucacugcagguaaaggaagagagaagcccuucucgugaucucuaauguuaaauggggaugugcaaccuugauucagaauagcuaguaggucacugugugugguaacaaaauuacccuaugguauucgccucuaccugacucugucugucuguguaucuuacuuguaacuguuuuacaugggacuaugugguuuagaguuguuucuuuucuuccucccugugaaugcuggggauugaacuggagcugucagguuugacagaaagccuuuuccccaaugaguccuccccaagaauauggacuuuaaaaaagacugcauggcaugguaacuuuccuucuuuggggcuacuugauauauaauuguaugagaaacgagcuccuuuguuggcauugacacauuguaugugagcuguaaaggguuaaguguuucuugggucugggcucagcaguaaagggcauuggcugcuccucuugugcuugugacugaaagugggguggagccacuguuucucucugaccagaggugaucuuaggcugcuccauccucagucauacuucacagugguuuuuaaguugcccuauuauuucuucguucauacauucacuggcuacauaucaacagucacuggcucuccuuacucacaagauacuaaauguuucugucuguugcuagaaguucaaacagcagauccuguuacuucuaaagaguagagccgggugggauuuuccaaguuuugggauuuagucaauaagugaauacgcuuucuucacaguuuugauauucugagacaaagugacauuuguaguacauuucaguaagaguuagaaaaaaaacacuaaagacggaauaaaggacacuuaaaugauuuaagcagaaguucagaaagcaguguucagugagcauacagccugccgguguguauguaugauguugccuuucuguagguccaacuuuuucaccuuuaaagucagcauaggauugugugacuuggauagccucuggagucaucucagggacaggcauauugauggcugucugggucuucccccauagguccuguucuaauuggucagggauauggccugggcucucggggguggggugggguggguggguugaaagacuugucaaucuuuuauaguuuugaagggguucuagugcucagaaaguguuggagccugugguucagagcggcaguagggaacaauacagaagcgcccugugacugugaagacagcagaaaauggccucuguucccgagaaucggcuagagaccucuucagugcucugcccuguguuggagaggagagaaaaaaaaauggguuuguacacaauacaaggcauacagaccacagucaguaaacagucaagcagccaguguuaauuuaaucaagucuguucauuguguagccauugagauuguacagguuuuuguuuuuaaagaaagaaaauccuuaacaaugaugguuuugaguaaugcccagcucauuguuucuagggguugggggauggcucggugggucagagugcuugcugugcgaagugaguccccagcacccacauuagaaaguggggucuuuguucauucaccugccuccccagcauugugggguugagguaggccgauuccaggagcuugcugguuacagucuagccgacacagcacacuugcugcugcuucacuaggaggcuuugucucaaggacacauagaggaagacauuggaaguccuccacuggccucugcauggcccucgggcacauaaacccacacacucgugugcauacucucacacccacauccacaccccaccguguuucugcaugucucagucugguuggacuagccuaacagcaggugaugugugagugagguugguuuuuuauucuuacuucugaaggcugagaauuccaagacugcaagccaccagcugauuuggugaucugacagcuguucugugcuucauaaacagcaucaaccugugguguagucacguggcagaagaggagagcagacuugcucgaguugcuuacaucagucagaacccuuauaaccuagucaccuucugaagguccccaugucuuaggauaugggguauuggauuccaucaaacugauuugugggguauggaaauccagacguaguggucaucuucacucagucguucucugauccccuacugugcuccucagucccccacauauucaaucuucaaaucugagguucaucugcuuagcaaaugucaguccagccguacaccaggggccggugucacccuuuagcuauggcauggaaugagauagauacacucucccuucugugucagcagucugcccgugagcagguaagaaauagggaaaguagagaguaacaggaacggcucuuuggauauuuaucugcggugcuauuuaagaccugaggagugagcuggaaccagccuggcagaaguagagugggccauggccugagguggcagcagccuuagccaaugccaccuggcucugugacagggaagagugccugggaaugacagagaagaggcaggugccaaagggguccggacgugcagagggcauggcucacccugagggaggugcaccuuucacuccaggugguuguaauuuuuucugauugugugagagagggcuuaaauaagagucacaugauaggacuucccagaugaaaugucaauggccgcugagaccucuggaagggacuggugaucuugcuaaaaagucaaccagaacuuauuuccuucuuucuccaccuuucagcuuuguuauuguuauuucuuccccuguagcaucauaggcugggcaugcagacuucuccugugccaccaucggagagggcauaaagauugcaucuaaagcauugggccuacagauugcaggguguggaaaugaaguuugggaaagcucaauuggccuccugccuuuuuccauuacucacccccuugagaaauucgugggcgcugcucaggugccucuggccccaggucaggacucugaaugcuggagcauggaagcagaggugagcagggagcuagugcuugcccacgggccuccuucuccggggucuuguguuuuucugugcacauaaucucuuugagcccccuauucucuguguuuagacauucuggccgcccugacuaggcugucuggaagccaaucccagccuuuuagguuaccaagagcuguugacagaucuaccuucaucucacugauaagaaaaggccggccaacaauggaacuuguuauagggacagacccaccucuucuuuccccguagcaguguauauacuucaguggccagcaugugcaaacaucuccacugucuaguuccgaacauuuuugucacccccaaaaggaaaucauuaguggucauucccacuucuccccugucuacuuuugucucaacuaaugugcucugcacauuggacauaggugggaucguccacuuugggcuuuugugacucugugcaguccugcuuuuaauggcagugcuuuauuaagaggcccugagaccagcagagaaugggacucuguaucuucaugcacaaagcuuguugccugagaccuacaaggaucccgugggggugugacgguguggugcugguucagccagggccgugaguccugacccugcuucucuguacaaguggaaccaugaugcgaaguguaaugguauggguuucuauguuuguuauugcccugcagggagagggaggguagguucucuguccuacccagaaagcuuuugguuuacaauucuguacagacaccugccuuucuuuuuacuuuuuaugugcuuagagaagucaggcugcuacucugcccgaguugccagaauucagccuuagaggucagguacaaaccaagguccuuuaguguugagugugguuuaguuuuuguucucuuucuguaggggguugaacgcaggaccuuguggguaccaccacugagcuaauacacaaccccuuuuaguuugaaaugauauucuguggucaggcauggugaacacacaacuacaguucuagcacuuagaaaguggagccugaaacagcaggaguucaagguuaugcuuagguuguaugugcgugcaugugcacacacacacacacacacacacacacacacacacacagaggaagaagggagaggcuauagaggugauagauuucccaagguuacacagaggccggagggcaguuuugcccugcagcccucaguuacuccaccuuugccacauuagugcuaaucucauagacuguaaguaugucuagaguuuaucacgauggcaucuguauuuagaaguuuugaaaucucacauccaccuuggggacauguuauuuuuguuuuccuaaugcucuccagcccaguuuaaacucauggcaccagaauaaagaauuuuauuuucucugagcaugaugacauaugccuuucaucccagcacuguaaagguggagccauccuggucuacauaguggauucuagcccagccaggaugagaccugcucuuaaaaacaaacaggacuuuuuuuuuuccccugaaaauauuuauuuuuauuauuuuagauugugugucugugcggggcuaugugaacauggugugggugcuggaagaggccaggggugcuggaccaccugaagcugaaguuacaggcgcuugugagccaccugagggugucccauauggaacucugguccucugcaagagcaguaauagcucauaacugcugagccaucucuccagccccaagaacuugacucuuacacagaugcuggguauuugguuaaggccuucacugauacagcucauucaauguucagaaugguccugcuauguaaacgugauggcagcucccacucuuacagacaggaggcagaaguaacagcagccucaucgaggcuuugaucaguuugugggaacugguuuaaagcccaaggagccuggucucuggucuggauuucaguuagaugcgcgucccacauggccuuuuguguguccuguagauucuugccguaaccuuauguagugaagaaaaucugguguuaacguuuccuuuuauuaaaucagcucugagcccguuagcuuugugcaggaccucucagauaagguccccccacccccuucccgguacacuggaggcauuugcugaguuuugugaacaugagcuggaagugguauuauuuuuucucuguuuccuaucauguagcuuuaacuuaccaccccgguccccacacugugcaugugccgcgcuguugacacacaucccagccccuggcuccuagagagcagucuuaacgaguaacucgcuggucuagaacuuaucccccugccucgguucuccuguccagagauuuuaggcaugucccaucacacuuggcugaaguuaaaccacacuugucauagagguuauaguuauaaagccuuugguuuuguugacaaugguugucccugugcuuugaagauagauucuucacuuuaggugacuuguuucugaguggcacaugaaccaugugcccaaguguauugggugugagacuucagaggccugcuaauguagaguaaauaauuacaagguguguuacuccugggcaaagagcccaacuuaaaaagaauuauauauauauuuguauuuagugaggguguggagagaacaaaugaacauguguagagaucagagggcauuucugucaucuguuugcuccuuagacuucauugcuuuguuuaaaguauauuuuuguuguuuuaaauugugcacgcaugcacacaugcaugcgugugcauaugagagcguaugugugugagggcaagggccugaggauucuagaggugucaccugaugugcgugcugggcaccaaauccaaguccucuauaagagcagaaagcucuuagccacaccgucucuccagcccacucuccucaggccugguuuuguggcagaguuucucuuguuucagacaggguguugugugugagugucuggcugaugggacugcagucuucugguaggggugaugggguugggauuaaagacaugagcacucuguuucacauguggccucagaggauggaacucaagcuguccggcuucaguagcugagccaucuugcugggccccagccuauguuuauaaaacucaaugguauuguguguaaagauucacagaagcaggccaggcaugguggugcacaccuuuagucccaguacuagggaggcagaggcagauggaucucugugaauucgaggccagucuggucuacaaauggaguccaggacagccagagcucugcuacauagagaaaccuuaucuugaaaaacaaaacaaaacaagaaaaagaaaagaaaagaaaaaaaagagucccagaagcaggcauuaaggauccgucuuuuuauggcaacaagggaaaacaaccuagucauacuuaggacuuccuaacuuuuuacaucauggaacuuucaggcaauuuaggaauuaugaguauucccaaaauacuguucucuuucauuaauuuuccccugacuaauuuuuguuuuuucuuguuauuuuuucccugugcuuaacccacauguuaaagacaucauuauccaaagaugaaaaaaacuguaagguuuuauucuucagcacugugaguguguguggcuucagcacugugaguguguguggcuucagcacugugaguguguguggcuucagcacugugaguguguguggcuucagcacugugaguguguguggcuucagcacugugaguguguguggccuggguuuucguccugcuucaguucaguggaacaggcuguuuccaagaagaggguacccaaccuggacuagcaagguuugaacuuuuaguccacuuucuuuuguucuuuuguggggaggaggacccaaacuccaaugaucuauucgcuccugguaaaaccuuaacuuuugauggacucugacucaggcguggaagcucugugaggauggcccgccgcuccuguccgucugcuccuggucuucuuuagccaaaaguuaagccuguucugcagccuccuccuuguuuuccuuaguuucuucagagcaguauguccaccuuuguguuggaggacacaagagacaggaccuggcuucuuacccucuuuuaaggacuguuugacaccguauuggcagacaugaucaucuuuacgaaagggugcagauucugcuagcucuuugggacccccaaccacugaagcacaaggauaccugucaguccaggaguacccuccacccccucucucuuagggcaaccaaguugagaacacucagauuggcacccacaaugcagccuugagcaggcuugggcuuccucucuccaguucuccuuggucuguuaacaagaaggcccugacuccagcaggcgcacucagaugccuuggcguucucaucacgcacggauuuggaccagggagcauuuccacucuucaccccaagcaucagcagcuacucuguugccaugguuucucgcaggccguaugguuugccauccucauccgcaucugugaguuucuggcagccaguaggaaggagacuggguuucaucuugauguggccuaccaucuaggaggcacagcaaaaaaagaacuuaaauccacuuuuuuaaacuugguuuuaucuccauugagguuuguuuuccauaacgcugacuuucugugguagaccccucucccacaagcaugcauacaggugaauuaggaagagcuuuugccuuuauuuugggugucacuauguagucuagacuggcugugaauucaucccagccucccuccuggguacugcaugcgugagauaccacacuagcuccgggacuucuuaaauguuugauuguagaccgcugagaaccacuuaagacuguggcccggggucaagugcaaguaggucaccugugcuguaacggauaaucuguggugggcucccaggucacauuauccacacuggugcacauuuaaugcgguaaaacaaacaaacugaagaucuuacuuacuucauucauuucucuauauucuaaaaaaaauauaucaaagaaaagagcaugaagccuguugauacuuccaagugcugcucuauuucucucuagagugaccgugucugggagaagagaaggacauggagaaaaugaauaggccaacaguugauguguaaacacugaaacucuguugugcuggccgagaacaaaugcucuguugagagcgagugagcgaguggaggcugcugcgggcucuccuccuccggcuucuguuuugguuucaagugugaucugugugugcggcucugggcuggaagagggagaggggagugguuuuagcuguaagggucucucauuuuaccagcagggacauucuguccuucaguugucaggcaucuuucccucccaugucacggguaacuccugaacaaacaaggcacgggauuaccacaguggggugagacuguuuuuuuuucuccuguucaaggcaucucugccaguuaaccugcacaaaaccgugcuguggcuguacgaggaaggaaugguugccagggagggagggagggagggggucauacugggcgaugagaagggcauggagcuuugcuggaacuuccgaugcaguaauguugcugugaaaguuuaaugguggcaguguccaccauuucacaaacucagcucccuggugccaguuaagagauuuuggcugcaguauauauaaucuuggaugcuauuagcacauacguaguaugcagauaggaaaagauauacucugucuucaucaaaacagcuaaaaugaaaccacuugugauagggcacaccacagucacaauacccaagaggccaggcuccccuggaguaucagucagagagagccuugguuacuguuacauuugaggccagcaugggcuacaugagacccaucuuaaaaaaaaaaaguagcgggacagugguagcacacaccuuuaauucagcagucgggaggcagaggcaggcaguucucucaguuugaggccagccuggucuacagagaaaguuccaggauagcuagugcuacacagaaaaacccugucucaaaaccaaaacuaaacaaaaaaagaaaacaauacucauccguaaagucccaaacuaaacagcauaauguaagauuuaaaaaauaugguauaaaaugccuaguuuguaagcagaguuuucuuuuuaaaguagccugguugaagaauaauuguagauccacaguaaaauucaacaggaagacccgaaauucccaccugccccucccucucugcagagccaggucuacaguuagcauuccuacgagagaggaguguguuacagcuaagcguggguggacaccucugucucaccugaauccugagcggugcagcuuagucaugucuggaucagggaauguuuucuguucucucuaauggcauuuaguuuggaggggggggccagagagagaagacugguagcucaugacuaucuccacuuugguuuucuucauguccuugauguuauccuuuaaugucuuugguucuuggcuuaguuucaaaaaacaaaaacaaaacaacaacaacaacaacaacaacaaaaaccaagccaacacagauucagaguuaugaacaaguaggugagccagcaaggaauggacucaggcagcaccuguggagccccgugggcugugagaggcucaugggugcccugugugugggucaguaccaguucaauacuaaagaaaacaauuuccccaguauaucucccggaguuggcccaaagaguguuuuaccaguguucaaaaauuuucuaaccugcacacgggccuuuggggauuucagcugacucuuuccucuuaggaucugggguauauuuaaaauccauagacaauucucuauucuccuuucagccuuacugguaauauuuccuguaccaguucuuagccagggacuauugauuuuuuuucucucuuuaauugcuuaccucccagugaguucuaauaaaaauuacuauaauuaccaccuauuauggaccuauuuauucuguaccauuuaguguuuauaaauacauuauacuaucuacuguaauugucacagcaacgcaguaagguuucucagucacuugguagaugagcaagcuaacgcccagaaagaaugaauauucccugccccaagguuauaaugggugacuggggaagguugguuaagugauugcaaagccaguuauagugugcccggguauccucaccuaguguaauuaguuuuugguaguuuacuucguguaaguagaaaguucaaaugauuucauuucaccugauggguucuacccucucuucucuguuucucuauguguauuuaucaaaggccuuuuaaucccuaaagcacagacugugucaccguggagaagacuguucauaaggaaaucuauuagcuaguuccucaagagagagguuaagugagcagggucacuugaguguuugguuauaacaaagccccagagagaaggagccucagaggaaggaguagcugucgucugcagcucaguggauccaaaugaaaccugccccuguuguuaaaaagcaccaggcuaggccaggcggugccagugcaugcgcuuagcuccggcacucaggaggcagaggcagaggcaagcagaucucugaguucaaggccagccuggucuaccaugaguuccagggcuacauagaaaaacccugucuugccccucccccaaaaagcacuauguucauuacagagacguuuaaugaaguaaaauccugcugacccagugcucagggcugauuuuaugcucucugaaaucuuucuggauacccaucuucgucugucugcacacaaagacccagccuuucuuuguucacuuguguuuuagcaucaaauuagaauauguuuccauaucuuacguuuuggaugucuuuguuuuuaucuguuauaaaggcuucagaauauuuaaaauguguuuaagccgggcgugguggcgcacgccuuuaaucccagcacucaggaggcagaggcaggaggauuucugauuucgaggccagccuggccuacaaagugaauucuagaacagccagggcuauacagagaaacccugucucgaaaaacaaacaaacaaacaaacaaacaaacaaaguguuuaaauaguccauucccccuuuuaaaauguguuguguggaacuucuauaauuuuauaauuuuaaugaauuagaaucauuuugauaccacuuugaccucuuugaucuucauuuucaaaaacacagacaggcaggcagucaggcagucaggcagguggacaugcucacacaugugugcacacacacaugcacacacacacacacacacacacacacacacacacacauuagcaugaccagguauguuaguacgguccuacaacccaguacuugggagguagaagcaggagaugagcagcugaaggccagagucaguuguacagcaaauuugaagccagccugaacuacaugagacccugucuaaaaauaucaacauaucauauauauauguauguauacauauauauacacauauacauauauaucauuuauauauaugcauauauaucauuuuuauauauauauauaucauuuauauauauaugagaauuuuagucaacucaucuuugagaugccuccaguucgaccuuugugguuccugauuccggucugugaaauuguaguguuccuggcuccccagagcagcagaccaucuuuuccuccuuagcuuugccugucacucacacggcccagcuucuuucuugccaucugcucuagggagguaaagcuccauucccaccuagaacauggugugaggcucggacagaggacacagaagccacagugccaagcagagguggucaggcuccgggucagaaaaugcaauguaggcugcaacaguaauggaccuaaaggccacaguguguccagagaggcugugaauauuuaccccgggaguucagaguucaggaucagugucugccacuuacgaugaggccaggccugugcauagagccacagucguugccagccgccacugagagugcuccggaaugucucuggaguuuugcgccuuuucccuuggccuucuagucagugcaggaaucaguagcugcccuucacuugcagcauguuagaaaccacaauggcuacugggguuuucuuucuuagaagugaguaggguggagcugugaaggcuggaaaucugaugaugguugucaaguuggcucuguggugcggucagcugcacagcuugcuuucuuuuucuucuuaaaucuuaguguguuugguguguguguguguguguguguguguguguguguguguguguguguguguugggguagcuuacccuggcaccccuguuggggucaaaggacuguaucaggugaggcgggguucguuguugccagcguguccacugggguagcuggccagugagcuugaggaugguuguccccgccucccaucugccaucguagggugggauuagacacacuguacuggguuuagcuuuacauggcuauguucugggcaucuggaccagguccugacuucugugcguuacccacugagacaucugcccagccucucuuguuuauuguuauuuuugagacagcaguccggcuuggaacuugagauucucuuguucucaccucccgagggcaggugccaccacaccuggcuccgguacagcuuucugagaacauguggcuggcuggcaccuuccacagccugaguuagugggucucaagaaggaacuagauacuguguucuaccgacuccucuggcugggugugagccagcagacuuucacuuuugguggucccuccucugccccaguaaguaggggggguaguagagggccuucugggauuuacacuuugggacuauggccucucucugcucuuuaugcuccaugaccuguggaccuuggcuuuuccuagcacagggcaagaucugugguaccuuacagaaauaagauugcaaaccuccuauuguacuuagcaaacaugaaaugcacauuuuauaccagacauguugcuaggugcugccaagucugauggugaguugcuuuuuucuaauuaagaaaacgacucucuacaguggaaugagcgcagacucuggagguguccuagguacccaggcugugcuauuguaccaaugcugccugucuucucuaagcuaagguucuuccucuaaaaacaaaacaaaaaaccagcagcaacaagaaacacccuacaggcuauuaugaagguuuuaaaaguuguuuuugacagggucucguuauguaucccucgcuggccuggaauuuacagagauccuccugccucugccccccgagagcugcagcacacgugugccacagcuccuacaucugcuugagguuuuuggugucagagaacagacugugaaggaagaguggcucucacuaauugguggcauauuuucuuuuacauugcuuuucagaaugaaagccaucgagagucccaacaaagaugaugacacccaguggcugacguacugggugguauaugguguguucagcauugccgaauucuucuccgaucucuuccuguccugguuccccuucuacuacaugcugaagguacaguggcgucugacggcuccucucuuccacacauaucucucagacuccaucucaggaccucugaaccaggagcaguaggagcaagggcuccaguguuggauccagugguucuugucucagauugcagaggcggaggcaggauuccccucucccuuccucuguugaaggccuugugucaguugccuguggcgguccuaugauugacccagguuaaucuccaugcagugaugugugauagccuucacaugcuuucagcauucacagugcugaagcggagucauuauuuuugggagaaaaccaaaaaauuuccauaauagaucuggagaaagaaaaaugucuaguugguugagaaaguuaucuugguaacuuuggcagugugguagucagagcucaggccugccaaaccuuguuuuuggcacaggacuagcccaggcugccagcauuugggguaaggacaggaaucugaagcucauuuauaacugggucucugcgggcuucuggcuuccccagaggggagcgagggggagaggguuguucauuacgugaacauagugguccuuucucaagcugugcucagauggcugcccaagucuuccccagaagaguggaugugauguaggcacggccucugguucucagacugcagacuuugcaagcuagagaagguggagugcccagccccuaggggcuccaggcuagccucugucccuuuuuauuaguacaaaguacaugugacauagcuuaaagauucaggucacucugaaagguuuuacaaaaaaacaguccauucugcaccucccuuaaagcuaaccauugcuggggcuggagagauggcucagugguggaaaguacuugcuacccuuggcgaggauccagguucgaaucccagcacccacucagugguggaaaguacuugcugcccuuggcgaggauccagguucgaaucccagcucacagcugccuggaacuccaguuccggggaaucugcuucucucuuuuuuuuuuuuuuaaagauuuauuuauugauuauauguaaguacacuguagcugucuucagacacuccagaagagggagucagaucucauuacggaugguugugagccaccaugugguugcugggauuugaacucuggaccuucggaagagcaguccggugcucuuacccacugagccaucucaccagccccgaaucugcuucucuucuggccucuggggcaccaggcacauggaagcaaaauaagaguaaacauuuuaaaaaacaaaaaagcucacuuuuucucacuuacggcaacuuagcuuugccauuucuugcuccgucuguaaauaagagguggcuuccggguuugccucuauucggugcaauauuuugaaagaugguuuggcucucuuuccucuccacauccacguccuaccagauccuuacagccuuuccauggccgagucacucccauucacaaaacuacgacuuugaagacaguguucagucuggucuguagguagcccaccgaauuuugguuuguuuuuuuuuacaccuagcaauuguugcauauaugucauaugacccauuuacaguuauuuuuauuuguauacacuugcauacguaaaugcuuucuaaucugaggacgcuuggguguggaucaggggguagugugcugucucgugcuguaguuuuuggauuuuucugggcugcaagccugagcagggcuuuguacaugcuaggcaagugcuccaccacugaccuaccccaccagcuccuuaggcuuaauuucuaauucucagauauaauagauguagcuuccuuugcugucugaucuuagccuucaucuuagagagccuguccacgcgucccucucucccugccgucugacuguucuugcacuugcucgcaguuacagccguccugcagugccauguguugggacuuuuauuucaucuaucagaauuuccaaaccuagcuaguuuuguccugcacuuaucuuaauuuuauuuuacuugugugugagaguaggugaaugugaaagaguguaugugaaugugugugugugggagugagagagacugcaugcaugugugcaugugugugaagcaugugugaaggucagaggacgcugucaggaguuggcucugcgucucucauggguuccgggaauccgcaguggagcucuggccuucgggcuugcgcagcugccucacuucuuugagcguagaaacaaucuacuguaaaauucugcauccuucagucgugcuucugcuccugacaaggucuguggcugauuauguuguuuuucuuuagaaacaguggacucauccaguaucauuauuuuggucugugaacugauuuuccuccaagggauuuauaaacucuuucaggcuguggaauaaaugacacgcccuuuauguccuacuuagcuuuuaauuguggacucgacccaaacuagagaagcgggucuccugaaggacucgccgucagacuagcugagggcuuguccuugggagauuauuuugaucacuaauuguuguaggaggacacagccuguucccuggcaggugguccugggcuguacagaaagccaguuacccugagaaugagugaaccagcgaccagugucccucacccauggugccugcuuuguuaccgcggaguucccgcccugcccaccuucgcugacaaaaguuauaacaaacccuuucguucccuagguugcuuuuugugagacuguagugucacugcaacagaacuaaaaauaggauacuucaauauaaaaaggggaacgggcuggagagauggcucagcaguuaagagcacugacugcucuuccagagauccugaguucaauucccagcaaccacaugguggcucacaaucaucuguaaugagagcccgaugcccucuucuggugugucugaagacagcuacaguguacccacauacaugaaauaaauaaauaaaucuuuaaaaaaaaaaauggguggugaugguagggaacuggcucccucuccugcucuuuucuuguuuugcugugguucagggcgagcggcugccucuguuuucuuuucccuuagcaggguuuaugcucagaaggccucagaugacugugcacaacuugaaugauugauuuuguuuugauuuuucgagacagggucucauuguauagcccuggcuguccuggcacucacucuguagaccaggcuggcuucgaauucacagagcuucaccugccucugccuccuacaugcugcuaucaaaggugugcaugcgccaccacggcaccaccgcccgguuugaacaauugauuuuauuuuauuauuuuuugaacaaucuauuuuaaauucagcuugucuccuucucuggcuauauugcaaaggcuuuccaaggucuagauuuccuuuuccccuuaauuauacagguuuucauaaggccauuuuauacaaauacauauuguauauugaggauauuucccuuauuuguuucccugacaguuuuuuuuuucuacuuacauguccucagaacauaaauggucuugugugucuaagacuuagguuucugacugauucauuguagcauagugggaaaaguugacacauaaaaucauuuucugcagugguggcccauauccuuaaucccagcacuugggaggcagaggcagaggcagguaaaucucugaguucaagaccagccuggucuacagagcagguugcaggacaggcagggcaguacagagaaaccgagucucaaaaaaaaaaaaaauucagucucagucucccauguuucuucuucuucucccuccucuccccacucccucccucccucccucucuccccccacccccucucguguaugugugugugugugccugugugugccugugugugcguuuguugccggggauugaccucugggccuggugcauuuucaggcaagcacuguaucacugaguaucuccagccuuugaaacacauuuucucuggcguuaguuuaaacucugaccaugacaguccccugacuaucaguucuagcucuacucuuggauggugauagcucugagacacaggcagucgccuggcuuguugucguguauggauucauugugucugugcugaugccacagcagccucguuagagcggugugugcccuucaucugagcugucaguuagagugggcuccucuggcugucucuagaguuaucuaucagcuugaaggagagcuugacaagaagcauggucaccucugugugaaaaauaguucgaagauggagcucugaaagcugguagcuggguauugccaugagaguuaaacaguaauuaaccuuuuuaauaugagaacuggcaagugcugaggauggagguagagagcaguaauuauuuuacugucucaagacaguuagcuagagaguaccaggaaguaccaaguggauagcuggcuguauauucuacagaguaaucacauugacgacagaacuagaaauguuugagcuggucccaucuguuagucuugccuuaauucauccauaagagagaaucagccugacuggauugcucaaagguagugucucugucggugggugauauuucagaggguuccagcaauaguggggacuuuagaugauacugugguccuccugauagcagauaaaaaaaagccaucacggggcuggagagauggcucaguggcugcucuugcagaacucagguucaauucccaguacugacaugguggcuaauagccauccauaacuccaguuccagaguaauuuaaugcccucuucugaccucugugggcacuguaugcacauauggugcacauauguacuugugggcaaagcauuugugcaauaaaguaaauaaaugcaaaaaauaaaaagaaaugauuuuccuaaaacccuacagaacagaaaaaggacucagacgugcucgcuugccugcgcucaugagauaggcccuuuugauuguucaucuggucagcuguuagcauuucaccuuggugcuuucuuuugaugugaauauaugucucugucaauaauuuauuccugaaaaugagacauccuauguuuuaaaaaaagauaguagccagaaacauaucccucuccuuucuuugaaguuucaauauucugugccggaguccagccggcaugaaagggcccuaaggaaaggcagugaugggggcuggagucaguggugagggcagcauuuauuuauccuuggcaguucuucugucuguaacuguuugcuaauaaaggccaaaagcuguuggcuucuuauaauaaacucuuucuguuagcaucaggagauuaaaaaaaaagaagaagaagaaggcuuaauuguuagguucccuucucucuggcucacggaccagacaagagguuugggcucauuaauucuuugugaaccaggaagaaaagagaaggaaagaaagaaaauaguuuacauaggcaguaugcacagauacauacacacacacacacacaugcacacacacacacacacacacauucuggucaggccugaccaccuaucucaucagcuccacaaguguucuugcauacuuacacacauacacacauaucuacccauguauguauauacaacagacauauacauauauacauuugguggguggauggggcagagccccagaugccacacuuuguucuuucuucuggccugcuuauacccucuuagacaaaaguuuuuuagaaaauuagcuuauaaauaaaaugucacauaaaaggggagucacagaaggauguugauauuaaauucaaagcaguauuucauuugauaagcucacuauauguucagggcaacaguuacaugugaccucauuuuaucauagugcacaucugugccucaucugaccuagaauguuuucccuugaucacagauuugucccaagccuauuucucuuccuggcguaauugugaagcucauuuuaugccuuauuaugcagccuuuacuuacuauuuaaugaggaaugagcacauuuuauucuugauucuaacuuuauuauauauuucuggcaaaauaacuaaaaccaucucuuaaaacuuuguuccuaaaauuauuugaaucaaaugaggaauucaauaaaaucauuagcucaucuaaacaguauuaacucaugaaaguucauuuuuauguugaucugagggaagaggcaugucagcugcaagaagcaauccugaguugaagucucuugggaccuugccucucagagcucagccaucauaagccaugguaggccaccuccaggaaagucaccugcuagccuuagccucuccuagauggcuccugacaauuuugcccaugcuggccuugaacuuguauguuaaagugcaguggcuggggcuacaagcacuguuguacacucagcucucccuuacuuuaauuacgugugugcaggguaugugcgcucaccugcgugugccccacccccacaccagccccacacacggggccggcgaucuaaacucagacccucaucucccgagccccuucugcauuauuuguuauuacuaggcucuuaagaagaaggaguucagucagacaagauggugcagaacagugagugauugcugugcaagccucucacccugaacuugaucuccagaaccuauagugagggagagaagugauuccugaaagcuagccuuugaccuucaaguguguaccugcacucacacacaugccccauaucucaaaucauaucacacacacacacacacacacacacacacacacacacaugguguaaaacauaauggguuuuacuagacauauuuguguuccuuuauuuuccucucucugucucccauuauuauuuguuuauuuaccuauuuauuuuagacauggucucacauaucccagguuggcuucacuuccuguauagcuguggaugaccuugaaugucuugcuucaccuccacacagugauggaauugugggcugguaccaccgugcccagcuucuguggugcugggggguuagcccaggagguugacugagcuaggccagcaguguaacgacugagcugugguccuaaccucucucugucucuuccuucucuuucuugugaaaugcagccucacugugucgcucaggccaccucguuacugguugugcuuuuuccaucugaaagaaagugccuccuaucagccauuagacaacacuggggcaccaguggggaugucagaaacaacgcugucugcugucccuggugugggggaggggguguguggagucccagcguguccggguucguucucaccagcuuucuguccccugcaguguggcuuccugcuguggugcauggcccccagcccggcuaauggggcugagaugcucuacaggcgaaucauccguccuaucuuccucaagcacgagucccagguagacaguguggugaaggacgugaaggacaaagccaaagagacugcagaugccaucagcaaagaagguaagccuuggggacagcuugugcacuguguggagaagaugccaugcccuaggcucagaugacaggugcacuggacaccuguccucccccacauccucagcuucuuccucagucaucagguuagaaaagugacuuuuccaccgcaggcagaguugagcaccagcuagauggaugucuguauauccaguucaggcaggccugcaauuagcaaucaagaaaaugccccaagacaugcccaaggccagucugauggaggcagcuuugcaacagaggcuucuccuccucaggugagccagguugaaaucaagaucagcugucaugagggcuuccugagucugaccugaaaaaucaacagaggagaccucaggguagacuauucaggaacugcuuguggaaaaaagcuuggaggcagaagacauaaaggaaacacagaaggauggcaggagcagggucagccagugggcggggcugggcagccaauaggcggagcagggacagucagugggcggggcggggcggggucggcaggggcuccccccagucagugggaaggccauuggcuuagacugcugcuggagaaguuugagcagaacagugugugggccacuguaugaagaguggacuaaggggcuuuagcucagccgguagagcauuugccuagcaagagcaaggcccuggguggguuccguccucagcucaggguuuggggggaugugggccgaagaaggaaggaaauauuagucuaguuaggauguugugaucuggcaagaggugguggccucaugauuuguagcagcgacaauaaaguagcaacaguaagcauggaaaucuugcuugcuuuuuaagguggggcagcaggauuugcuuuuuaagguggggcagcaggauuugcuuaggaguuugagagagaaagaagccgagaccaggacuuaaagcuggagcaguucaaagacagacuugccauugaggugggaagacuggguagcagaaaauacaacauccuguccugggcagaugucugaagugucuauuagauagagaccuguguggagcagucagauagccacuggguacagauguugagaaccucaggaagugggcuuacacugaggguaagaaaugaaagugcacugccaguuggcugcaccagccuggagaggcugaucaggauagcaagacagccagagaguauuguacaaugagguguccaucacgccacgugcccuaaggguuaggugagaggagaccaagagacgaccgucagucucagcagugagaaaggacuagugacccaaagaaaguggcuuuuugggcacugggaacaaacaccugauuggagagauuuaagagaccaggagcuguguccugagagaacaggaagauaucuggggaggacacagggucaugagacuccaaagacccuucuuacaguaggagaaacaucauguuugaaagugauuaggaauggccaguagagcucacaggguaggggcagggagcugcugcccacaccaugcccucaagcagacuagagauggauggcaucuaguguaccacaggguggguagccagggcugggacguuuuggacaggaggggucgguguuagagaagcugguuuugagugugcagcugggagcuucaguuugcucaauaagaagaaaagagaagugaaggagcggggaggauggaggaacaggaggaggcauggaugcugucuaggaagaggcuggcauagcggggucucagugaacauuucagguaucacaggccgucaggcugcgcaguucuagcuuugggucaugaaaggagaccccgaguaggauuuagaaauuggaagaaaguuggugggagagacggcccacugguucucugauggcucagcaucacuggggaucucucacacagcuagcugagaaagacgcguuucccccuugaugucaacuuugccuggcgauuugaagggagugaggggagagcgguugccagaaagcuuguggacaaagggauuccuuggcucucacugggagccucugggccccaucaaacccagcugcuguccgugccaucucacugugcaccccacucuucggucucccgacacuuccugccuuggggggaauaguagcucagugagcaagucuaggcggguauagugugguguggguucuguccuaacucuggucaccaugaccaucucugcugcuuugaugauugaaggacacaggacagauuguccaggugaggaugucauacaagccucaaggcuagaugaccuucgagaguucugccgacauuuuaggauuugugucuauuuccuggaagccuucuuagccuugaccacaagccuccgugugugcucaucagcacacaagucacccgccuuagucaccaccuuaucuaguagccagggaggauggagcuuacaguacaaaaguccuucauacauuuucuuuucccucaacagucaagaaagcuacagugaacuugcugggcgaugagaagaagagcaccugaggccuggccgggcgccccuccccccccacccccuggagcucugugucaugcuagggacaguggcacagucguuggauaauguugccuuggaaacuucccgcuguauuaaaaauggaauguguuguaagcugcuuugccuuuguugucguauauguagaaagcauuuucauuuaaaccuaacagagugggcaguaccucaaguguuuaaaauauuuugcuguguaggaagacaugucacuauacuccaggaaauacaaaagaggguugggaaucucugucuguaggccccgugcucugcggggcucacucugcaugcgucuccuugugcuuacaguuaggaaaccuuugugguugugcuucacgcaguguaugauuauauauauauauaguucuguguuuuaauguaucugggcauauacauauauauggaaaauguuauuguuuggcuagaacaugcacagugcuugugaggaagaggccaggagaggcuuguagacgccaccugugaccugagaagggagaccaccugccgaggcuggaggucugagcuuccaauaacguuucagaaaucaaugcaagcgaguaagacucgaacccgugaucagcuccaguuucccaggaaacaguggcaccaucuccccugcuccuccucugagaugcugaaaugccagccauuuaugguuuaccugaaagcuggcuaacaagguccuuagucucuccucccaaacucuuuaaaaacuaguucauggcaccucccaagacagacaucccaccucccauuuuuuaaaaacacgaucccacguagcccaggauaaccuccaaaucccagcugcugcucauuguagcuugugccccacggcuggcauacguguguguucuuguuccugucagcagcacauugcgcugaugacguccagcucuaagagccauucugggcaagugaagggcaguggcuaacagcuguugucgguccagcaguggcuggguuaaacuuucuacucuuuuuugguuuuauggccaaccucaagaggucuccuuacuuuacaauucauaauuauuagcauucccuuaaaaaucucguucaguuuuagguuuuguuuugacagauagaauaaaguuuaagugacugcccauggccugauuggucagagguuugggucuaaaaaucugcaguuugcaccauaugccagcgucccagccuuugaguuagucugaaguggacuaaaggaguugucuaccaaaguuaacaacaggaguuacuuucaagacaaauagauaguaauucuccuccagaugacuaagaucauaauaauaugauauuaaauauuaacaauacaaaauaagaggcacuguggcccuagcguaauaugggucacugugucaguuuuccuggggauagcagucauuaggcuucauaugacuuaggggagaucuuuuuagaaaauaagaacuauuguuuggauaaagucaauuguuaggcuuuaaacaucaaaaauauuuagguccuuauaaguaaaagcacguuuuucuuguuggcagaaugaaaauuacaguguagcauauaggagcagaguguuaauauacaaaauacuuucuguggggaaugggcaggcagggaaugaugcuuacgguuagagauuguauugguggaaacgcugcagugaaauaaacuccaaaaguaauuuugcugcaucaaccccacaacuuugcgggagacucccugcuacuuucugcagcugucaaugggagaaaucaugaaucgacuucugccuacugguccuucccaaauaaagugucauggcuuaaguguugaaaaugagcugaguuugugucuggcuggaaacaaagcauuuauuuguaucugagugguauuuccuaggcauauaaaguucuagaauucuugcuaaacauuaaaugucccaaagaguucgugcagcaauuauuuccugacauugugggaagguccuccauccacaccugcagaaaacagccaaggccuguaaggaaguucuugccuguccucaggugugaguagaaaugaugugcccagugccuccuuacacguucccagacuccccuggcugccugaaccuggaagaguacugaacucuauguggacuguucuuuccuguguguguacauaugugacaaagguuacuggcugaacaaagugacaauuagaagaauuacaacauauacucaaauaaagauuauguuuauguggucucucaaaauaccuuuaa

SEQ ID NO: 8862 - RNA, 66289 nt, Mus musculus
ccggcccggccgcucguccuccgcccuguuccccucccgcucgccguuagggaggcucugcgccucagccgccaccgccuccgccuccgccuccgccgcucccgcccacuucuccgcgucugccgccgccgcugcccggggucuccggggggucgcuaccgggcuggccccgcgccacugcagucgcuucagccucgcgcuagaggccgcuucaggaggagacccgccggccgccgugccacuuagggccucaguucucgccucgucgacgucgccaaggguucuggaaaagcggccaaggccggggaacggggcuucgcgguuccaacgguggguaaacgggcgggggcccggcacugcgcaugcgcagcggcucgccgcggcggcccuucccccaaccccggacucugcggcugcuaggcagcccggggucccacccgcggcgggccgcugggcgaugcuguucggggucugggagaugcaagggacagccccggugggcauucgguugaggggggcuucuugccugcugggaagaggaagcacaggcgguggcccuggcugucggggggguguggcagccuuggguuuccagcugcugcagugcgcgcaaacgggcgugugccucaccucucagccucgccugcccaccguuucucugccaccucugcgcccacuuccuucaagcugggaagaggaguugaugcaggcaaaaaaaaaaaaaaaagaaaaaaagaaaaagaaaaaggugguuuauuccgggcucagcugcgucccuuuuuuuacggucacgugagaugagugguugcugacuuccuuaagucgcucggagaauauagccaaaauugggcuguuggugcacagggaccucauuuagaaggcacucagccagagucaggucugaggggucccuauguagggcgucgaguuucugauggggugcccagcuaguuaagaugauaggaaguggacucaguuggcacacccgccuagugggaacuguuaaacucuucuuuguuuguaaucaauuaaacccaaagugacuuagaaaaacuguugcaucauuucauccgguucccuggaaggccuucuaaucagcuuggaggaagccaaacugaaaauggcaaccacaauugcaguguauuuggcuauuuaacauuaaacagccguggcaggcaaguuuguagaagauauuaaaggauaguuuugaguauuaacuuucuguucuuggguuagugugaauuuguaccuuuaacgcccccuuuuguaaccugaagugcaguuuggcuuggguuuuuaaggcacugugcucuuaguaaauacuuguugaaugacccggucauuuguuugucuuuuagugccuccucuuuauccuuuaaaauuaggauauggucucacaguuuuaccagugagguaucuguaacauuguuacaguccuugcaguauguaguguaccuuagugacauuauaaucuuuauuggauuaaaauaaaggugacugaauuaaagagugauuuaccaguauuuccccaacaauaaaaggacaguuuuauuuugagacauggucucauggaagucugucuuauccagcugaggaagaaugaccuccaacucuugaaccuccugccccccucccaagugcugggagcaaaagccagcaccaucgcacuaagauucaaauccuuuuuuuaaaaaauguuuuuguuuauuauguguucuuguuccacggcaaacccugcaggucagaggacaacccuuaggauucugucuaugccguggcuucugggguagggcuucuguugucaggcuugguggcaagugccuuuacuccuugugucuucucucuaaucuucaaguuauauacauaaaauguaccauuucauaguugacauacaauuuuaaucuucgagguguucucucucuaucccuggcuggccccacccaaaaaguuguauggaagcagccugagugcugggaugacauuacaguggguaccaccacaucccgcuguaacgccacuagguucugcccggaggguguaccuguuccaaucccccugccuacccacaguugagucuagguauucuuccugaccuuugaguccucuuccuucaguguugagguuacaagcuugcaguguuggggaccgaugagggcuuugugcgucugaggcaagcaaccguguuuacugagucacauuuuuagccucuccugcgccuuuuauuuuuuaaugucucuagagacugguaauaggcaacuucagaaaguuuuuaucuguguguaggugcagguuuuugugucaugguguguauagagguuggucauagggcaacuuuguggaguugguuuguuccuuccacuuuaaaaaauuuuuuuuucuguguacggauguuugccugcauguaagucugcaccaugugcauuccuggugucccuggaggccaaaacuccuagagcuggaguuucagguuuaaacagcuugugugggugcucgaaccuggguccucuggaagagcugcuagugcucuauccauugagcucucuaacgcucuccuuucaccuuuuuguugguucugaggauugaacucagauugucaggcuuguggggcagagaguaaaggugcuuuguauauauacuugagcuaccucgcuggccucagaauagcuuuucuaugcuuauugcccuaguuagguuucucuugcugggauaaaacacgauuaccaacagcuugggcaggaaaggguucauuuugcuuuacugauagaaguguuuucgcugagggaagucaggacaggaacuugaggcagaacugaaguagaggccaugggagaaugcugcuuauuggcuugcuccuggcaugcccagaaccgccuuuugggauggcacuuaacccuaguggaugagauucucccacaucaaucauuaaucaagaaagugcuccacagacuugucacaggccagucuggguuccgccuuccccgaugacccuggccucugucagguugacaaaagaacaaacaacuagcauacuuaccauuuuuggagaaauauuuaucucaaaucuauacccauuuuaaacuuaguuguuuccuuguugaguuguagguguggucuuuuuauuuucuauauggguuaaaucuuuuuuuaaaaaccuaacauuucugaaaauuuacugaaaauuaauuuuauauagcauccuguuuuauauagcaucugguuuguuuguuuuuuuuuuucgagacaggguuucucuuuauagcucugaccaggcuggccucgaacucagaaauccaccugccucugccucccgagugcugggacuaaaggcgugcgccaccacgcccggcuauagcaucuguuuuacagauaagcagcaaagaagcugauuuuauguuuuuauauuuauuuauuuuguuuguuuuuuuuuguuuguuuguuuguuuguuuguuuuuuugagauggaucucucuguagcucuugcuguccuagaacucgcccuguagaccaggcuaaccucaaacucaaugaucugccugccucugccuccugagugcuggaauuaaagacgugcacuaccaccccccagcuugauuuuauauuuggaaaagggucucagccuaaauuuagacuagauauaucaauacgaagaaucuuucugucacguccguauggaaaaggcaugccuggcauacauuuuuuuuucuuuuucuuuuuucuuuuguuucugagacaggguuucucuguguagcccuggcuguccuggaacucacuuuguagaccaggcuggccuugaacucagaaauccaccugccucugccucccaagugcugggauuaaaggcaugcaccaccacugcccaguuggcauacacuuuuaaucccaguacuuuguaggcagagugcucccaagcaugccgaggagauccagguuagucuuguuuaugauugguuucuagguagguagggauguauaaugagacacugucugaaaaacaauaccuaucaaaucaacgaauaaguauuuuucagauauaucuuuguuaauaaaguauuuuuguaucaugucaagaacaugggaggaguuaacggucuagaaaaaggaaguaugggauguauagaugaacuugccuacaaauuguguucccuaaacuugagugcauuggaacuucuccaagagagaacagaagguuaauuugugaguagcugauuuuaacuagaaaugggaacaaugaaggauuuggaauagaguauagugcaugccacuuuaaugcaacaacucgauucacaugauacauuaaacaaaugggaagcaugcuguggcuucguacacuuuaaggaaaauugaagcagcaguuucagugggaucuauacuuguuagcuagaaagggcauccacuucaaagucaguugcagcuuuugucacaagcucuggaaguugaccaguuuuguuagcucucugagccuuuaucuuuuuuuccuccuuaccucaccagauuguugaaggauucugguggguagugaacuggaaaauacuggaaaugauagcaucaguucaaauucuuggauucuacuguugguuaguuuagaaguggaaacaaaaaaaugaagaagucuuuguuguugagauuugcucaaauuucacaaaacaagaaaguauagucccuaccuuuuucauuucguggacuuuaggaucaaacccauggccuuauguauguuaggucagugcugcuuuuguucaugugccuaucucguguguaugguuguauguacuuacguguacauauggguguggaugcuaguuauuguuccugugugacugaguuuucauuugaaggccaagacaacuuggaauauuguuuuucaggagccauccacuuuguuuuuugagcuugucucucacugggagcugggguuugcagauuaugcuaggcuagcuuaucugcuguggagcccagggucugucugccuccccagaacugggauuccaugccaugccagcaugcucgacuuuuuauacgggugcuggggaugaaauucaggucuucuuucuuguggggugagcacuuaccucuccucuaagucggcauauuaucuuuauccccuccuccccccaaaggaacuuuuugccagcugugugaaaugagaaauauuuccauuucuggaaaucaauuugucuagaauaaguuauugaauuccucuaauaccuuuuucugaugaaaacaagugcauuguacuuuuauuuaaaaaaauaaauuauccaaguauguaugauuuucacaguaaucaggaggcugaagcagggggaucuugaauuuuaggccagucuugacuacauaggacucugucuuuaggaagaaagaaacaaaaaagauggguuggagagaugguucagugguuaagagcacuugcugcucuuguagaggaccuaaauaagguuuagguucucagaauccacaucggguggcucacaacuccuugaaacuccaccucuaggggauccaauguugucuucuggcaucugcagucucacacaaauauauauuuauucucucucucucucacacacacacacauacacacaaaaucuuuuuuuuccccauuuuuuauuagguauuuagcucauuuacauuuccaaugcuauaccaaaagucccccauacccacccacccccacuccccuacccacccacuccuccuuuuuggcccuggcguuccccuguacuggggcauauaaaguuugcggacacacaaaaucuuaagcauaauaauuuuuuuuccaaggcaggacuucucuguagcccuggcugcucuggaacuccgucuguaggccucaagcuuacagauccaccugcuucugccuccagugcuagaagcuaaagcgggugcaccuuuauuacacucagcuuuaguacaguuuuaauuccguucuguuucugugugucucccucucucccucuuuccaugucccucccccccccccccccccccccccgcccggugugugugucuguguuugagagggaggagggguguguguuagaggucaacuuucaggaguugguucucucccuuuaccaaaugaucaaauuuaccaaggaucaaauucaggucauuagguuuggcaacaaguacuuguacccauugagucauccuaagcuguggguugugaccccuuugagagacgcauaucagauacucugcauaucaaaugcuuacauuaugauucauaacagcaaaauuaguuaugaaguaacagugaaauaauuuuauggcugggggucaccacagagugaugaacuauauauaagaggaucacaguguuagguugagaaccacugcucuaggcuuuuaaguuuccuaauguacuauaucucuauacguuguauauuaguguaucguucucuacucugcuuuagaaauacaagauacauacaaauaggugcuacuaaucccuccaccccagaaauacagagcuuuggguaguggaagacaguugagaaauuuugugcauuucaaugauuagauuuagcugggaggcagaagcaggaugaucucugugagcuugaggccacccaggcagggcucauaaugagacccuggguuuuuuguuuuuguuuuuguuuuccgagacaggguuucucuguauaucccuggcuguccuggaacucacuuuguagaccaggcuggccucgaacucagaaauacgccugccucugccucccaagugcugggauuaaaggcgugcgccaccacaucuggcgacccuggguuuuuuuguuuguuuuguuuuguuuuguuuuuaaagauuuuuuucagcaucuaucugggaauaguugcaagauccugaaaucccagguguuuccugggaguucauuggcugguuagucuaccugaacugguaagcuucagauucagugagagauucuuuaaaaaaauaagaauagaagaccacacacaaacacacauaaagauaugggaacugaagcaguuguuuucucucuuuuuauagauuaaguucugaaguacugaucgaguucugcguuucuucaaugaggaacuacaggcugaucuucugccauaaucucaaacagccauaaaugacagaacgaugcuugcucagugagggaagcuggugcagaagccguguuuuaaacuuagguguuuaaguacucaaagguaagcuuucuuauugguaauguucuauaaacccacagagacuuuuagaguuugcuguuuauagcugcuacucaguuuuucuuccguuuauuuuuuuugcugucaacaauucauauaguuagcugcuguuugguuaacuuugagguuuuguauuaauuagcugauaccaacuauaucaaagaauagauguucuuuucccaagucucugaauucaugauauuuucuuguuccuaacucaauuucuaccauuccugaaaguugguuggauuguuuccugguuauucuauggugccuucgaucuagcuaauacaauugauucaaucuuaauuuuuuaaacuuuagaauccugggaguuuaccuuuggucugaaguaucuguauuuggaauuuuuuuuuuucuuuuaaagauaauucuuucuccuuuuguuuaaagaauggauuuuuacuggaauuaguuaaguuaauuuuuuggacuacuugguaguucuugcuuuagauacuggagacaguuauuucuuuucuuuacugaucucuauccuacaaaauuaagacaaccauagaccauuucuucuggacuagcuugaggaucuggaauuuuuuccucacuaaaguugaaguguggugaugcacuugggaggcagaggcaaguggaucucuggguuugaggcuacccuggucuacaaagggauuccaagacagucaaggcuuguuacucagagaaacccagucuugaaaaacaacaagaaaaaugauuauucaugccagguagugguggcucaugccuuaaucccagcacuuaggaggcagagguagacagauuucugagucgacagagugaguuccaggacugccagggcuacacagagaaacccugucucaaacaaacaagcaaaaccaaaaaaacaaacaaacaaaacccaaugauuauucuuguuccuaucaggucccuguuuauaaaaaaugauuguuagugaggaauguuccuuauggaguuaggagucuuagcaguuaggaggcugaggcagcaggauaugaggcuaaggccaaucccaagcuugagaccaggucucaagccucucaguuuaucaaaggagacucuucccgauuacccauuugugaagggagggcucauauuacagggcucagaguuggauuggguuugcugcuucuaaaaacuucauuaucacugugcuugccgagugaaagucuugggaccacauuugacccuaauuguuuugagaucuuaaugucacuuucccaaaaguuuuaaaugacuuguuugacgcugauaaaguguucagacuuuacagagcuuuguauaguagagaaaaacuuagaugauugcacugagauguauuuguaggcuguaucgugggccugauaacugggacauauuuaaauagacgagugcacauucagguguaaaagcauuuuuucuuuaauguauuuacucauauugccaccuguuaauuauuauagucuuuuuuuuccccuuuucuauuuucuuuuuugucuuucauuuggcagaaaagacagcuuugauuucuggcugcaaaaaagcuaugaggaagagcuccuccccuuccuugaguaacugcaacuccgaucuugcuagcaaaauauuuggaauuccacuugaugagcugcagcagggaggacauccagacaaugagguuccguucauaguccgccacguuguggacuauauugaggaacaugguauacauuuccuuauuuugagggcuagcuuuuguuguaaugaacacaauuuaccccuuuuugauuuuggauuuaauuuuuucuuaaaauaaugcaaagcauggagaacaauauaaacacuaagaaacaauaaaaagauauuuuuauuuaaauugauuuaccuggaaauggcaguuacccagcugagaacauuuucagcggggguaauaggaaauuuuaaaauggauauaaagggugggaugaaagaauaucccucagagauacuauguguuagaugaucaguuuguuuuuuaauuaaaucuggggagcccagaaaggcuuuccaaaagugugagcauuuuaaguugagaaugaauaugaauaugcauauguggcuagacacuugaaggugcagcuuaauucuugccuugaacuaacauaggaggucuggagcaacaagggcuguuucaagucaaugggaaugcugagacaguggaguggcuucggcagagauacgacaguggagaagagguggacuugguuaaggaagcggacguccccucagccauuagucuccuuagguuuuuccugcaggagcucccugagcccgucauaccuggcagcuugcauauucacuugcugcagcuuucucaagguaacaguuggauuuuuaucagucauguauuauuaguuuuagaguccuuaccuuuuagaaaucugauauguaguuaguuuaguauauauauuucagagauuaauuuuuauuuccuuguuuguccucuggguauauaguuaagggaguggcaaaauucuuggaucuuuguaguacuuauuaaaaaaauuaaguauguauuuuuguguauaugauguauguguuuauaugugagcgugcaugugucccacugugugaguaugggcaucaggggacagccuugaguguuguuccucaacuuccuacuuuuccauggauuccggagauccagacaguuggggaauugaacuuaggguuccagacuuuguggcaagugccucuauaugcugagcuaguccucuggccugagcuaaaauaaagcuuacaggugucuauagagaaauagaugauaaauacaaaauauacaggacaaauuggagaugguaggucuaauuaguguuaaucgaauguugcuuuuaauugauauaagugacuuaaaaguuuuuuuuuguuuuuuguuuucuucaagacaggguuucucuguguagcccuggcuguccuggaacacuguagaccaggcuggccucgagcucagaaaucggccugccucugccacuuaaaugcuggaauuaaaggcgugcgcccccuggcuuauuuuuuuuuaaauuaugaauauaugugugucugugugagugaagguuucugcagagucccaagagauugucagauccucuuuugcuaaggaacugaacuaaaaaucucugcaagagcagcacauaccgaaucgcuaaagccaugucugucuguuugucucucuaucugucugucugucugucugucucucucccucucucucuggaagcucuucacagaaguuaacaaauauuuauuuaccugucugccuauguggguuuuuuuuguuuuguuuuguuuuuuuuuuuugguuuuuguguggcagggucucucuauguagucuuggcuguccuagacuucacuguguagccucuggaaugcugguauuaaagcuuguacaaccacacccaguuacaauuaauuuuccacuaauuauaggcgugaugucuuaaaaacauuaaauuauuaaaauauuaaauaugugauaguuaugucuauaaucuuaggcauguuucauucaguugugagaucagaguacugguauauuuauuugaauguauaguugcuaauaucgcaaaguauaggaaagucauugcguuuaaaaaucuuaaguaaaucaugugacuauaccucuuccugauacacuuuguguguguguguguauggagacaagagguugaugucaguugucuagucacucucuaccuuauuuuuugagauaggucucucccugaauuuagaguucugagucaccuagacuggcuggccagcaagcuccaggguuccucaugacucugccucucuguccugguauuacagggacguaucucuguauuuggcuucuuaugggauguuggggaugcuugugcagcaagaauuuuacugacuuaagcugucuccccagcuuaagauaaacuguuuauacgucuguugucuugcagaaauggccaauauuauuauggcccuaaauaaccuuuuaccacugucccccuaugaguuaauuuuaagaaaccugcagaaaaaaaaaaguaauuuauuuugaaguaccucugagaaauucuccaaaauuagaacaucauccacuaacgggguuucuaaaagucuaguuucuauuaguaaaaacucauugcuauaacaaacauaaggccuaauagcuucugugaucuuaugcacuugguaaaaaaagaaaccagagccagguauggugguuuaugccuauaaccccagcacugaggcaggaggauugccuaugaguuuuaggcuagccugggccugucagucuaagcuaccaagugagaccaucucaaaaacaaacccaaaaaauacagagaagaaaaccaaaugagaaacagaaaaccuuucaguuuaauuggaccauaucacuuauguuuaguaauuguuuucugagugccgagagagcagaaaauccucugucacccuguucauuucuuauuuucuuauuuguccaugaugaagacaauugucauugauaauugcuuguugauggcuccuucauaguuuuugaugauuggaggucaguguauuuugacuucuuugaguuggcauuuguuuggagugucagguauaguccugcaggagacagcaugaggaagaauuagagacuugaggcacaugaguaacaaguggggaagacauccugcaguaauugaggggcugaguccuuuaucuccaccuucccuuuaaacucuucuuucacuuaauaagggaaaugcaaagccccuaagggguuuggccucuccagaggaagugaagagguuugaauuguuauaguaaaaaaaaggauguggguggaguaaugugagccuggcaaaauaucugagcuuuacuuuuuuacuucauucagaaaaccugucauuauguuuuauagauuauaauaaugaagaugaauuuggaagaaaguugagguuccucuugcaacagcuuccaccuguuaauuacaguuuguuaaaguuucuguguagguuuuuagccaauguagcaucacaucaugaagaaauuuggucugcaaauucuuuggcugcuguuuuugguccagaugucuuccaguaaguuauuucacaacuuuuguuuacguuuuuaaaaguuggguuuguggaauggaaucauuauacugucuucccaaggaucauaggaugcuuggugaaccauuacuuuuaauagucuaucugauuaauucucagagcauugcuguguucaggguacaaauuagguuuuacggaugggaaaacugaggcacaggaugaugacauaaauugcuuaguuucauaaagugacucacuggugguuuucucauuuuaccuguaauuaauuuaagaacucagcucaauuuaagcuuuuauucuuagcauuuacacggauguggaagauaugaaagagcaggaaauugugagcaggauaauggcgggacuucuagaaaauuauuacgaguuuuuugagaaugaagaggaagauuuuucaucaaaugauuugaguucaauuacugagcaggugagcauauuuaauauuccauuucuuaaaaaauauaaguuugacaugaacuuacauagaauuuacuuucuaaacuagaggugguucucugauuguuuuauuauaugauuggauuucauacccuuaccccuaauuucugaucucaguuuagguacuaagcaaaaggcauuuauuauauauuaauuuauagugcuggggauuggacccagggcuuugaacaucauagguaaaucguucuaucauugagguaaaguucagcuaggaaaaagucaagaguacaugguagaaauuguuuugugcuucauucuccagccccacaauuaaccuagaaauuguugauuuuguguagcccagauugcccuugaaaucuggauaacuccuuuuucuugaguguuaagauuucagauauaccaacacuccuggcuaguagauaauuuuaacuucugugacuuuaauaaauuauucaaaucuaugauuuauguagugauuuuuggguuguuuuauuuuuggcuuuuacuguuugugugaggauagggucuuaguuuagccuagucuggcuugaccuuaguagguagccuaggcuaauuaaucuuaaauugcauuagcuuucccagugcugggauuagcuuccaugccuggcucuuaaaauccauuauuuaagcuacauuguguuuucuguuuacuuuuguugagggaauaucuccuguagcucaggcuggcuucagacuugcugugcaggcaagagugaccuugagccucugauccuccugccucuaccucccugguagaauuuuaggcauucacuaccacacuugguuuuauucacacucugccugaguuauauccuuagucccuacauuuuuacauuuuucuuuuuccuuuaugaauuaggaauuucagagucugaauaauuguaauauuuugguaaagccauuauuaauuuagaucuuucucggguuuagaauuuauaaguuagagaucuguuugaaaguuuuucuucuacaauucaagugguuuuucacaagaauuuuuuuuuuccuuuuuuugagacagagucucauuguauauuucugucuggcuuggaacuaaccgaagaccacagacuggccuccaccucacagaucuguuugccgcugcugccugggugcugggauuaaaggcaugagccaccacaccuggauagcuuauugauauagggucuucuguaguacauagucugguuugacuugguuguguagcauagauuggccuugaauuacugaugccguuagcucagguuucuuagugcugggauuacuggcaugugccuccacacuuagcuucagaugauuguugcuugagaauacauaucaagaggacaggucaguagcugccauaaagguuguuuuguuuugugacugggucucauagaaucuaagcugaccuggaacuccuuacauagccaagacuugccuugagcuucuaauuuuguggccuuuccuuuccaguguugggauuacaggcauguaccacuaugccuggcugauacuuaaacuuuaaugucuugauaguuacaaaucuuaucuguugagaaauucuguaaauuauucuuuuuuaaauuacauuuuaaucuaauaguucuuuuagaauuaagauuaauagcuguuuaaaauaaaauggcuguauauguguuuauaucauugauuuccccugauuucaagauguuuguuuguuugcuuguuuguuuguuuucgagacaggguuucucuguguaguccuggcuguccuggaacucacccuguagaccaggcuggccucgaacucagaaauccgccugccucugccucccaagugcuggcauuaaaggcaugcgccaccacugcccggcacaagacuuuuuuauagaugccuaaaauuugcaguauaugccuugguugugcuuuauauugugauauaauuuuguguuuuccuuuucuuauaauuuccuuauaugucuauauguauuaugucaguauuuuuauauuuuuuucaagcauuagaaaaauugauuuuaaaauauauugugcuuuacuuuacaaaagaugauacuuaagcaagacugagauaaaaaaauguugaaauuucuuguuugcccaugaauggaaaagauauuaguaaggcuggcgugguuguacaugccuuugaucccaguacucaggaggauucucuugaguuugaggacaggcuggucuauggagcaaguuccaggacagccaagacugcacauauaacugcacccaguauugaaaaaaaaaaaaacaaaaacaaaaggaaaagauaacaguauauugagcaaaauaccuccaagacauagagguagugagguggguuuuaaaguagggauguauguuuaauuaccaguugcuaauuaauaggaucucauguuuauguguauggguauaugucuaugcaccaugugcaugccuggugcccugauuggccggaaaaagguauuggaucuucuggaacuggaguuacauaugcuuggaauugaaccuugguacuggaagagcagcuggugcuuuuagccauugaaccaucucuccgguccccagggucuauuuucuuacacauuaaaaaauaaacuucuuguuuuuuuuguuuuuuuuuuuuuuuuuguuugagcaguuuugauucguuaguagaauugaugagauauuugagugaaaguaagauagucuuaaacucugagcaguuuuguacauauuuuaagaugccuauaaguauggcaaccuggcagaacuuugcuuuuuauuuuaauuuugguaccugaaggaagccaaguuuguuuaguauuguuugggaguuuuguuccauuagcccagguauuuaguuguuaagcucuccuguagguaguagguagucuuugucauucauuguauguguuggaaugaugaauagggaauguuugagaaaugacucgauaaagucaaguggacuuugaaugggcuuuguaaauaaugagaauccagugaggugguuugaagauggaagugauaauuauguuucuuuauacguuugagaaggcagguagcagcauuccccacagucuggagucuggagagcaggcauuucacgaggcccuagagaagggaauuacagcagucaaagaaagaagagauguaaguaugggugaaggcuuuccuuacgugaagucgaggcagcuacacagggcaaguucaaguuaacuucugaauaaagaagaauuguugagcagacaagacagucaaguggacagaggaaagaugaagaacuuuucgaggauuaauuugggaugagagaggacauuuuacuguauguauccuuuauguccucucuuguucuaaguaauuggauugguuaugacuggaggaaguuccagagauuguacuaggaauuggaauugagaaaaaacccuacagguuauauuuuuaguugcuuauaauaaugcugaugaaaauauugccaguuauguaaggcuuauugauauauucaguaugaaguaacagaaggcuuucauaguuucacuuucuaaaaauaauuuuuacauuuuuaaaaaauuuuuuugagagugugcuguaugcguauuuguaugcuagaggacaauaugugugucuuccacuauugcucucugccuuaugacaugggggucuuacugaaucaggcacucacuaauuggucuagaucaccuggucagugugugcuggcaucuccugacuguguccccaguacuaaguuuacagauguacgugaccaugcccggcuuuuauauggcaccuguggauccagauggcgguccuaaugcuuucguggcauguuguuugagccaacugaggaaucuaacuuaucuuggcuuauauguauaucuauuugugaugcauauguguuuguauguacaugggcacacuugugcaaacaugcaugcacauguguguaccuguguguggaggccagagguuaacauugguguguuccuugauuccuuuucacucuguuuauugugguaggucucgcguauacccagacuucacugacuuggcuagucuagcuggccaucauucuuaccuggcuuuauauaugguucugggaaucugagcucuaaucucauacuugcauguuauauacuuuaccuucugagccaucuccuuaguccccaaaaugauguguaaaagugauacauguuaaaauagugccuuuuaaccaaaaauagguggacugaauuaguauuuauucuguuuaaguaaaaauuaguucuaaaucuauuguguaugugggugaugugggugucaugguuccuuguggagguuagaggauaucuuggggaauuuguuuccuuuuccuugguauauaaguucuggggaacaaucuuaaggacaucuagucaggcuugauggcaagugccuuuaucugcugagcugucucgccagcucacugcccccuuugaaguuuuuuucaucacuguuucaugcaguagaugaggcguuacauuuauaagcacaacauauuaaauggagucugucauguauuuacaaauugaagccauuggcuuucauuguuguuguuguuguuuugagggaccauagguuauacccauagucuuggguaugcuuugcaagcagcgaaucacugagccauguccuccagccacugacuguugaauuuucaucugacagaugauaccagcuauuguugagaagcucccacuggaguucuguguaggcagccaugagccauguugauaagacuucauggguguaguguuugacauuucuaggagacccagucucacagcaaauuuucugucccucuggcuugcuuuuuuuuuuuuuuuuuuuuacuuuuuuaaagauuuauuuauuauuauauguaaguacacuguagcugucuucagacacaccagaagaagaugucagaucacauuacaaaugguugugagccaccguguugcugggauuugaacucaggaccucuggaagagcaguuggugcucuaaccacugagccaucucuccagcuugucccgcuggcuuuuacagccuccaugcccucuccguccguggucccugagcuuuaggugcaggagcuccuguuaaaucugucagcuggggcuggcacccacaaucagcuuguucugugcguucugaucaguugugguugucuggcuaguuugacuaggcucuggcauaagaugugcugcucaguauuuuaaugacugguauuagcuuauaagagcuauuagguauuuauaguuucuuugggauaauuuauuuuugagacaggaucuugcugaggggcucauguuggccuaaaagucacuuggagcccagguagguuugugccaccacaccuaacugcugcuuuuagacaaccuuaaaauauauuucacuuaaaaauggucuauuaacuuuucuuuaguauuuuaauggucuuuguuauuuguuuuuguuagugacuacuuaauauaguugguuugaugauggagacauuuuauacauccuacuagaaaaauauaauuacaacuuugugcuuauuaguuaaaauguggggcuggagaaauggcucagugauuaagagcacugacugcuuuuccagagaaccuggguucacuuccccgaacucacauggcagcucacaaacugucuguaacuccagcaucugcuacccuuaauacagauauacaugcaggcaagacaucagugcacauaaaauaaaaguaaauuaauuaaaaaauaguuaaaaucuaaguucuuuguuucagaauuuuauuuuguuuuaauuauuuauuuauuuauuuuuggacaaugauggagacugaacucaucauuguaaaugcuagacaaguguucuaucacagagcuacgucacuaguuagaguuccauuucuucaugaaaaaaaugugaucagaaguuagcugaccuuuucugaaacauagcuaauaccuaaagcauuucacuccucuuuuucuccuugguaggguuucacugugucuuuggcuugccuagaauauucugugcagaccagaauauucuggccuggaacuuagagaaaucugcccgccucugccuccugaguacuaugacuaaagacaagugugccaacucagcugaaaucaucacuuaccuccccccccauaaguccugagcuaccucuuaacuugcuguguaagaugacuuugaacuuuuuuuuuuuuucccccgaaacaggguuucucuguauagcccuggcuguccuggaacucacucuguagaccaggcuggccucgaacucagaaauccgccugccucugccuccagagugcugggauuaaaggcgugagccaccacgcccggcgacuuugaacuuuuaauaauucugccucugucugucucccaauuacuggguuuacagauacguuccaagucaguauuuuugugccuucuuuuuuacacuuaauauuaaauggcuauuuaauguaccuagaaaauggagaaaggaauuauauaucuuucauauuaaauuuauaaaaguaguuagaaaaugaagcuuuaaaaauuuuuuugaggcagguuuuaauguauaguccuggccaguuggaacuuuaagugaucuccugcccuggcuuccccaguguuggaauugccugugcugccaugucuagcaaaaaacgaaacauuguuacugcuacaugcaagcuuuuguuuagauuguaauauuauucauauuuguccugcaucaaaaugcuguuugucauaaacaaaauuaaaauuaaagaguuauauuugucuuguuuuuuacuuguuuauuuuguuguuauuuauuuagcuuugcaguguuugggauugaaucuggggccuugagcauguuagggaaauguuuucccugcucuagaauuuuacuuugauauaagaaacuuggcacuuuauaggagagacuggauuaggaaauuuaaaaaugaguuauuugccuuuauacuuuuuuuuuuagaauaguguauuucaauagucuuuauuaaauuuaauccugaaauuccuuuguguguagguuaaugaacuuucugaggaagaagaggaagaugaaaagcuggagcauauagaagaacuuccagaagaagguguagaaaagucagcuggcaugccagaggugcugcaguuaaggaugacugaaaaccuucuggacucagacaguguuacagcaucaacaagguaaacauuucaguugagucaacuuucacuguagacucaagcacaagagacgagcuugugucgcugagcuguggguguagcuaguauuggagaguuugccuagcauguguaggacccuggguacugaaaagaagaaagaaaagguaaugauuuuggcuguaucugguggcauguuccuguaaucccagcguuugggaggcagagguaagaggauuucuuuaagcaggaggccaggucaugcaggccguguacacuaagaccuugucucagaaaaacaaaagacuugaguauaaaaaagagcaaaaagaaaacuaaaauccauuaaggaucuuuuauuugcugcugucacacuuuucuucagaaauaaagccuuguguauacuuuucuuaaaauuuguuuucauauuagcuaguuuuuuggguuggguaagauuuuauaaccucugaaauagaauuucuaugcugugacagaacaccaugaccaagauagcuuugcuuuggaaagaaauccucuaacugggcuuaugguugagggagguagaguucaugaugauggagcaaaucgugucaggaacagcugagaacagcucacaucuugauccagaagcaggaggugggguggggaugggguuugggagguggggggugggaugaaagcaagacagcaugaacacguugggaguugggaguggcucuagucuuuugaagccggcugcagugacaugccuuuuucuuuuucuuuuucuuuuuuuaaaaaaagauuuauuaauguaugaguauaugguaacugucuucagacacaucagagagggcaucagaucucauuacagauuguugugagccaccaugugguugcugggaauugaacucaggaccucuggaagagcagccggugcucuuaaccacugagccaucucuccagcuugacauaccccuuucgcuuucgcacuuuccuguucuuuucaaacaguucaccaguuggggaucaaguauuuaaacauaggaacuuauaaggacuauucucauccaaauuaccacauugacuuuuaaaauauuuuguuuucaauuauguguguaugugugggauauguauacaugagggcaguguccguggaggacagaagaggcuagcaggaauuccaggcuuuugccaacuuccugaccugagugcuaggaacagaugguugugagcuaccaugugugugcugggaaugaacccaguucuucuggaagagcaaccagugcuuuuaacuacuaaggcagcuuucacgcccugaaaaucuuuuuuuuuuuuuaaagauuuauuuauuacuauaucuaagcacacuguagcugacuucagaugcaccagaagaggacaucagaucucauuacggaugguugugagccaccaugugguugcuaggauuuuaacucaggaccuucggaagagcagucagugcucuuaaccacugagccaucucucuggccccugaaaauaaaucuuaaaaacaaaaccccacagaucauuuuauuagcucucuucacauucuauuuuauuuguaauaauaaacagaauucucaaaugaacuauagagucauguaacuaaucucugucccaccuuuuuuuacuuugacuuuuggauaauaugccuuuggucauucucuucuggcuauagcagaauuucucaaaugugcuaaguuauauucuccccuugagccuuugcaguuucuuuuuauuuggauauguguccaccuagauauuugcuuacuucuuuaaaauucuuuguaaauguuacuuuucaguaaugacuccccauuuuuuuaaaaauucuuuucuauauugucuauaaugguuguggccauguaaucguuauauuuuggaucuuuaaugcucaucugaggccuuuguuaaaguuguguucuccagaguguugggaagugauuaaaccuuuaagagguaagaucuagugguuuucuuuaggucaguaagagcuccugagugagauuuugggcucccuuucucuucuuuuucuuuuacuucuuggccauaaggcugacaacggucuuugcucaguuucacucugauaugcuacuuuaccacuggacagaaaacaauaucaccagccacucauggauuaaagcuuucaaaacaaggaagugaaauaagcaucucuuuuaaaguuaucuccaguacuuuguuacagugauagacagaaagcugccugaugagugauauguguuaauuacuauugucuuccagcacuggcacacagaacaugacacacuuguuuacuuacauccuuuuuacuuacaggagucacaugcaugcgugcgcaccuuuguguaguuguguucagcugugaaccgcucacugagcauagauccugcuuaggcuaaacuggcuaaaaucuuaagaaucugccugguuuucuccuuuuuccccaguguuaggguuguagauguauaccaugccaacuuuuguauguguacugcaaucucagcccuucauuuuugcacagcaaauauuuuaccagugagccaucuucccuauccuacuuuauauugauauuuguagcacuaauugcccaucaaaaugcugacuguaucaguggcaugauguacaaacuuuacuuuuccaauguaaacauauuuuuuauucaccugauguaaauguugucuggaggcauacugguaaccuaggccuaguccuggacgcuucuagccacuguccaaucuaauuuagacuuagaauuuuucagccucugaaacuuacuguugaguaagcucaccuguucuuggucugagcucugacuggcucuuucaguucagcucaaacuccucuccaaacugacugauucaguuggcuucucucucugcuucuccugaguugugcugcuugaucucauaacuuuaucauucuguucugaucuucuggcuccuucucauucucuggcucauccugucuucaucuguuucuagcuuguucucugcaaccugucuuuguacagcuaucccaguacaaugccuccucuuucuguacugccuauucucuuucuucuugugagaguugagcauaguguauucuguuaaaucuuuccuuugucugcuacucaauuagaagucacuuucaaacaugggugcuuccuucuaaagcuaacuuucccuucaauguuugugaucaaagguguguacuaagggcauaucuguauucuagccagaaagguuaaaguuauaugguaaagcugagccacaccacagcuagaaacaaauuuucucaguaaauaacacgcucucaggguucacagugugaucaaauauccugcagcauuucucuuuuucguuuaaauaaaagacucuuucucuaacaucaauaaacucuauacugucugguucauuauacaaugucuaguucauuuguauuuggcagccuuggagaaaguacucuacucuauccuaucauggugacuccaaaguucugcaucuacaucacucccuaucauaacuugaacuuaccaaccuaaaaacaucauuuuagacccuagcacauuuucuuaaauccuaaauaacuuuaagcuuaacugugagacuaauucuuuuagucuucagccucaucagagaccugagaaggauuaauauuaucucaauaaauaggaaauguagaacaagcaacuuccaaaaguauagaaaugacagagacugcuggccaucuggacaguuacccaagauuucucuucaguguuggagcaccuaucucuuuggcccacugacccauaauaucugacagaauuuuaugugaaacaagaauuauaugaaggacuuacauaccuuguccuggcagaguucaacauuggacuuucuuuguguccugcuuuuccacuacuuagcaaacugucagcaguuaaagcaagggcagauucuugcccaguagcaacuuaaccacauuugaagcaaacucuauaaggaggcucuucagugcucauuaucuucuuugaaguaguaugguggugcuaccaggagccugacagguuucauuggucaaagaagucuuacaucuuuaaaugccacauuauuagguagauguuugagguuuuugcagaucaccuaucaguauauuuaaauaggcaaaugaugcucgucucuagcuacucccuaccugauuaacauagaaaacaucugugauuaaccgaaccuaacaaaaccauauauuugguugauuauuaacuagcauuucuuuuuuuuuuuugauuuauucuuuauauguaaauacacuguagcugucuucagacaccccagaagagggcaucagaucucauuacagaugguugugagccaccaugugguuguugggauuugaacucuggaccuuuggaagaacaaucaguucucuuaacugcugagccaucucuccagccccuaacuugaauuucuuaauuauccuaaacaauuuguaaugguagcuuucuuucuuuuuucuuuucuuuuuuuuuuuuuuaauuuuauuuacacgaguacacuguaguugucuucagacacaccagaagagggcauccguucccauuacagaugguugugagcuaccaugugguuguuggaaauugaacucaggaccuccggaagaacagucagugcucuuaacugcugagccaucucuccagccccuaaugguagcuuucaaaugaacuagaacagguguccacuguuugcacagaacuugguaguggaagaggcauggagcaguuuugcccagugguauugagaggccaaaucuuuuaaauucagacuucauuuuagauaaccugaccuaaguuugaacucagguaaacuaacaggcugguauguagcauuaguuuccaaguugcccccaauaaaaccugagccuagcuccagucucuaagacuaauacccaacaagaucagaguuuccagguuacacccucaacaagacaauugucuccagguuauucccccaacagaccugcaccccagguuacaagccuacccccuaccauguagagggaaacaaaaguuaaguuuaugauaugacucccagcaucagccaauuauguuaaaggccacagcagcuuuccaguuagaugcuugcacauauacucccauuugcugcuuacuauaagucuugcuacauaguaagacauuauagacauuauaguaagacuauauagacauuuguggcucccucaccaccaaaacugccaugcgugaugguggugcauugcgggguggggagggaggcaagcuaguuugaaaagaauaaagacccugcugugaguugcaucagaucugcuccuguguguguuuuuggggaucacuaacauuucccuuguacaacaguauugugauuacaguccaagugguucauuauuaugggaccccauuaucaucuuggaaaccauugggcaguuuuuauuauuuuuugugggacauuuuuagcucuuuuucuuaccauguuucauuuguccaguggucuccagaauccuuaguuguaugcuuuuauucugggaagauaaaacccugccccaacccuaauucggggguggggguaggguuccuguuuuuggccaguuauacauuuucuagggcaagauguuuuuuggcaauaaagaauaucuuucaauugauacuaaaaaaauucucuugaauauuugaaaucaaauauaccuuuguggauaauuauaccuauuuccuccuucccucucucucccuccaucucucccuccuuccuucccuccccgcuucugucugucugucugucugucuauaauuaacaugcauaaauuaaagauuauuuucagaucacaaaggacauucacuuuaaauuucagcuuguuuuuugcaagcagcuuuuagauuuaaaucauuguaauucuuauaugccugcuucuacuucccaaguauugagaucaaagaugugugccucccaagugcugggauuaaaggugugaaccaucaucacuccauccauuguuaacuguagaaaagaacuauuuuauagagaucugucugucucugcuggauuaaaggcauggacuacuugccuucucaaauaguuuaucuuggcuccaaaucacuccaauucuuuuguguuuuuuuuuuguuuguuuguuuuuuguuuuguuuuguuuuguuuuguuuuuuucaagacaggguuucucuguauagcccuggcuguccuggaacucacucuguagaucaggcuggccucgaacucagaaauccgacugccucugucucccaagugcuggcauuaaaggugugugccaccacugccuggcuaucacuccaauucuuagagauuuagaaaacaaguuuaaauuguguuaacccuuugaauuuauuuaagauauuuuaaaucucuuaacuuuuuuuuuauaccaaacaauaagaauauccuuuuuauugaagaagaaaacuuaaaagcugauguccaagauggugugggccauguggcagucuacagucuaauauucuaacguggaauuaagaaaagucguuuaagaaaauccaagacucuuuucaugccaguaaggcaaguaugacuuuggcaaauuaauuuuaaugguagggcaguugguaccuuuugaaagaccaacaccugccgaguccuguuuacggacaaccuggacagucugugaauguucuuaguaccuuuuaauauuuuucuuacaagcagucuuuaugguuuguuucuaagauuggagaaauguuaccucuguguuuccauugcuguaacaauuacuuccccauuaauucauggcuguauuagcagcauacggcuugaauuucccuacuuauccuccugucccuguauauuuaaccuaccuugcacuuuguuuuacuugagauaauguucuaaucccuagaaucugaauauuuaccuccugaagaggccaaucuggaugcaaagguuuuggugauauuauugcuacaccugcuccugugucacugaaccuuugauuucaaugccauuuuucuguauuuuuagcuuuggucuuugauuauuuguagcaguuugccaaaauacuuauuuucuggucucuccugaguuuuuuacuuuaucuguggaagcuauucuguucuugauuacauucagagcaguguuguuuuuaacaacaggcaauaaauguuguaguugcucuguggcugagugucucugaugcugacagaugaugauugaauugauuuuggggccugugggaggagaagcccuuuagagcauuucccaguaacagaaggucauucugaauuccaacauuuuugugaaaugauaguuauaucugcccuuguaucuaccacaucaucuguuucaauaccauuuacuugcaauuucaauuuugaccugagcaauccuuucaccugcauuaaauugcaucugucuuuuuacacaggccauaaauuuaauuuccccuuugaauuucuggaugcacgaugaauccuugggaagucaaucuaccccuucccaagauuaucccuucuccucucccuggaaguaaaggaccuuaaacuccaguaguuauuuuauagcaucaagcuuuggggauagaauaaaauguuuaccucuguccaaaccuagagccacacugcuugaaguagcaugcauuagaucugcaauacuuccgugaaaaauuucaaucuguauguuacuccuuggcuaacaagaaagaggugccggggggcuggugagauggcucaguggguagaaguacccgacugcucuuccaaagguccagaguucgaaucccagcaaccacaugguggcucacaaccauccauaacaagaucugacucccucuucuggugugucugaggacagcuacaguguacuuacauauaauaauaaauaaaucuuuaaaaaaaaaaaaaaaagaaaagaaagaggugccgggcgugguggugcacgccuuuaaucccagcacuugggaggcagaggcaggcggauuucugaguucgaggccagccuggucuacagagugaguuccaggacagccaggacugcacagagaaacccugucuugaaaaaccaaaaaaaaaaaaaaaaaaaaaaaaagaggcaaacagcucguacuuuuugcuguagagccuugagucaggacuuccauuuuccguuucccuacuguaugaaauugcguuggauaucucucuuggaccagugacaacccuugccacaucacuuguacaccccuggaaguccaggccuucuuucuggucuauauuuuaggaaacaugcucuuagagaugccugcaauugaagcacugggcguuuagcuugacauauaauauuaucauaguacaugcuggaaccaauaucgguuguaucucuuauucacuuguccaaaggugcuuccucugucuuuaauugacucuagucacuuuuuaacauuuuuugaaugccauggucucuaucagcaccuguguugugucaggaucugauaugguuuuguucacaacugagacuaauuuuuuuuaauaguuuuuuuuaaaagauuuauuuauuuauuauauguaaauacacuguggaugucuucagacacaccagaagagggcgucagaucuugucacgggugguugugagccaccaugugguugcugggauuugaacucaugaccuucagaagagcagucggugcuuuuacccuuugagccaucucaccagcccaagacuaaucuuuauuaaaaaaaaaucagugaaguuuucuccagagccuuguauagucuuuguaaacaagguggaccuuuuuucugggcuccuuaauuuagccccaagcucuuaaagccacuaaguggcauuguucuauaguagugucaucaaguugaauuuguucuuauauaucauaguaccacccuucacccagcaacuggucuuugacuguucauuucccuuggucuauuucgcuguuccauauuccugacuucuucccuccaucauguuagccaucacagcuguugagugggccuagaacagcugucaucaguuucuuccagucuugaggaaaaauuuugaguguuucaguuauuuagaaucuguuucacauaaggugaguacaucccauaugaaaucauggccucuuuaaaaugccuuagauuuaucauuucuauaggaugccauccuaucucuuaaccuguuccacaccauuagcaggcauaugcuguauggguauugggaaggcugauggugguagucuuguaacccuggcugauggugguagucuuguaacccugggcuacccuuccucccacucugguggcuugguuugaagguaacucuucuuuggaugugggcuguaucauuagguuguccuccagccuuuucagcuuaucucugacucgcugccacaguuucuuuucgcuuuccucuugcaggacacucaugcucucuugcucagucaccaggacugagagccccuuuguucgccuuuuuucugcacuucuugccucucaagcaguuccccuuucaccugcauuuuuuccagaugcaaagccaacucugcaaccuuuuaagaaaggagagagcagacaauggacuaggcccuccaccauuagucaguaaucaagaaacugccccauagcuagaucuuauggaggcauuuucucaauugagguuuccuccuugugucaaauugacauaaacuaaccagcauauauauuuacauauuuuuccaagacaaaaccgugaagagcaagccuguaagcagcauucccccccauccaauggcuccuagaguuccuuuccuaacuuccuuuaaugguggucugugauguggaaguauaauccuuuccucuucaacuugcuuuggucauggcaugucaucacagcgauagaaacccuaaggauggauggauauacacacacacacacacacacacacacauauacauauauauauauguauauauauauguguuuauaguuuguuuuauuugaggauuuagacaugauguguuuuauacacuuagcuuagagaaauauuuauuuuuugagauaggucuuagcaugcuuaccaggcuagcugugaauccacagagauuugucuguuccgcuuuuccagugcuaggauuaaagccaugugccauuacaugaugaaaauauguuuuuaaaugguuuucuauguagugaggaauuauuuaguaauucuuuccacccuaguaacaauaguggcaguauggauacuuuauauuagaucauugauugauagauuccucuugaaaauuuaagucacuguauauauuuuucuuucauauauuuauuuuugcauccugguucaccuguuuacaugcuauaauaguuuauuugcuuauaauuaggcuuuauauuaauauguccagauacccaguuagggugaguguucuguuuguagcauuuuggaaugaacagccagaucagcuguagcacagaauaauagccagcaagaaacuuuuuuuuuaaagauuuauuuauuauuauaccuaaguacacuguggcugucuucagacacaccagaagagggcaucagaugucauuacggaugguugugagccaccaugugguugcugggauuugaacucaggaccuucagaagagcagucagugcucuuaaccucugagccaucucuccagcccccagcaaaaaacuuguacuguuauuuacuaaagugccgugauuaagacaggaauauuaauagcacauugacauaacucuaguguaugucauuugaaugaaacaauauacuuacacaccuguuacucuuguguuuuuccagacaggguuucucuguguagcccuggcuguccuggaacucaaucuguagaccaggcuggccuugaacucaaagcuucaccugccucuguccccugagugauaggauaagguaagaaccacuacugcauggugguagguuagagguaugugccaccacugcuggcuaaguuguuauuuuuuuuuuuuuuuuuuuuuuugauuaaguuagugcuuuuuuuaaaaaaaauuuuuuuuuagauaauuucuucauuuacauuucaaaugcuaucccaaaagucccccauacccuccccgcucccugcuccccuacccacccacuccuacuucuuggcccugguguuccccuguacuggggcauauaaaguuugcaagaccaaggggccuuucuucccagugauggccaacuaggccauccucugcuacauaugcagcuagcaauacaagcucugggggucugguuaguucauauuguuguuccaccuauaggguugcagaccccuuuagcuccuugggugcuuucucuagcuucuccauugggggcccuguguucuauccuauagaugacugugagcauccacuucuguauuugcuaggcacuggcauagccucacaagagacagcuauaucaggguccuucagcaaaaucuugcuggcauaugcaauagugucucuguuugguggcugauuaugggauggauccccggguagggcagucucuggauggucuauccuuucgucuuagcuccaaacuuugucucuguaacuccuuccauggguauuuuguucccucuaaguuguuauucuuuauacggacugcuguccucuuccacaggauguuguuagauuaguacuugaguguuguuagucuaguauugcucugaucuguuaucuuuaacugcaguugaggaaacacuugcuuccuuuccuguuaccacagcccugcauuuaugauauguauguauuucucucagagaccacaauaaagugguuuucauguucauauauaaguuugcauuuuggagacaugugaaagauacacccauauuuuauuugaaucaugacaauugauugguguauagguuuauuuugaagauuuaaaaaaauuacguguauguaugaguuuaugugcaccauguggggaucagagggcauuggauccccuggaguuaaagguugugaaucacccagugugggugcugggaacugaauucggggccuaugcaagagcaguucuugcuuuuaaccaccaagcuacaucucuagcccccgaagaagacuuaaauacggagugaaaacuauugguagacaugaaaacugguggcaggaaugcuuauuuucagguaccaugcuauccaacuguaaauguaccauguaugaauugccagacucugaagcucugugugaugguaguccuggcuuguaugguuugaugccaugauuugaauguaacuggcugggacugaggguggcuguguaguggagugcucgccugcuguucacaggggacuggucccauguguguccguuaacagcagugagaagggcuuguagaaccaugcccuaaaccaaguaggaagagaacaagugauauuggaagaggaaggaaggagguaugggagaaaugugacagagauauaacucagccaaauucuauagcauuugauccugaaaccugugucuuguucagaugcugcucucauucaccaguggaaauaauugugucccaucauuguuagcgaucucuuuaucaccaaagacuauaguguguagaacuauguaaguuggaaaguuuaccaugcaaagcuacugcuguuguaccugauaagguauaugugaugguguccaguacugaguuucuauuuagcuaggaguguaggaguguguguuuguaaaggaaauuguuuaaacacaagaguuuuaucuuaugagaauucuuacagggucuguuaauauucaaagaagaauaaaaauguugcagauuuaaucuaacuuagcaagaggaaaaaaaggacauuuuuaugaggaugucuuuucuuuaauaacuaacaugucauugaugacauugagguauauaggcugaacuggaaguguucucuaguacucaggggagagcguggucacagcaacugcaggcugcucauacagagucagcuucuguacugucucugucagguggaguucaugaugauauacacuggcucugaugacagcagagaggagcugccaguauccaggaaauagaggcagacaggcagauugccagucugaggucagcuggacuacaugacaggcuucuaucucagggcaaacaaauaaugaccuuacccccaaccucaaauaaguaaagauagcugaaucauuugcuuugaaauguggacucauguaguccaggcugaccccauacucuugcauagcuugggauuaucuugaacucuugaacuucuguuuucauccccuaugugccaggauuacagacuugugcugccacgccaaaccuaugucaugauugcuauucaguuguuucaaaggccugaucugauuuuuuuuuaaaaaucuuauuaggauugaugcugcugcugcuacuacuacuaaugccagugaugguaacauuaaguguucaaaaccuguggcugguacuacugcagauaaugaagucaugcagcaagauuuuguauuugaggaucagaaaaauaaugagguaagaaauucuagaaggaucauucucauugugcagaaguuaaaguuacaguugagugauuuugcugacauacuugucucgguuaucaaucgcuaagaauauacauucucuguagaauuuaggagccaugcuagguagaaagguaaguuuaaagcaccuuacaguauuuuuauuauuuuuaaucuucauguguguuugugugacagugugagcguaugcaugucaugguacauguguggaggucagaggaaagccuuugguagaagucauugcccucagccuugucugagauaggauggauuguuuggcugcugcguacaccaggcugucuggcccaggagcuuccgaggaccugccugcccuccacauguugcuguaggcacugggacugcagguuuuacugcuguacuuuauguggguucaggauuuagcuuguguggcaagcacuuguacccaagugcaaguuuucuguuucuguuuuagacagggucuuacuguauagccuuggcuuuuguggagucucuauauagacaaggcugccuucuucuguuucccaaguacagggauuaaaggugugugccaccaugcacagcaucaaacauauuuuaaaaguauuucuagggcaggaaguuaaugaugguggcugaaguaguucgugguagagguugagcuuuuauuaguuucaaagcuuuuuguauuucuucauacuucugaagagcauaauaccccccucuucuuccuuuacaguucuuaguugaaauagaccccuguaacagaagacagguuuaaguaaugguuuuguuaccuucuuaugugugugaguguuuugcauguaccacaugcaugcuuaguggagucccagaggcaaaaaggggaggcauuguaucccuugggacuggaguuaacaauugugaguugccacaugggaucuggggacugagccuuggcccucugagagaguagccaguauucuuaacuguuaaaccacuccuagcccuccccucuucugucuuuauuuuuaaagacagaaaccccacuacauaacucugucugaccuggaacuaauagugaccaucuugucuuucucuucugaaugcugggguuaaaggagugggccaccaggccuggcaacagaagacacauuaaagaggagaaaaacaagcuuaauaaacaauaucucaaguacaggugggaauuggauaaacaguaaaucucuaaaggguggcuuaacuuccaccaauauccagaaaugaagguuagguauguaggaaaugauuaggaaaaguguuugagucaaaauaaaauauuuaguucuguuagagcagagugauagaaauccuagugacauagccaucucucucuuccugaugggggagauauuugaacugaggagauuuuauggauuuaauguucugauacaaaaagagugauguguuugcuauuuucugaaauaaucagcucaaaguaauguacaagagaaguaugcuggcauggcauguucagaaugcuacauuacagcucauuugcucugacagcaaaccugagcugagcucucaguaguacugcuuaagcucuuggcauaaugcuuuuaaaaaaagaaaaagaaguucaaacauagaagcugggauuguaugucagugccugaauggcagaguuccuggguuugauuccuagaacugagagagaaacaaauacaaaaguaguaucgaggacauucuaaagacaugcuucccaacacauuuaucuauuuauuuauuuagccagccuuuuugagacggggucuuacucuguagcucuggcugaccuguguugcgguaaaucucccaaauaugccccggcaaugaaaacacaacucaguuaauaugaauacaugcuaugcaccuagacugggcagaucuaccgcuauacuaucaccuucaacagcuaugagaccccuuagaacuugugguuucuccaggccgugugcuucugcucugcuuuucuucuuccuccuccucugcauccucucccucuuccauuuucuccuucucucuaccuucugcuccaccuucccuuuuaucugcccaaucaucagcucuccuuuauuuuacaaauuaagguaggaagcagguuuacaggaaaucaccugagugcugacucaacaccucacuggagaacagaauuaacaucaaauauaauuagccccaaggcucuccacaacuggccuguaacuugcuaucuaaaccaggaugaauugaagucugucucugccuucugagugcuggaauagaagaugcauaacaccauaccuggcauuuuucacacuuuuaaauaagaaauuuuucuuuaguauguagucguguaaaccauauugaaaaguagguguggggcuggugagauggcucaguggguaagagcaccugacugcucuuccgaaggucugaaguucaaaucccagcaaccacaugguggcucacaaccaucuguaacaagaucugaugcccucuucuggagugucugaagacagcuacaguguacuuacauauaauacauaaacaaacaaaucuuuuuuuuuuuuaaagauuuauuuauuuuauuauaugugaauacacuguagcugucuucagacacuccagaagagggugucagaucuuguuacagaugguuguaagccaccaugugguugcugggauuugaacucaggaccuucggaagaacagucggugcucuuaaccacugagccaucucaccagccccaaacaaacaaaucuuuaaaaaaaaaaaaaaaagaaaaagaaaaguagguguaauaacaagcaccuuagaguuggcacaguugcuugucuuuuucccuucuuuuccuaaguaaguaguccccagacuuaccuaagcugugucuuagucauucucagguucgaaauucuccuuucucucccucccagcccuagugcuauucuuucaaaugugguacaaaaaucccugauuacuguccuuucccuaccuucccaucuagguucuggggaccuacuguaacagcuuucuuccugaaauacagauuuggcuccauucauuaccuuuucuucaaaguuuucuauauuuuuucuucuacugaaaaaaacaaaaacaaaacaaaaaaaaaacaacccuagaacuguuuagauaguauuuuaggccuaccuucuaaaaguauucucucacaauugucuuaaauuucucagcuagguauguucauuaacaaccaccauuucccuacagcccucagucucuauucauucuguauuuuucagaaaucccuagcaaacuuuaaccccacagaaggugaguucaaaaccaucuucucccuuggacugaaauucuucccucuccuauaagaugacaguacucacuucugcuuuuaacagcacuggcuauguuggacacuauuaaacuugagugcaagccagcugagauggcucaguguguagacacacucgccacccagcccgacagccugaguucaauccccaaaacucacacagucaggaggcaacuucugaccuccuaauacacacuuuggcauauacucauauauguaaaugacuaaacauuuaaaaaggucuuaaucacuuuauguguaugaguguuugccuguauguguauauguucacccacauacaugucaggucuguagaggccaaaggguaucagauuccuuggauuagaaggcggcccuggaacaaacaguugugagccaucauggaaguacugggaaccaaaccuacaucuucugccauuucucuaccccaaauacauaauuuuuuaaaacuaugccacaugucuaaaucuaacagagugacgauuccaaucugggaaucaauaacacacaacacaugauaucaaagguacuagagaaaaugagaccaucaaggaaguaaaugaaacaagaaaucuaguaacagagcccuggacugcucaaauuccaaagauccaaaaaaugaacagcaaagaggcuuggcauaguuugacuaaagaaaggaauaucaacagugagauauucuggaagcucaauggagaguuggagauaauuacacaagugaaucaauuuugcuauuaggccaacuaaaagauguucaguacauaucuguggggacugacugcaagagcagcuugagaggaaagacuaugaguguguguguacaugccacagcgugcuuguggaggucauggcacaagcauggagaucugaguuuugaucuccaaaacccaaauauuaaaaucaaaauuuucccagcacuggggaggcagaacuugauuuucucuuccaacuuagguagucaggcuuggcuacacgugccuuacuggccaccuugccaucccuaugaauguuuucuuaaagaggagaaaguugguucaugauuggagagacaggaaggccuuucugcugaaggcacuuauccugaugauuuccccuugucuagcuuaagggugauuugagacucagggugcuguaaguucccuguggagaacugaugagaaggcacguggggagggaggaagacaggaacuuccuucacagagaaggagcaagcgcuucuugucuaugugucauuucuucuuuucucuucauuuuuguuauuuuguuauuuggguuuuguuuguuuuuuuuuuuugagacagaucuuauaguucucaaauacuaacauuauaugugugugccucuacagaugguucugagcaugagaaugguuuucaugucauuuuucucuguaugugcaugugugcaugccaggggacaacuuuuaguguuccuauagaguuggucuauuuguuuugagacagcauaucucaccgacuaggcuagcaggcuagugagcauacacuugucucugcuucccaagugcuggguggugcuuguuguuguugaagugaggguuuuagagaucaaagcucaggucuucaugcuugcaaggcaagcacuuuacugacugcucuuuccagcccuuauuuuucuuuuauauugcuuccaguugcuuuuuuauuuauuacuucaguaguugaaaagcauauuuaaaaguugggcauagaagauggugcugaggcaggaagaucacaacuagguuggccuaggcuacaaagcaagauugauuacaguuugggggaauauaaucaaacuuaggguuuguguggugauuugaaugagaauggcccucauagacccauauguuugaauacuuugggccucaauugguagaacuaaccauuuaggaaggauuaggagguuguuggaggauguauuacugagcuagauguagauagcccacaccauagcucucugcuuccuacuuguggaucugauguuaugcucucagcugcugcuacagcaccaugccuacuugccugcugucauguuccccacccugauggucauggacuccaaguugccuugcucaugguguugugucauagcaguagaaaaggaauuaagacagcugggguaugguauuggcagaguacuaucuaacuucagaggguccuggauuggguucuccagcacuccuccccucaccuccacacaaucaaaacaguugcacagagcuuggcauagugguacacgccugucauucuagcacuggaggcuaauguagguuaggcuuuguuucaaagaaagagacaggcauuguuucagucauuucaaaguaaaaguauagauuaaaugagaaugggugacaggauagcuuguuuuuguaauacagguuucuagauuuuucugauaaucauacuucucccccgcaagucaggguuucucaggcuguucuggaauucauucuguagaccaggcuagucuggaacucacagagaucugccugcuucuaccucaccaguauugaaauaauaugccacuaugcccagcccaaucucauuuuuaaauucugucuuaaaaacuaaggcauaugaaauacuggacuuuuguuuucaugugccuaguugugggagagcaaggagcuaacuagcuugagagguguggggcaggccucagguggaaggaaccggacuuuuauuugcauggauacgccuguagggugugcaguggaaucacucugguaacaaaaggaaagccuggagcuuuuuuccuucugggcuggaugcugguauacaaugcgggcugguuaccaugugcugucugguugugggugggguuuaucggcggucaucccaugugugugcuguggaaccuagguuucugaggcucaccauggcuauugcucuuuuggauuugcuuuccacccugcugauucucacucagcaggaaccugucagcucuaaguagcauccuaguuuguccugguucuucaggcuuugaccuaauacauagaaacucugagaauguauaucuacauuccuaauaacuuuugauuuuuagauuguugguucucuuacacugagguuuuuaucuuuuaacaauaaaacauugaaaaucuuagauuuuuuuguuuauauggguauaucaguauuuaucaucauagaaguaaaauuaauuuaaaaauaauuuacuacauaaauucauucguaauuauuuuuuucacuuauuuuuguuuuauguguauggguguuuugugccccugccugccugaauguauaugcaccacaugugugaaguucuuuuuuuggaggccagaagaggaugucaaauccccugggacugggguuacagaugugccauguggaugaugggcauugagcccuggcccuuccuuugcaagagcauaagagcuccuaaccacugagccaccucuuuagcccccuauucgugauuacggguuccaucauguuuggcuggagccuuccauccaaguuugugugaguuucaucugugcauaugcauguggauggaggucaaagguugauaccaacucuccuccucauuacucucugccuuagguuuugagacagagguucuugcugaaccugaagcuuggcacuuugguagauuuagaagccaguaagucccuuggauccucucgucucagccuccccagugcugggauugcaggcuugcacuacuggggcuggcuuguuaccuaggugcucgggucuucaugcuugcauagaugcacucuguuggcugagcacuuuuagaaaccuccuuuucucuuucuuucuuucuuucuuucuuucuuucuuucuuucuuucuuucuuucucucucucucuuucuuucucucuuucuuucucucuuucuuucuuucuuguuuaaaauagcuguucucauaaaagguuuuaauuugggguucgcgucaauuuauguuuguaaauauaauuacugccugcuuagcagacaggacagguggaggagcagguggaggggucucauauuugccuuuuguauucaguccacugcuguggguuugauuggauggagaguagcaaacaguucagccucauggagacagagccuaagaaggguggcaggagggaucaguggguagaagugcaugccacacaugcuugguagucccuggaacccacacaggagggagagaaccaauuccugaaacuuauccucugaucuauacacaugcaaacacauacuaauaaugaauuaaaaaguaaaaauauaaguuuuuguugauuuuaaagguuauaaaaaugugaaaauguuuauacacuuugugaaauuuugaagggauuuguauuauauuugggagguuuuuauuuuguucauucauauagcuuaggcuggucuguagcuuaggaugagcucagacuuugagucuaacugcaucugacucuugaaugcugagauuacaggcaugugccaccacauaaguuuucuuaucagagguaguauuaauaaacucauugaaaaguagauuguucugugcuucugaggcucacgcgcccuccccaggccacuccaggaaagaaguuauuuuaaauguacacaggccagagccuuuccuaugcuaccauacccauaguucagaacugugaauuuuaaagaagagaauuuuuuuuucccaagacaagguuuuucuguuguagucuuagcuguucuggaacucacccuguagaccaggcuggccuugaacucacagaauucugccugccuccgccucccaugugcugugauuaaagauguguacuaccacugccuggccaaaagagaauucuaaggaaagaggauacuagugauuauuacuuagaaggagagagaaaaccagcguccccacaaguacuuaguauguuucagaucuugagggaggguaaaccuuguguagaagaacugcucuaaugcccuaaucuagauuggcaucuuucucugacgcacgaguguugggagcugauaaacaguggugguauucuuuugucagucuguagguauacuguuagagccuuguagugaccacggggauagugaagauggcuguccugagagguaagccuuucuuuguuguugcugauaaauuguuuugagaauuggaacaaccucuucacagauuuuugguugaaaauuuuggguucaucuauacauuauaagacauaguuugguaaaaagaaaaucgggcuuuuuaaauuuuaaugguagauauagauauauuaauagccacaaauauuuagagcuuacaagccacauuaguuaugaacauauucagagagagcacagcuuuuuuuagagauaacaaaaacuuugauuuauagaacaauuagaauuugauacuguaaacagacccauuggugaguuaauugauugucuaggaacuguggccagccacucaaaacuuaauacuugcuucgauggguaagugugggauauuuuugguuccugcuacuccuccucacugugucuagggauaaucuuuguauuugguguuuguucaccccauccauguuaacgugucugagacagugagacccaccaaauguggugucuccucagauacagucccuuugaggaaaagguguuuuacucaguggauagaaguuuuuuccagucacuuuggucuuguuaccccuuugcaucauucuuucagaagacgccaagauguauaucuucauauacucaguaaugaggccacuacauuucugguugcugauagccuguugguuagguaauguuuuaaugcuguugucuuuugaguagaaaccuguuguuggaggguaaguaaauucuuuggagcccugucucuggaguguccucauacucugaagauccacagucuuccugcuuacagcaguuccuugugcuuccuuucaggaggcaggacugauccucuuccagcccagggaguuuuggagcuaugggcugaagauauaagauuaacaggcauccccagaaagaugacaucgggauaugguagagcaauaaguaucuauuuagugaggacccagucuuuuuuggaaaacucuuugcucuucaacuuguguguagguuagcaaacuuguuguagauccagaguacuuugucuagguggauugcauuuugcaugguuaauaaucaaguuuuucagauuuagauaguuaugucuuucagaguaagucugugagagugaaucuaacuuauccuacuaccauuugcuccuagccugaguaaaagauguugaagaaaccuggcgguuggugguguacucguuuaguccuagcacuugugaggcagggguaggugggaaagaagagugcagcagccugguuuacagagcucguuucagaacagccaggggcuaugcagagaaacccugccuugauccucccaccccauccccccccaaaagaaggccuugagccuuucagggacuuuaguuuauuucucaggccaccgaggguaagauacugccauauaaagagauaacuucuuguguuuaaaucaaggcuugucuuccaagugcccaccacauuaaugaccacuuaaggaggcacuuggguauauguauuaaauuaacacaggucuguuagaggagaauuucccauugugggcauuaguaaaauuugcuuuguuuacuggccaaagagguagagauuguuugugacaauguacaacaugauuuuuaaauagagguucauuuuuugggggggaacuacaaggugaauuaaaucccccccuuuauuuuuuugauguaaccuuagauuacaguauacacuugugauagugcuccgccuuaaaggacagaccaaaacuucuuuaaaagucuuugcauagauagaauaaaccuguugguuaaaacuaauauuuauuuuauggauucuuuuucuaauaugcaucaguucucacugacugcuguaauuguuuuuuaauuuuccuuuuauauagauuuuucuuuuggggguaguuuauguggggagggagugguagagacuauuacuuaauuuuuuaaaucugaagugagucuguggaucuuuuuaguauugugugauuuuucagauauagggcuccaaagaaugggcauaugcccuguugauaacuuuucccuuucaaauuuuaaaugcuaacuacauugggaaagaaaagaaagaaucuagguuaagaagaaguaauagaaguaaccuuucuauucuuuauaugcuaauaacuauauuucuguuuuuaggaaggaauauuuauuaugugacagugauaaauugccgcacuugauucugguaagaacuaucuuuauauuauaguucuuaaaaauguugcuuaaugugccaguuauuauagcuggccuuuaguucuuauauuggauaaguagaaaggagucaaauguaaaaguuaagcaguaauuaauguaacaaaauuauggguuaugaaaguucuuuccuauauuugagaccuaaauuuuguuuucuaguaagacauuauaaagugcaaauuuacaauugaauguaguuuucuuggggcuagagagauggcuuuaaccaugaagagcacuggguacucugcuuuuuuagugguccugaguucaauccccagcaacuacaugacuuauaacugucuauucauaggauucaaugccaucuucugugugcacaagcaaacaaagcacucauaaacauaaaaugcauaaauaaaccuuuccagaggaccugggcuugauuauuagcacccauguggugucuuaugccgucuauaaccagucucagaggaucugaggcccuccuuuggccuccuugagaauuaggcaggcauguggugcacauaauguaugugcacgcaaaagccccuccacuguguacagauaaguagaaaugggacaguugguuuuguugggacagcuggcuuuauugggacaguugguuuuguugggacaguaaugaaaaaugcauagggauauaugugugugcagauugucucugagacaguugugaaaagagucaugguuaugaaaugcauucuuuauuuuaaaauacaggauucuaguagcaagauacgugauuugaaugccaacacugaauuggaaguaacggaaggucagaguguugguguucaaggagaagcagcguguauacagauugcgcaguuagaucugaagaacguuucugauggugauaaaugggaagguaauuuuacccaagcauguuaauucccuaaauacuguuauuuguaacugaaauaacccaaagcaugacaagacuccugcccuccucuggacagugcuugccauccugaucuguucugggggggggggggggagaaguuuauuguuuguuuuuuuucccaaguacacuaguagggcagcucucucguggguagaacguaacugaauuauuagcuuugcugcugccaaagggugcagugaugcaugccugugaccucagcaugugggagagaaagaugauccugaguuucuagaccagaccgucucagcaccccucccuaaugcaccucccucaaagaaagaccaaaauuuguuaaaaauaaaaagugcccuagauuaaacuacaauagauuuauuguuaaaucacaugcuaucucuugguuuuugaaaguugagcauauuaaaguuuugaugauuuuuaccaguuuagaacaggguauuuagcuaccuuauaaucaucgagaacagguuuuuauguuuuuaauucuucacugguacuucugagcaaaguuuguauuauauagauugcaaaaguauuuugaggagacgcuaaaauuucuuaaaacuuuacacugaaaauuuuugguaaauguuuuacaguaaaaauaccauaaauuauaaacaaaugugggauuuaagugaauuauuuacaugcuaaaguauuuacuugggaaaaacacccaagaaucuauuauuuccuuagcaguccauaagaagaagauggcugacgaaauggauaagcacuguaacaaaugugggacaguacagugugagugguuagaaccucugucagcacugcgugcuguauuguuaucaacuguaaagcaagaccuuguagaagggaaaacuaacaaccagguuagaucccugaauccgugagcuaucaaucuuccuaauaagagaaaaugagaccacgcaggaauccuaagcccaguuucuggucaaguggcuagagaccccugggauugugccuuugagaguuauuugaugacaaacacacaguggcaauaacuggaggaauuggaguaccagugcucugaguuccuuugcuauaugaccauaguuuuaauauguaggguuuucuucuucuucuuguucuugauuuuuuaaccuaaaguccagcccugcuuuaaaaguuuuuagcaaacccuugucugugccaaucuuuccugugagccuaacuucagcuaaaugaaguugguucuguuugacuuauuuagaacucuuagaaugaaugcagaaagucccuugaguuaggagauguuagcauacuggugacagugaagauggcauguccuagauguggaaaggaaaggaaacauuggaaaggcacaguggcugaaagagcaucccugggaaccuugguuaagaacggagucucugaacaugaggauuaggauacuuuugucucuucuagcgggagacgcaaauaaauaaccacuuaggaucucugacccuguguuaacacaaaagagaugaacaguuuccaugguuuggagagacuggucucuauagcuugaacuuucagaggagaaccugaugcuggacucuccccaccccugucaggaucccccuugucagaggaaaggagagacccugcucuucagugcccccaccacacaccccccacucaucagucucaauaaguccauguaggucucuuuccagaagaggguggggucagugaccuucaccagaaccucagugcuaggacagaugcgugaacuucccagcccugagagagaaggguugucauuaaugucauuaauguuguucuaacuuugccacaaauguaaaaaaugauuuuuuuuacaauuauguguuagaauauuuuuguuaaaucucaagauaauagcuuucuuuagauuuuauguucuuugaaaucugcagacauauuuuguuuguuuguucucuaguagagaaaggggugaugccacgaguucuggcccucuuuacuauucccuaguaagugaggcuuuaguuuuuucucaaaggguaguuagcagaacacaaucugcaagcagguuguguaucccuaccacagccaguaugaauuuguagucacuguucaaagagccauaaugaagguggacagcaucuuucccucaguuuuucugcugacgacuuuggaaugacauacaauagcaguauuuuuaugagacaugagcaaaagggaggcuuuucuuuguuucuuuucucguuuugguccugggguugaaccuagagccuucaggaugccaaggaguucuccaccauuuagcaguaccauccucagccuuccuucuaagggaguugccucucuucugucugucaaccauacuagaaggcuucaaacacaugugguuaagauguuuugguucauuggccuugugucugaaauuuaauaacaguuuugaguuuccuuacuugugaaauagaaauauauguuugcuuaaaguuuguuaguagucauuucuuuaaagcagguuuuugagccaaauuccugccugguccuggggaaaugcuauugugcccuuggcguuguguuauguguaugguuuguucugccuggucuguguguucacuuuaguauuuuuugccauuuuuuuccauuuuauuagcguuaugccuuaucacuuucccccucauugauuucaaaacaaugcaucugcagagagcuggggaggguaaguauggcucgcacagcucagcuuugcuuuccucuguggcucacugguuugucuuguuucagcccuucuccugcuguucccacaugaaacuucuauguugaaaacucagaaaaaggguuuuguaauucuuuucuuaaaacauuaaaauuucuccuaaaauguucauuauuaguauaucugcugggacacagguacaaggguugcuuugaaaucacuguauuguugaguuuauugugggauuacauacuuguuacccaaguuuuagucaaccaaaauggucuaggccucaaaggcaagguaaauuauuuucuaaaaacuauuaaaagauaaugcauagcuagggagugguggcgcaugccuuuaaucccagcacuugggauuucugaguucgaggccagccuggucuacagagugaguuccaggacagccagggcuaaacacagaaacccugucuugaaaaaacaaaacaaaaagauaauacuuaagugacuacuacauagcauuaaacuaaauugcugaaauggcuggcuaucuugauuauucucuaaagaaaaauacaacuuaaaaauuuuuaauacuguuaauacauuguucuauuuguuuuugcuuuugcaauagcuauuucaaugagauuuaaauuuuuaguucuaagauauaucuagaaguucuuucucccccccauacuccagugaugcuuaaaaauaauguuguauuuggcauauauuuauagaugguguauuugagaagagauguaagcuauuaacauggauucaguggagagugcacagaaucacuguaauacgauccgugugcucagggagcaccagagcuguuucauuuucacuuaaauacuguugugggacuaaaauguguguguguguguguguguguguguguguguguguguguguguguguguguguguuauucauaggaaccuaauaacaggaaauaacuaacauuacuuuaauguuaacaguuaacauuauuucuuauuauuuaacauauuguagacaggcuaaaguuaccuccuuauuuggaauauuagaauucuuauggcauuaguuccauuucuuaguauucuguguaguguggggaaauuuuucauauauuaacauagccugucaccaucugauagugagagacuguucacuuuuucuaaggaaagacuuguauuugaaaaaauguuuuucuguauaucaucuuuagaauacugaguuaggauuauguuauauaacaucuuuagaauuacauuuauaaaacuuuaagugcucuuucuugcuuuuguuaguggguuuaggcguauaagcaguaucucuuagugaacgaauaugaagaauguagaagcagcaggcggcaguauaaauaugcuaguauuucuugcucugauguuuuccccugcuauguauaaaaugaacccacuauacaauuauauaggcucaagucacccuuaguguuauccuuguguuuguuucacagagccguuuccugcauuuaagucuuggcaggaagacugugagucuggagaagcucagcugucuccacaggcugccaggaugacucaccacccccugggagaggacugcccuccaguauuaucucaucguaguuuagauuuugggcaaagccaacguuuccuacaugauccagaagcguuggauuucucgucaaaggcacuuuccuucacuagguaugggaucucuuguauuugaaaagcaguucuuauucucuacacaaauccuuccaggccuguaaaucugucugucuauucgacugcuguuguauuuugaauuuauugaagcuacguaguacuugggguuuacuguuagacuguaggugguuccugugguuuaguccucauguauucacuaauaauuggagugcagaacucugaaagugagaagcugacuaguuuguacugcucuaauugaaucuuaauuuugagauauagugguucuggcaucuuguagcaucauagaaugcacauacauccuagaggagcugccacaccacugagugggccugagugucuacugccaaauggaucucugaccuuuacguucuuggugggguggggguuauggggggggaauacaaaaagaaaaugcaaaaaagaaaaacaacaagaaaaauugaugaacuguccaagcuggcagaggcaagagaacuuccguggaaaagggacuguugucucuccuguagagucccgugccuucagucauuuggcauucauuuggcucagcagugccaagacagcauugucugucuucuagauucaaacuggcaugcuuuuuucagcuuauggaguuggaacaguaucaagaaaccagaguuugcuaagaaccaacaccacagcuugucauucauguuuaacaaauuaauuuugcuauugaaaauggaaucucugauuauuuuuauucagauaaguuuaaaauguguuacuauuacugucuuuaugauguuguguuggggacaggagcucucaugcugugacagacaugugaaaggaagaggacaacauaguagagucagcuccuucccuuccaccaugaccuggggucugccuaucaaacucaggucaucaggcuugcacagcaaacgucuuugucugucaagcauccuaucauucugggaaaccuuuuugauggucagagaagauagacccuugauggugcacaugaagagcagacacuaaugacuauuaaccucuuccaaagaaugccuccaaaugaagggaggcaagcuucaggguugcugcuauaucuuuagaaaauuugaguagccauagguugugcuuuaauacuccuuuuccugcuagucugcagacuuacagugaaagggaaacuuacauagucaguccauaacacaaacauugucuuaaaaggcuuagaaagacuucuuugggaugggaacaaguugcgucaugagacuuuggagccuguuaucuauagcucauaaauagaaaggcucauuggaggcaccccagugcuucugggucugccuccauucugagguaggagcucccccagguggcucaucuggaggcauacuuuccuaaggaauguugaagaacugggacagauguuaaauguaaaauucuacacaggagcuaggcaacaugccucacuugccuaguuccuguguagauuuuuuacaaguuauuuacagcuuuaguguggagauaucuggaaugagauagugaaccuauuauugguaaaguucagaaugcaagauaccauuugaagccuuuacugugagcugcaugauuuguguggcuuuuucuauuacuguugugucuguuuuuguuggguuuuuauucucagcauugaauguaaacgcaggguuuuaaccucaguaggagaacauguaugcaaugucacuuccuaacauccagguagcauucucuucuauaauucuuugggguugggaagauggcucagugguuaagaguucuugcugcucuugcagaggacccgcaggcucaguucccagcacccacaugguagcuuauaacaaucuguaacuccgguucuggaggcguaaugcccuuuucuggccucugaagaugcugggcacacaauauaggcaaaauacccauacacauaaaauaguagcaacugcaacaacagaaauaauaaacaauacaaaacuucugacaggguuacaauaacacagcacaccaccuuccuauaggcuggguuauuuugccuaaaugaugaucagggggucaauaagaaaucuuagucauuuaaauacauuuuauauugcccuccugucuuagucaggguuuuuacuccugcacaaacaucaugaccaagaagcaaguuggggaggaaaggauuuauucugcuuacucuuccacauugcuguugaucaccaaaggaagucaggacuggaauucaaacaggucaagaaacaggagcugaagcagaggccauggagggauguuacuuacuggcuugcuucuccuuacuuggucagcuugcucucuuauagaacccaggacuaccagcccuugaucauuaguugagaaaaugucuuacaguuggaucucauggaggcauuuccucaagggaggcuccuuucuuugugauaacuccaacucgugucuacaaaacuaaccaguguacacaaaacuaaccaguacaccucccauuuuaauuauguuuguauguguuuuucuguguguggguuuguguaugugagugacgugccuccagaggcccggaggaagugucagaucccuugggauuguaauuacagaugccaguggguacuaagaacugaaccuggguccucugacaagagcagccagagucaucucuccagccugauaaaccauguguguagccaaguuauuuauugacuguccuuuaguaauagaauuuuaauuuuacuuaagaugguuguuaccauuauuauuguguuacuugcucaugccuucaugcuggcuucucccuucacuuguaaaauguccuuacuggaaauaggaacacagcaggacaauaaguaaugcuguguugacacuugaaaacuuaaugugcuguguuggucuguuguuuuaacucagaauucgaaggucauccuucaguucaaaagaugagaaaagagaagacagaacaccauaucaguuggucaagaaacuucagaaaaaaaucagacaauucgaggagcaauuugaaagggaaagaaauagcaagguaaguuuguagugcugccuagaacaaacuugaauucaugucuuaagagagcaugcugcaguucuuuccugaagagagcacaugugagaugcuggggaaaguggugaucacacaggccggagagccaaugggcccuuaguuguugauuucugugacagugcucuuaguacuguaccaacguguuucuguguuuccauuugcaaaguuuuuggaauuuguaaaccaaauucuuuaacaaauuaauguucuuuucugacacaaaccacacuaacaaaaggggaggaggaaaugaggacagugugugucuguaaugauuagacccuguguguaacgucucaucccagagaggaaagacccgccuucagacuuggccccuuccaguuguaugaccugcuuuagaagagcuugauaucaaauuaaaauaaagugagaauugaaugaaauuuuaugcuaugggaacuguaaacaccaugaggaauaaauuaacauaacuauugggcauuacaaaugucagugauccuauuccguaacuuugcagcccuccuacagcgacauugcagccaauccgaagguauuaaaauggaugacagagcuuacgaaauugcggaagcaaauuaaagguauaagugcauuuuguggaaaaucugcaucuuuaaaacauuuauaauucugugcaaaauauagcuauaauuuuugaguuaugguggcacacccuucuaaucccagcacuaaggaggcagaggcaggcagaucucuugaguuugaggucagucuggucuccauagagaaauccugucuuuaaaaaaaaaaaaccaagauaaauaauaauaauaacucuaucuuggaacauuuuugaaaaagauaaguuuucuuuuguucuauuaacaccaguaguguauauuaagaaauauaaauguaacuuuuauucccugagguaauugucgucgcuaaggcuuaccgccucaucuccuaaccuaggccuaguccuggaggcucuuaacuuccauacagucuuaucuaggccuagaauguuuucagccuuugacacugaauaaacucauccuuucuaguucuuuucugaacucuagcuggcugauucaacucagcuguucuggcucacacuccucuccaagcugacugauucaaucuggcuccucuuuguuucuccggaauagcucuguguggccucaucccaacuuuggcaaucuguucucaucuuuuggcuccuucucauucccugacuugcucugucuucacugugucuagcuuguucucucuguaaccugccucccuguaacuaucccaguaaaacugccccccccucucuuaaguagcugcccuuuccuucuuuccccuucccaacucuucuuauaagaguucggcauagcauagucuaucaaagcguucucuaauuugucacuuugucugucugccacuuaauuagacaucauuuucaaagaugggugauuucuucugccaacuaauuuuaccuucaucauuuggaauuaaagguacuaaggguaugucuauauuccagccagagggauuaaaguugcguggcuaagggaugagccacacaacuagaaacagggcuuuucaguaaauaccacaaucuugggguucaaagugugaucaaguaucccgugacagagauaugggaaucucugugcuguguucuucccagugucucuuuauuugcaugagugugaguuauugaaagauaaucuagauuguguucauagaugaacugauccuauauaguuaucugaaauauaguccaaauacugagaugauuuggguuuugguagguauuucauuaaggucuuuaugcaugggcagggaguaaaauuuuaucuuaagaugauauaauuaggagcuaggaggauugcucaaugguagaauauuugccugccaugugggaggcccuauguugucagaucccuuggaacuguaauugcagacaguugugagcugccgugucggugcugggaacuggaccuggguccccuagaagggcagcccgugcucuaaccauugagccgucccuccagccccugggaacucuuucuaaaccauaaaguaugcuauguguuuuuggauguuaguauaguguugcuauugugaaauucuauuuauucugaguauccuuuaauaaucacagcuacuuuuaaagacagccauuaacaguuuguaucauuuuucugauucauucuuuugagcuuuacucaguguagaaauuuugauaucuuucaaguauuaaguguucagacacuguuucucuuguggacuuugcaaucuuauuuuaaaaggauuauuucuccuuauucuauuaagcauuuccuuauuuaaaccacuuuguagcugcuguuaccauuaaauugccuagauaguguacugucccaguucucguccacucuuacugucuugcaguccgucauuugcacagccaccagaaauaucuuuaaaaaauaauuacucuuuuuaaaauccucuaagugggauuuaaaauccucuacguagaauuauuguaaaucuagacuccagacucuggcucuuaagggcuugcacagacugcccuugguagguuuuuaucauguuaaugucucuuuuuuuuuguucucagauuuggaggaauuugucuaggcuauugccucaauugggcacuagugcuuuuccccucagucuuguaugcuagguuuagcuccauguuaaccagaacacaccguucagagagacugccuuuguuaacuucaucuaguauugcuccugccccaaagcaugcucucuuuacaacucugacuccuccauuuuuauuuuauuuuauuuuauuuuauuuuuuuguuguguuugugggcagaccagaguucagugugaaucuuccucaaucaucaaaaauaaaauucaagguuuuuuuuuuuuuuuuuaagacagggucuuacuauauagcccuggcuguccuggaaguugcuguguagacaagacuggucuugaacucacagaaauuccccugccuuugccucccuagugcugggauuaagcuuugugccaccacacccugcccaugcuccgcucuuuuaugaacccggcguucacuucuuuuccaucaggguugugcuuuaccuugggcuccuugugggcauuguuugaaaggacaaguauacugcaugcuaaaugugugagccuuggguuaucaagccucucauuucugaaauuuagaugcaaaacacaaaaacucugauggagaauuugcgccucagacacguccucggaguaacacucugccaaaaaguuuuggcucuucucuagaccaugaggacggcgagagugaaggugagcccagagucauucagaaagagaagacgccaucgaaagaagcaacucuugagcugauuaccaaacgguugaaggagaaccgugccgagcggcaccuuccugaggauaucaagguaauucugagcuguaggcucugccuggggcggccuuuagaacacuggaaacaaacuggccagcauagcagggugagagcuagguauccugacucuucuacccugcagaucugcaacuccaaaauaugcuuuuaaaccuagaguacuuacuguauguuaaugcauguugcagacugucagcgagacggauguguagaguagaaaauggccaaguuugagcaauagcuguguguauugaguucuugguaucuggcauaaaccacgaggaaucugucacuugguuuuuguuuuguuuuguuuuucuccuuucccagcaauauagaugugauauuagccaauggaaaaaauacugucuugaaagacuggcauagugacacauauuuguaaugcaaauacuggagaauuggcaggagauugggaguucagcuacuuaaugagguugaauccagccugggccacgugacacccugaugaaaagaaaaagaaaaggagaaaaggguguguguauguauguggagagauggcucagaaguuaugagcacugguuacucuuccagagguccugaguucaauuucuugcccucacaugauagcucacgaccaucuauaaugggaucugaugccuuuuucugccaugcaggcauacauggaaauagagcacucauauauauauaaauaaaucuuaaaauaagaaaacaagcuuggcaauagaggugcacacuauuaauuccagcacuuggaagacagaggcagguggaucucuagggaguccaaggacaaccagaacuacauggagaaaccuuuucuucaaaaagaaaaaaagcaaacaacaaaaccaguugaucuauugguaucaggaguacaugaguuacauuuuucaggaacuguuacucuuaauguauggaguaugcacguguggguucaugcaccuccauaugcauggaggccaaagacagcugucucgugcucuguucuguuggucucugccguacuuucugaagacuucacugcaccugaaacaagccccucuauuccagaaagcccucugaggcauccgggcagagcacuugguaaccaagucaugugagagaugggguugcuggggaaaggucucagcugaaucuuagucuaggaaguggugaaccagacacauuucagaauauaucucccucccucccucaugaugucaauacuggucuguuugucucccuugaacagggcuaaguuacucauucucaucacuuuccucugcaucaucuuuuuuuuuuuuuuguccucuugcuuuuugauugcauuagcuuuauuagauuuaagguucaaacuugaaaauaaaaugacaguauuuuauaaggucugcacucuguuauugccuaguacaugaauauaaucugaaaugauuuuguuauacagggcaacucucagaugaauuguuuguaaucucuaauuuccucuagugagagacuaagaacuguuagccauucuuggaaauauguagaauuuauuuggucuaguugaaggguaucuuguggaauugguucauuaagauaauggcugagccuguggaggagaaggaaaauuuuauauacaaauauacccagggauuucuguccucucuaccauucagaguauuaaaagagaaguguguuacacuguagagaguaugcccauccaugcaaagggaaauguggucauagaggucuaagguugcaaauugacauuuugagcuuucucuuggaucuguacacuauacugcuuuggguuuccuuaguagaguagagacauggacucauaaaaucuguuugucuacugaaaugugugucugcaucuacauuauuauuauuauuauuauuauuauuauuauuauuauucuccccucacccccccccccucuagugucugccuauccauccacccacccaccuaucuaucauuuauauuuauuuguggaaccaauugaauccaggggcucuugcccaaagcuaagcacauguaccacugaauuacauuagcagucuuugauuuuuugagaaagacucauaucaugaaggccacauugacuuuaaauucaagauucuuccugcuucugccucuggaaugcugggauuauaggccucugccuagccuguauuuacuugucugucugucucuggucguccuuccccccccccuccccccgggguguguguguguguguguguaugugggcgggggauggagauauauauggguguuuaaggaguuagcucuccuuucccauuggcucugcagauugaacuuggauugugcuaaggucuuuagguuugugggucaggcacuuugaaaccugcugagucugcuagcuguccauauuugagguugucguaaggaaagacuucacaacuuuaucaaaugucgggcagguguggaagccccugugugcugcagaagcacuguuaccagggcucuuacaucagugaguacaggccuuugagcaagaguggaguacuacuuauagauuggaauauugagcacaagauggcuaaggugcccaaacuaacauucauaaaucacacaaaauauaaauuaagccauaaaaagcuauacauugacauucuaggaaguuuagauuguauagcagacugaaaaauguugcugcaaauccagaaaaaagaaugcauuugccuagucuauauugcugaccguuuacccuuucaccuaacugauuacauggcgggcgugaggagaauacuaacacgagugcuuuucccccauucuagaaaaugacaaaagaucauuugauagaagagaaaacgucucugcagaaaagucugcuuuacuaugaaagucaacacggaaggccgguaauuuuuuucuugauaagacaauuugauuucuucagaagagcaugaauaacuucuguggucuguguucuuuagcgccauuuguaucaagcguuguuuccaguaggugggagauugcauacuuaauuaaauuuggggugagggagucacacugcuuaugucucugauaacuagauuccugauaguaaggcuacucugcuucacuuuuuguuuuguuuuguuuuuuguuuuuuguuuuggcuucaggugaccagggaagaaaggcacauuguuaagccucucuaugauagauacaggcuuguaaaacagaugcugacaagagcuagcauuacuccuguccuuguaaguaaaacaaaugcuugauuuuguuuuuaaagacagggccucacuuuguagcuaaaacuggcuuggaacucacuagcccaaacaagcaaaacucguacguucuguaguuauagggaugcauuaccaugucuggaacaaguauuucuucaguucauuuugccaacguauauuuaagaaagaagacagaagaaacaacggcacauuuuaguacauuagagaccuaaguagccaaguaugagaaguuuucaguugagauuguggauuagguaacuugugagcacuuacaugcacguggcaccaagucuuuacagaccacacacgagcuaggacugaugcugagaucuaggcagugcuggaugcagauuuaccugcauagauggcagcguagcacuuguaugugauaccucaucuagucucuauuucaguucuugucugcauagauuugucaucauuaccuccgaucgcauuauagcauacaugaaucuuaaacauguauuuauuuaaagggcugugugugugccaaugguaagagcguuggaggucagagggaagaguggggggugggucaguucucuccuacuauguagguucuuggggauagaacucaagguugucaagcuuggcaacccuaaaaauugguuuuaaagaaagaacccauuaagauaacaccgauuaugaagugucugguauauaccuuuaauccuagcaccagagacagauuaucucagugaguucaaggccagcauagucuacauaagguaggggguuggggugggggggagggaggggggauggaggggagggagaggagaggaagaggagaaggagaggagagggaggacagagagaagagaggagagacugacccugucucaccuuuaauccuggcagagacagguggcucucuugaguucaaggacagccuggucuacagagugaguuucaggacagccaagacuacacagagaaacccugucucaacaaacauacaaacaaauaauaaacuaaguaaaauuaaacaguguuaauucacagggccagagagagagagagcuuagcagguaaaggagcuugcaucaaguaugaugaccucugaccuucacacacaugcuuggcacauacacaccaucuccccacccccaaccacacaccaaagaaauguaauaaaauauuuuaaauaaugcuuaccuguauuuguguacacuuaaaaaaacuuauuuuaaaguggggucuugcgguguuuguccaaggugguuucgaccugugaggucaugugauuuuccagccucagccuucugaggagcuagaccagugagcaugccaacaugaaggaaacugaaaucuguaguacucagacacacaucacagggccagcuagugaaacuuagcaugacccuguccugggauauacuuaugccgugugaugauaaccuagcaugcuaggaugaagaguacauccuaguuuuuguuugguuuaguuuuguuucuaaagaaauuuaugggguucucagaccucagaauaaagauacuugggcugggugugauagcauuugccuacaaucauagagucugagagagccgaggcaggaggaucucaugcacuagccugugcuacauagugaaacaagcccuuuuucagaggucuucaccccauugucucuacaucacaccccugauccauugaaugugaaaggugggcggcacagagugagcuccuguaagacuuugcuauguuauuaaaaaaaaaaaagauuuuauuaaggaacucaauaugaauuuaaaagacugcuuuaagguuuugaaaaauuugauauuuuuuuuauuuuuauugaaaacguuuucauacuauaucuaucuaucuauaucuauauaucuauauaucuauauaucuauauauauauauauauuguuugcuugaggcaggguuucucuguguagcccuggcuguccuggaauucacucuguagaugaagcuggugaucucagaaauucaccugccucugccucccaauugcugggacuaaaggcaugcgcaccacugccuggccauacaguauauuuugauuauauucuuccaucccccaaacuucccagaaccucccuaccuuccuaaacucucaccuuuuaaaaaagaaaaagaaaacccaaaauaguaguuggccaacacaaaacacacucaacuguuuuuuuuuuuuguuguuguuguuguuguaccuuuaguuuugcuuagguguuuaucuuacugauuuucuuuuuaguuugucuguuuugaguuuuguuugcuuguguuuuuagcugcuggggacuaagcgcccuauuagguggaaguaccauuauaugauaggaaugugaaguugcacuaauguaaaugugugggauauaaaacuggguguugcuguuguuacaggguucuccuuccacgaagcgccggggucagauguuacagccaaucauagaaggagaaacggcacacuuuuuugaagaaaucaagguacuuaauguagaaaaguuacucucuuacuacguuccuaacgggcauggaaagucauggccuguguggcucugcuugguugucauuuuaggaagaagaagaagauggugucagccucuccucugaguuaggugacaucuugagcacaagcgugcacacacagucguccuuggaaaacuuagaaucugaugcugaagaaaaucaagaaaaacuggcucgggaucucugcuuaucaaguacccgggcagcuucuguguauguacucagcuuguacuuagcuucucugacaagagggaugcgugcggauggauugaguuccguuccuuccuuuuuccccuggugcuguggauggaacccggggccuuguguaggggagacaagcacuacaucccagacuccacuuucucauuuuccaucuuaaaauuguguguguagaggucagagggcaaccuuacguguuguucuuacccucuaccuugcuuaagccgugaucuccuguguuuuuguguuguuuucaccucacauggcauugccauagagugcuggaauuagacauuuaacauguuugucauuuuauauggguuucagguguugggcuuguauaucaagcacucugacuugcuaauaagcccacauucucaguugugguuccuauuucuuuauuaaguauuucaaucaaaaguuguauucaauuuauaacaaaguuauaagaaccaacugaggauuugucuauucuuuauuggccugcuuaucuuuagauggauuuaauuauguguauguuuguguggauauuuacauguguugagggcuucuggaggucagaagacugcauugugaucccuuugauguguagucaugagcugccugacacauaggugcuggaaaccaaacucgggucuucugcaagaguaguauguguuucuaacuacugagcuauuucuccagcacccauucauuuuuacuuuuaugcguauggcugcuuugccuguauuugucuuugcacugugucugugccuggugcuccuugagggucaggccucugggacugaaguuauagagagcugugagccaccgugugggugcuagaaacugaaccaggguccuccggaagagcagccagugagugcuuucaaccacugaguuuucucuccaccucuccccgcgcagccccuucucccacccccguuuuuaagcagcaccucuuauugacaaugggggcuuguugauuacuggcuggccagagauuuuugaagaguugggauuauaggugcacaacacuguacucaagaguuuuuuggguuuuuuuuuuuuuugaguucagguuccucaggguugugcaagaaccacuuuaccaacugagcaauccuccaggcacaggaagaaguuuacauagugagacuggaaccuuaaucucaguaauuuugauuuauuuguauguuucuaaaagcuguagccagggcuacaaccacuguuaauauaaugaagaaccuguagcauuuaguaauguuuuguuacuguuuuaacucuaggccugaauuacuggaacaacuuuggaaagccagagcugagaaaaagaaacuacguaagaugcuacgggaguuugaagaagcguucuaucaacaaaauggaagguuuguuaagcauuggcgauacugacaucuuuguccuucaacucaugagauguauguuaauauaguggaguacacagaaacacucuuagaaguguagguguguggcuccuauagaccagugugcuaugugucuuuaacuggugugcagaguugacaguuggggagagguacagauugguacaucccuaugaacagccaguccaacuaaaaacaagcagcuugaggcuccucagugaaaaaugauagagaauaccaaaugucuuccuguggcuucugcaggugcagguaccugugcacacacacuuaauuuaccucaauucugccacuaccucuguuuaagucucaaaguuuucugaguaacuagaugacccuacaaaaccaggggcuauaacaaauuaucuccuggccccugcugcuuuuuuagaguuucacacuuacaugauuuaaaaaaaaaauaccagggaaauggcuuagucagugaguaccugcuggguacuaagauguggaucuaaguucgguccucagagccaaagcaagauguggugguauccaaguuguguaucacucggcuuaagagccagcuagcuuagcagcuacuccguaagcuucagggaacccugccucaaaaaguggacaagacacccaagguuuaccucuggcuuucuguuugucuuuuuuguuguuguuuugagacaggguuucucuguguagcccuggcuguccuggaacucacucucuagaccaggcuggccucgaacucagaaauccgccugccucugccucccgagugcugggacuaaaggcgugcgccaccacugccuggcuggcuuucucuuaagcauguauauguguauagcauguguacucaugaaaagguguaagaagauaugacuauaaaauauaaaggcaugacucaugguaauguucuagcacuuacaagucaucccgcuuacugguaaguauguaccguuauuuaagcaguuaguagacauagcuacuaauguucuuccugugugacuuaguccaauagccucuugcccacagagcagcuuugaauuucagcuuaaauuuguaacauuauacuccauagugaagaacacacuuugaguguuuuacagaguuuuaucuucccuaggaaugcccagaaggaggaucguguuccggugcuugaggaauauaaggaauacaagagaaucaaagccaagcuuagacuucuugaaguucuuaucagcaaacaagacucuucaaaauccauauaaaauauguuccuugaaaguugacgccauaaagugcuuguguucccugacaguucaccaugugugcuuggcuguacuugcguucacuuugucaggcacucagagagucccauugugugcuuguuugugguuccaguaggcaaggaaagcuguuccacauucccgcagauccucuccacacuuaggaaacacgcaggcuccuucauuguuuuacugcagacacggcuguuagcaaaggacaagaguuuuacucuuuuacuucaagaacuuugaaauaaaaagcucuucuguuuacuuuuuguuuuuucuuuugcauuacugaagaaaauugagaggaaaaaaucuucauacugaaugaaauucuucgguugccuuuucuuauaaaaugacugaaaauguaaaagaauagccuauaagugugacauauggaacgguauuguuuuuuucuagaaaaccaaacuggauuuucaaauccuacauuggaacaccuuucugugucguucccaaagugacaccugcacagauagcacuuagccaggauuugcaauucaguggucacaacuccugaacggagagaagcucgaguagaccacaaagcaaccuugcuuagucauugcaacauuacacacaucacucacagagcugaaucacaucacaugcugccuacaggacuucaguuacugucaccagcuggcaaugcugacuugucuggaucaaucccugugcuguccccaacccaccuccagauaaugugagaaaauagccaugccaguguggagggacuuggguggugcucagaucugugugucaucagaugggccucaaaagaaugagcacaccucaguguguucuccaagggcuagaccacugcagcuuuccagguuuauucagggggcuucaucuccagaugaccaccgcucgcucgcccgcccaguugcuugcuguucagagcagccgcucacaggauguguagugguaugcuucuugucguagacucuuagcaucuuuuuuucguuuggcuuugcauggcuuuucagauaaucugcuaaucauuucuuacgggauaguaacuuguguuaauaugacagaugugggucaggcuucaucuaaguggguugucccucauaccccacccccaccccggugcuuauuugaauugauaaaugucucacuuugcccaugcuuugcauguaaugacucaugcaugauuuucuucuuaauaguuuguuucauacaaauaaauggaauuucacaacaucuuuaauaaggugaggaaagcaugaaccuugaacgcugccacuauuauuacccaguaagagcaggaaguaguuugauaaggaauagugugucuacguacuucacauuucacuugugugugcaaugccuuucugggggagagggaaaauccagcaguagugaguguguaguuggaggguuuuuuuuuguuaaguacugaaucacccagccuuguuugugugguuuccuuuugauaauacuaggucauucauaauguauuuuuagaaaaguaauuaagaaugccaaaaaaacccuguaucauuugauuugaacccaucaugugguguacuuuuuaguuuuuuuucccagacaggauugcuacauguaauuuuaugugcacuguauauuuuuaugaauguuuuauuuuguauaccacaugcaaaaauguucaugugcacuauuuaaauguuuuaaauaauauauuccuucuguauaacgcuaaaucuauuugaguacaauauuuuuauaagucuguagccugacugguuucguugaguuacagcugcuucauaauuuggucguugaguuguuaguuugggcugaauagaguagugaaguggcucgcacgcuuccaugggcuugcacugaacucaugguuagcaguggggauaguuaggcagcuugcaagagguuuacuuugguacaaauaaaaauuauaucuauauauaaauacuauauagauauagauauauauguguccaccuuauaauuacauugcuguguuuguuuggcacuucauuguacagacuuuuauaauaaaagaacuuuacuguucuaag

SEQ ID NO: 8863 - RNA, 27278 nt, Mus musculus
ucuccuuauuuuugccccaaccuugguaagcucauaucagcuuuuuuaccaccugaaaaucuauccuuuaauguauuauauccacaaacaauuccaucuuaaaaaauguuguugagauauggucucaaccaugcaacccuagcuagucugaaacuucccugggccaggaugccuugccuauagacucacuugccguugccucugcagugcuaggauuaaagccugaggcaccgcgcuuagcaguuuuccaaauuccagugccuugguauuuguaacacaugucaguuugugaacugcuuugagucuuaauucuuggacugacugaauucucuaucaccacaaagacuaacuucucccuuagcuuaacaaauuuuacauuuucaaacagggucuuguguaucuuguggucuauuaucuugcuauguaggcaacuaaauccuuuugaccugauccaccaucuaccugcugagugccaggauuacaggcuugugucacaaugguaaaugaagggcuagggauaaaauccaaggcuuccuccacaaacucuaagacacuucccaagccucaaauuuuaucagccauauccuuuuguuuaguuuuuuucuuuuuuuuuuuaaugacagggucucacuagguagaccaggcuggccuggaacucacaagagauuacuugccuguggaauccugaaauuaaagguguacaauaccacaccgggauuuaaggaucuucuuaaaccuuuuuccucaagauagaauaaagaacuaaagaaugccccacuauucgucuuauuuuauuuauuuauuuauuuauuuauuuauucauucauucauucacucauuuauugguuuuucgagacaggguuucucuguauagcucuggcuguccuggaacucacuucguagaccaggcuggccucgaacucagaaaucugccugccucugccucuugagugcugggauucaaggcgugcgccaccucgcccagcuuauuugcuuuauuuuuaaaaagggucauacuaguucauuucacugcugaaucaaauuuuuauuuaguaacagaaguuagaacugaggacauauuaacacauuacauuugugugcacacauacauguacauauauaugagaaugcacaugccacaaugcguggaggucagaacacaccuugcaggagucaguucuuuccucccaccacguggguuucagagaucagacucagauggucaggcauguuagcaggcgucugaacccacugagaacuccaugcaggccccacuaauagauuguuuugagacaaugucucccucuguagcccaggcuagcuucaaacugucaguuauccucuugccucgguuuucaguguuggaauuacugguauguguuuccaugggauuucuuucucccagcacuggcaauugacaaggaaacuagccaaaagcuguaccauuauucuaccaaaaacauucccagccccaaacaucacaacccucaaagaguaaccuuuacacaaauguaauaguaaauuuuguuuguuuuuuuuuuuaagcacucuuggccuagcgugcuacacacaccuguaaaaccaagcuacugggaaaguucaaauugaaagauuuugagcuguaggcuagcauuaucaaaaaagggagacuccaccucaaaauaaccaaacuaacacuguacacuaguucuaccuauagagagguugacagcaucggcaaggacugaccugucugcuacauuugcccguggucuaaucccuaagaaauauaaccagaucuuaaaacccuuaguauuucccaaacauucaagaaaugcccaguaaaauagucaaauuguccuuuuuacacaaucaaguccuuuaaaaacacuaauuacuacuuuggucuugguuacuuaccuccucucagucauagcaggcagucuaugggacuacucagcucuaaccauuguaucccauacacacucaguuaucaugguaaagaaaacacaucucggggcuggugagauggcucaguggguaagagcacccgacuguucuuccgaagguccaggguucauaucccagcaaccacaugguggcucacaaccauccguaacaagaucugacucccucuucuggugugucugaagauagcuacaguguacuuacuauaauaauaaauaaagucuuuaaaaaaaaaaaaaaaaaaaaaaaagaaaacacaucucaaacacaaaggacacaccaaaggccagaguuuuccuucugauuguuauauauacacacuucacagguuuauuauuauuauuauuuaaaaaaucuguacacuucacaagacaguacaaauuagcuacaaucugcuaguuacacauuagggcauuaacagagcccaugauuucugcccuaaaacaggcaucugugcuacuccaacucucugaaaagagauuuucucaacucaugucauuuggcccaggcaccuccucuucuguaauuccacuucuggacucccugcuucucagccuuuugacuaagaucaaguguggaacugagcccacaagcccaagcuaaaguaucuugcuuauuucuauuucaggcucagcucaaagagggcauucacuucuucaucuucauaucugcuucaauggcacagcggcguccccugguucccccauccuagacaacaucaaagaaaggaagaacacaugagugaguugcuuacaugguaagagaugagguacagcaggaaugcugggaacuugauuucuuggggcaaagaaucugcagagaauaccggagggaugagguggaagggauuuccuguucucccacagaguagcuaaaagaagaccugguauuuugugagugauacuguaagacaguguugucuucauguccucaaaauccaccuggugccccacagaaugacuaccagucaucccacccgggcgggcucaauugugugaaaagaaauaguagagaaaaugaaaggugggauaggcagaaagggcaguggauagugaggugcuuggcuaacauaccuguccaguuguuggucccuauaagaaaggccuuuccugcagacugacccuggcacuaguucccuagcaccuccugacaguuguuuuccaugacaucaggacaaucaggcuucauuccaucugcugcucucucccuguagcccagauccuuccucuugugcaaaacucugcugucuucgauagauacaagauccuauuaaccagccuugcaauagccagccacucgaaugaggauccagucacuguugcaggccaauaagaaagaacagagaucacgguguucuucugcccgugguacagcucuacaggcaagaugaacuagugaacacuuuugcuggaccagaccaguuuugcauuucuaauaugcaaggauuaaaaaauuuuagaacacaaguugccaauagccaacaguaagaauagaaauaacaccuugcauuuguguaagauuuuaauuuguuuucaaguuaguuucauaacuuauuuuacccucacaacaucccugugagguaggcuggacagguaucucaaucuuacucuuuuuuuuucaauuauucuuuuuuuuuguuuuaaagacuuguuuucauuuuauauguacgaauguuuggccuacauguguauaugugcaccacaaguguacagugccugugagggccagaaaagggccuuggauuccuuaaaacuggaauuacaggcaguuguaagccaccaggugguuguuggaaacccaacccagaucuucucagagcagcaagcguucuuaacugcugggucaccucucuaguauucccacauguuuucuuuugagacaaggucuuacucuguguacuacguaugcauugauucugcaggcaauucuccugccuuucaacucauaguuacuucuaucacauagauggaaaauuaaggcucucaaagguuauccagugaucguagaaccauaguuuuugagcaaggucuuucccucacuucauugcucuaccaugaacaaggucagucuuuuaacucauggaauaaacaaacaaaagccuuggggcuagaucuauuguguuuaucuauaauccauaagcuauuauuguaucugguggucacuauuauuguauguggcauauguaugggagcacacaugccauggugcacauguggaguucagaggacaccucuguggagcauucuucuucuaccuucagugggguacugggaaucaaacucaggucagcagacuaccauggcaagugccuguacccacuguaucaucucaccugcccuugcugcucugagcugucuuccauuguaaguuaagaauugguaaaaaguggaagcaagaaaugaggagcaggugcauccuaggucuuuaccccaagaauauuucauaguccaauccagugaucuugaaaguugccccucccaaccccgccacacucacacaagcaaagagaccagaaugcagaagacaaagaguuuccuauucaauggauaaaaaaagaacuucaagacauugccacagucugcauguuggauuucccucugucacccaggcccagcaggagcugagaaucuuucuggcaacaucaccacuugcagccauucaauacuuacaaagagagagagaaggaaggcaggagagcccauggggacacuguccuguuagaggacaaacaaauacugaucagguuccacagaaacucucagccacaaguaucccaaaccucaggacagagacaaaagcaccauacacacaaaacaaagacaaaauuuuaaaacucaagaacaagaggaaagagaucccacagccaucuagccguaucuagcagccaacugcugugaacuaaucuauccccaaccccgacagcacucucccggaggguuaauaauucacucacugggcucuaacuaucucccauggaacugguacuuucagucacagcagcuuucuucaacaguuagacagaagcaagccaucgccauucuaacauccaugcagauaccacuggcuuacagaagguuagcaguauuagaguaacuuaagguucucuggauguuuugaacuuuauuuuggucugcucaccuucucugaagcaucuuguuuucggguagagucucucccccggagacuuuuagcacugauuccagacucagauguuugcauaaucaacuguguggccaagaauugcuguagggagaagaaaaacgggaggccauaaagauccaauccaguaggaaagaacuaacauacuucacauuuuauaaacagaacuuauucaauucuuuuuggcuuacuaaaaggcuaauuucuagcuauuccuaaagaacuuagaagugaaaagaagcuuuaaaauaagccaaagagccuucagcaauuaaagucacauggcaaacuuaacaaagauacacuacugcuuccagaucaacaucacaaagggugugcaguguuauaacuguaagauugaaguagacuacuugugauaacuagggguuauaaagucuugguugaauacaugugccacaguauuuuauguaacuaauaacacuagcccuuuauacauugaucugaaaacuuccaauggggcuagggauacaguuuagauggacagugcugguccagcagacaugaagcccugggcuugacucuaacgucguccgucagcuggguguguggagggugugacguagcucacaggcaccagauuugugaccugugaagcacugguuuauuagauucuugccaacaagaacaacagcaacaacaaaaaccuucaaaaacggaauucauuugcccaagaaaaauacaauuuuuuaaaagacguuuauuuuauguauaucuucaggcacaccauaagagggcaucagaucucauuacagauaguugugaaucaccaugugguugcugggaauugaaaucaggacauguguaauagcagucagugcucuuaaccacugagccaucucuccagcccaaaaagauagaauuuguaucauaauucuuccaucaaaccaaucaaaucuauaaaacuucaguaagaaauaaaaauauuuaccaaugaacucaucaauucuucucugcauuucaucccuacugaaacaaaaaugagcaucaauguaccuggaucuguuccaagacaucucucugcaucucuacugccaugugauagacaucauggucugagcuauuguacauaacagcauucugaaacaucagcaugaugucacgcugaaacucagcugugcuucggaucaguccauuuucaauguuuuucuuuauaguugacaaauccauaggccuaaauaaauaaauaaauaauaaagggguaaguggccacggaggaggauucacuuggauucccaagcacaguauuacuauacaguccuguucauagauaccuucaguaucagcuaccaagauuuaaaagcuaacccauuaucccagagcuuauacucaacuccccaaaaagccaaucugcauaauaggcaucaagaaaaacaaugauaggugcucauucuuuuacacuauuaaugacaacacagucacugcaauauaagccuuuaacaaucacagcacugggccgguggugguggcgcacgcuuuuaaucccagcacuugggaggcagaggcaggcagauuucugaguuugaggccagccuggucaacaaagugaguuccaggacagccagagcuacacagagaaacccugucucggaaaaacaaaacaaaacaaaacaaaaacaaacaaacaaaaaccaaaacaacaaucucagcacuggggaggcagaagcagaaauuacucacuuucugugaguuugaggcuagcuuggucuauagagaguuccaggucaaccagggcuauauauaaugaaacccugucucaaaacaaaacaccaccaccaacaacaaaaaaagcaaaacaaaaaacccacccuugcuuuaaauaaggcaaaaauucacuuaaaucaacacaaauuuuaagucaggugugauaguugaaugauggcuuaccucuguacaaugcuaugguaaccaggagcuaugucaucuguaacagguugcaggaacacauuggcauaccuguccaaaaagaauagguuuauuauuuauuccccagaagcaaaaggagagaauuuucuucacguaguagaagguacuaagaaucaacauuaacauaagcugucucacagcuuacucgaauaauuuccuaagccuacagugaggagcugguaauaccuacucaccuaugauuugcugcagcccuccauacaagcaugauggcuuucuuccauauuuucugagccugaauugcuucuugaucuucacugcacacggaacugaaauagauacaagagugcuacuaagugggggcuggugagauggcucugcgguuaagagcacugacugcucuuccaaaggucccaaguucaaaucccagcaaccacaugauggcucacaaccauccguaacgagauuugacgcccucuucuagugugucugaagacaacuacaguguacuuacauauaauagaucuuaaaaaaaaaaaaaaaaguacuacuaagcauaaggaaaaaaaaaauccuguuucucuucaacuauuuguuucaagccaagaaagggaaggcaaauacaauguggcucuauaguagaaugcuagccuaccacucaaaaaguccuggguucagucaguguauguacacacacacacacacacacacacacacacacacacacacacacacggugggguguagggguaugucuguaauucaagaucauccaaaauuacauagucugaguugaccaccagccuggaguacaugagcccaccuaaaaaugagaaggaaaaaaaaaaaaaaaaaggaggaggaaucacagauacucacaacugggaggaggcagggcugcuugggauggagucugccagagugugugacugcaguguggcguuauguauacuaaagccaucaucacucucacucacagggggcucauuauccaucucagacaaauagccuucuccuugauccucuuccuuaggcuccucuaggcuagcugcuucacugacuccaucuucuuccucaucgucaccuggggcauccuuagauacagugugcaucagucagcaaaugcaagcaaagcuaccuaguaaggcauuacuaaaugacaucuguuugggguuagaucagcccuagaaaccgccucacacugauguuuggcugagcccucuaucacuuauacuucccucuacuuuacugacuaagacauaacuuagaaccuggacaaagaauaaagcccaggaucuuuuugaaaggaaggaaaaaaaaaaaagcuacuuacuuaagacuaagcuaagaggcguuccuucuuuccccuugcucuugaaaggaacucugacccuggauacaaaguuaccaaaaauaguuuuauuucaugucuuugcuaauggagcaagcucaccucacauuauuuuaaaucccuguuacuacuacuuuuguaauucuaaauaacaccagauaauucucuuuugauagucuaaacuguaaccugacuccucugugaucuuccaaguuacucugaauggaugcaagcuucuuuguccauuacagacagaaggacugcgugaucuucacaacucucccaggggaagcacauacugcuuuguacucccacuaggucagaauguccacuacagcuuucccucaccuagcuccuuacugcuuuacaagacaaagauaggaauuuaggaauuuacuaaaauucauuguuaaaggaaguacugugggaaaaucugaucacauggcaagaagaauaaagaaaagucugaaauaccuuuaucuggcuuccaaaaauagucccugauucuucuuucaaugagucugcagaggagagagagacugccugaagauugugcaccucagccuuccccuuccuacggagcacgacucuucccugcagcuagcuagcucuccuuucuuuucaggcuggccuguccuaccuccucuacuugcccacaacccacaaucccugagaagucagucaagaauucaaauuagauacaguucaaacguccuguccguuauuuaccugacauuucaaacuuguguugagucucugccucuaaaggaucuucaauaagauuugagccaugugauggagacaacaugcucucaggggaugccugaagaccaaaaaagagucagugcccuaguuacugacaaacuguucuagcucccacaauucuauucuccagugucaaugagaccauagaagaaaccccgaugguuacucgauucauguuuuaaugcucacugcagaaggacagauagcaguggucacagccuguggcuuuggauaugugcaacaagucagaacucaggaauucacgcaccugagcucuucucgccuaagucccagcccuccuccuuccgagcccaacuguguucaauaccucugucuucacagcugaaaguggccucucaucgccuuucccacuggaaccaucugccucaccaaugucuccagcugcagaacuucuagguucuucaucugagucuugacuccugaguucugguggcuccauacuuggaacuggaccaacuccagcuacuaucucagccccagacaugccuggcucuggcucuguggguuccaccuuaaucucaacaccggaaucccugauguccaccaggucauggagcccuuuguuuucugauuccucgaagucuagccucucuuguuugacugucaucucuggugcuggcagagguacuggcuugucgcgcuccugcuggauagggugcucccaggggccaggcagggacugagggucaucauucucuucacagaacgauaacgccgcuucuaccgcugccacauccagcacuucagggugaucauccaccugucccacaacacacaaacuguugagcacacagggaaagcccaggucccucagguuaccaguucagaguuagaugcuacagcugcucgcuauuaccauuuagugggaaccacaagugcagacacuugugcuaugcagacaaguaagagagaugaaaaggaagaucaguuuagcagaguacaaagcugaaaacgggcaaaaguagaauuaaauaagucuaagucagagacaggaaaaaggguguaagccuaggagacuuuuuaggauuuugcuacacaguuaccuuguccucaaugauggcaaugaugucuccaacuguuucaaaguccaacucuucaccuguguaagacacagcaauauccaucuucuccgcuagauccaagucuuccuucccaucuaugcuuggagccuuugauccaccaggagccucugcuaccccugagcggaaacacucuucuuugauggaauuaaugaucauggagauuucauugcuauccauggaaacagucacaguauguggaucccccacagcuuccagggguacacagggcucaggcuggcucacugaugaacaaaaagaaaaagcaacucagaagcuuauccaguauuaagugaccacccugagaucacaccagaacuguagacacuuaaggucaaaaacuuauugcugaccaugcuuucuucucccucguuuuauuuauaaaguaaagugagaauacagucucaagccugcuuauguuauugcacuuaacuugccccacccaacucacaaacacacacccacuuccauccuuguaguccuaaggguaaagaugguccaagucuauggagaacagaagucucuaggugggagaucauggucuuggccacccuucucuaucuaagguuugguccuguggcgcucagggcgugggucagggacgcaccuggagcuccacuuucagaaguggagacagccgcagcagaggauggugcuggcagcgcgggcaucaugacaaugguagccugggacacagacucuacaggggguggcacaagcuuaacuggcggcucacuggcaacaguagugaaggaaggaagaggaguggugaacugugugggcccagcuucuaaaagccgggaaagagugggagcaccugacaaagaaguacacaaagugagggaagacagcacacgaaugaacaagaggcuacagccacgcuaggacuuaagacuauguuacaguuucaaagaacaaaagugaguucuguguugaauaagcuaccaccuacaccccuccuuucuuuaaccucaccuaagaucuuccagauaggaacaaccuaaguaccagauuauacacuguauauauuaaaacuggguggucauuuccucugaagaaaaauaagcagucauugacaauaaaaaugacugcuaugacaggcaagaggcuaaggaaggaguagaguucaauggcuacagagcaaaauccugggcagcucgagguguacaucaagacccuguuccaaaaaccaaaaccaaaaccaaaaccaaaaccaaccaaccaaccaaacaaacaaacaaaaaaaaagaaaagaaaaaagaaaaagggaggaaaaaccccuucuacuucugagauuuaguacacguguaccacccaaguucaaaauauuaaucaaauaccaaucucuaauauuuauaugguauuacuauuuuugcucuacauuuuguuauuuaauuuuuagcacaucccugugaaguauauauuaauaaaaaaggaaacuaaggcucaauaguuaagaugccucuccaagguaacaaaaccaauaaauguuguugaucugagguucaaacuagguuuuugguucuaaaucucuuacccuuacuuuauaaucaccagggucucuagcaucuuuccauaaaucugcaagcacuaauauauugcaaacauuaauaaaauaggaaacagucucaauaguuaccuauucaaagucacaagaucaaauaguaugcaagacaugagauucaagcccaaaucuccaguuguaaauuucuuuuccuauuuccuagucucauggcucucuggcaucuuuucacauuuuacaagacagagaaauaccuucacuacuaacuuuacuguuucuuugaucauuaucuacacugcgguaaauuagagcuaucaguauuuuacauaugcaauggaucaauaaucucaaacaggacauuguuuaauagaaaacuaucuccaaagcaaagucuaaaaacuguaauugggccugaaauacaagaugacuauauucuuucuaauaaacaugaaagggacgaccagcaacuuaccugaggcagccggggaggccgccacagcacugguuguuggcuguaucuccccaccauguaucaugggaagaaccccuccuaccuccaagagaaccccugugcuguucagauggccaggggguacaggcauuucacucucauucaccuacggggaagaacagaggugaaggcuauucucaagcucuuuaacuaccacuuucccccaaaacaaaaccacacuccaguagucaacaaaacuucuugaaacuaaaaccuaguauccacagaaaauaauucaagauagaagggaaauucuaaacuacaauauucggaacuuaagugucaagaguucucuaggggaagaaaaccacaauaacuaucguucagacaccuuaggauccaaggauccuaauguauuguuuuuuuuuuaaguuaaccuuuaacuaggacauuuuuucccuguuuuuuuuuuuucuuucauuuuuuuccuuccuuccuuccuuucuuucuuucuuuuuuuuuugguugcuggcuuuuuuucccccaagucuuauuuuagggcccaggcauucccuuccaaguacuaaaucaccacagcucucaaacacccacagaagucuccauaccagucuggggcuaguaggcaggaggcugcccuucuucaagagcucugacagcagaggggagggggguggaguugcuuucuguccaagcaucuuuuucuggggugaaucaucuguuauuggggucaugggggcuucuaagggugcagagccuggaggaagggugucaggaaucccaggaaacgaggugacugggguacucggcaaagucccagggguuaccuaagagacaacagagaaccuuuaucugacuuuucaaacuauggaagguucccuccuaaucuggauggguuagugugucuauuauuuuauuaguucugaauggaaauaaccagaagccaucuacacuuccuucccauaguauuuucucuuccacucacucuaacccacaacccaaucauucuguccaagcugcuauuuucuaacuccuuaaacacuaugacuauuauauuuauaaagaaauggucucuuucuucagcaguaauuuuauaagacuaaauacauugacaaauaauucacacagucuuuuaccuaucccucaacaagucagaauccucaacacuuuuugguccauccuuacagcagaagaguguguaagaaacugagucuucagugcuuagaccaagaguugcuucuaggcaaaaagugugguuuccuauuauucagcucucugcuggcuuauugucccuuugcaaaucaauuucgauaaauacagauacacguaccccagagguagccucuuccauagugguuggagucaagucuccaaguggguaaucaccuccuggggaggcagagucuacaggagagcggaccaucacagucgguaaccuucgaggaggcguuuucacugcuugucgcgcuacaacagaagcaacagacgaaaucuucaggguuaaauaagugaaaccagccacuguuauacccugaagcagagauuagaaauuuuauuauuacuuuuuaguuuaguuuuucaaacucagggcgauucucacauuaaacaaauuaacuacuuaacuacuucaaagguccuugcuguagcacaugguuuacaucucaacaucuucugcagcaacuuaagaaucugcuuuuagaaagaggagaaggccucacugauucucaccauguagucugucuuacaguugcuaacacccauguuucccuccuaccucaccacccaagaugaacucuugaucauuugcaauuaacucuucaucccauccuccuuuggauuccaauuccaaacucugggauuauaggaagggguggguguggguguggguggugucucucacaauguaguccuagcuggccugaaacccacuaugcaaacuugacugacucacagagaucuuccugccucagccuuccgaacgcuagcaauaacgacguacaccuccgcacuuggcucacuucacggcugaccuuuuuuauuggccucugagcucuagagccuuaauuaagguuaauaagaugguucuugcugugaugaucuaaggucaauuucugggacccaucuggugagaggagagaauggacuuucacagcuuguucuuuggucuauacagacccaccacgugacacguaucugugccuccacuuccaaacaaacaaauguaaaaaaaaaaaaaaaaaauugaaggaaaaaaaaaaccuggguggugguggggcacaccuuuaaucccagcacaagaaaugcagaggcucauuugaguuggagaucagccuggucuacaaagugacugccagggcuacacagagaaacccuaucuuggggguaggggugggaguacucaaaaauaaauauaugaagagaauaaaaauaaauaaauaaaaccuuaaauuauguucagucugccauuaucaagcuugugaguccuacaaguaaauuggagaccuagggaguacgaaagaccucauuuuucgaaguauuucuucuugaacauaaaggaugguuuauucuguuagaaaaagagauaacaggaaugauucuuucucuguaguuguuuguuaugcuagagacuaagacucaugcaugcuaagcaaggguuuacccagacaccuuauuuuaugagacugcuaugcauacgcacacaauaaaucuuuacauuuuuccuguucacugccaguuugcuccagagauucaaaaucacucaaacuuuagagagaagaggaaaaguuguaacugccuugccuuacaguuuagcagaucagucaggagccuaagacacugggcuugauccauggucuacgacugggaaaucaugggacaugacaaaaauuaguaaaugggaaauacaaaagaugaaagaacucugauagggguaggcgccgauccuugugaaagcuuguuuauuuauugcuaccuggaggccuaauuuuagcaggcauguacaaggcccucagcucaauccuuagcagaaaaacaaaaagaauaauguuuugaggggaaaaaaagaaggggaggaacaugauaaacgcugcaagucaacaaaaccaguggacuguacauuagaaaacaagugacagcuaacucuccauagagcaguggucaucacacuccucuaacgcugucauuagcacacagaaccacauggucaaugcuaacagaagcacuaaacucagcucacccugguacgcagcaucgguggccuuccuuuuuacuucagccucuuccucuuccaauuucuuuuuccuaaaaaaggaaaagaauugagcuacaucagccagcucgagcuccucuccauaguucacaacacacucauaaaaaaguauucugacacacuggcagagcacaaauggaaccuacauugcaaugucauugcagagcucauccagucugcuguccaugugcccggcuuggauuaguucugcaucucuuuucagacgccuauagaaacaaagaggcagacaucaguccucuucacaguaaguuucuggguuauugagacagggcccuccucuaguugggcucaaacuuaaugaaaauuuucuguuuuggucugccaaauguugggauuacaggcaugagcuaccauacucuuuuuuuuuguuuguuuguuuuucaagacaggguucucuguguagcccuggguguccuggaacucacuguguagaccaggccucgaacucagaaauccaccugccucugccccccaagugcugggauuaaaggugugcgccaccacacccagcgcuaccauaaucuuuuauuacuuuauuaguguguguguguguguguguguguguguguguguguguguguacaaguacagguggacacauuucacagcacaugaggucacaggccaucuccuaccaccugggucccuuccaucucugccacugaguugucuaaucaccaccuacuauaaaccacauuuagagcuuuuuacuuguggucucaaguuaccguuucauuucaaacuccugaguagcugcuguagacauaccaugcaugcauccagcauuuuaacuacauuccccaccuucccuccuucccucccuucuuuccuuuccucccucccucccucucuucuccuccuccccuucuuuguuuuuuuuuaggauuuauuuauuauauguaaguacacuguagcugucuucagacaccccagaagagauucaguuaucauuacagaugguugugagccaccaugugguugcugggauuugaacucagggccuuuggaagagcaguuggugcucuuaaccacugagccaucucuccagcccucuuuuuuguauuuuaaaaacaaguuucucuguguagcccugacuguccuagaacucacugaggaccaggcuaguuuugaacuuaagagaucugccugccucugccuccuaggugcuaggauuaaaaggguuaaaagggccaccagagggugauggacucuagcuuaguuuacagacagaguucaggccagcccaggacuauacagugagacccugucacucauaaacaccaacuuaaucuuguauguaccagaagucagcuuuuuaugucuguccaaugccccucccaaaucaccugauaacuaccuguaucucuccugugucuccuuuaugacuuucuucaguucuucaacucucucagcagucaguuugcgaacaauaacaucuucaacaguuucuaccacuucuccuuuuucaccccguuuccgucuguggaaaacaaaaaauaaauccaaauuuaaguaagaggacauuuguuuccacuuguauucuuugagccuuucuaccauguaaucauaacaucugcuauacuuuucucacccaguaagauauauuuccacagugaacccuuccugaccaaacagauguaccuggguuuauacucacuuuggagucucaguagucucuaagagcucagaauacugagaagcacaaugcuauaaaagaaagaaagaaagaaaaaugugauaagcaagcucggaaacaaacuuucagaguuucaacaaagaguaauaagucucagugaggauaucuauucacgauugugucguuagcuggccguggugggaagcagaggcaaaggaucucugaguuuaagguuggccuggucuacauagugaguucuaugaccaccagagauacauagugaaacccuaccuaccucuaaagagacucacugugugucuagggcugggaagguggcuuaguggguaaauaaccugaacucaauucccagaacccaggaugaaacugauugcugagaguuagccucugacuuccauacacguacacacaagcacuacuacuauuuuuuuuuuuuuaaauggcgcugggcagugguggcacaugccuuuaaucucaguacuugggaggcagaggcaggcagauuucugaguuugaggccagccuggucuacagagugaguuccaggacagccagggcuacacagagaaacccugucucgaaaaaccaaaaaaaaaaaaaaaaaaaaaaaggcauuuucuuuuguuucuaauuuuggaaaaauuuuaaaauauuuuauuuuuauuaaauuaaaauuuuauuuuuauuauauuuaaaauauuaagauacuuuuacuuaaaaucuuauuuuuuauuuauaucuguguauguaugccugcaugaauuuaugugugcuauuugccuuaagaugcccucagagaccagagaagguacuggauucccagaaacuaguuauuuaaaagccaccagaugcaggugcuaggaaccaaauccgaguccuuugcaagaguauuaaguguucuuaaccacuaagccuucucuccaguccuuuuucacuuuuaaaaaaauuaauuaaaauguuaaagaauauuuuaugugcauucauauuuugccugcauguguaagagugucagacucccuagaacugggggugcagacagcugugaacugcuaugugggugcugagaucugaacuuggguccucugaaaggcagucagugcucuuauucugagccaucucccuagcuccuacuguguucacauguucgcacacaugcauuaguaugguacuugugugugcacaugcauguggacacccaagaugaaaucugggagucuuccucaaucaguuuuuaacuuauucuuugaaauagggucucauaaagaaacuggagcuuauugucuugacuagucuagaaaggcagcuugcuccaaggauuacuuacugccucuguuccagcuaguguaauaacuggcaggcugccacggcuucuugguauguuaaguggguuuaaggauccgaacuccagucucugugcuugugcagccaaaacuuuacccacugagccacacccaaggccaugguuucuuuugguuuucuuuuuuguuuuaaagguuuauuuauuuaauauaauuaauauauauacauaacauuguagcuaucuuuagacacaccagaagagggcaucagaucccauuagagauaguugugagccaccaugugguugcugggauuugaacucaggaccucuggaagggcagcggugcucuuaaccaccgagccuccaggcuuuguuauguagccccgguuggcuugcaacucugcauguaaaccaggcuggucucacacaugcuaacaugcuccuaccuaucucccaacugcuagaauuacaggcaugcaccagcacaaccagccuauagcauucuaaguuauuuucccccuucaugauacugaaaaccuuguagacaacaagacaaaaccugguaaagaaucaauuucauauuccaacgagcauaaaagaaaaucugauugauaacuuacuuuuugagagaaccagucuggaggccggccagguucugcaaagggcuugauugcucugcuaacugauacccuacaaaaugagaaaagccuugagguacacugagcucaaaguuuagagaucacauagaauaaagaauuacaacuaaaguauuagaaugccuuuccuuuauuauuaacucuaucuaccuacuuuucagugcugagaauaaaaaccugagguucacaaacauguuagguaagugcucccccacagccauaccucuaguucuggaauaccugaugauggaaaacgacgcaacuauuuacaaagcaacucgggcuggugaaauggcccaguagguaaaggaaaggcacuugcugccaagccugacccugccuccacccccagaaccuacaaucuacuauaucuacuauagcuacaggguagaaggaucaccucuuacuaacuguucuccaacucccacaccaccacagugguuugcauauaccuauauacacacacauaugcacaauaaauaaaaaugcaaugauagaaucuuuaaaugaauccagggccucacauaggcaaauacuauaugacaaaacuauaguauauggcagccuggauuaaguuuugaaauuggcucuauggccuuugagaaaccaguucauauauuuaauauagcuuucuuuuaggacugguuuuugagaagccuacacccugcucucauuuccuucugaguagucccuuucucucuuaagccucauuaugagacuuuaaaacacuuuuuuuuuuguuuguuuuuuuguuuuuguuuuucgggacaggguuucucugcguagcccuggcuguccuggagcucacucuguagaccaggcuggccucgaacucagaaauccgccugcuucugccucucaagugcugggauuaaaggugugcaccacuacugcccggugugaugccuucuuuuugauuuguuaaauaucaacuauauuugggagggauaaaaaaaacacacacaccagauuugauuguuuuuaaaagcagaaauaucucuagaaaauuguuugaaaaauuuaacaguugggcagguaugaagauguauaccuguaaucccagcaccuuggaugcagaaacaggaagauuacucaaggccagucuaguuuaccaggcaaguucuaggucagucagagcaauagaguaagacccagucuaaaaacaccuauacacauaaugacaaaaguugcagaaaaaaaaaaauuaacugguguugaaauuguauaaguccaucucaauaguuaaaauuaaugguguuuuguuguguuuggucagucucaaguauccaaguaagcccugaccuaaggaugacccagaacuucugacccccccugccucaacauccuccuauaagacuccagaaacacaaguugacauccaguuuaguuuauccagaggguugacgauguuagguaaauuaccaauugaccuuuaucucuggcguaugguuuacuuuuuuggucuuguuuucuuuuuaaaggaaauguuucauguaguccaggcuacacuagauuuccugauccucuuaucuuccccuuuccaguggguaauauuuacgugugugacaccacacuagcuaaagauuuuucuuuauauuugagcuggguaugguaggaggaucaaauucaaggcuauccuugauucacaaguucugguuccacaaugaggaaccacuaagauuucugggccaggcugggccaauagugaguucaaaucaaacuagaccacauauucagacccugucuuuaaaacaaacaaacaaacaaacaaccaacccaugaaaaugucucagaaagaaacuauuugauuauaaggcuuaagaaaauugaaagguaggcugguuguggugguacagaucuauaaucccagcaacuugagaagcugaggcaggacaacaccuaccaggcuauucuaugugauuaugguucugcuuuucaaauaaauaauaccaggcauaguggaggucuguaauucuauugggaaguggucaaggucaacugcaugauaaauuccagccaggacuauagagccagacaguuuuaagaacaaaaauggcuuagagcgaucaaucacucagugauuaagacaaugcaaagcuguugcagaggaucugaauucaguacccacacuagguaguaugccacaguuuguaacuccagccccauggggauccaaugugcgcucaugcgugugcacacgugcuugcgcacucacgcacucgcgcgcgcgcgcacacacacacacacacacacacacacacacacacacacacacacacacacacacagaguuuaaaauaugcucuugcccagggcuauucagagaaacccugucucaaaaaaacaaaacaaaacaaaacaaaaaacaaaaaacaaaaaaccucuugcaaaaaagagaaagaaaaaaaaaaaaucagggcaucaggucagggcuaccaaaaucagguaaaguugcuccuaaagccuuacaaccugaguuugaucccaggaaccuaaggaaaaaacuaacuucacaaagauguccucugaccuccauauccaaaaccauauguuaaaaaaaagaaaaguacaggcuggagagauguucagugguuaagagcaccgacugcucuuccagagguccugaguucaauucccagcaaccacaugguggcucacaaccaucuguaaugagaucugaugcccucuucuggugugucugaaggcagcaacaguguacucauauacauaaaauaauucucuuuaaaaaaaaaaaaaaacuuaaacaacaacaacaagacaacaguccagggaugaagaguugguucugugggugagagaacuuguugcuuuugcagauaaccaaggucugauucccagcacucacaacuacuuauaaauucccagucucugaggauccaaugacuuguucuccaaagguaccagaaaaacacaugguacauauauauagaugcaggcacuauacacacugauacacauaaaauaaugaugacuuaaaaaauaauuuuugggcuggagagauggcucagugcuuaagaacacugauuguucauucuuccagagguccugaguucaauucccagcaaccacauggugguucaccacuaucuguaaagagaucagaugcccgccuccggugugucugaaugcagcuacaauguacuuauauacauaaaauaaaugauucuuuuaaaaaaaaauaauguuuaauaguagaagccaacaaacaaaaaagcaaaacauauucucccagccaauucucaaguaaagcaauagaagaaacuaaacugguaucaacuuuuggcugggccugacagcucaugucucuaaucucagcacuugggaggcugaggcagacagguaacugaguucaaggucagccuguucaauaguuaguuccagguagccccccaccaaucaaaaagaaagaucuucaaaacuuuuguguuguaaacaauaccaaucaaaaaguauaaagacagguuagaaagauauaagucagugguuaagaucauugauuccucuuccagaguaucuaggcucaauucucagcacucauaugguggcucaaaaccaucuguaacuccaguucuggggaucuuguacacucuucucgcuuacacauauguuacagacauauaaucaagcaaagcacauauacauaaaaaguaaaacaaguaauuagaagaguguuucuuuaaaaaacuauaaagauaauauacaaaaaggagaaagucaaaggaauaggauccagauuacacaaagaaauauaaugcaauuauugaaagaaauucaaccaaacaaaaaaauggacaaaaaaauaccccauaaauuucucuuugccuguacagauauaaaauuuucuuaccaaaagaaagaaaaaagaaaaaaaaaaaucagcaagauaguuuaucagguaaaggcgcucauucuaaaagccuuacagucugaguuugaucccaggaaccacacaaaagaaauucaucccacacacaguugaucagagaaaugcauaucaaaacaacgcuaagaaugccaggcaguguuguuacacaccuuuauuucccgcauucagggaggcagguggaucgcuaugaguucgaggccagucugguuuacagaaugaguuccaggacagccagggcuacacagagacacaaaauacaaaagcccccaaacaauaagcuacuagaugugauagcucacauuuguaauuccaggucagaaagcuagaagggggaaaucacugagaucuaggcuagucuggacuacaugcauagacaaauccugucuuaaaaagacaaaaaccaaggugcaguaaguuggcucagcucguaaagacacuuguccccaagccugaagaucugacuuugagccccauaacccacaagguggaaagagaacuaaauccugcaagcugucuucugaccuccacccacacuuaugcacacaugcaauuacacaaacaaguauaaggaaaaucuguaaugagaugacuuacuagcauagcuacuauaaaaauaaagaaauauaguaaagcagaaaaagaaacuuauaagggauggggcuauaguucagcuagccgaggaccugucuagcaugugugaaaccuugguuugaucuguacuacaaaaacugggcaugccuguaaucauaguauucaggagguaaaggcaggaccaggaggaguucaaggucauccuaggcuacauaggguguuugaagcuagcuuagcuaaaagaaaucaagguuugagucagucauggugcucacaccuuuaaccucaguacucaggagacagagacaggaagaucugaguucaaggccagccugaucuauaucuacauagugaguuucaggacagccacagcuacaaaguaagacccugucaugaaggaaugaaggagugaaggaaugaaggagugaaggaaggaaggaaggaaggaaggaaggaaggaaggaaggaaagaaacaagcaagcaagcaagcaagcaagcaagcaagcaagcaaacaaacaaggucugaacuugugacacaagcuagugggauaugcugaagcaguagacagccugggcuauccuuuuuuugcugagcaugguggcacaugccuuuaauccuagcacuuauaagacaaaauaggaggaccucugugaguuggaggccagccggaucuacagagugagacugucuuuuuuuuuuuuuuuuuuuaaaaagauaguagaaucuuuacucagcaugcaccaaauucugaguuccaccccuacuauguccacuccaaaauuuggagggaugaagaaauggcucagggguuaagagcacauauugcuuuuacacagagcccaaaucuguucuacaaacccaugucaggucagauauuucauaucugccugcaacuccaggggaucugauguccucuucuggcuuucaggggacucugcacucauguacccauaacccccacccaacacacaaacauauauaauuuuuaaaaauaauaaaggaaaugguucagcaguuucucaaaaaggaaacaaaccaaccaaccaaaaaaacaaaccuggagcuaccacaugacccagagacucuacuucuugggugagaccuccgcggaacugaagacaaaguccacaaagacccaauucacaucugcccaaagguggaaguccaaguguagguaauguagcugacugucuagagucaggggaugugcauucuuggauguccucagccuagguuggacauuacagucauacccaaaaacaaacaaacagccgugucugcacuuguacagacacacucccuaaccaguggcucucaaccuuccuaacgcugccuccuuuuaauacaguuucucagucaugacgacccccaacuauaacauuauuucuguugcuacuucguaauuguaauuuugcuaccacuaugaauuguaauguaaaauauuuuuggagguaggggcuugcuaaagugucaccaccccacagguuccucugcccuaaaccacuuacaugcuauuucauugcauuagguaaucuagagauaaucuggaguacucaggaggauauguguugguuacaugcaaauaugagguaucuuauguaaaggaaucgagcuacuaccauuucuauacccucaaggguccuggaacuaaaucuccauggauauggaagggaugguuuguacgauuauccggccaacacuagaaaagaacuaguaaugucuguuacaugggaguaaaccuugaagagagugcuauguuaauagacucaaaagcuaguuccagaagacuacauauuauaccuagaggaagccaaaucuagggaaagagagagggagagguaaggguagagauuuacuucaaagaaacuucuuaaauuggagggauggcuguacaacuuugugaaaauagaagaaaccaucaauauuuucccuuuccacaagcuuauuuuaugguauguaauuuguauuuugguaaagcugacuacuccauaaagcuuaacgaaacuuaagaaaggaauauauugaggugaaaaauacuuaguccuggcuagcuugauugcacauuccaguacuaggaaggcagaggcaggcauucucugaguucaggccagccuagucuacaaagugaauucuaagauaaccaguuacacagagaaagcuuguuucaaaaacaaacaaaacacaaaaagaaagauacucagucacucagugacaucugauggcucaagaaaucagguaucuucgauuccuuaccaguucugauccccacuccucaugacagaagaugcuaaacacaacuucucucggauggaccauggcucuguugggccaguacucagcagcuugugcucuggaaauacagaaggcucagaaacaaccucggagcuaguccucagccccagaacugcuaaacgccucauauaaaauaacaacccaggcaggacuacuguggaguaguaaucccggcucucaggaugcagagacuagccuggucugcaugaguuccaguccagccaggaucagucacacgauaguagccugucucaaaauaaauacauuccaaacucgucccaagugugaaccacuaacaucaauuauuaucaacaaaucuugauuuuuuuuuucaccguuccaaugaaauaucaccauuacuggcuacgguacuuuuuauugaauacacauuuuuagaacaucuuguuuaaaugccacggcuuuaagguggucugcuuccaaaaaacaacaacaaaaaaggcaguguuacguuaaaaaaaaaaaaagguaauaagguucucauuuuuaaaaaacacuucuaaaacguucaguuugaacgcaggcuuauuucccacgauucccagcggccaagggcuccgacugccggccuacuacuuugcauaaaguuguuuacauacggccccgcccccuaaccgucggauauagagcgguucccuggggaagcagaaaaauggcugaacuccgggagacgcguuuuccccugcggcaggaaaagccuacagcuaacauaucaccucgacugcuccucaccgcucgguuagauaaacagcagagucgcuggccacuucacucugccuuuccguuuuacccuaggcagcgccuagcccucccacaaaggcuucccgggcuguuucuccgcagccuccgucuccucccaacacuguuaaaccccaggcgggggucccgaaagcgacaggaaaggcagaucucugagcucugcgcucuccgacaacccacuccucccacgccuuucacgccugagaauugggaugcuagucucaacucuacaaaggccuugacuauaaaaggggggccgauacucacugccugucccggucgccaucuuggcuucgacgucuucaacguuggcgacagacgcggggaacucugggaaacacagugcgaauccguucgcggugccucguggguaaugugggugggucaguuugcccuaauagaagcgaaguuccucuaggaaaaaaaaaucugcuuuuuaacuaauaaaggacaagggauugcggcugaagccucagaaaagaaacgucuagauuuagaauuaagcgacaagaauaccaggaugaacaacauggaagugucaguugguaacccggacccacauuaaaagcaaacggucuuccgguaggcucugcc

SEQ ID NO: 8864 - RNA, 8667 nt, Mus musculus
agugcgaauccguucgcggugccucguggguaaugugggugggucaguuugcccuaauagaagcgaaguuccucuaggaaaaaaaaaucugcuuuuuaacuaauaaaggacaagggauugcggcugaagccucagaaaagaaacgucuagauuuagaauuaagcgacaagaauaccaggaugaacaacauggaagugucaguugguaacccggacccacauuaaaagcaaacggucuuccgguaggcucugccuccucccuucugcugauuggguccuucaggcuuugcuuuuugauuggccggacaagcucagcgcgcaguuuaaaacauuguaugaggaacaaagcuguuccucgugggcggaguugugcucuccagccgcaggagucuugcugcgcggguggguagaagcugggaucagagaagcggcgaggcagacagucuucgggugagugaaguugggcuggagccccgguuaucagcugcugcuugcgcguccguagaaggcuccugugucuuccauaauucucuaggucucguggucuuuggaauaagguuggaaaaguacccuugggauccuaaaacacgcucgcuggcggaccuguagaccaccucuguagagcguggccuuccguucugcuuuagaacuagguaucucuccgugccuacuuaccuucagaaaugcagccuccggcuguacuaguucucauucucuuccccuuagcugauagugguguauagucuaggcaucccaccccaccccuuaccaggugccuguuuuuaaccuacagguuugcagguuuuguguauuaauauucuacccaucuacucuugucucuuuuuagacauagacugacucugcuugucaugucucaccggauccuuucuccgccagcgggcuuacucucugaugaggauguuguagacucucccauauuagaauccacagcugcagaucugagaucuguuguccgaaaggaccuguugucagacugcucugucaucucugccucucuggaggacaagcagguaaaggaguugaguggcuuaggggcagaaagugguaucuucagcuaacaguuguuuauacaagguaguaugagaucaaaagccaguaauccugaaaaaaugaaagaucaguuaaaaaauuaaggguaaagcugggcauuguggugcauacuuuuaaucucagcacuugggagacagaaauagcagaucucugaguuaaggccugccugguuuaccaaaugaguuccaagacagcuagcacuacacagagaaaccuugucuugaaaaaucaaaacuggguuggggauuuagcucagugguagagcacuugccuagcaagugcaaggcccuggguuccguccucugcucuggaaaaaaaaaagaaaugagaagagaaaaggaaagacagacagacagacagaccaaaaugccgggugugguggcacacacaaucccagcacucaggaggcagaggcaggcggauuucugaguucgaggccagccuggucuacaaagugagcuccaggacagccagggcuguacagagaaacccugucucaaaaaaccaaauaaauaaauaaauaaauaaaauauuuauuucgagauaguauuauagucaaggcuggcuuuaaacuucagaucccccucucucuaguguugaguguugagauuaaaagcacaugccaucauaccuaguauauggugauuuucuaacaacuuuuuuuuuuuuuuuuuuuuuuuuuugagacaggguuucucuguguagcccuggcuguccuggaacucacucuguagaccagguuagccuugaacucagaaauucaccugccucugccucccaagugcuggaauuaaaggugugugccaccaugcccagccucuaacaacucauucuuacucaggaaagccaggauugcagggcaguguuggacagggaaggguaacagaauucaugugugcuagaaugauguggaaccaaagaauggcugcacaggaccacuuaacgcuuacugaggaaugagggagcagaagcaugcuuccuaggaucuaggcuguuuguccuggcuuacagguuaacucgagaaucuguuacaggcucuacuggaggacaccucagagaaggugaaaguuuaccuucgaauucgaccauucuugacuucagaguuggaccgacaggaagaucagguaggauuuaagguggauuuaagguuguaguaggagaggcucccaggagugcuccuuuacucgguaaacccugcuuucuaccuuuccagggcugcgucugcauugagaauacagaaacccuugugcugcaggcacccaaagacuccuuugccuugaagaguaaugagaggggaguuggucaggccacucacaaauuuaccuuuucccagguaugcaauacugcuguacgaacauuuaggaaauguauuucuucuuuaaaagauuucuacucgaguguggguucuuuacgugucuguaucuguaauuuuaagaccuuuuuaugugcuagucagugugugggauacuuuuauguacaugagauaccacugauguuauuacuauuacucuucucccugguaagaauacgauggcacauauugcagugacggggauuuugcugaagcuauagcgcuauucagugguaaagacagagcugagauuuggaucuaccgucuccaaacccaugcuuacacccaacuguacaaccccgugugugugcacagcacuacacuuaacagcauuccuuaaguguuucauuaggaugaacugaacuagccggggcgauggaggcuuuagcauuuaggaacaacuggaguccaucaggaaagccugcuugagcaggcuccagggaggauuguagcuacucguccgguccaggagacggagggcagaaacaguguggcuucugagagaucggucucuuucuagauauuugggccagaagugggacagguggccuucuucaaucugaccaugaaggagauggugaaggaugugcucaaagggcagaacuggcucaucuacaccuauggagucaccaacucggggaaaacguacaccauucaaggucaguagugagcuucagcaggguugccuggcaacuuagcguuggcuuucccuuugaggccuugaguaaaagaucccauugcuauuauuccagguacuaguaaggaugcggggauccugccccagucccuggcucucaucuuuaauagucuccagggccagcuucauccgacaccugaccugaagcccuuauuguccaaugaaguaaucuggcuagacagcaagcagauucgacaggaggaaaugaagaagcuguccuugcuaauuggaggccuccaagaggugaagugcucaggaaguugggauaaauaguacagauuuuagaaaagauuagugcuuaucuuuucucugugccccuuuaggaggagcuguccaccuccgugaagaaacguguccacacugaaagucggauaggugccagcaacagcuuugacaguggcguugcugggcugucuuccaccagucaguucaccagcagcagccagcuagaugguguguaccaugagugagcucuaugcugggcaaucgggguugggggggggggauaugaccuacucccuauucccaacagcuguaagugguauaaaucaaagacugcaacuaaaaugccaucuuucuaaguuucuguagaccaaagcaaaaugagauucuccacgguuaaugacauacauguauauauuggguuuuuucacagaaacaagucaauuaugggcacaaccagacacugucccaguaaguguuccagcagacauucgcuucucugucuggaucuccuucuuugagaucuacaaugaauugcuuuaugaccuguuagaaccaccuagccaucagcauaagagacagacacuucggcugugugaggaucagaacggcaauccuuacgugaaagguaugcaaagguagaggagguuggcaggaacccuggagggacauggggaaaugagaggaggggucaaguguuccaccuuacucucuuggcuccagaucucaauuggauucauguucgugauguugaggaagccuggaaacuauugaaagugggucgcaagaaccagagcuuugccagcacccacaugaaccagcaauccagccgcaggucugcugugggaauugacucuugacuguaucuagauagcuuuagccuuccaccugaucauagaaguuauagaguaauuuuucccuuuuccuuuucagucacagcaucuucucaaucagaaucuugcaccuucagggagaaggggauauagugcccaagaucagugaguaaguuuccccacuuagaaauuugaucaucuuggccaugugguuaugggggcagaagggaacuucucaaaggaauuugcucuuucccuucuuuugauauaaacagcuuggaagggcccuucccuagagagaggaauuauagaacaaacuaugaguuccuuacaucagcuccuaugcuuuacuccagacugucacucugugaccuggcuggcucugagcgcugcaaacaucaaaaaaguggugagcggcuaaaggaggcagggaacauuaacacuucucugcacacccugggccgcuguauugcugcccugcgacagaaucagcagaaccgguaagcuguaggcugcgguggccugggccuggcccuuugcucaguuccuggucagcccugaggguggugcuuggauacacacacacccugccaaaggcugcacuuauacucacaaugcuuuuuaucugauucuguacaaggucaaagcagaaccugauuccuuuccgugacagcaaguugacucguguguuccaaggcuucuucacaggucgaggucguuccuguaugauugucaaugugaaucccugugcaucuacauaugacgagacucuucaugcagccaaauucucagcccuagccagccaggugagaagcuauacacauaaugauuguauuuuccuuggaugcaauuuuuuuuggucuuuugagucaggguuucacuguguaguccagcuauccuagaacucacucuguaaaccaggcugagauccaucugccucugcaucuggagugcuugggauuaaaggcaugagccacuaccaccccgcaggacuggcaaucuuaaaauagcucuuaggagccgggcagugguggugcaugccuuuaaucccagcacuugggaggcagaggcaggcagauuucugaguucgaggccagccuggucuacagaguguggguuccaggacauccagggcuacacagagaagcccugccucgaaaaauaaaaacaaauagcucuaguuaaggagucaauugagauuuuuuuuccccuuccagcuugugcacgccccaccugugcaucugggaaucccaucccugcauucauucaucaagaagcacaguccucagguuggcccuggcuuagagaaagaggacaaggccgacucagaccuugaggacaguccugaagacgaagcugacgucuccguguauggcaaggaggugaggacacaaggcaguucgguuguggcagcuugguggcuggacaugugcuacaagguguccuggucgauauggggcuuuuuaaaaagugcaggggggcucauagguguggucuucuaggaacuacuccaggugguggaagccaugaaagcgcuacuuuuaaaagaacgacaagaaaagcugcaguuggagauacagcuccgagaggaaauuugcaacgaaaugguggaacagaugcaacagcgggagcaguggugcagguacugcuagcccagccccugugacagggacagcagugggguguaggcucuguucuccagcuucacucaggauccucacuaccacuuucugacagugagcguuuggacaaccaaaaggaacugauggaggaacuguacgaggagaaacugaagauccugaaggaaucacugacaacuuucuaccaagagcagauccaggugaguuuauccuggccagucucaacagccacucggcuuccaucauuugggucagagcaaacaaaugucuacuuuuacucugucuugaaaaaccaagccaaccaaacaaaaacaaaguccuggaacucacucuguauguagaccaggcuggccguaacucagauccaccugccucugccucccaagugcuugggacaaaggcacacacuaccuaccaccaccgccacugccagcaucuuauggguuucugagauagggucucacuauugucgcucuggccagccucaaacuaaguuuuauaaacucuagaaagaacaguaguauauacuauaauuaauguuuauuagguucccuuaguaucgugcagcuauugaguuuaaguugagggaugagcucaguaugaagugugcugcaggcuaacgucagcgugaaugguacggacaggaugcuuagguucuuuuagucugguccucuggcguuugucugacccuggacaacugugcucucuccuucccucuuaggagcgggaugaaaaaauugaagagcuagaaacucuguugcaggaagccaaacagcagccagcggcacaacagucaggggggcugucccuccuccggcggucacagaggcuggcagcgucugccuccacucagcaguuccaggaaguuaaagcugaacuagagcaaugcaaaacagaguuaagcucuaccacugcaggugaggaaggcaggaagcccagcagugagagugggcgagggaaagcuggcauucaaacucaguccugacuccaccucugggucauaucuacccagaucucacucugcugcuguuaaagcccaaagcugaaaaacccaugcauuaaguguuaucuauauguccuguguuucuccccucagagcugcacaaguaucagcaaguguuaaaaccgccacccccagccaagccuuucaccauugauguggauaagaaguuagaggagggccagaagguauuuaaccuuaaugucuuucaaaggccugugucagggguuuaaaugagaauaaggcguuuuucuuuuugcaagggucugaggaaugaaagccuucugcuuuacauuuauuuauuuguauguagugauguggaagccagaagaacgguucucucuucccaccauguggguccuagauguaacucagauugucgagguugggugcuaagugcccucaccagcuaagccagcucaccagccuccggcuuccuuaagucugucuucaaauggcuguugauugauuuuggccacaaucugauuucuacucuuucagaauauaagacugcuacggacagagcuccagaaacuaggacagucucugcagucagcagaaagagccuguugccacagcaccggagcaggaaaacuucgucaagcauuaaccaacugugaugacaucuuaaucaagcaggugagggcagccuagccaguguguacgugagagggagagaagaaccagugaaaaaauaaagcuaaugucauauaaagcccagggcuuucuguaugcuaagcaggcaggcacucuaccacuaagcuauggcauuucucauugcuaaugguaccugaucucuuaaaugauaaauguauguuuuaaacuaaacauggcauacccaauaauuauguuuucucuaacuuuuaauguucuuagaaccagacccuggcugagcugcagaauaacauggugcuagugaaacuggaccuucagaaaaaggcagccugcauugcugagcaguaucacacugugcuaaagcuccaaggccaagccucugccaaaaagcggcugggagcaaaccaggaaaaccagcaaccaaaucaucaacccccaggaaagaaaccauuccugcgaaacuuacuuccccgaacaccuaccugccaaagcucaacagacagcagcccuuaugcgcggaucuugcgcucacggcacucuccuuuacucaaaucucccuuuggcaaaaaauacuaaaguuguggggaugaagaugcaugguuguugcccugagguuggucagcugcuuagcugauaagucucuuuuaagcuucagcauacacccagaacuguauucagaauuauuguauuauaaucaccuauguaaucuuguuuuuuuuuucaugcacaaauauuauauggaauaaagacauuguuuaugcuuuuauuuggauuccaaauuuagaaaaauauaaaaagggggacagaaaauugauauaaauaccaucuggccuguuagacccuuggacaggaacagcagugggaaccagccuaaugcacacuaggaaaugaguacaauuuuaaaugauacccaagaggcuuggguagcuuugucuggccaggaaguugcuaugucaaaacacccaccugccugucuccaaaugggauuaaagacaugcaccaccacauggcacccaguuaguguuccuuccauuaaauggggaguaaaauguucugaguacaagagaaggaaggcuagcuccuaaccacagaaugaucuauagcaccuacugcacaagcucauuguagcagacaucaaguggcucugaaaccuagaaaaacacagugaauucuucaaccuuguagauaagguugaaaaccaaauuggagacuuuaaaauccgaaguaaaaaagcuucca

SEQ ID NO: 8865 - RNA, 18572 nt, Mus musculus
cagaccucuggcuguuggcuuugccuucaggccaucuccggagagaagaagcaaagcugaaccucgggccacguagaugcaauuuuaacccgaagaaucgcuucuguuccucagaucccuugucauucuguggagucuucgcuuacguccaguccugcaggagguuuuuuguuuuuuuuuuguuuuuuuuuuguuuuuuuaaucucacaaaauucaagucggccuuuaaacuuaagguaagccgggaacuguguccaucccggaaucuaggauacccgauugucccugcaggguucguucgggacccgagauccguauagccucaucuuguuuguuagaucgguuucuucuggucaagagugugaaacugcgugguccggaucaagccaguguucucuucguuccaccuuugaaguccugagcuugccugacgucuguaaguuuucgcccugagcaacugcaauguaacauuccaagagguuaaacccuucauccuaccgggaugcuccuccacccgggcucagccgggcacuggaaaggguggagagacuggaguuguugaauaucuggaguguucuucuccuagauagccccaccucccucggugaagacucugaagucaugucuacaggaccuaucccaccugcaagugaagagggaaguuuuguuucagcacccaguuuuagguccaaacaaaggaagauauuacaccuacuuuuggagagaaacacuucuuuuaccauccguucagauuucccugaaucuccgaaagacaaacuccacgacucggcaaaccuaagcauucugucgggguaaauuuauuuuuaaacaacauuuauuguuaauuuggggggugggagugguugugagcuaccuaaagugggaguuggguggguaguaacccgagugcagucuucuauaagagcagcaaguucuuaaucacugagccaucucuccugucuguaaauuaauuuuuauuuuuacgccuuaucuuugauuuuuaugaacaaguuuguuugcugaguuauccuguuucaagguccagaguuugagucucaacuaugaucuugaacuuuaugacucuuaagucuugggcauccuuucuauguaaaaaacaaccaaagaacauuuuucuaaauaggacuugguggaggcugagacaaggaugaucaacagguucaaggccagcaugggcuccuguugaauuccaggacaacuagugggcuauagugugagacccuauugcaaacagacaaauaacaagaagaaaaaaauuaauuuucuuucuuaccaggaguaaucuuuuccuguaauguuggaaucaaugugcugucuagaaaacauucuaaaaacucuauuagugugucauaugaguugucacuuuaauuguguuugugucagugauauacuuuaaauucuggucaugcugucuuuacaccucauuagcaaacaaguauugagaaggaguagaaauuccagggagaaguugaguuuauguguucagggugaacaggauagacaauugaggguuaagauccuauucacugggcaagugagacguaaaggcaccugucacaaaaccugauggccugaguuagguucccugucuauugcaaguggucuucugaccuucacauaccaauauguguacacacaauauauaaaauguaguaaaaauucuuaaaaguauucucuuuagauucucauuaaauagauccuaucucaguauguuggugaaaagaaaacgaggcucgcauuauugaaauagagaaaaauuggggggggagguuccuucucaacccagucugagcugauuuguuuggacacuguuuaguuuuuugugauaguaauugagagacccaaauacaggccugaacucuaccuuuuaagaguaauacagccuaaugggaaucuugauauauuuuuaugucucaacagaggaaccccaaaauguugccuugaccuuucgaaucuuagcaguggagagaugucugccucuccgcuuacuacuucugcugaccuugaggacaaugguagggguauagucuuuaaaagaaagccuaacuuuuaaccuaaaaauuuauauuuauuaauguguuauguguauaaaugagcauucauguguguguaugugcccugcaugugugccuggugcccucagaagccagaagaagaacuagauccucugggacugggaucacagacugcugugaccuaccauugcaugcuggguauugaagagcagcuaccauguggaugcugggguuuuuggaagggcaacaagugcacccaacugcagagccaucucuuggucuggagagauggcuccaucuuuaaggcuaaggcuuacaacuuaaggagaacuaacuuuucagagagacgauaugguacuaggauagaaauagaagaugagccgggugugguggcacacgccuuugaucccagcacucgggaggcagaggcaggcggauuucugaguucgaggccagccuggucuacaaaauuaaacccagggcuuugugcaugcugggcaaacuacuaccaaguaagcuauaucuccagccucugauucuucauaucugauugcagguuccuuggauucaucuggaccucuggauagacaguuaacuggcaaguaaguuuugcuguugaauggucuguaugcuguagccuugcuguaugaaucacagggauguuauccuauguagacucuguacacgcucaaguauuuuacuuuggacauuaguggguuucaaagauucugacuugacagcuuuuaagcuuuccaguucuaaauaguguugugaaauccaggcuauuuucacucagcauacacggaaauaccuuguuuuuacaugaaaagaaauggugcccugcacucacgguagggcuucucuuugcacgugagaaguccuguauuuuaguggcuaaggaugcagggugggaaaugagacugucuggguucuggugacaacuucacuagcugggacccacagcuucuuaauucauuggauuguauuuucuuuauucauaugagguaacaaaagugcuuauuaagaacagcuauugcaaagauuagauaaaaaugagaggcuggccuauaugagacauugucucaaacaaaacaaaacaccacccaaaccaaaaauaaaaacauacuccaaacagacccagguaacaugguuuacauuuguaaucucaggacucagaugggagaggcaugagagucagaaggucaaggccagccuuagguacauaaaaagccugaggccagccugggcugugugagacccuaucuuaauaccaccucccaccucuauccccacccuacccccccuccccccaaaaaaaaagaagaaaaacaaaacauguaucuagcucauacgaaacauuuuguuuguuguuacaaccacuguggagucucuccuggagauucuaaaauaguuagcuaguggguauacagagaguaaaaacugauuugaaugcaacucuuucaaaccuuaaauagccuauuuuguacacacuagguagaaauuugagagggaagaagaaauuaaaaaaaaaaaaaaaaguaagccaggaguggggggugcccuuuggugguagaauguuuaccuggcuuguacaaggcucuagguuccaucccuagcacuaaaauuugaacagaagacaaacucccauuuggugcauguuuaucuuguauaguuaugcuagugaauugagggccuuccccccaggacaccacuaagucuuggauaucuaguacccugaauauuguuagaagauacauagaaucgcaaagacuagggccccuugaacagaagaaacuggggugccccaaccacugaagaaccaaacugaguauggggauuagcugauuagugcuuguuuuuguuuacucuucagggauuuucaccaggaccuuaugaaagguaucccaguaaguagaccuccaucccuuucccucccucccuccucugcucccucccuccuuuccucccucccuccaucccucucuuccuuucucuuugucuuucuguuaagagagggccucuuaacuguguuuagcuaccugggcuggugcagccguugaacacugagacggaagccaugugccaccaagccuagauuuuccuuccugacuuugguuugucucucagguggauggcagaggguuccacacagccguguggcuguagcuguuggaugcuuucuguagacaugucugucuuuuagguacagcuucuuuguaguacuccgaaugcuaugaaucauggccacagaaagaagauugcaaagcguagcacaucugcacauaaagaaaaugugaguguuacuuccuaaacugggaacugucagcucuguucaguuuguugguuuagaucucaaguugcugcugcuauccugaaaauaacuguuuggagagcaucacaaacagugugugaguguagguuccuguaauggacugcuggaagucaguuuuugccuuuucacauggguccagggcuggaauucaggacuuuaggcuucuuucccagcaagcacuguuuaccacugaacgcuagcccuaaauaauuuuacuuuguaagaacauacauaacauaauuuguucauaaauucuuuguggguuuuuuuuuuuuuuuuuuuuuuuuuuuuuugcacuuuuauugcuaaggauuggguguagucauuguucaaacagcucuuucaugucauugagcuauaccccugccuugucuuggauuccugaggauggagcaguauacagcccuagugcaugccaggcaagcagcagccuacagcucacuuuuugugugcuguuuuuaagauagaguccaugggacuggagagauggcacagcgguuaagagcacuggcugcucuucuagaagaccuggguucaauucccagcaaccacaugggaacucaaaacugucuauaauucacaaccucacauagacauacuugcgggcaaaacaccaauuuacauuaaguaacaauaaauaaauuaaagaaaaaaaauacaggguccaguuaugcaggcuuuccaaguagcuaggauuacagaccugcaccaguaggcuaaacuuucgucuuucauucuuucgguauuagggauugcaugaaaggccucagguauccugagcaaacacucugucacuggacaauuacauucagugucuggccuccuuuggccuuuuuuuuucuuugagacagaauuucauuaaguuaugaccuugaacuugaggucccaugucagucucuuaggugggauuaacugugcacuacuagcaggcucauauuaauuuuuucugauuucuccuuagauaaacucuugaggacacuaugguccuuuuuauauaagccuuacugaccacuuacuacgaugauucuuuaauccguccaucuacacugcuuuucuagccgucuucugugucuuccaucccuucagcuagaucgguguacaugcuaaaguggcuauucuagucucuuuucuuucagauucauuuguuuuuauuuuaugggcgugaguguuuugccugugugugugugugugugcaccacauuagugcagugcccacagagcuggaagggugguuagauuuucugcaacuggaguugcaggugguucuuggccaccaugugggugcugagaauugaaccugaguccucucuaagugcucuuaaccacggagcccuaucucuaguccccacuaugcuuuuauucuuuccuuauacuagagaagauaugccugguuuuagguguuuauaaucaucuuuugaaaauuacuacuaccucugccccuuaauuuuuuuuucuguauuuauuuauuauguguguaugugugucugugucugugucugugucuguguaucuguguguguguuugugugcucaugugcccguagaggucaaaggacaacuuauagaagucaguuuguuccuucuguuucuuaggccgccucaguuccagggcucgaacacaaauugucaggccuugcgcugaguaccuuugcuagcugagucaucuuucuauuccuauuauugccguuuuaaucuccccuuguaaaucacucuuuaaaaucucacaguccaggacuacagaggugguucagugguuaaaagcacuuacugcuuuuccagaguugccaacacccacauggcagcuccacacccaucucaucuguaaguccaguuccaggggaucgagugccuucuggccucugcagguaccaggggcacguguaacacacauaucuaugcagacaaaacacucauauacauaaauuaaauacacuuuaaaaauaauaaauaccuacaaauaaaauugcagaucccuucccaagcaagcuuucuuucauccccuguccuuuugcuuaugaugauaaaauccuccaaagcaaaucugugugucagacaucaaauccacagcauuaucuguaucuucagauaugauuuagugauuacguuucuguguuucaggagaguuauucauaguuugaucagacgugauauuuuuggcaggcagcguuccugcuucucucccuccagcugauugacgcggguccuucuugugcagauaaacaccaguuuaaaggcauuggaaugggaggcaccuaggaccccaagguuucgaaaaaugccuggagguccucugacuucuccucugugugagcuggugaguuacugacuaugaucaagugguggcugaaguaucuugggcgacaggacaacagccauggacuccuggucguugacuuucaauaagccaccgccguagcugagaagagggugggaauaguaaccgccaacaugaggagcuaugugccuucagauaguuuggguuguuuaaacugcggggugagaauucuucuuagccuuugguuuccucuucuuuucucuuccuuucuuuuuggggauuugagacaagguuucaggcuauuacauuccaagcugcccucaagcccacaacaauccugcugucccaaucuaggugcuaggucaacaacgaugugccacggggcacaguguccauuucuuuucucauuuuugaaaugaaguuuuacugugcugcucagggcagccuugaacuccuucacucaggcucucuucuuccucuuccucuuccuccucuuccuccuccaccuccuccucuucuuccuccuccuccuccgucuccugaguccuguagguuucugccacuacaugcagcuucuuuuaaggguuguacaguuuaacucuuacauuuauauuguugcuaacaugauguauauguuccgaauaagguaaggauuucuuguuuuuuucuauuaauuuagauuuuaauuuguuuuuuucuuuuguugaguuagcauuugaguaggcagcuaaggcuugccucagacuccggauucuuuugcuucagccccuugauuugugggaucauagacauaugcuuucauagucagcccuaaauagguuuuaaucuugucaguauacuugacaggaaaugaagcaucugggcagucccauuacuacgguuccuaagcugagucaaaauguaaagcuagaagaccaagaaaggauuucagaagacccaauggaguguucccugggagaccaggacgccaagguucagugucauguuacuuuucacuuuccaccuuuguuuugcaguuuacuuacuccgugcgugugucuauggugucuacguuucugcgugugcaugcacaugcguggcauauaugugguggccagaggacaguuagugaaaguuaguucucuccuaccuuguggguccaagcaucgaacucugucaucaggccucacaagaugaaucaucucaggagcuuuuggauguuugucauuguuuuuguuuucuauuuucuuaaaaaaaaacagggucucauuaaguaguuguugacauugcuguuuagcccagaguggcuuugaacuggcaaccuuccuaucuuaaccuccugaauacuaggacuauagguguggcauccugugcuaccguaccaaguuuucuuugucacuuuguuuguuuguuuguuuaagaucaggucucacucggagguccaggcugaccuggaaauuacuuguagccaaagcagcucuggaauucacuguaguagccuaagcugacuugaaacucuuugaaauccucuucccucagccuuccaagugcuaggauuacggacaugagcgucuacauuugaucuuaaguaaacgauauuguuugucuauuguacuagggcugugacaaaacaaaacaaaagacagagucucaguggugaugcauaccuguaauuccauuacuuuguagguagaggcagaggguugugaguuaaaggccaaccuugaguacauaaugagaccuggucucaacaaggacaauagggcuggagagauggcucugcaguaaagagcccuggaggcucuuucagaggaccaugguuugaguccaaaaaaaaaauuuuuuuuucuuaaaaaaaaaaaaagaaaaaagaaagaaaagaaauucuuuagacucuaagagauacccgacagacagugucucaucaccaugaagagcauucuauuacugaaugaaaaguuuuggucaguaauuuuagacacuaucaaagcaguggcuggaauaaccuagcaggugucuuccaaggcacuucccacaucacaggacaccagagauagucucugagguguuuggcacuucuaagucggcuuuguuuguuugaaaauaugguggacaaagauggcuuuaaaugcauuaguuuaaauggaguaaguugugaagggcaccaggcugacugguggagacgugagaggagcacaaaaggcagggugggggguggggagcacugcacuagccgcacaacucacgccuuauggcaacuuuaaagaguuagaaauaagugacuugccagcuuuggugcuucaugcacauaauucuagcacuuggucucuacuaaggucuccucaagcuugaaguuagccacgguaacagaggaaugcccugcgucaacagaggcagauguggugucauggaguugggcacuugggcuccaguucuugcccacuacuagugguagacucuuggccagacuacugcaaacuucaguuuucccuuuuaaauuagacagcugcccagcccauaagcauggggaccccaauucggguccucggaacccacauaaaugcugggugggucuaccuuaaucccagcucuagaaaggugaagccagcagguggagguuggagcacgcugccuggcuagacagccuugccagcacguucaggugacagacucugccuuagugaacaaggagagggugauuggacaaaacucaucuacacacaugcacauggauacaugaacacacaugcaaagaauagauaaaauggagaacaugaugaaccuuucauagaauugcuguucauaugauaaaguauuaaaagcaguuuguauaacuccagcacucgggaagcugaggcaagagaguccaaguucaaggccagccuccagccuccucucucucucucucucucucucugugugugugugugucugugugugguauguaugcaaacacagggaagcaguguuugaugaaguguuuguuuaauuuuuauuauagaucuugaagguuuacauuuuuuguuugugaaauauaccucaauuaaaauagaaaaguuuuuugcggggagugacggcacaugccuuuaauaucagcauuugggaaguagaggcagaaugagcuggagucuggucuggucuacauagugaguuccagcccagccagggagggauacauggugaaaccuucucuucuccccacagcccccuaaaaaaagaaacaagaaaaacaaaaacuuagaaagcaacuuauaauguuccacaugcuuuauuauucuuuaaagguuuaucuuauuuuuauuuauaugcuuauguaaauaucuguguaggccagaagguugugucagaugugauuguuaggaacccaacucugguccucugaaagagcagcaaguguuuuuuaaccacugagucaucuuuccaacccaacucuauuauaucaauaauaacugauguaaguaguagcaacauucaauaagcaugauacuaguauugcuguauuacuacagcuaaggacagucauaauugagagaagauuccuugggcuaaaaagauaguucaguuugggccuggagcuacgguuuaacugguaaaguacuuacugugugcaugggaacccaccuccagccucagcaccagaugugguaacacuuacaaucccagugcuaaggaggcaaccccgggaggcuggccaggcuugucuacucagcagggcccagauuucauuuggagacccuguugcaaauaaccagguggaugacuccugagaaaugacaccaggguugacuucugacccacagcagcccucacacauacaaagagaauauguuuguacaggagguccugaguucaaucccuggcaugggcuugggagggagagaaaaguacauaucuuuggaguguugaguguuauuguuguuuuuaaggcagagucuuaguauguagcccugacuggccuuaguauucuaacucuaagugcuggaauugcaaguguguaccagcaugccaagucugugacgugucuugaaacuguuuucaguguuggaguugaacucgggaucuagugaauauuaggugacugcugagcccaugagcucuaccccagucuauauaauguucagauaugacaguuuuauauuuaaguuuuaggaacugccuauugcaguauaucauuuuacauucccaccaucaaugcacaaaagucccaguuucuccacagcuuaaaaaaauuauauuuacuuaaaacuucuuuagacuuuugucuuauuuauauguguauguauuuaauuuugugugugugggggggggcaugugacauguauguggagcucagagaacaguuuuaggaaccgguuuucccuuccacauuuauauagguucugggaauugaacucaggucgccaggacccagcuaguaccuuauuuaccgagucaucuugccaguccaggucuuuacaucuuuaacaugagaacuggaaguagugggaguuugucuuuucagggcuuaagucuaaggaagauggucccacucugugacaugaacgccauucagauggaggaggaagagucuggcucagagcuucugauuggugauuucucaaaggugcauuuggcuggauauacucuuccccucuccucucccucuccuucuccucucuuccuccuuuccuucccccuuuuguguguguguguguguguguguguguguguguguguguguguugguuaauacaaaaacuugguagaaagugauaacauuuaucccaaaccuuaucaaccagaaaaaauauuuuuuauauuuauuucuagacuuuucuacacaaauacaaacaagugaguuuuguaugcuucacacacacacacacacacacacacacacacacacacacacacacacacaccacggcaacaacaacaaauccucuuaccccacugugggucuguugagguuuuguguuucucuguugcuuuguaucgucucgcuaggacgagauacggugauagaguguguuuguuuuuuagaguaaguguaugugugcaugaggauguguguguguucguaucauaacagagaagcaacgcuugagggagucggcuuucuccacucacuauguggguccugggcauugaacucaaguuuucaggcuugcuggcacgugccucugugguucugguuuuuuuguuuguuuguuuguuuguuuguuuuuuaaauuuuuauuuauuuauuauauguaaguacacuguagcugucuucagacacuccagaagagggagucagaucucauuacgggugguugugagccaccaugugguugcugggauuugaacuccggaccuuuggaagagcagucgggugcucuuacccacugagccaucucaccagccccgugguucuguuuuuuuacagauaguauauuguagcucagaauccuccugacuaccgggauuauggauguauuuugaugugcuugcacauuuuaucuucugguuugggguguacggggugcugugugugcuuuaguguguauauaccugugaaagccauaggucagccuuggacaguguccucaggagcugucaccuuguguuuugagacaggggcucacuggcaccuaggacuugcagauaaacaagucuggcuggccagcaagccccaaggaucuuugugcccaugcuucucagcucugggauuacaaaugcaugccauccuaccaaacguagcuccucauaauuacaugauuucaccaacugagcaguuuacccggccccauguuaucauuaacaccaauaguaaaaagucuuguuuauuuuuauuuuuuaagccuuuuucuuuuuuuuaaaauauuuauauacauauauacacacauauacgcauauuugagugaucugucauugugcauaacggaagagggaaucagaucccauuuagaugguuaugagccauuucuccagcccuauuuuauauuuguauguauuuucccugaauauauguaugggcaagugagccauaaugugguugcugggaaguggacauugguccuucggaaaagcagcaagugcucuuaaccacugugcaaggucucuagccccccauuucaucauuaaagaaauaagaaaagauuuagccuugccuuuaauacaaacacucaggaggcagaggcaggcagaucucugugaauucaaggucaggcuggucuacagugugaguuccaagacagccaaaguuucauaguuuuuuuuuuuuuacucucaaaaaccaacaacaaaauauuuuuauuuuauguguauggauguugugcuugcauguaugucuguacacaucugugcagugucgucagaggccacaagagggugucaaaucuacuggcacuagagcuagagauaguuuugacccaccaccugugugugguaucugaacccagguccucuggaagaacaacuaaguauucuuaaccacugcgcuaucuccgcagacccuuauuucaucauuuucaauagcuguuuauuaguuaguuaacuuuuuggcuacucauaauuucucuaccaaucccuucuugugggauagucgcuuggaaaggaccauaugggaggguuuguugggaugcuaugggggggaauuccugcuguuauuucaguucucgggucuuuccaggugugugugcugccaacggugccagggaaacacccggaucugaaguauaucagcccagacacaguaaguacaaucuggagauggccacugguuagaucauauuaucagccgcuggccugugcucccaacacccacuucagucuguaugucuuucacucugucccucuguccacucucaugggcucuuacugggcugaagcuguauugaagguuuccuuuguaucuuuuuuuuuuuuuuuuuuuuuuuuuuuuuuuuuuuuuuuuacagaucuugccugaguuuauuuguaagaacagcauaggacacuggucaucugcaaauagugugcggggaggugugucacagcagcccgucugucuuuacacuggcaggagccuuuucuauggggccuucacaggggccugggcaccuuugggggccugagcaccuuugggagccugggcuggaguugaagccugggccuuagcuggagcuuuggccccugccuugguuuggaccuugggcuucgguuggcagagccucugacccuuggccauguagcuucgaauccgcuucccaagcuuagggugagcgauaaaagccagccgcuugaguuuggggccuuuuggcaucuugggcuugauggccugaggcuucaccagggccuugauggccucugcgugcacacucacugccuuugcauugcuggccugcaucuucuccaggccuuucuuguugugcuucuuggcaaagcgcauguuccucagaaacuuggggucaacccccuuaagagauucguaucuuugcgaccgggguuucuugaugccauuucugugccauuugcgggacugguuguguguggugugguucuuggacuuggccaugucugcacgguaacccgcggcccccgcagcgccugagaccggaagagcuccuuuguaucuuuacuuuucuuuuucuuuuuucuuuuuugagacaggguuucucuguguagcccuggcuguccuggaacucacucuguagaccaagcuggucuugaucucaaagaucugccugccucugccucccaaauacugggcuuaaaggugugugccaccacugcucagcucuaauuucugucuuuuuaaauuuuuuacuuaaggggcugaagagauggauaagcaguuaaaagcaccggaugcuuguccagagguccugaguucaguucccagcaaccccaugguggcucauaaccaucuguaaugggaucugaugucuuccucugacaugcagguguacaugcagauagagcacucauauacauaaaauaaauaagccuuuaaauuuuuuuuuuuaguuagacaaaugauguauuauuauaaaguagagaagagaaggaaaacauaaaaagaagaaaaaaaaaucacucaguuggggucuuaaagcagccaugauuaauucucucucucucucucucucucucucucucucucucacauacacacacacacacacacacacacaagaugacucucuugagacagugucugauucuccuuuaucuugacugguuguaaaucacuauguauuugagaugagaugacuaaugaccucagauuucugagccuuuugccuggacuuccugagugcugggauuacaagcaggucccaccacaccugguauaaggagagcuggcaguguugcaggguagaggaaacaggcuuaguguaugcacuguaccaccuaagguacuccagccuccuacauuccucuuucagacaggaucuggccuggaacuuacaguguagaccagacuggccgugauuauagagauccaccuacccaguuuauaaagaauagaguaacggggaacuuggaguguugcaguuaauuuggugagaucauuguaagaagccaaagugaggccagccagggcugcauaguaagaccgaguguuaagaaaaaaaaagaaaaaaaaaaaaaggucagguggugguggcggcacauaccucuaauuccaguucuugggagacagaggauggcagauucugugaguuugaggccagcauggucuauggaacagaaccagacaaccagagcuacacauagaaauccugucucaaaaaacaaaaagcaaacagacaaaaaucuauguuauuuuaauggcuguguaaucuguuauaccagaauauacaauuuguuuaacuaaaucccccuuaauggauguuugaguuguuuguaauauuucagaauccuagacaaugcuaagauaauuaucaauuugugugcuuuuacuuaagguguuagaagaaauuggggauagugguacaugcuuauaaucccagcaguuaggaguuagggccgggaggaucaagaguucggagcuauccucugguacauagugaguuugaggucagccugggcuacuuaagacuuuaucucacaaaacaaagauuucaaguauaauuccauguauuuuguauguauuuacaaaguucucuauagaaaggcuggaccaguuuauucuucgggauguccucuuacauuggguuguuuaaccacuaauacuucugcuacugcucuacuccuuagcugccucguuggucaugccuuccucuggauagauaaccucgguaucagccauuuggguccucccucuacacaggccaucuucaucucacacucguaugugggauuaggcuucauccaugugccguguugcaaauacaggcuacacuuggagguucugcauauaguacaauaaugggaauaugcagaaaggagcuguguggcuccucucucagagcaacagugaucgaucgggauauuuaaucauucuuugugugcagguggcugcuuugcugucuggaaaguuccagagugugaucgagagguuuuauaucauugauugccgcuauccguaugaguaccugggaggccacauccuggugagauuacaucgugagcacugggaaaggagaggcugcggauucgcuuuuacugagaagagugugggcaaaggguccugugagcuccagcgcuaggccagagaugauacauuuggaucccaucaaaggaaguccuuauucccacuguaacccuguguaccuugagcagucccuuucccuccuugacggucucccuccuuccugugcgagccuaggaacccuaaaaaccauccgggaaccagguagcacuuugcaaccauuuaauguucacagacaguucucauaguuuaucccguacccuggguggcucaguucugugaauauuuauugagcagcuacauagcaaagucugugccaagcccuggaguagauacagagggaggcuuagguucccaccccggaacuccuuguugcuugguuuuucuggccucaaugucccagaaaaguauaccagucauucccgaguacugacuguacacaagcccuugaggaauacuugcuaacauucuucucugcagggagccuuaaaccugcacagucagaaggaacugcaugaguucuuucugaggaagccuguuguuccucuggauauccagaaaagagucaucauuguguuccucugugaauucuccuccgagagaggcccucgaaugugagugucugcaugaguugaagccggggauggaaacggaucuugagugagacguggcacaccuguuuggacagagaugaaccuaaaugaaugccugccacugcaguuccaugagcauuagggugaucgaaggaagguguucuuacaguucaaaagaauugggcauuggcaauguaacuccgcuggcagaguacuugccuagaauauuuaguccuugggcuugauccccaauauugcauaaagcugggcguaauuauacaucccuaugaucccaacacagaaaaguaagggagucguggugugucagggauacacaagcaggaagaucagaaauuuaagguucuaaaucagucugagcuagagauccugucucaaaaaaaaaaaaaagauccagacauggugguccaugccgauaaucccagcccuuaggagucagaggcagauagauaacugaguuugagaccagccuggucuacauagugagacccuguuucaaaaacaaaacaaaacaaaacaaaacaaugaaaaacccauguaaaacacacacacacacacacaaagggauuuggggaugaagcuucaauagaggaaagggaagagugucacuggaccuugguugguaaacauggugagagccuguguguauugggguggggguggcuguggauuaaaccugggucuucugccagguggugguggcgcacgccuuuagucucagcacuugggaggcagaggcagucagauuucugaguucaaggccagccuggucuacagagugaguucuaggacagccagggcuacacagagaaacccagucucgaaaaaaccaaaaccacaccaaaacaaaacaaaacacaaaacccugggucuucuguguacuacaugguacucuaccacugagcuacgucccaacacuggagguccuccggggcaguuacucauaguguguucuucccucccucccacugaaggaccauagaguccuggccuugcuuccuccauccaacccaucucuguguuuucuuuacaggugccguucucugagagaaaaagacagggcucugaaccaguauccggcauuauauuacccugagcuauauauccucaaagggggcuacagagauuucuuuccagaguauaugguaaaaggauguggaagaucucagacauggugggaggggugcuccaacucagcuuuagcauagucuccagggauguaaagcagucuaggagaaaacggguuucucagacccagggagcaguaucucuucucuguaguaggcagggcucaggagucugagaaaccuuugucucguaccuuucaggagcugugugacccacagagcuacugucccaugcuucaccaggaccaccaggcugagcugcugagcuggcgaagccagagcaaggcccaggaaggggagcggcagcugcagggacagauugcccuccuggugaagggugcgagcccacaauagugacuaugacgguggcagugaagacacuacagacccuggacagaaggagucaucuuccaugucgcuaaucccgugauuaugucugcaaacaugggcagagccaggcaggcuguaaauaaaugccuuucguccuagcacuaaggaggcaaaggcaggaggaucuuugaguuugaggccagccuggucuacaugugaccuugucucaaaaacaaaacaaacaaaauaaaacaaaacccauuaaaccaaaaccucuagaugucucu

SEQ ID NO: 8866 - RNA, 3288 nt, Mus musculus
ucuuccuuccggcccggcucuccaggaggaggaagcgggcugagcuccguggcucucgcgagcauuuccccagcuucuacgggcuagaaugggggugccucuuaaagggcgagagagagagagugcguggucguugucuuucguucuucccccuugaucugaaugagcaucugaagcucugcggcgcaaaguccuguucauggacguaggagcguggggucgacugcguuagggaagcauggaggaaacgucgcaacgagguucaacuuuauggcucgcugauacagugcggugggcugugugcaucguggcuuugcgaacaaaaguucagaaucuugaccgcuaggucgagaucaggaacuucgccgaggcuggagccgaucgauugcgcggggugaagaaggguuucagugcuaacuaguauggguucacuuuggauuugggacuuuuggguguugaaggauucggggguugcccgagaucagagacccaagguuucugagagcaugcgugauuuguucuuaacuguugggcguggagguagggagaaugaugaaagcguuagaacuuuuacuuuaugaguuaagcuuuucaauugucuggcuccguucgccucgcuugggugcauucaaauauuuugaccucgaagcaaguacuagaucuuguuuuucuaggacuaaacuugaacaaaguaauggaacccuaauggaguucacagccuaguugaguuuauaaucgcuuguaauuuuuauacuuucguuugagacagguucuugauguuggccucaaacuccaacaaauaaucauaucucagccucccgaaugaugggauuacaggugugaaccacuaaacccagaugauuucuuuuucauauuuuauacgauaagauaauugcacgaauauuuaaguacucugaaaguguaugacaagaaaucuaacacugaaaugaggcuuggagaaugagugauuuuugucagagggucuaaaauauuuggggagauacaaaaaaggcaguguguugaagcaguaggggaagaagacauugacggaucuuuuaggccaagccuaccauuugaaaggcagugucaucauagcagaaagaaccagaggacacauauguucuggacucagaacccuccuugaccuuauuccuuguaucaucaagcuguuauucuguaucuuuuguaacagccuuuggaauggauaaacuguugccuugaauucugugagccacuccaguaaauuagcaaacccagccagaccugucaaguccacaggucccaaaccugcauccaaagcuggaguaggcuaggagacugcucuuuauuugugggaucuaguguuauaacuccagguaguguuagaacugacuugaacacccagcugcugcuuaguauggaaaaaacuuaagcguucagcuacagagguugaauguaaacaauuuguuaguaaaauuaaagugucuuuccugguuguuaaggaugcuggaaaacacuguaccaccuaaauguucuguaucugcaacccuuuccuaaguugucuuuaagugauauguuguuguuguugcugcugcugcuacugcuguuguuuuucugccccauccagagucccacaauagauuuuugcauaaaccuggguguauacagugguggaccacuuacuugccugaggcucugaauuucaacugugucacugagggugaaaagaagcuccuauguggugcgugccuguagcuccagcuacaccuaguguaggucucuagcaguuaccccuguccagagacugagauuuugucaguugaguucaggaauuggagacaagaucaggacacacauuaccaucucagacaacuggaguguaccugggugcuagggaaagccuaaagucccuauucuuuaaaaaaaaaaaaaagaggcaggaagaucuugaguucaagggcugcccaagcugcugaauaaauuuaagggcagccugggugauguaagacccugucucaaaugaauuaauuuuuuaaaauggaguggggauggcggugcaaggauugguuguaguguucaacaccuuuaauuccagcacuuuggaggcagaagcaggcaggucucugaguucaauaccagucugcuuuagagauccuaggacagagggcuacacagagaaacucuugugugggugugugugggggggggugguggugacugacagaugguucagcagcuaagaguauuugcagugguugcuccuccaaaagaauguggguuugcucccagcagccaaaugaugguuuuauuccaguuccagugcacacgugguucacauacauacaugcaggcaaaucaacacauaaagaauuaaaucuuuagguuugaaaaacaaugaaaaggcugggacccuaguugagugugugcuaauuguguguagggccauuccucaacacccaguaaaauuauuaguaucuaguuuuacaucagugccuaaggacuggcuagucuauuuuuuuuuuuaaagauuuauuuauuuauuauauguaaguacacuguagcugucuucagacacuccagaagaggacaucagauuuuugauacggaugguugugagccaccaugugguugcugagauuugaacucgggaccuuuggaagagcagucggugcucuuaaccgcugagccaucucaccagcccuguuuguuuuuuucaagacauuuuuuuuuaauauuuauuuauuauauguaaguacacuguagcugucuucagacacuccagaagagggagucagaucucauuacagaugguugugagccaccaugugguugcugggauuugaacucuggaccuucagaagagcagucuggugcucuuauccacugagucaucucaccagcccugguuaguuuauuuugcauggaccuuuucuuuaacuuacaaaccacugccauuguuucuaaucuccaucuucugagucaugcuuuaagaguuuacuuuaggacucaugcuguccugugcccugaucaaagggauuccuuuuuuauuguuuucaagacagggucuaacugcaguccaggcuccaaacuuugggagucccucaccuccuugaugcuggaauugcaggugugaaccacaugcuugauggaagucuuaauauugauuauagaugaaaauguaucgauguuaaguuuucugauuuugauaauuauggggaucaugaaaaaugcaugcugaaauacuuuuaggguuaaaaaagcaugagugugaaaugugcaagguaaauaaaauguuaauucaaucuguau

SEQ ID NO: 8867 - RNA, 17772 nt, Mus musculus
agggcucacaguuaccucuaacuacagcuucaggagauaagcacauagacauaggccaaaaaacaaaacacccaaaaacugucccgagucacugaaaucagacauuagaacuuacuaaugaaacuauauucuuuaaaccaacucugcuugaaauuuguucaagguaaaaagcacugaaguuuuucuagauagaagauuacaacgacuggauuuguuuaugccaguacuuuuauuaagacagagucuaacuguacagcccugccuggcuucaaacugcuuccugaguggacuuucacauccagcauauaugccagcauuuuauuagucacuccccauguuucauuuguucaaccuuuuagccagugauuuuucucccuacaaaacugauagcagucauaauccuugagcuaucaccauucacaaaggagaucaagaggcuuucagaauuuuauuuaaaaaauccagaguggaugaaaaaggaacaaucaucaagaauacagaugccagacauuggccaaccaagaggguggcuagagaaguaugccucaggcccaugagaggcuuauaucauucucauaucauacuuuaagcuauggcuaacacaacugcuauccacugaccuagcuucugcaccuacagaccaugguacagguagcucagucuuaaaggcaucaguuguaggagcaaauauacagaggucauucuuuauaguagugcucuuggccaacaagcaucugcauaugaucucaacucaaggucaaugacagacuaccuccacugcaugugaaaugggcuucccaccuugaaaucacagccauuucagcacaaaccaaaucuaccuuaaugauugguucacagccccaucccaccccuuuacaugcagcugaaaauaacaggcuagugacagaacaguaugaaccugcuauugcugacuuuauuacccauuaaaugaguuagcaauugucacuaaguuuauauauuaaggaaauuauauauagaauacugcaaaaauacaguaaaaagacugaagucugccccuuuucugcucaggaagucccuuuagucccaagcuucauaguauguccuucuggcuccacaaugcacugccacgauuacuguuucucuuccuucugaucuuccuucuguuccccagugccagaacuuccagaaccuucccguucagaugccaucuguugagaaaauacuugaggaucacuaagauuucacagguauccacaaguucgcucucuguucaacaggcuucauucaccguacaaaccucaucuuccccgugacauucuauuuacaguuuucucaauucuauaaaugguagagggaaccccaauaacuaggucccaguuaccccuccagcccuuguaccuuuuuguacgccauuucgaagaguuucaaugacgccugcuguagggaagaugcugccugccugauguucucuccugucucacuguccuuuccagcaaggagcgcucucauuuuggaaaucucuuccuuuagcuuguugcacuggaaacggcaaaacacacagauacacagacacaucuuuuuaaucuagguaucuugucucauuacauuuagauuuacuauuacaucuacuauuuagauuucuaaaugguuuuugccucuccaccuccaacccuuauucauauguuuaagaaacugaaucacuaccaacccaagaaaaaugagcuucaaagaaccagugaauuguuaccucaucagcaggcaacugguccuuaaauucuuccaucuugguuucugugucaugaauaauuccuucagccauauuaacugcuucaacacguuccuuagaaaaguuaaucaaccaaaguuucauuaacuucaguaacaauugagaaguuacuugccacacaguuucuuagcugaaguacuuggcaugucugagaguugagccggcuuuugugacauggaaauuuugauaguggaagacgaaagagaucaucccaaacccaguaugugcccuggaucccagguacuagggagguugucucaaacacccugacuacauaguguaaucucacauuaaacaaagccauuaggagaugagaggugagagagacuggguaucuguaaccaaacucuacugucagcaaaaguaaucaccuucuuccugcggucuuccucagcguacuucucugcauuuuuaaccauauuuucaauaucaucuuugcuuaauccaccagaagacuggauuacaacuguaguuaaaaaaaaaaaaaggcagcucuuuaguucucuuacugcacugagaaauuacuucacuagguaugaagguacacaccuuugauuacagcauugagaaagcaggcagaucagaguucaaggccagccauagcuacagaccaccacuauuuauauaguaauuaaucugaaugauucagauuauaaauacucauagccuuguaaguaaauuguauaaaaaguuugagagggugggguggggcuggagagauggcucagugguuaagagcacugacugauccucuggacaucaugaguucaauucccagcaaccacaugguggcucacaaccaucuguaauggaguuugaugcccucuucugcugugucugaagucagcuacaguguacucauauacauaaaguaaauaaauaauucuuuaaaaaaaagguucacgugaucuucuucuaagcaauccauacuuaacaauccacgaagucaggcuugccuguuuaccccccucuuaauguuauacauauaaaaauucagacaucuaucccaccauuuggaaggaagaagcaaucagaucucagaguuuaaggccagccuugccuauccagcaacuuuuaagggcauccagggaaacaaagcgagacccugucucaaaacaauauucaccccucccaaaaaguuuaagagaggcagcaauccuuagggaaaaaaaaagauggggggggggggggaacuggacagaucauuuacagucugauuacuuacucuguugcucacgaccagugccuuuaucuuuggcagaaacgugcacaaucccauuggcaucaaugucaaauguaacuucaaucuggggcacuccacgaggggcugggggaauuccaaucuaaaauaaauauccagagugagcuccuuugaaaggcccauguauucucauuuccaaacaggccaacuaaccacuuguuuccuaaaacaaguaucuucacugaauguucaaaaccuugagauuuuaagugauggugguaguuuuagugcuuucugaaaucacugggcuucaagaaguuaauaaccaugaugguuauaugugcccagaauuuacagcaaauaaacuucucuacuguagcaaugcugaccagaaccaguagcuauuaaguuuuuuaaaaugaguaaucaggauaaaacuaacuucugaguuagcauugcuucugagucugaacauuucccaggcuuugaaaauuucaaauucugaaaacacaaagcacuuuuagguaaaaacuaaaaucauggguuucauaacucauguacauaacguucuuuuuaaaaaauaacacaauaugccuguaugucagcaguuuggagcuuugcaagcuauagaccccaaaagcaugauacucagacucaaaacacuuaccaaagugaacuguccuagaaguuuguugucuccagccaucucucguucccccugacacacuuuaaucucuacuugaguuuguccaucagcagcaguagaaaacaccuagggaaaaagaaaacuugauaaucugauuuaacuacaccuauuauagagaaaaggcuaacaagagaaauuuauucagacacuggguaauuccuaauguuuaugacucuuagaacaaaggacaggaacaggauuaauuuaaaaagacacacaauagcuguugcuucagcuaauuaagcaagcuauacaaggugaggcuuuaagccuuaacguuuaaggcaucaaaacaagaccuuaaauacugguuugcuaguccagggaaggaggauuagagacagacaauguaccaugugcucaguaauaacaagucaccacaaacuuuccuucagaaugaugugacaaauacaucauugcucaaacaccagaacuagagugcucaagaaaaacugacaacuaaauuaguauagaaauaaaauauuggagacguguccacacuacaugguccaaggcaguucucaaacucugaauuuucaugucucaacauccccaaguguuggaauaaucuaccagccacaagaaguaauucuucaucugagaccaugccagacccauaugucccuacuuggugguguacaacacagcccaucauucgcccagaaaucaaaccuacucccaugucccuccccaggcuuuucuugcuuuugauaacagaagacuacaaggacuaugguaauauaugguaauaaaugacaacagccuuuuaaggaaauugcaucaucuuucaccacugcuaguugaggucuaacuuuucuaggaacugcaaaaaaagggggaggaaaaaaacaaaauacauagucucaacacccaguccaguuaguauagucuuagaaacaaaguuuuaaagaguucauaaagugauuguaaacagcacuuguacaacuugggacuguuaauaggcaggaaaaaagaauggcucuuaccuggcucuuuuugguuggaauagugguguuccuauuaauaaguuugguaaagacgccucccagagucucaauacccagagagaggggagugacauccaggagcagcacgucuguaacgucaccagccaacacaccucccuggauggcagcuccgauggcuacagccucaucaggauuaacagcuuuacucggggcucugccaaaaagaucuuguacagucugcugaaccuaagcaucagggagaaagaaccuguuagccaacacccagggcgacugauggagccaaacagaauacgccugccagacagcaagucagagagauucauauccaagacugcagacuuguuuguauuugacaacuucagagcaucucauccacuguccacuuaaaugagagaagaauuuaauuaucuagcuucccagaggauaucauuugaaauagaaggcacaugacaagggguuauaaaauacaguucucauauucuacacaaucgcccaaucuuaggaagaaguauuaucaauuuuacaucugaaaugagggauaguuucugagccuauguauuagagguaacaaaagugcacagcaucuuaggagaauuuguuaauaucaauaacagaauaaaccagaauccuagggucuuauuuugggcucauuuuccaacaucuaugcauuucaaagagagaaaaagaacaaaccacuaccuaaauaaaugcaucauuaacuugguguaagauaauucuaucuagcuaccaaaacccaacugcaccuucaacaagucugugcucaguuaucauuucucuacacaucuauuuucagaaugauguguugaauaaaaugcaucaucgcacaaguauuuguugaagaaauucaaguagcccccaccccccaccaaguacuacuggaaaagguguccaaaacaucccccagggacuggcuacuaucaagcuuaacaacuucucuuuaccagacuggguuuaagugugugugcaagguagaauucuguagcugcaucuuacccagaacucaaggccauccuccuacaugagccaucacaggcgacuaaaagcacuuuuuggugagucuggucucaccacucuuuaaagaacacuagaagaauggaucacauuuguuuccacacacaacacaagccauuugccucaagaaugcauuguuauuuuuuuccucuaggagaaauaccaugaguccauaccuugggcauccuugucaugccaccaaccagaaucacuucuccuaugucacucuugcugacuucugcauccugcauagcuuucugacacggagcaauaguucucuugauuagaucugugacaaugccuucaaacugagcucgagucagcuucauauucaaaugcuuugguccagaagcauccaugguaagguauggcaaguugaugucagucugcacaggaaccacacgucaguagggagaacgguugguacuuugauacuccacucaaaguuaaccauaaccacggacuugaaaagcacaugcaaucaaggauauuuagacucgaugugguaaauauauuugugugaaaaucuuaauaaaauuuauuauguauaauuaguauauacugaagaguauauauagcacauaucuaaucucagcacucagucuguuucauagcaaauaaauacauguuacuagacaacuagaaacacaguuaaaaaaauuaggcuaacaaaauucaaagaauuugcuaugaacauugugugagaaguacacauccagauccccccucucccaaacugcuuugcauuucuaucaaaggcuaauaggauauacaaccugagaaaagcuaguucuuaagcacuuugcuacaggaaaagcuaccuuacacaguuaaauacuucauaguaaauacacugucuauauaaauaagggcgauauacauugcuugaaagaauaaugacaauuucucugaaaacuucaaugacaaaucagaaaauaacuucaaugcugucuggccguuuugucaacagaaacugucguucaauuuggcgaucacuagccauauguaacuacugaggacuuucuaggauuaacagcugucuguguuugugugugucuaaaacagggucuauguugcucuggggguccuggaacuacauauagcaggaugaccucagacuuuaagagauucaccugccucugucucccaaguggaacuacacucggcaugggacuacuuuuaagacaaagucauucuaugacaaaguuugccuuccuuccucacuuuuaaacucuaucaccuaacucucauuaauccacagcuccuuaagaaacauuuuccauucuauuacacuuuuucacauguuuugaccauguuuaauaauucuucuggggucuguacuuaaugacccacaucugugucuagguuuagcaucuccuccaucugcacucagcuuuuccaaccccaggucuuuuaccccugagccuuauacaaucugccacauugaauuuuuuccaaaacucucuuaaaaaguguguuaccuaaacguauauagauguguacugcauaaguacaggugucuaaagaagcaagaaggugucaguuuuccugaacugguguuacaagcaggugcugggaaccaaaaggggguggggaggugggggauagcaacuacucuccacaaauuaucucuucccuaccaccucaaacuguccuguccuuaacaugcuguaugcccucaucagauguuuuuucagcuucaaaccucucucucacacaccaagggucucacuagucaggugaggcugaccuuauuaaacucuuaucuuccugugaccagcacacccugcuguuagguuccuuuaaaacugcuucagccuucagaguacuaggauuacagauauaagucaccuuuaaguuauauuuaaugcauaguccuuacuauuuacuaguuuccuuaggaagguaaaccucaaguguaagagaaaauuaccauucauuagcuucaguuguagguuaagaagaaaaaguggaacgauucauccaaauucacagagcuaagaaccuuaggagugggcuggagacaucagugguuaagaacacuugcuacuucaagccagggauguuugugcaaaccuuuaaucccaguacuugggagacagaagcaggugggucugaguuugaggucagccuggucuagugucccagggcuauacagaaaaucccagucucaaaaaccuaacccgagggggcuggagagauggcucagcagugaagcgcacugacugcucuuccagagguccugaguucaaaucccagcaaccacauggaggcucacaacuaucuguaaugagaucugaugccucuucugugguaucugaagacagcuacagugugcuuuacauauaauaauaaaucaaucuuuaaaaaacaaaagcaaaaaccaaacccaagggcuagaaagauggcucagugguuaagaguacugacuacuauuccaaagguauugaguucaauucccagcaaccacaugguggcucacaaccaucuaugaugggauccaaugcccucuucugaugaagagagugaguguacucauguaaauaaauacauaaaucuuaaaaaaaaaaaaauuaaaaaaaaacccuaacccaaacgaaacaacaaaacaaaauuaaaaaaaaaaagaaaagugaauuacuaauguuacuaaugucauucccccagaagcaugacuguuauuuggcucuaguguaucuguaucaucuuuuagcucaggaauggacagauggcucaguaguuaagagcucaccaagaagacucagguucaauccccaacacugacaugucaguucugauacccucuucuggccgccacagaaaccaagcacaaauguaguacagacacacaugcaggcaaaagauacacacauccauaaaucuacuucauucauucaaaugaaaagaacugaucaucaaguuguuccuuugcucaugccccaaguuuucagccaacagaaaacuguaaagagcuacacugacauuagguaaauuagaauacacuauucaaauaugcucaguacugggauuuuuccaucccucaccugcacagaugaggaaaguucacauuuagccuucucagcagcuucccgaacccucugaagcgccauguugucuuuggucaaaucaaccccugucuauaaaauaggauuagugagacaauuaauauagaacugcaguagugauguagaacauguuuuguuugcuuauuaaggggccaauccuuuauaaagaaauacaaauuaucaccuuuaaagauauguagaaaauaaccaaauaauaauuuaucggacccaugucaguagacugaacucccaucaacucugccaagcucaagguuuuguuuuucagaguuccuaaaauuccuucuccaauacuauaaccacugucacuuggucuuuuguucccaaucuaagauuauauaacuaaacugguuuaguuuacccaugaaucugaaguauaguuaguuaccuuaguauaaaaaagcuauuaacaaagcuaaaagcaaugcaaacaaacaaaaauucucaacaacccaacgccuacaccuuaaccaguggugacuaagcagugguaacuaaccaguggugacuaaccucucucuugaacuccuugacaaugugccgcaacaaagcuuggucaaagucuuccccuccuaagaaaguguccccauugguagauuucaccucaaacacuccuuucugaauuuccaggauagaaaugucaaagguuccaccaccuaaaucauacacagcaaugcuaaaaaauaaauaaguaaguuaaguuccaaggaacaaaacaaaggaacgaauuaaaagaccaaaaguuuaauuauuaacuaugauauuuccugaaauacuuaauaacugaauguaguuaucaaccuaaguggcaugccuguuaacguaucauauaagcaugucauacagaaacaaguaaaauuaguaacacaccaacuaugauuuccaaaguauuugucaacauauaaaaaaaacuaucaaggucuaaaaugaacaguaaaauggucaugaauuagugaucauacaaacagauuugcagagaauaaaguacuuuuuuuuuuugucuaagcacaauacuuucacccucugaaacaguaaugcucuaggaaaaauguuauagcugucauaauuuaguucacaguucagguuacauuuacagcacaagucagguggugguaguguacaccuuuaucccaggggagagggaggcaggcaaaucucugaguuugggaauagccuggcuuacaaagggagcuccaggauagcuagagcuacauaaagaaacuguauccagcuaggcagugguggcgcacgccuuuaaucccagcaaaggcaaaggcaggcggauuuuuugaauucaaggccagccuggucuacagagugaguucaaagacagccaggacuacagagaaacccugucucgaaaaaccaaaaaccaaccaaccaaccaaaaaaacaaaagaaccacccugucuucaaaacaaaacaaauaacaagcacaagggccaucaaaauagauuuugguucuaagccugaucaaucucagaaaauuacauggaaggagaaaauugaauccucuaaauuguuccgaccuccacaugagcacugugcugugaacgugacccaccacacacacaauacauuuuaagugugugugggcuccaggagagucugacaucucugugucaggauuaacaugcauauaccuauauacaaacaaaucaauaauugaaaauaagugucauuucuuaacaaaagagcagaaccauugaagaugaaggcacuugccaccacaucugaaaaccugacccaaaaucuaccuuaggaaagucaaaaaccaguucacacauuuaaucuuuugaccuccauauccaugccaugguacaaauguaccacaacacacggacccacacaaauuguaguaaaauuacacacacacacacacacacacaaccccuguaaaucagguaauauguacuguaccaacuuacacuuuaucuucagauuuguccagaccguaagcuagagcagcagcuguaggcucauugaucacucgaagcacauuuagcccagauaucuggccagcauccuuaguggccuagagaaaguagaaauaaaucuaucuuuccauccuuuaacucagguaccccaccuccacucccagcaaacaagagaucuaauuuuaccugucgcugugaaucauugaaauaagcagggacugugaucacagcauuuuuugcuguguggcccaaguaauuuucugggaaacaaagaauaaaauucaauugugguaccauguuaggaaaauaaaaaaaaggcaacaaaacuguagccuaauauuccacaucucauccucuugaggggcaacagacuccuuuguggcuuaauauguagagaggccuuggaaaagagcaccccaagaaagacacuagagugaguacuguaucuaucaccuugcaacuuagcacccaggaggcagcaggaggaacaugaauucaaagcugcccggguuacaaaggaagaccugcaggcacaguagcucaugcguauacucuuggcacuuagaaagcugagggucaaagaucacuacaagucugagacaagucuugacuacaaaaugccaagucagccuaggcuacaguaugaaauuuggucugaaaaacaaaucacccuaacuauguuaguacuuaggugguuacaacuauaggaucggaagcucaagccagccuguguugcugagccccccuccucaaaaauguuuuaaaggucugggaagugcuuuugugcaacagcagagauguuaguggaaauuccaaaucaccuuuagcauuucagucaagacuuaaucaauauccagugaccuuuagacuuaaauuuaacuuguagcuuucugauuuuuaaacacaaaauacuacagugcacccuacaaccagcccagcacgaaaguuaaacccaaucugcagguucuacccuuccuaaauuuucuaugcaaaaagcuucagacuccauuaucuacagaauaugaaguuaaucaguauuaaugcagagaaauaaacagcacauccaauuuuccuaaaugugaaauaaauccacuuaccugcagucucuuucaucuucaucaacacaaaugcuccaaucugacuuggagaauagaguuuuccaugagccucaacccaagcaucaccauuggaggcacggacaauuuuaaaaggaacauucuuacuuaaagacagaaagaauuauguaaguaaacuaucccugugaaacuuaccacucuaaguucaucauauaucacauguauuuuaaauuguaaaagaccagauagucucuaagaaaauguccauacaauauuacuuggucacaaaaauaaguacagaugcaaggaagaaguugaacacugacuuagaguaacuugaaguuaaccaggucuacuucauccccagagcuuaaaaaaaagcagguuccugggcuggagagauggcucagcaguuaagagcacugacuguucuuccagaggucccgaguucaaaucccaacaaccacaugguggcucacaaccaucuguaauggaaucugaugcccucuucuggugugucugauacagcuacagagugcauauauaauuaaaguaaauaauucuuuuuuuuuuaaagcaguuuucuaagaaaacacacauaauaguaagcuugagguguuuuucuaaauuuuacucauuuuauguauauugguguuuacucugcaugucuauguacuggccaggaggugucagauucgcaggaacuacaguuaccaauaguuugugaaccaccauauagguguuaggaaucaaacccagauccucuggaagaagucagcacccuuaagugcugagcagucuccagucugcuuuuauuucuuuuucuuucccuuuuggauuucuuucuuuuucaagacaggauguccuuguguagcccuggcugucuugaaacucagaaaucuaccugccucucugccuccugagugaugggcucaaaagcauguaacaccacugcuaccuggcccauauuuuucacuuuuaaucucaacuuuaaaaaaaaaaaaaaaaaguggggcuggagaggggcucagcaguuaagagcacugacugcucuuccagagguccugaguucaauucccagcaaccacaugguggcucacaaccaucuguaauaggaacugaugcccucuucuggugugucugaagacagcuaugguauacucauauacauaaaauaaguauuaaaaaaaaagugcaaaacaggaccaagaagauagcuuagcaagcaaaggcucuuacuaacaagucuaauaaccugaccuucaacagacaggaccuacaugguagaagaaaauggacuugugcaagguauaacucuggccuccugucacaugacagaggaugaccauacccacaaacacaacaaaaauguaauaaaauaaauaaauaaaagccaggcaguggcgguccaugccuuuauuagucugagcaccagggaggcagaaguaaggagaucugaguucaaggcaagccuggucuacagaaugcguucuacgacagccagggcuauuaucuagaagaaaaaaagggggaggaggguggauacacauacacacacaacuuaacaugauacgaccuauuccacuacaugacugcugaugacuuacauaauuuaggaaugucucacaaacuuagagcaacuucucccccacccccacgacaggguuucucuguguaguccuggcuguccuggaacucacucuguagaccaggcuggccucgaacucagaaauccgccugccucugccucccgagugcugggauuaaaggagcgugccaccacugacaacuuaaagcaucuuaauacaugaccuguuauuaucauguguuacugucauauaaaucaaaguaagcucuaaucugggaaggcaaaaaugggcuuuuuagaauuguacucuugggccgggugaugcuggcacauaccuuuaacccuagcaccugggagacagaggcaggugaaucucagugagcuugaggccagccuggucuacagaaugaguuccaggaaaauacacaaagaaacccccccccaaacaaacaaacaaauaaauaggaaaacaacaacaacaaagaaauaacaaaaaaaaaaccuauaugccucugaugguggugugauuucuucccaagagaaauaaugaaaaagugaucaagguauccacagaacucaagguauccacagaacuuugaucaaagcaccagucuucuggacugauuuuccuauuacucacgugucuuucuguacuucagggucaucauaucgucguccaauaagacgcuuaguagcauagaagguauuguuuggauuggugacagcuugccguuuugcuggcauaccaacaagucguucuccaucugcuguaaaggcaaccacagaagggguaguucuggcaccuucagcauucuccaggaccuaaaauucccaaagacacugauuaaaguacuaaucaccacuggaaucucuauaaccaugacuuaagauacaaccauggcuugaaucauauuaaaaaaaaaaaaaaacuaaauggaugaugcacuaaauuggcauguuuuacugcugugaauccuacaugauaaauauuucaaauauguccacaagccuauggccauaccacuuuuauuaagccuauucuuguuaaguauacagaagcuaaaauuuuagacaaagagaacaaaauagacugagcagcauaaaucaggauuaaguaagggcuuaucuuaguaucaaacaggugggguuccagccuguagccagcccagguauugguaaagcagcaaggguaaaacagacaacuguagagucccaggagcucuaagucuugacaacucaaacaggaaaagcuuguguauugugcugaagaggcuucaacaaccucuacagaacacaaaagugggaguucuccuuguuucuagcaaguagaagcuucuagucuugcuggacuccuaacagagcaggccauuucaaguccucuaaugacauguuuaaauaguacucuuguaaucuaaacccacucaauuaugaacacccaaagguuaauucccaagucuuaaaaaagcaaaagcagccuuuaaaugcaaauuagaagucuggagcggucaaugccuguaaucuuagcacagaauacugcaccguugaggcuggcccaggauacagucacucgaagaaaaaccagcaccaaacuaaauucaccacuguugguuuuugagacaggguuuuucucugaguugcccuggcuguccuggaacucacuuuguacucuaggcugguccugaacucagagaucccucugccuuuacuaggauuaaaggugcccaccacuaaccugggcuccgacucagcauuccuauguacuuaaugccagacuggguaucuaagugaccucagguuuccaaucaugcucaccuuugcuuguuugcccuccauaacagccacacaggaguuaguaguacccaaaucaauaccaaccacugcacccuugauugcuucugaucuguaagaaaugaaauuccauggucaucugaacaguggucuccaauacgaagaacuguguuuuauguugguguuaccaguggcauauugaauaaacuacaaguacaaauguauaacgcacccaacccauccaagcuuugagguucaauaaguguuuuuuuuuuuuuucucagagaaacugagguuguacuuacgcauaaucucuucuugaaacaaaucuaaaagccucauggcuaaggccauuccagccauccuggggggaaaaaaguugcaucagccaucaacuacacaaagaaacuugggcuuuuuccaauuauucugagaaacacaugcaagcuuuaguccuuaguauguaaaauacauagguugagcuauacaucacacaucuacaaguuuuccagacuugucugguaaaauuaaacauacauaaaauugucuugaauugcucccccuccccagagauaaaaaaauuacauugccaauagauuuccaacuuugacauuauugaucuuguaccaauauuugcugugacaaaccgagaaaugugaugcuuagaagcaacucugaccuuuaccaacaagaaacccauaaauuaagugucccucaaagucaggacaaccuggaagcuggcagauuugccuugcuugcacacaaaaccccauguguguagggugugugugugugugucugggaaccacuuccucugaagaucuguuuaagcucacacgaaaaaaauugaaaacucaguugacgggccuaauggcaaaugccuuuaauccuaauauuuccaggccagaggcaggccuggucuaguaaguuccagaacagcuaaggcuguugagacccuaucucaaaauaaaacucacaacccuguacaccuggccucaauuaagguacucauuuccacuggccugaucaaacaaccagauaauuauuuuuauguauuuuauuauuuuuaugaauuauuauguacuuuagaaaauuacaggucucauucuccaaagagguccuuuucucuuauuucaagauccacaaucuuuuuucuauuuguuauuauaagccacaaguaaaucgaguaagaaggggaaaaaaaaaugucacuaacauuggagccgggugugcucgccuucaaucucagccgccgugcgacagagacaggcaggcgggauuggggguuugggggaggucucugugaaguccaaagucaauucccgggcaaccaggucuacaaagagaccuugucucaaaaauaauaaagcaaaacguccaagaauggaguuggaauuuaauuuucgguuccuaauguacauacccucccccguuucuucauagcagcgacauucaugaauauuuacaguacagaaccuguccaucgacucuccgugcuuaguucugccuuuccaguaaacuacguccacugccuaaguccaggcacauucaaagcgccacagguuagaggggggacccagacguccucaauuagcgggguaaagacuuaggaacgccaaggauugugacucagcacaguucgaagcuaaagcccugcaagaaggccaacaaugcccacagaagguccguuacaucccuucgcuccggauuuuuccuagagucugaccccgaagggcaaggccugccucacucgaguccgggccuggagcccccaccggaaggcauggcagcuucucaccuggggacgggcggcugcggggcuccgggacgcagcggugcccacgagacgcgcggccgcggcucugcuggcgcuuaucaugguggcuggacagaggggguuacgagggcaagaaccaacaccccacgggcccggagcugcgugcacggugguggcuacgcuucuggaaaccuccaaccacguggggugggggcgggggcuggccgcugcagcaaugaagcccgcucuucugcugaggcgcccgacgugcugccugacuagagacuacguguccgcugcucccgggaucggcgcacgccgccagcacgccucucagcauuaaucguugaaaguucccguucucucaucacgguuuccagggcugugggagcagggagaagggaaagagagaagagagguggacaggcaucgcuucggacagucccgguccuuaggacgggaaagacucaaggucacacgggauaaauuacgaacagauuacagucuccuugcgucaguugcgcagaaggaggugcguucugcgccugcguucuccgcuccggacagaggucgugaagcgcaugugugaggggcguggagaaaacggguucggguuuaacuguagcguuuauuggaugcuccagugcacgcgaauuugcgggcgagugccgggggcgcgagcucgcgcgcucacuggcaggcgcgugggcguuguccccggaggccgcgacuugcugcggucgccaucuuguccugaggcguuguuucggggaccuuuguucuccaucgcuguuuguucgccgcuugaaaugugcacaccugaaugu
